United States Patent 7,868,149 (PLANT GENOME SEQUENCE AND USES THEREOF) - sequence listing, part 38

SEQ ID NO: 19835 - DNA, 4229 bp, Oryza sativa
tttggtggggaaaaggggaagaaagaggattaaaaaaaagggagaggctgacatatgggtctcggtgtcatagagtcaaaatagagagggtagatgaagatactgttggagtgaacaattagtttgactaggtaaatcggatgaagagttggctatataagtgtttgaagagtttgatctgaaaagactgttggagatgctcttaggctacacaaccggagagcgcgggacaaaagctacaagaacacaggctcgatcggcaatttgccgaaccggccggcaactcggcaaccatacggccagagtggaatccagtcacggagaactgttcgatctaacgtgaaacgagctgggccagcccttgaccgcagcctccctggcccgtgaccgcgcacgcgcgcgtgctcaccacaccacccgtcacccgccccgcactcgcccgtacgtgaaatttttcgcttgccaaagcgctatcgcgccaccggactcgccacgctacgcagcacgtacgcgcggtagcagagcagcagcatccgccgcccgcgtcgccgcgttgctcgtgtcgcgcttggggggcagcatgtgccgcggcctagagattcacgcttggcgtttgcggtttccgctcgtttcttgggcccgtgccgttctcgtcgtgcagctacggccacattgtttaaccggcgcggctgcttcagggagacagagaaaaaattgccccggcaaattgtggcctgtgagtgcgtgcgcctgcttccacgttctcgccatcctgttccccggaaatgacccaatcatttgcggcgcgcatcgggcatactgtactaatgccaatcttcaatacaagacttgcttggatgcagtacaaatacaaggcggccaaattggccttctattagtaattattgtagtataccgacagttccgttttggtataaacctagcacgtccaaggtgtaaaacgttagagccagctagtaaaactggccactggaagagacagagccagccaagcagaaggaagagcaaggaaaagatactactgtactacatgggggacactcgaattactaccaagatacgagccacagtttggcgtcatgtactcatttgtctgctagcttcgcttggccggagtggtccactgatttgcagcgtgtgcatgcaaggctgcggcgctgcgccatgaaaagtgctttcctctccccgcaagctggtccctaacctggacggattatctaccccgccatcgaaatagagaaggctaatcccgattgagttatatctatccccttcgtaagcaaacaaatcgaagataccctccactttgcaaagcatccccgtttccctgcgaggtgtctcctttgcacccattcacacacacgtatatatggactaatcatagtactatccctcccttatttattccaagggggacattgcagtagttggcaccttggcatcctcccggagcaaacatagaaccgtgcagttgtttttacctttgctagatgctatcactaccactctactaccgctcgatcagttaatagttcattcggttattactataccatctctacaggctacagcgttgttccaaactctttaataaggcggcagcagcagaagcaaacagtatggcgaggcgatcgccgttaactttggtccgcactacgctgcatatcactactgaaacgaaggcaacatatggatgcacgcatatgatccgcaacccggcgtcgctcctgcgaacttgcaggcttgcagcggcgcagatagcctgaccagctaagccagagacgcatctgccgccggccgtcgccgcgccgcccgcgcgccggcgagaggcgatcgactcacgctgacgatcactgcccttttggcgggtaccgcactatggaactgagcgggtgggccccacctgccgcaggccccaagggcatagtaggagtctcgtgatgccaaaatttcccgggcgcatcgcggccgtcggtgcgttctcctctgaccgatccggcggtcgcccttaattgcctccccggtgccagcgtttcgtgctcctaggattctttgaccgccacgatgaaacttttttttaataaaaaagagatttgaaaaagaaaagaaaaacaaagtgtgatccccacccaccgccacatcttgagaaattccggttttaatcttgttttgctccgctaatcccgtttccacatgctaattcctctcctccgtgcaaatgtctaatgacgtagagtagctgcttaggctgtatactttggatctgacgacatgtgggacgatcaagcagcagtttgaattactgccaagtttttcatcaagttggttttttcagtttctttgatctcgctcacatgctctacgcagaaagaccatgttttacctcggttattctatccaactccctgcatctgaatctggctgtgagcagtacatgtcgacgggttgactagaattttctatccacctcgagtttactgggagcataaaaatatggagatgcagtcgacttattgcttcgataaaaatatcgagtagtttatgcataatgccttgttatcttcaaacaagcttatcaatcatgttataatttgaaatgtgagtctgtgagttggaatataaagaccgaatatatgacgttatacagttatacaccaatttttgtcgccatgttccattttttttccaagctcaaatgatgtccaatagctcattgataaggttcggaattttcttcttgattgttatatagtacaagggcatcagtaggagtatttagtattttggcgggagagctagcatatcaatttagaacagcattaaccgaaactgtttctgtctcaggccgatgcacatgaataaaaatcctttgccgcactctcgaagctgttgcccacgcctgcgggtcccaccttctctgcgctcccaaggcgtggtccccagttcctgccaaggggtagcgggtaacttttcggtgggtgcggtctcagactggggctcttgtgttttttacctccagtaaataacatttctatttttttttgagaaaattgcatcctgggccacttttattgaccattgttacatgttggactagaggtagaacattcttttcagtttgaaccagaaatctttgcaaaaattttcatattgaactagtcttgttcttcctctagatctccccctcttctcttctcttccctcttttggttcaagctcaccacactttctcaggttccatctacgtgcttgacctacgtcagcgcctgagcttgagtgtgtggtagtctccgtcttaagctcaacacggcacacggcagagctccagcttaagctcaagcacatagccaatgaatcacggtggcacggtgggaaattctaacaccatatattatcactccacacttatactccaccaactagtcaataggtcacattctagcccaagtttatccatggcagcactagcttaattggagctagggcacttaatcaaggttgcatattaaatcttgagcacgaatgaatgtggcaggggcagcgaaggctgactggctgagtagagctcgagcatgactgtactggtgaagcttgagctctatctctactaaaaccaactagccaggtatgtgaatctcaaactgaaggtagagagagtgagaaagcagagctggaagaagaacactaggtcctaagtgtaacatattgtaaaaattactagcctaaagtgaaaataatagcttgttcctagtccaagctgcgaacatagtaaagaaagccagtccaatatgcaattaactattttttttttcaacccaagtccagtagtagtatactgcaatcgaaaggggagaaaagtaaaatcgatcgcaaaacccgtgtcacggtgtcatgtacattcacggaatacgctggcgtgtagtcgtacacgtaccattaccatacatggctgctagaccctacacacgtactgtacgtccagcggttgtactgtacgttgcgctcgtctcactcgcgcgtaacgtatacgatcaggagttctgacatgcgagccccaccgtccagtggcagccacaaatacaaaaaccttcgcagccctcccgtgcggcgtacggtcaccgaaaatcaccggactgaaaactgcatcggacccctgcttagccgtgcggcccgtgcggcgtcaatggcgtggcgcacggcgtaaccta

SEQ ID NO: 19836 - DNA, 839 bp, Oryza sativa
  unsure (1)..(839): unsure at all n locations
gcatcatgggcgaaaatctgaccaccagggtgcgtaggatgatgcttgctggtatgaatcgataggttgctcttaaactgttcaaatttcaccagttgcattgtttgatcagagactattttcagctatcttgaggaatgatgtggggtggtttgatcaagaggagaacaattcaagcctcgtggcggcacgcctttccacagacgcagccgatgtgaagtcggccatagcggaacggatatcagtcatcctgcagaacatgacctcacttctcgtgtccttcgttgtgggcttcatcatcgaatggcgggtggccgtcctcattcttgtcaccttccctctccttgtccttgccaactttgcccaggtaaaacaactctcaactcacaatattttcgttaacatggaggtgtcattctattatgtgccttttacgttctaacctggattagacaacgtgctaggaatctttggtggaataggagaattaccctttcacattaaaccgaatagtactttgcacgacgaactcactgagctcactgcaccgttgcgacgccgttttcggcgcagacaaccgtttgctgctcaattactccctccggagataggatgccagattaaatccatcagcattgctatggtaggatccgtggcccatgccactgccactgcttctgccgccgcagctgccataaattactgtgcgcggcatgtgcaaccctgccaagatgctccttggcctcctctctgcaaaggcaaagcggccgtgctaatnnnnnnnnnnnnnnnnnnnnnnnnnnnnnnnnnnnnnnnnnnnnnnnnnnnnnnnnnnnnnn

SEQ ID NO: 19837 - DNA, 915 bp, Oryza sativa
gatcttaacaacgaagcttcagatcatcaccgtgctctttgtggtacgtttaattgatatatacaccttaattagttagtagtaattgctacagtaattgtgatcgatatgaatggaggacgagtaggggaagcctatacccgttactttccaacggaatacttgatttactggcgtcaggtagcagacataatatacacatgatatacctagatatcatgctaatgtcagtaacgtaaactgtatagtattcaacattatagcgttttgtagtatgatatgaatataaatgcaggggatagttggatcaggaatagcgttcttggcgatgtcatggtgcgtggagcagagagggcctgtgttcacgacggcgttcacgcccctcatccagatcatcgcagctgctatcaacgtcatcgttctccatgagcaactccatcttggaatgtacgtacgttagttacgctcatcacatcgatcgatcatgtctaattactagtataaattgattggcattaatcatgtgcatatatacatatatgcagtgtgataggatctgctctggtaatcattgggctgtatttcgtactgtggggaaagaataaggaggcctcgtcgtcgtcttctccagcaaaggaggctgtgcctgcgctgcggcaacaatacggcggccatgatcaagaaacgactaatgatgtacaaatgcaaactgtctagtactactacgtactgaaacaataattagtagtagtagctaattagcatgcacaccgcgcacttgatgatcgtggataaagaaaaatgcatcatgaaaaaaggagtaaaaaaaatccggccctgttttttttcccttcctcctatagtatatgcccgagtatgcatatcaggagggaagttggtcaagatgaattgctt

SEQ ID NO: 19838 - DNA, 353 bp, Oryza sativa
aatagcactgaactggccgtaagcaaaccaggctggaggattcttcttaagaaccaaagcaacaaccctttttgcgaggtcttctgctggagtacaaaccaaaccctgagaagcatcagtcctgactctaaaggattcctcaaattttttgtagtacttccaatcacgtattgaaacatacttaaatataaatgtacttcccagattcgactttatgccctcaaggtgcaactatcataacattaattccgaaactttttacctccagttctgcagtgataaaaactgtcgggtaaactgacagtgtcaaaagtgaaaaaatatttccggcgtcaaaagcccacagatcatgc

SEQ ID NO: 19839 - DNA, 679 bp, Oryza sativa
tagggcgaattcgagctcggtacccttctgaatatccttactcagtatggcctccctgctggtttttctggctcacttgggatccatcgtctaattgagtccttgaaacattactttgcaataaggatgaaccttggcgaccctgagtttgtaaatgttaacgaagtcgtctctgatatgatgtcccctaaatttgctgctgacctgaaaaaaaccatctatgataacatgacatttgaccctaaacactatggtggcaggtaaagcttctcttttgtgcacaaatatgtcttccttttcaagtagaactgtcagcaaagtcctattaaattcctgcatatactagtatactactattactggtgaactaatttagtaatctgcattattacaggtggaacatccttcaggaccatggaacaagccacctgtccatcgtcgacagcgagaggaacgccgtttcgatgaccaccactgtcaacgcgtactttggatccctgatcctgtctccgagcacaggcattttgctcaacaacgagatggacgacttctccatgccggcgaacacgtcggccaactctccgccgcctgcccccgccaatttcgttaggcctctgaaacggcctctctcctcgatgactccgacgataatactcaaagtgaccaccacctcgcgcaa

SEQ ID NO: 19840 - DNA, 1249 bp, Oryza sativa
acttttcgaccaacgtttgaccattcgttttatttaaaatttttatcatgcttaaagaacatttgatgataaatcaagtcacattaaaataaatgataattacataaattttttaaataagacgaatgatcaaacgttggtcgaaaagttaacggtgtcatatattaaaatatggagggagtattatatatcttggaggcttaagaacggtcatatataccaccacccatgcgggggagctaattgtactcgatccatcggctaattgataagaaaacaaaatcaggtaattaactaagtgtaaaacaaaataatacctagctatacactcagctgaacccaggccacaaaggcaggcagaagttctccctggaatgcatatgtctctcctcctgtatatatcgatcgtgtcctcccttcgtcttatattacccttcgtctcataatataagaaattttgagtttttatttacactttttatcactcgtttaattcaaaaaattttaaaataattatttattttttttgacttgatttattatccaaagtactttaagcataacttttcgttttttatatttgtataaattttttttgataagacgagtgctaaaacggtgtaagcaaaaacttaaaatccggaacggagggagtacgttctagctaattaagctactctcactatcacacatcacggaagaataatccatatatccctctgaaaaaaactggctgcaggatcgatcgattagaggacaaaaaggccagccacctcggtctgggtgctcacgcttttcccgatcgatcagtactacgtgaattgaatgtgcattacctagctatactgcgtacagtactttctctgttgcccagtgtgcacactactatactgtttggacacacgcacacactgatcagacagtgtggccatggctagctgcataaacctctacttgagcaatactacctgtgtactcctcagataacgtttaggaatcttccaactaactttacaaggtggtgggctagatgatctggattcaaagtctcaccctttctaattatttgatattaaatcattccttaatattcgtgtcttttacttgtgtgctgctcgctccgtcctataaaataaaataaattttagaaaaaaatatcctaaaatataagggattttagaattccaagacaatattatattcttcaccggcctatcaaccttattcatcacctactaaacttttctac

SEQ ID NO: 19841 - DNA, 35335 bp, Oryza sativa
aagctttgggatgttactttgaattggggatttggggattgatttagggatatacatggcactatattcgggagaaaatatagagattaaatctgggcaaaagaaaaaaaaagcgctactctctctttagtcccggttggtgttatcaaccaggactagagattcctctcatttttcccggttggtaacaccaaccgggactaaagatcgatctttagtcccgggtatttgaaccgggactaaagatagtgatctttagtcccggattcgtactcccggttggaaaaccgggactataggggggttaccaatcgggagtaaaaaggctttctcaaccagtgatggggaaatttgttgtatccaaatatatgtacatgttttataatactatgcccttctttggatatttaaatgcatacaactatatgtaaatattttcatatatactatttttaattgaacaataaataacttgatactaacccaaaatgtagctttcaacacttgtaattgaagactagacacaccaggaaattcgataccttccagtacctcattaagagccataaaaacactgagtaaaaagaagactggttgatgtaaaaaccctatattaattgtaaaattaaagggaaaaaatccaaatattccccctaaattttggatggaattctatttgacacctgaactttaaaactagacatctaaccccttaaattttgtaatacagttcatgctaccttctaaggtggttttacataatggttttacgtatttgagatcttacatagttgtatttaaataagttcaatatatttacgtatcatcaattgtaggctgttaatttatatactatacaataatgttatagtattgctactctagtatttctctttgctactctagtatttctcttgcgagtaagagcaaacaaggggtaaaaagaaacatttaagtgaaaaatttacatatatgtttcaatgcatatttcgcatgatcaaagctcagccaaaacatatgctaatgagataacgactttgtaaaactaccttaaggatccgtatgaacagtactataaagtttagagaactgaatgtccggttcaaaacttcatgttgctagatggactttttttttttgagaattacacagtacagcgcagacactcacaacgcacgcgctctcacccctatgaacacacgcacacaaaccctacccctatgagcattttcgaagactgggccggtaaagtttagggaactgaatgtcccgttcaaaacttcatattgctaggtggacttttgatttcaattaaagtttaattaggtggttattaattaggacttctttttcaaatttaaaatttgatactgcttaaattacaaacccaacctaaaacaatcaaacaagcacagtagtacatgcactggcctctctctctctctctcctctgcctttttaagcagccacacgtcgagtcgtctcctccacacagatcgcacacaccagtagctgcactagcccactgtgatcactagctaccgagctgcactgcactgcacacaacttgttcgtcccgagtcccgaccaccactagctagctttcgcacgctcgccgcgcgccatgatgagcagcaggctgaacgccggcgcgatggcggtgccagcggcggcggtggcggccgacgtcgtcaacttcgggtacgccgcccccatgccgccgccctacgtcggcttcgacccagccggcatgggcggcgagcgccagctgttccagcacggcggtgcatgccatggcctctacgacggtggcctcgacttctccgccgccgcggcgttccaggaagcggccactcttggagttggcctgccgggcggcaatctgctgcagtccctggcgccgcccgccgccgccgccgccacgccgtcgtcgctgcagatgccgatgatgatgtcgctgccgggcctgcctgcgacggcggccgacgtgtacccgttcggcgtcggcgggttcgtgaagcgggaggatggccccgtcctggacgtcgtcggcggcggcggcggcgggaggatcgggttgaacctcggccgccggacctacttctcccccgccgacgtcctcgccgtggaccgcctccttctccggtcgcgcctcggcgggatggggatggagatggggatgggcatgggcgtgctcgggctgggcctcgccgcggcggcgcaccaccaccagccgccgcggtgccaggccgagggctgcaaggccgacctctccgccgccaagcactaccaccgccgccacaaggtctgcgacttccacgccaaggccgccgccgtcctcgccgccggcaagcagcagcgcttctgccagcagtgcagcaggttagctccgatcccgcgcaaccatgtcgctgccaggtgggacccagcaggcacacgtgtcgctgccaggtgggacccagggcacagccacacacgcactcacacacttgacatatagctgattcaattccgtacgagatgaacactgcagcaaactggtgagatatgtttgcttgtcttttccggtgcctacttgccaaccacgcatctcactcactttccatgcatgcatggatatttctatttcatcaggatggatcactgtacattcaacctacttcatcccttctaaaatatactacctccgtcccaaaatataacttttagctataaatctggacacacagttatccaaattcatagctaaaaatacttatattttgagacggagagagtaaataattttatatggacgagacattttctaatactacaaatttacgaatttagacagagagcatgttcacactggtatattaagggaatacccccctccgtcctaaaagaaagttcaatcctaactataaacctagacacatatatgtccagattcgtagctagaagttggttttttatgggacggagtagtatgtcatattcatttaaaatctcttatattttgtaatgatggagtaattatataaatagctccccagatgatttgcatgcatgcaattgagcttaattatgatgaaaaacaacctgatcactagctagtggtagtgtatagctacctgcattattaattcatggccatgcaacagagaaaaagctttcttttcttcagttcttgcttttcttctctctgtactgtgagttcatcatgcatcaactgtaaaagaaaaaggctactagatgagatattttgatccaagagtttaatctgaggtcagatgctaattactagtattagatgatgcttgcatgcatgtcagtcagatcagatcagagagcacaaggcagtggttgcactttatcactgtagctatacctagcgctgcatgaccagtgtagcacactcatcattgcaactcatctgacgatccatggatggagatacatggcccctatatatatgtcccagtatatattactgtataggagtacagctgacagattgtacacctactagcccctacataagcagtctctgtatctgcatacattggcatatttacgtgtacatgcagtgcggatgcatatgtattacagttaatttacagtagtagcagtgtccattaagtctaatttggtactacatttatatattcagtttgatttaaatttgtgttcttaatttggacaggtttcatgtgcttgctgagtttgatgaggcgaagaggagctgccggaagaggctcaccgagcacaaccgccgccgccggaagcccaccgccggcggccaatcgtccaaggactcgccgccgccgccgccgtcgaagaaagggactgacgccagcatcgctagctcctacaccagctgtgaccaccacaagggtacgtactatactaaaatttaactcaattaattagtttggtcctcagaagggagaacacatttgaaataattcaaaatctaattaagtgtggcaatgctcaatatataatgctgaacgttagatcgatctgaaagcaaaattcagatactgatgttttcaaatttcaaactatgtacagactagattaatgctcttcttaaattaaccatttagatcagagaagaaaaatatacaaattaaagatgaactgaatctttttttctataactaaaacacagtcaataactcacctcagtttgtaaaagggaaaagtaccatcaggatctgttactcttcactgtttttgaccccaagcacaagccttgctattttttttcaaaaaaaaaaaaagaaagcccttgctaaattttttgttttttttttagaaaagctaggtcgttatataacgtctattcaccaacttgtctatataatggagtgctactacgtaccatagtccatagatacgatcttttgtgcaagaacgtggcaaatatatatacagacataacacatatgacttgacagttgtcacgcctagctagatgctacaaccacgtacaactagctgatcgatcatgcacacttcgcgccaaattaagctttcatgcacctactatagctaatactctagttagcaaagtacgcgtcttaaaataaaacaacctaagataatatggtatataacctaatataacaatctagatagaaaaatgttcatatttgttaaactagattatatttaggttgttttatttttggaacggagtgagtagtttacgtcgcaattcctgcattattctacatgtgatcatcatctctcttcgtgcagcagctgcgagcaccacgacggccagcggcgtgagctgcctgcaggagcttgcagaccaccacgacgtcggcggcggccatcaggcagccatggcggcggcgccgccgccgacgctgtccctggccgcgctgccgccgcaggaggaggacgacgaggacgaagacggcggcctcggcaacgtcctgatgatgcagcagcaccatcaacggcggcgactgcaacacgacggcgacggcgacgacgatgtcgccgccgccgccgcccaccaccatctgatgagatctctcgcgcggcagcagcagcagcatcgccatagcagcggctgcagcaacaacaacgacggcgacgacgacgaccacaacaacaacaacaacatactgtcgtgctcgtcggcgtcggaccagcagaacagcagcaacaacaacaacatgcatttcttcgaggtggatttcatctagtcgtctcgaaaccaaaaaaacatattaattcgtcagggtaaatatcctttggaattaattaccgatggttttttcgaaccgattcacgtgaaaatcctgtaaaattccaaaggagatctcgattggattgatatgtacgtgtacatctgtgtttttcagaaaatttagagattggtcgatgggaagtaacgagaaaagggagtagagataggctgctactgctggtttgactgcattattatgagacgatgagttgaaaagaaagcagctagctgctgttgctgctgcagctgcagttgctagctagtattagctaggttcgttgcatgcgatagctaggctggagtgagtgtgtagctaaagtttgctttttttttttcttttggggttttcttttcactgtgttaatttgtacttgctcttgctgcttgccctttttactagagagggggggggggggggggaatagtgtgcagctagcatgtgttttttctttgttcttttgcctttttggtgacaatatgtaaattatgttgctgtgcatcatgctccttacaacgaaacactagctctgtttgcatctcctcttgacttgttgtaacttgtaagatcttaattttaaatgtcgaataagttcatgattaattatctcccttgtctcgttgagtttttagaccattatgttgacagatctctgaacatgtccctggtctggaattctggaaatagctctttgagctccttaatttggtgattatggatcgctactgtctagctagctagctcccctaattagtcacagcaattaatgtcctgtccaaatgggagctgatcacttacaagtgacattgtctatacataatactccctctgtattttaatttaaattttaatgtatgacgccgtcgactttttaaccaacgtttgaccattcgttttattcaaaatttttatgtaaatataaaaatatttatgtcatgcttaaagaatatttgatgataaatcaagtcataataaaataaatgataatgacataatttttttaataagacgaatggtcaaacgtcgatcaaaaagtcaatgttgtcatacattaaaatacagagggagtatatataaaagacgatagtgatagtggtaatcagggtacaaaattattaaaaaccgcttgctttcatataaaatggagatttcgagctagctagagatcaaatggcttggtaaaccaatcatttttctttaaaaaacaaaccaaattttagtcgaatttcaccgttagtcaaaccattggtactatcaagagcggttatcgagggtggttctgtttagttagccgggtggtaccatccgacaacggaattttctatatatgcatatggagtatttgttttgcttgaaatatgttttgttcgacaattagatcgtttgtttgtatgtcttgtaataagatcatttgagcaatacaattgaaaactgtatgaaaaatttaaagtttatattttttttatatacttattctagttctagctagatgagaattaactatatataattaattgaaaatatagaacaaataactttatgtgccttgagctaggctgcaataagttgtactgatcactatctacggagaacctatttgagttgcgtcatatataaggcataacaaattttgaattttagaacttgatatgatttagggttttcttacgttggtttcgttgcttagccttgtcttttggaccgttaacactagaattgtaaaaagttcgcaccataaaatacctcccaagcatgatttctaggtttagttaatgcatgcctacaatattactactcatagcataggccggccatcgatctcataatgaacgttggcctcatcagcagtgaatagaaagggtgaacatatctttctcaataactagggtatctcttcgtattgaaaggcggtaggaccagcaacgacacacacacacagttactgctgtactgcagtaggagtaataactaaggatttcaattgaaaagaagagatgaaaagtactactagtatcaatcaagcagggaccggaccaagatcgcatcacattgtttatctacatgccgccatcgatatatgcctgcgtgttttaaatttatggcagtgaaatctaacgctccaagaacattaattcaaaagctagagatggatctcgatcagtgaacaaaatccattaggtagttcatgccaaaattgaaagtttggttgaaattggaacgatgtgacggaaaagttagaagtttatgtgtataaaagttttgatgttatggaaaagttggaagtttgaagaaatattttggaacaaaacaagggcatagatagttcaggaagaaattttgattgatatatagacaaaagcgatgatctcataaaagcttgagataccagctgctggatcttttatgagctctatctgtgctgggacccaaattctcttttcttacggatatttaattgtaccaacagttcgatcaacctcattgtaaatatgctcttatgcacttaattaacaaattaattacctgtagtacatgggagagatagatggaccaaatatataatactccctataatggcttgtcaggactgatcaggagttgttacaacaattcaattgcttctgcaggccagaatcagaaagaaatcacacagcaggatctctccccattttaattactcctctcttgatctcttcctacaattgatggaaccaacaggcttttctttcccgttgatcccgtcacacgcatgtatatatatctgaatcgttagctaacgaatcaagcatattcaatgttcataggatcacccccaaatctctctctctctctctctctctctatatatatatatatatatatatatatatatgaaaaaatacgaattaccccctgaaccgtggcagttcattcagcattctatttattaaaaaatgtgagacccacctgtcatactcctcccactcttcctctctctcttctctcactcttcctctctctcacgcgcacggcgaggcagggcggaggggcggcagcggcgaggcaaggcggagggcaggcggcggcgaggcgagcgcggaggcggaggaagcgaggcggtagcgaggcagggcggcgcacggggcgggcgggtgagagagaggaagagtgagagaagagagaggtagagtgagagagagagagagagaagagacttgacatggccatgtcttgaggtccataaagtctatccgtgacagggtaccatatttttttaataaatagaatgctgactggactgccacatgtacgccacgtagaccaaaaccaccgcagattaggtcgaagggggtaattcgtccggtttgtatagttgggggtgaagaatatccggttttcgggttcagggggtaattcggacgaccgcgatagttcgagggggtaattcgtactttttccatctagatatgtactgtctgatctgttctgaaaacaatgacatcctaaaatacgtacagacacacatctctcaaaagaggacagctaggggacggaataccgttcatctgacggtatagtttatgatcttgatcgtgcacgacattctgctacccccgcttctccgaagggacgcggcagtagtgctcatctaatcaagtctcctatctgggttagtttggttgcactgtgaggaagcgggactggttggcctatgtgggacacagctagtctgatagtaataaaagagttttcttattggtctacacactctgatgtggactaataatagtctagtatctcgttaggtcatatgctgatgagattgggacaattgatacatatattcacaataaatattttttgttgggtcgtgtgctaattagggtggaccaataaagatacacacatctacaactagttattataaagtacggagaaatcatgtacttattgtcacgccccgaactagccctgagcggaactagcccgtgacgctccaatttaacctgttaaccgataccagtcccaggaaacagtgctggtatcacaggaagacagtatatcacagcaacagaggtctctttattacagagtaggagtacagtcatgttgggctgcggacagatcccgagctcgcaactgcattacaaaagggaaagcggaagccaagacttggaccaatcatcacaggcgcgacttgggaactaggccgaaaccctaaaactcatcatagccgacttgctcctagaagaactcctcgtcggcgggggccacattatcttcttcagcaactgggggggggattatttatatagagcaagggtgagtacaggagtactcagcaagccatgggaattaagtgtttaatgcaggcttcaaaggaaaggctgttgtttttgcaattgattttatttaaactcctttttgaaacaactaagtgagtgcttctcaaacgacacggatgggacagtgcgtctcgtccggtcggagtatgtgcaatgtatcagtctttgaattgatcagggttggcacccggccaacagctttcaaacggccacccgagcctggctgatcccatcaaccgcagattttttcaaacatcgaacccattccacagcagcaatttcacaaagcagtagtcaaacaaaactacgctaggaatcacctcacatccgcccatgaccgtgggcacggctgttcaaacagtttaataacctctgcatagggggtacactttacccacacgacattactaacccagatcttccagcccgtgcagaacggccacgtctagagaccttaaggctttcatgacaaggcatttcgaaagccgacacaggttcaccatatgccaacgagaggggtcccagaccaacaacagattaggtcccagaccatactgtgccaggaaacccgggggttctccccggcaccaccccgttgaatccacatgtctcttggcatcatggcacccccgattagctagttactcagccaggggtgtcccattccacccatgtggtcgcacttgtcttatgttcggatgaaattccaaggaaacagtccttaagtgcaagagcgggaaaccgtactcccggtacgttccccggtccgcgattttggaaattcatttagttcgcaagcaccgacccaggtgtcgggttttccaagtcttttgtaaaacccaagttttacccatcgttggatattttaaattttgagggggggtgttccgatgcgcgtacccgaaggcccatgcatcgaagcacaatagttggcaagggaggtttaagtgttcaataattcacggagggtaattgcagcaattaggattgggggccagcaggctatctcacaagccgcggccaaattacttgtgtagatcctattcatgcaatatttgcggaaaagaaatacttagatttaaattataggtgcaagatgatcaaaggtgtcttgccttgctcgagaccttgagcttgatcctcgaaatcctcgcactgcgggtcttcgggctccgaaactacacgcgagacgggacaactcaacaaacggtgaaaataaagccctattatggacctctaagcgtgccattagatagatctcgagatttgaggaattttagaagttgaacggagtcaaacggacttacggttgggaagatattgaatttctaagattattggatttttgatctaaaggaaaaaggatttatttaaaacctttttgagaaaagaaaagaaaagaaagagggaggggaattagacttccgtcgggcagctagggcgcggcccgagagaaaggggcggctcggccgagcttaatgggccggccggcccgagaaggcggcccaaggcgcgcgcgcggccggtgaggaaagaaggagccggtgggccgggtccatctcgcgtggtcccgagtgggacccgcttgtcggcggctcggctcaccgtgagcgaggtgcacgcggggcgtgctagggtttgggaaggggaggcgcggcgcacgcgcggttcacggaggacgcggtgcgcggcaggcccacgcgcagcctcacagctcaccgtggaccatgcgcacggggagggtggaatggagggagcggctgaccgggtcggccgatttggtcgtgccgaggtggcaccgacatggcgcctacatggctgccacgcgggccggctggaggaagacgaaggcgccggccgcgaatggacggcgggcggtggcggtttctccgggacgccgtgcgacgacgaggggcgacggggtgtacaccggaatgacgagggagaacgagagggagcaagccaacggcttggattcgccggagggagttcgtcggtggcggattgcggcggcggccaccggcggcgagagaagaggggaacgatggcgagacgactagggttcgattcctccggactagagcatctacacgacctcgggattgcattccttgcgccggattaggaggaaacgcaccgagggtggccggcgacgagaggcgctaccgagctcgggcggcgacgacggcgagcacacagtgggcggcggcaaggcttggggcggcgccagctagctatggggaggttacacaagcttctatcgaaaactaaggggaagagggggaacgaggagggagcacggggagatgcactaccgtgcgggacggggcacagtgacgatgggccgacggcacggtagtgatctctccggcatcgggccagggaagcggaggaagacgatgcgcccgaagtccccttcacgcgtccttcgcacgcaccagctctcccggtgcttggcgatgaacggcggaggcgagacagagggatggcaatggcgtggaggtggcgagcgaaacgggaggaggaatcgatgggagggcaccttggttaaataggaggcgatgtcggtttgggaaccgaccaagggcggtcaagggagcgagctagcgctcggcggttgcggccaaaacggcgacaggggggtgacgccggcggaagagaaaagggaaaatgaggagagaaaggggggcttgccccttgccactttgggaaaaggaggagggagagagggcgacgcggcagagggaggaggagctcggcctccatcccttgaagctagcgcgcgaaggtggcggggccgggtcgatgacgacggcgatgacggcggaccggtttggagcggagcggcgacacgggcggcagatgcggggcaggcgcggcaggtgctgacagcggcggcgactggccggtcggccaacacggcgtgcgcgcgcgggaagcaacggggcgacgcgacgatttgggcggcgttggcgggaagcggcagcgagggcggagggcgctcggctcggcgcggctcacgagcacgcgcacgcggcgcacgggcagagcgagggagagagggagagagggagggagggagagagagatgggccgagaggaaatcgacccaccaaacctgagggaggcaaaatagacttttgcggaggaaatgaattgggaagaaaaaaaattgagattagggtttggatttgacgatggatcggggattcgagatccggaatggcacggagactgactgcaagcgaagaaacaattttcgcaattagggtttttagaatttaaattttcccgctaggcgccacgacggaacgggcgctacacttatcatccatgaaaccccatgatacttggtactacatagtaccttatatgttatgaacctccaaggtaacagacctggtattacatatgtatcatatgtggtatctaggtatcagacttatacttagacccagtatctaggtatcagattttgtagatatcgtgggtatcatatatgatatctgggtaccagatttgataattagacttggtacctaggtactagattttgtaaatattgtaggtaacatatatggtacctggcatgatacttgatacctagggtatcatatatggtgcctgggtatcatacttgatacttagacatgatacctaggtatcagattttatagatactgtgggtatcatatacctgggtatgatacttgatacctaaggtatcatatatggtacccgggtatcatacttgatacctagacctgatacctaagtatcagattttatagatactgtgggtatcatatataccttggtatcagacatgatacctatatatattagatatggtacttaaaacaagataattaagaaaaagatgaacataaaacaagataattaagaaaaaagatgaacataaatctagataattggccatggctctttccagcaggcccagctagtatgtgagcacctcttatgcatgtcctacaactaatagaagaagaagtcacgtccacactcagcaggacagtgcgacaagctagttcatcacgtgggagcctatccatatctcgcatatgaggtaggcatcaacgacataacgattcgctcacattaatcgtcccgtgacaacgggataccgttttatagcttttctcctctcaaaatcgtaaatcattaagaactataaaagaattagaacttgatatgcaaaaaatatattagcagatttgatgtgggaaaacttttgaatagttataaatatatagtttgaaaaaaaagtaattataaaacatgtgtattagagacatgtcggtatgcaaataaaactttaagaagaagaaaatagaacttgtacgtgttttgcagcacagaattaagagagctattgatcgatccagcagagcgtaggccatatcaatgagactcccatgaatatgcagaagctgcctacgaagaagctaggatagttgctaagctaggtagcttcctgttgatccgtatttctccctccatccttaaaaaaaaataaaccctgagttttcatgtacaacgtttgaccgttcgtcttatttgaaaaagttatgaaaaaaaatttaaaaaagcaagtcacgcataaaatattaattatgttttatcatctaacaacaataaaaatactaattataaaaaattctatataagacagacagtcaaacgttaaacacggaaatttagggtttgtttttttttttgaacggagggagtacaatactatatatactgtacttatatggttagctttagcaagctaaaatcctgtgtatgttacatctgtacatgtgctctaggtgcactttggaaaattcgtacatatatacacggtttaattatccggacagactttagcttggtggtacatgtcctgcatgctgttctgtacttctggtagggattaacctgctccgcctatattaaaaaagcaatttttatatatgaattttaacttagcgtatgtctagatttatatataaaagttacattttcgagatagagggattaaccacctaaataaacatgatattttaactctaatacattggcttcaatacaatgcaacataactttttattcatttgctctcaatatgctactctacttaatttcgttcttctcctcttgtgacttagcacatttgggctagctagctattcgcatgtaatgccacgatctagtgtactctttctttttctctctttcttttctctaaactcgcctatacacatttctccccccaacttcatggatcaaacaacacgttaacttcgaatatctaacatttagatttaccatcatcgtcagatttgtaacatccagtcaacttaattaattacccctgcgtgcatcacagcttttaattaattgggagagagaattggagtaaatgtatatggctgcttttcctctgttcggccataagaaaagctctaggaattgtggtaaatggcaaaggcttgtgcatgcaggggttgataattaaaggggcaaaagctgctgttgcagcgatcacaatccgaaatgccatactagtatgttgagtcccataggacgcccttcataaagagaggggtctttagatccacgggtgtaaagtttcggtgtgtcacatcaggtattatataaagtgtcgcatagggtgttcgggcactaacaaaaaaataattacagaatacgtcagtaaaccacatgatgaatttattaagactaattaatccatcattagcaaatgtttattgtagcatcacattatcaaatcatggagcaattaggcttaaaagattcgtcttgcaaattagtcgcaaactgtgtaattagttattttttagcttatatttaatacttcatgtagatgttcaaacgttcgatatcacagggtgaaaaattttggggtgagatctaaacagggccagagacactaactctcaggtagagggccaacgactataccatatcagaatattagggtctattttagagagcttaagaatctgagaagcagctggttggtagacagcttctgagaatctcaaaaagctgggttttccaaacttttagttcattttctggattctacaactacagctttttagaatctgaaccaaaaattggattgtttgcgggagtttctggttatgagagaagctgcagcagctagaagctccccaaacagacccttaagcttgttgccttatcaatcatggttaatatttaaatttaaaacttaattttagagttgattttgaggtcaaagtagtttatttctcaagctgttagagctattatacagctggagctatgaaactctgagttctaaactacaacctaaacagaactttctcatttttagttagtttggaggaaaaacaaaagatttggactcctaagaattaattcttatgaggcatactcagtttgtaggaatgtaaatataggtaaaccggaaattttccttcctacaagttgaaaaataattaaaacataaaaaaatcatccacttaaacctcttgaaaaattcatatggattaaagtgtgcatacactcatattttctctttttatatttctataaattaaaattcctccaaaccgaaatatcatggtgtgacataggatgtgcactttacctaaataaacacaggatgtgcacatgtactcctaaaagtattaatagttggccatgttttcttgtttcaagaccctggaaacatccaattaatcatgtacaatcaaatcatacgctagtttcacatggcggcacggggacaaaatctttttttcaaacagtccctatgtctatatatataattgccttgtcgtggcagctcccgcgtgcgtgcatctattacttgttttcggacatctcatacttctcattttcttaagtgatcccccctactcctaattactaggagtactagtactcgcatggaaatgaatgcaaataacaggacaacaccagtttccacttcccagtagatgcatgttactcagggtccaccctccatgcttagatggaagtttagacagattacaataccatctgtcaactaccacaaatgggttttctttctcttttgggactagtacaatttgttaattactgttccttaggctatgaaaatatgaaaaaaaaatgaaaatgtaactttgatcgctaatttctattacagtatatatattgcagaacttgagaacattatagtattatgaaagtatttctcaggacagcctacaacgacttttatccaaactaaacattcaaaatgataatgttcaaaagtttgaaagttccctttgagatgtgtactctaaacgattggttttcgtgaccagagtaaaatctagttgtttacatcttttagcattgtctgaataacaagagatcagattattcttaaagtggggatccgattgttttcaaggcaacatgaagttctctcaatcattagtccattactacataagggtaaagtcatactaataaaggaacttttaagtctaaaataaatgagtatgcagatggcgggacaggttttgaagtcaagtccctacgtgcctactaaccaacaccatgaatccgaacctcagaacctgaactgaactgggacagttcgcgttcgccctacagtgataacaataccatcatttgggcctgctaaatgtaaggggctctgatggtgatggggccggccgggctgaatttatggacaagtacagaagatgtggggctctggactctgggtaattaggcaagtttacactagggctgttcacccgggaattttcattttaaaccttttaaatttttaaattttaaaaataaatccttttaaaactggcctgggtacccttcctctcatctccggcgttctcgtcgcccgagtttgtgtcacgcaccgggtagattcagaaaatttcccagatactccctccatccttaaaaaaaagacaatctagaagggaatgtgaccactcctagtgcaacgaatctggacagagcaaaggttacatctcctcctaggttgcctgtaatatctcgcacaagaatgtccatctcactgagacatgtttctttctccattcttgaagaccagaggaggtgtgatcctacacactacacaacgataggccggaaaggcaaaaaagattgaggcggccggctccttacgcgacggcgatgcgaggggtgccgcgcgcggccagtgatccgttaattccagaaagcactcaggtgtcaatgtgccatgccacgcacatggtggggagaatgaggggatcatcaaccgatagcccccaccaagccgcctcgtgattcgtgctaaggagcatgcacacccccaggctcctactactactagtagtgctgctgttgtttccatgctttgaacttgttgctatgctattgtgtagtaattgtggactagggtagccagatgcgtcagtgcgtgcacgttgccacttccccaattcactatagctcctccagagttggagctcggaggcaggggcagatctagcgaggggcggcgagggctcgagcctcctttactggcgataggattatggaagtcttcactaattctttttaccatatacattcgaaggggactatagatatgtctagtttgttcagacccttctgttatttcttaatacgccactgctcggaggtaggactgtgcagtgactactaactacaacacatgattaaattgaaagcagaacagctcactctcagttctgatcacctagaggaaaaggggatgagagtagaaggcacaagggcaaaatttgcacacggtctacatgtgtatatatatatatatatatatatatatatatatatatgtgtgtgtgtgtgtgtatatgtagtgtatggtgccgcgctaggcttgccatatatatacatcaaaggaactcatcaaaagttttagaattccgaagtgctaagaaactgaaggtaaattcagaatagtagtagcattgcttagttagtctactgaagatagcaacgatcaaaggcattaagcagtttctccctgaatactggtaattagaaattactggtgttagctcgaacctggagtgagccttttacagttctgatcttgcgcattcttcatcttctgctggccttccagtacctgcagtaagtaagaatgtacatcaagcttaattatggccctagctttatcttgatttttaaactaaaggatggaacggagaatcaagaagccgagaattacctcaccttcttgacttccttggcctcccaaccggtttcttcgcctgggttggagccaagtctggctcctggccaaccgctatcggttcgccttgatgtgatggaccactccttgatcgggttctgctgtcaatgtattggcgacgatatacattagcaggtgaacttctcctagtttgagtgctcctttgcaggctagctcctgtgcaattcctaggactgttttcaagcggcacgcctgttgatgaactgaatagatggaaggacacaattacttacgtattgcaataaattcttttatcatgaaaatataaaatgtatatagtagtatatcatctgttcattgtggacagtttacattgcttgatagaagaaatgcatttcagattgttcataactagtaaggcattataggctgaccattggttatggagcatgtatacacattgcagaatttagatattaagaaaaacaattcatgccatattattgcaatgttgtattaaagtcataaaacaaacaaaatgaaccataaataccagatatcatgagtttataacaggaaaacaacattggcccatttgaagatacatggctgccatggacattacctgggcgcagcctccttgtcctcttgaaacataagttttgaaacagaacaagggtcattgcagatggtgcctgctgcagaaaaactaagagtatcagacgagttaatagtagaaacctaaggtttatactcacagaatcagaaactttaaactaaatgcagaaacgtactgttacggtttttgcgtgaaaggactactatttcaggatcaaaaggaacaatatcatccaaaggttccaccttaataggaaaggtatttgtcaggtcctgtgacaaaatttggagttactttcagtaacagggcaccacagccgaatttgacaaattccaaagagcgacacccagtaaactagtgttgtatagtccaagtacccgatcagagtatggatagagcatggtaggacaacggttatcccggttggcttcactagtggctgaagcaaaggtccgtgcagttacagcaggacgcttaccacggagagctgatatgtcattatcagtgtcatcatatgaaacaatgttggaaaatattaggttgtccgtcccgagaagggggatatctttgaacagcttctttgtatcttctggtatccccctgaatgcattagggtacttggtggttgcctcttcaaatgaagctatatctatcacaaaataaaggcacagaaatagttgatgaccaacatatatcccactagaataggctttacggttttgaaatgtaattgcaacaattacaacatattttacctgaatgactcttaagaataccatcctgcctatttgaaatgttcaaatcatttagctttggtctgacacttcgggagtgagactcatcgaggttatgtccagtgcaagaattacttcttttcagagcctgcagttgttcaacaaaactgcaagttaggctcctataaattgaactgtgtgaacctggttaggcattctctttggttgatttattcaggcttgcagttctgcagttttgatcttcattatttatagttttgtttgctcctactataatgattcaatagcagatgatattccacttcaagaagaaaagttagaacgtttgcatcattccagggtcaaacaaaaaaatgcaagatttgaacaaataaaatgagatacctgctctgagatagactaagtattgcccacgaaaaacttttaggcatgctgttagccaataaagaaacatcacttggtctagaaaatgaatggtattaaaatgacccaagaaggttagtagctcagaattatcaaacccatggcctatactatgaagaattttgtagtgatgggagaaaaatcagaagaaattaataacatgaataaaacctcagaaaatatggtgtactttggcagtttacatcatcagaagtagtcataaaaaactgagcacagtctaatggtattgaaaaggcgaatataaggtgcaatgtaaatacatgtcatgaaattctgtgatcttgagtaccaacatatttagtgtaaagtatatttccacaaggttcagagagttggggactcacatgctgactctcttcaagccatccgttctcaacaatgttgttgtcaagctgttggctacaatcatgaacatttgaactcgcagagcaagtgtttggacgaaatgaagagtatggaacatgatcttgctgttggctagtttgccaagcaattggaagaacaatagaaggttcaaccacatcagggtctgagtccacaacccgctcgtgaattatctttatcagtatatcacattccgatctggcacgtaattgaagaattgaagtcaaacttagcagtcaatatgttcagaaattgcctctgtgataaatagtcataataagaacgaatttccctatcaaacttatgtctttttttctatatcatctcaaggagataataacagaaaggccacgctcttgaaatttggtctgatagatatattagtaattgccggccacagatacatttagcttatgaaagtactaaaatttttcaccggaaggaagtactgaaattcaatgaaaataaactcatatgattaagctaatacagatccaatagtgaaaagattggttgtacaactaaaaaactacagcagaagaaaacaaagatataaggtatgataccttgagtacgtttcttgcaaaagcatctgcagtatagcatccttgggatctatctctgagacaagtgctaaggatcccacaccactgtcttttagagtaatctcctttccgctctatgatcatgaaaaggacattcttgatcaatctcttcatcactcctaaactaagatttacagtccacttgaactacagagatgtacaaagatggaaatacctggttgaactgattgttagaagcaaagtgcgcagtattatctgttcatttaagaagatatagatcaggcaaaaagggagcaaactttgatgtgttttcatcatcgagaaatgtgaagcacaaaacagagtaatggggttaatctaatcatctgttgctacaaagtatcgcatcaaaaggattcaatagttgcatgtatggcgttcttagataatgtaggagtagaatgcatgtgcttttagaaaagctacaggaaaaagaaaaactaagtatgtttcaatgctttgtcctaccagagattaactgaaacttcaggtggcagagagaggagcatcgacaaggtcaaattccagtctcaattttcaagcattgtacaatgggattcagcccaacaccccacaccattttccccctactgttcaaaccaatgaccagatcactggcaatcatacagaaaacacaaggccacctacacttctctagttttaaaattaacaggttcagtacaatatccgtgaggaaaaaatatttctccaagttctctccaaattggcaaatgaaaccactactaaaacctagagaatccgatcatattattatacctctaactccgtgttcgtgtgatgctgcactcggtttgtgcaaaaattaactacaggattaggtagcgccaaattcactcgaatatttcgcaggctaaccaaccacacggacgcgccaccatctccagcgacggacggcaacggctcacgccgaacacccgcgagggcaaacagcatcaaccacggcgcaaaacaacgcagcgcactcggattctagaactccgctcgagggaaggatcgcgtaccgccactgccgcggtggccgcgcggaggcggcggagactgggacgacgactcctgcgaggaggaagcggagccgccggtgccggagtcgggggagtccgggccgagcacggcggcgaggaggcggccggcgccgcataccaggccggagaaccaccctccgggccgctccgctggcggcggcggtgacggtggatcatcgcctgcggcggcggttgccatggatggggaagtggagaattggagggaaggggattgagaggaattttttttggttttggaatttgtgggcagttgcgctcagttactgcgaatattaaaatgaagtgatttttcgaaaaaaaaaatcccggatttttcgccacggtgaattttcagctttttttctgttttatttgctcgcttcgtgaacagcaaattccagaggcttattgaaagcccgtttgaaaagctttagagcatcaccaagagaatcccaatatttcattctcaaaactattctcaaaactatttttataggaattctaaacaaaatttgatgtgctaaaatattgatccctccaagagattgtctgaaattgacttcctaaaactaaaaggtgggccctctacaaaaccactaactgaaatttatttccgtctctccctatgtgagatcactctcgcgaactcctaatcgcggcctcgacaacagcacatcaatagcagcaccagctgcaaaatttaggaaaaacagtagagaacaatagcacgagaaccagcaagcagcaacagataccttaatcttcagcaagtgcaacaaaggtaatctgtaaaaagaatcacaagtgactgaccgattgaaactccttggtaaataaaaaacatggcacaagtttgagcaatggtgcaagagcagagattgggatcattcacttgcatcgctgaatgaatcaccaacggtaaactgcttcgacggatgaactcatcttcatgagagaccaatcccagcaaaaggaatgagcaactccggccgagtcatgatgatgggagccgatgcaggcgggctaatttgcgtcgtatcgaggcggtggctcaaatggaggcagcgatggtggttgggggatagacgaggaagttcaccggctgcagtgcagatggggccgctgccgctgccaaagcacaagctgccaacaccggaaaagctttggggagcggcgtatgatttctagccggccgcggcccgcgggtgagatggggctgcctgcaggacaccacgatgaggcgacgaatgacctcgcggcgaaccccaggtgagaaaatttcatgtggcgcgggaattcgctcgggagagggagattgggagctagcgcctctccccacttgtggagaacgaagaatccgggcttgggaattccaaccagtgggagcttggctagggattctgttggactgggtttttgaacgaaaatccccaaatttcaggattgagaaaataactacaacttcttaaatcaaaacttctcccaaacaattcaaattttttttagattctgcaaagttatagttatcagttatggaactcaaaagcgaactacgaagtactccctccttccaaactacgaagtactccctccttccatgaatttgaatttttttagattctgcaaagttatatagattctgcaaagttatagttatcagttatagaactcaaaagcgaactacgaagtactccctccttccatgaactaacgtcataataggaggagggagtattagttgttgaattcagaaagcaaattaaaaattaaaaattggtttttccagccgtttctcggaatctaaatctcctaaacaccctgagtcagtcacgtttcaaactcgttcaaagcggaaaagtaatacaacgcttatgtatttcatatttgagcaagtcgagaacagattgttttgctttgatccatggaagttgtcgtaagtttgaaacgaaacgtagaattcaaattgcctttgatgttatcgaaccatgaaacacaaaactgatagcttatctaatttggctaatcatgacaggcaaatggtattttcttacgaaatatgatctcacacattccgagcaacgacagtttcaacgcataacattaccatatcatggcatagttaaagatccaggtcaatctgcatcagttgtacatgacacttaattgttcatgtcagcagcatattacaataatcaatctggacatggcccgggctatctcattccgcatcctctatctcggtatcctctggaacgcctcggagatacaaaacgttgttgcacctgtacagttcacaaatgaaacaaataagaattatacatcagacaattgaatatgttttgtgggcaaccacaatgttgaacaaaagcaggtaacaagcaattaatataggcttataaccaggtaagaagcattgtgggtagagacaataactactaccgggccattgtgctactgccggtaacaagagaataaagaacaatattttctgtagatatgggaatctttttgtacgagcatggctataggagatagttttacaatgattctttttaaggtggaccccaccttaatttgcagaataggcatagcacattgtgagctttgtaataactgttaccacctgaaccccaggcccacgttattatccactttggtagtatacattgcggttgctctttaacgatttagtcagcaaaagacttcccaagttataagcgctgctacttgttatacttctgcatttgagtaaattccatatactctgaactctatcattctatctctccacattttaccatactatcattctatctcttaatattaccagtcagactgaaaacagggtaatagcatgcaagtaaccaacagatcacctatgagtacataagtaccagcggtaagccaataactacagatgaatctggtccaggactgaagggcgatatatagagttaccttatcagtatctcacccaagtttccagagaaatgcccatcaatatactcctctgtattagccagctgaaagcagtagacaattaggtaaattgcagcaaaagaagatgacacgtcgatccatattggtaaatgaacgaatttaactgatacaaaatacaaaataatacctgcagattcatataagagtcgacagaaacaagatatcctgaaaggggggtacaaaaagagtatcgtcagcataatcgataataaggcacagtctgaaaactaaattacaacaagaggacccattttaacacatgatttccattgaagttccattgtaaaaccaatgaaagtggatgttcttgataagtgccatgaagtaattgtccatggaagcaagaaatttcatgtaaaaactggacaaatttcaatgttcctgaaacctcagagatttcattctgaaatttcaatcactagcctaagcatatcagtgaataaaatgtgacgggtaaaagtatagattacctttgtattccataccccacttaagtttgacaatgacaggcttccctgtcaggttgttcaagaaaggcttcgggttaactggcacagtctgcatttagaaacaatccattaatagtatataaaagagtatagacaagatgtatatggaggcaccacttggaactgaataccatgaataatcatcatgaagaaaatcagaagaaaacaaatactagtcaggtcagtacaatgtctgtaacaaatcaagtttgttttgcaattatctgcagcaatagaacaccaaactgatgtgttgaagccctaattagcgcaagacgctgggtgctactccctactcagccgacagaccagcagctacataccgtaactgattacgcaggcctaacaagagacaggcagaagccaatccaggacagaccggctaggggcaacgcatgacatttagaccactgggtcattgtctttgttttccccactcaaagagggatacaatagttcctcaatgctcttctgaagctccaattcaagtaaagcatagtccacatagagaaccttgatgtgaacagctgagttgtcaagtttcaaatattttttacaagattaagctgaagatgccctttcctcttcagcccatactgatgtaccagtcagaatagtgagcaaggaatgggaacacttcttgttcttgcatcttgagcagcatggcagattcaagtgtgtgcttcccattcaaactcttcttttactctgaaatattgaatttcattttatcacaatccatggatttttctgatgttcaattcgatttttggcagttgtgctagtgatatgcgtaaaggaatcacagtttctgatctgaacatctcagaaaattaatggagttgtactccctccgtactcataaaggaagtcgtttaggacaatgtttaagtcaaactttgggaatataaatcatgaataactctcaagttgttgagtttgaaaatataaaaattatatgtatagatttgtcttgaaaaatactttcgtaaaagtatacatatatcacttttcaataaatatttttatagaaacaagaagtcaaagttgtgttttggagaccgtgtcgctgtcttaaatgacttcctttacgagtatggagggagtatgtatctttgttaaatttctggattgaaatttctattttctggttttaattcaatctggcacgctttctgtttctgttctgaattattcagctatcaatctgtcaatttctattatcaacttgtcagtctgaatttctgtgtgatgcttagtgtgcactttgcatgcgctgcagcctgaactagtgcacagtcctgcagaacctaatggggccagccagttccactgcaagagggacgggccaatttttctccctggtttccaagtggttcccatctaaattggggcagagggtataggtgacgggttggcccatcccgtcccgttttcggactgatctaccatgacttgaggataactagggaggttcgtgtgccgcataaaaaaagaaaatcagagcacatcttccaaccaaacaaacagctctacatccatcgttctttcaacctgaaagctaagcaagggtccaaacttacactcctgcgccataaaagataaccataactcaaaccacatcttcgaaacaagcagctctaggggtttcaaaaagaaaaagaagaagaagaagaagaagaagaagaagaagaaacaagcagctctacaaccccaaaacgaacttttgggggattttctaaatacttcaatttttccctcaccacaattcgacatgaaacctatcccaaatcacacatccgacctatctatcctggaggtcatagacctagaacagttaagccctccaatctatatccacctactccgaatcgagcacacgaagctacggctacgagactaccacaacagttggcaccaaatcacgcgacaaaaaaaaacattcgaagcgtaaacagatccactacacgagataaacaatttcgcggagtaatatcgagggagaaagagagagagagagagatgagggcaataccgccattgaaggggggtagccgccgccgccgccggtgccggtgctggtcggggatgcgtaggggggaaggcgacgaggcggcctagctagggttttgaggtggggaactccgataccaccgcctgaactaaaagtcgctcgatgggccacagcccatttatcggtttgagcggttcgaataaatccatttatgtccttcgtctttccgtcgagttttactcatgtcactgctctcttcgttccatattactccctccgtatttctctcttcgttccatattactccctccatattttaatgtataacaccgttaattttttgataaagtttaaccattcgttttgttcaaaatttttgtgcaaatatgaaaatatttataaagaacatttgatgataaatcaagtcacaataaaataaataataattacataatttttttaataaaacgaatggtcaaactttagaaaaaatcaacggtaccatacattaaaatatgaaggtagtataatttaaacatgtgatagtggtaggtagatagtcaaaatacgactatctttaaacgggagtatatcttacggcagtatgtcggagagccgtttgcattgccataggacctaatttaacttggttttataagttgaggtccagatttttggtattacggttaagatatattaaacttgacaaaaatatgagggacgtcaagtggaattatttctaagcggtttaaatttggggtcgtgcactctttccttttaaggaccatatttaaaaatgttatgtatataaataatccaaattttctctttttattaacatagtacatatgcagacgtttatataaacatgcgtacacacttacttgcttatcattgaaataataattagccatgaatgtgagtcctatgtaaagtctatgactctaaaacaagcgggcatgttccaccaccagaaacctaaccagtcgagttacgctcgcttcgtaattcaaatttgtttttatttaccataatttatataatgtgttgtcctgttgcagttaaatatagtgtaaacacaatgtaaagaagaaaaatgcagtcccttgtttatttttatttgcaaaataccgttatctataacaagaggggcaaattgatttttaccatttcattcaaagtttgaccttaagcattgactacatgaacctgaaaaaaatattcccgatactaaattctcaatgcacccacatatatcaatagtttacagaagcacttttcaatatttgtttggttctaacacttcttacgtcaaggttggttgcccaaaaaagaagtcataatgtgtaaacacacatgtttatataataatcaattagtttgttggttctaagacgtcctaactcctactcctagctggtcagggttggttgtcctgaagaaaaaagaagcgcacatatatgtaaataattgcatatacatgtacaataataaccgttaagtatatagatatacatgtgttcacaaaatcacagactcacaggcatgtgtttggctagccgtctgaatcaactccatgaaattcggatagccaacgttttgcatcagtactaacttctgccgaactcgtaaacaaaacctaaggccattagccagtaattgttggtgacagaaaacattagccccaaatactgttaaacttctttaaataagaattgttaaatttcataatgaggctttccacgacttgatgtttagctacatttatcacccagttcaattaaattaataaaaccgcaactgtgtagtcacgtagatgacgatttgcagacagagatggcgatgcatgatttcagagctggtcggatgagcaactgaagtgacatagaagtagcagctaacatatatatactccatctatccaaccaatctcgtactagattataacacatcttattactatgaatttagatatccaaattcatcgttttactatgtaacacatcctactatgagattaatttattttatgagattaatttatctttatgtatgctagttctgaagacaatatgtagttaacatgcctaatatgttttggttgcgcactttgttaactagcccccattttttaaaaaaaaagaaaaagaagaagaaaaagctatatatctagagaattttgtatatactatgtgaaataatattatagagctttttgaaacaagggattgtttcatactcattcctttaaattttctatgaaataaaccagtctaagcaattttggggggaaataagcatgagatttcacctcatggtttttcctctttcacgtgttttttctgcgttctaatcgaacgatggttttgtaatttccctatgttgcaaaattcacgaaagttatgttgtgaaattccgtaaaaatccaatgagtatgatagtctatttatacgtttttcttattctaatgtgttttctcagtcctgcgttttaaagggttcttagcccgtgcgaagatggaaacagggaaaaaggttatgtcatatatactccctttatcccattgtaaatgcaaccataaattttcatgtctaattttgatcatccgttttatttaatttttttatgattagtatttttaatgttattagattataaaatatgaatattattttatgtgtgacttatgttttttattatttttttaaaatttttttaaataagacatacgattaaatttggatacggaaacatatggctgcgtttaaaacgagacagatggagtatttgggtaggggattgcatcgaacctcaaaattgactagctagtctattatatttacttgatgaacctagtaggtgtgtaattaagaagatcataggataccggaggttatttatggcgacatgcttgtgatccaccttgatatatatcgttgttaaacaataatgaacaaatgcaattaatggttcagatcgatgaaagtgcttaattaggcttatacgtactaactaaaaagaaggacacgaacagcgttattcatctctgtgttacatatccaaccattttatacttgttagtagtggaggcttacgagtacggatgaacatgaaccggacggataatccatcagaacatatatacacatgtgacaacgttttttcttctcctagaaaagtcaagcatttactccccagctaatcctatgattaagtagtaatacaactccaacgtgttaggtgattcgtttttatttttatttttttggcgcgagtgttaggtgacttgttcgtgcgaatgagacatgcattgcatatacacatgtttttgtttgtttaatttgctccagggactccaggctagccgatcgaagccacttctggtgtctagattagctagtgcctaaaagctggagaacctaatttcagcatcgatcgtctccgccggctaacaaagattccttgtctcatgttgcaatagctagctcacgtaggacatgcaaaaacttaatttacagtatgctttgaaagtataattgcatgaaaacctattagtataaacggctaccggcctgtcattcggcattttttttaagctatagtcgtcatttttatgaccgttggatatgtgttaagattcgtgctggttattggatgcatgataaaattcgtgttagacggccggtaaaaaagatcagcacatgtggtgagttacatttgatatatttttaagggattttcagtcagtcccatgatgtataaaacataccttaatcttaaaaaaaaaattggactaacatatttttgatattgacgaaaacatccgttcaacatatgactatcaacggatatatcatttatatatataactgacaaaacaaaaaacaattagccgtaaatataagtacatgtgttaacttgaatccatatgaactgatcacaccacatcagttgagctacgcttattttgtgtctttcaaaacacatcgtacatttgggctgtgtacatccattatggatgtagaggccggattttaatctattttctaaagaaaaaaacacacatcgtacacacgttccaatcggacactgccaaacgtcttcttcacacactcaagtcatcttatctcctcccggcttccatttttctctacacagaaggttaggtatatctagctaattatcagtactatatatacacacacccaaatccaaaattccaagtgcttaccttagcttagatgcgaccgagcgaccgaccgggtgtagccgcgccgcaacggagttaacattccacccggccgcggtgtaccgtgcaccggtgtacgtacgtggccgccgtgatctacagactacgcgacggtgggccccacccccaacaaccgcggctcgcgcgcgccctctcgttcgcgcgcgccgccacacggatgcctttttttcctctccttttttttctttttgcttggaccataccgaccgagcgagtggacactggccggccgacccgatccgtcctccgccactatacgtgctactgctacctttctgccttttctaccgtgctactggcgcggtgtgactgacgtcacggtgacgtcagccggtaggttcgtttctccgtcgccggggcgtggtaggtgaggccgggccggttggacgtcggagcgggtctccggtccggtccggtctagcccgtggaagcaaacaattgaagaagaattccttttgactctcttttaattaaactattatctctgattgttgttttgatcattcttttttcttttttaccccttccatagatgctacactgcataagtccaagcttagtgaggtgtggtgaccatcgctaagctgatcggaaccgtatttttttttttttggggttggtggtgttgttagattataatccgatttaggctatgttcgctccagcgtgttccgaaaaacagaacgatccattagcatataattaattaagtattagctaattattttttaaacatgatcaatatgatttttttaatcaactttcgtacaaaaacttcttaaaaaaacgcaccgtttagccgtttaaaaagcgtgcgcgcggaaaacattgaagatgagttgagatacctagggtaagaacacggccttagtattggatgtttccttcccttatatagtttcttacgtagtgtccgtttcctgtccgtttcgtaaatattttttttatatctaccaatggtagtgtccgttttgtaaatattttttttataattaccaatggtctttgagaaactctaatatatttcacaaaagatatacctatgtacaaattttctctgaatcgtttctcgttagttttatactccctctaattcatattataagtcgtttgactattttcctgattaaattttattagatttgatcaagtttacagaaatatttagcaacatctaaaatatcacattattatttttattaaatctcacataatatgtttattttgtcttgaaagtactattattttttctataaacaacttataaaaggaaacagagggagtagtaactgtttttgttgttatcgtcaaacttaaatttatttggtattaacacatgcaatgagggaaaaatgtcttattctaaattgggaaaaaaacaattatagccaaaagcttgaggataaagacactccctcatacacgatgtgtcataggtaaacaacaaatatatgaaaccgtcaattctttaggataaaaaatcatactcttgtaaaccaattctaaaaattcagcttgccacatatacacacaaaatgacatacaaaaccaaaatgtcacatcacatatatagaaaacaaatacctaaaaacttggatattccaaccacaccaaacttcttcgccaacagcttccatattttagacatgacatatatgccgtgcaaacgaaaaagatttactctacagcaggcaaggagaaaaggggagatacacgagataaaagtcagtggcctgagagagtgaaaggctgaaactcgagcacaacccaacactgccagcagaaaaaactgaaaaaaccagaaaagccaatggtcaccaaccccaacaaaaaagcgagcgaccaatgcgatgggggttccgtaaaatcccatccccttcccaccctacccaaacacccgctggtataatggggttggtaaacgacgttgacgtggcacccctgccccagtcaacgaaccccccctccctctcaccaacccaatgctcctctcgcttacaggtgggtcccacacgtcatcctctccgggccccgctcaccaactccccccaactcccttctccctcccgctcccgccagtatttaacccctcccaccttccattcctcccctctccaggagacctcgccgccgatcgatcaatcgccgccgccgtctcctcgtgtaaccctagcttagtggattagtttaagtgtttgccggagattatggggtcggtggcggcggaggaggtggtggtgttccggtcgaagctgccggacatcgagatcgacaacagcatgacgctgcaggagtactgcttcgcgaggatggcggaggtcggggcgcggccgtgcctgatcgacgggcagaccggggagtcgtacacgtacgcggaggtggagtccgcgtcgcggcgcgccgcggcggggctccggcggatgggggtgggcaagggcgacgtggtgatgagcctcctccgcaactgccccgagttcgccttctccttcctcggcgcggccaggctgggcgccgccaccacgacggcgaacccgttctacacgccgcacgaggtccaccgccaggcggaggccgcgggcgccagggtgatcgtcaccgaggcgtgcgccgtcgagaaggtgcgggagttcgccgcggagaggggcgtccccgtggtcaccgtggacggcgcgttcgacggctgcgtggagttccgcgaggtgctcgccgcggaggagctcgacgccgacgccgacgtccaccccgacgacgtcgtcgccctccctactcctccggcaccaccggcctccccaagggcgtcatgctcacccaccgcagcctcatcaccagcgtcgcccagca

SEQ ID NO: 19842 - DNA, 7010 bp, Oryza sativa
  unsure (1)..(7010): unsure at all n locations
cacatgtcagactatctgagggatgttctgttcccattttggataactcggtgatcaagcgagcaggggccggctgggttggattattcggatttgtttcgatttggcgttacatatgcgctgtgcttgtgtccgtagatttgttcacttgtgtgcaactgtgagctactactactggtaatagtgttatgctgctcggtgtggggcccacctcccacaggcatcgtcacctaacaacggtgtctggttgtggcccctgcgtcaagattcgtgcatggtcatccatgagttttggcgccaacggccaagctatttcaaacatgagttaatatagtattatcgagtagtaactaaacgtgatcaaattttcattctttttttggttcatgaaggtggatggagagaaccctaacctgtacttcagcaaggatgatgttatactatgcctgctgccactgttccacatctactcgctcaactccgtgctgctggctggcctgcgtgccgggtcgaccatcgtgatcatgcggaagtttgatcttggcgcgctcgtcgaccttgtgcgcaagcacaacatcaccatcgcccccttcgtgccccccatcgtggtggagatcgccaagagcccccgcgtcaccgcggaggacctcgcctccatccgcatggtcatgtccggtgccgcgcccatggggaaggaccttcaggatgcattcatggccaagatccccaatgccgtcctcggacaggtaaattgatgccacattacaatcattgcgcggacgaaaacaaaatctcctctctctctctttttttttgagtcactgacaagttagtccgtcatatcccttcttctttagggttacggtatgactgaggctgggccagtgctggcaatgtgcctggcgtttgccaaggagcccttcaaggttaagtccgggtcgtgcggtacagtggtgcgcaacgcggagctgaagatcgtcgaccccgacaccggcacctccctcggccggaaccagtccggcgagatctgcatccgcggagaacagatcatgaaaggtacacacatcacccacccccacccaggccaaaccctccattgatctctagataggatgtcaataccctgacgctgacgtggcgcaaaacgacacaaggccgttggacactcgcctctcccactgttgggtgggcccggggtggcgacttctctcccgcacacttggctttcaggtcgtacatggcgtcttgctgcgagctgagtgaacaaacttgctgcagcttaatttggtgcataggttggaaaccaactcgtttggtcccctgcgattaggccaaaacacatgtttttacatgcgacgatgagtcgtcgtcgtgattttggattggtctctaccaagccacaaacgtggtagtctagctgccagtaccagtagggtaggttccagtttccaccgactgaatctgaattctttcggagaaattctgtgcaaaaccagctgaaaaatcgatatcgtctccgatttctttgaacagaggaaggttctgattctttttttttttttggcttttgaaacgtggttagtggctgatgttgaggggtcggaatttcccgtactggaaacagttgaggtgttgctgattaggtggttcgttgggagatcctttttattaaaaaagaagtggacagattagtggtttggtccaagctccatggcgatgattgcctgaacagctgaaagaggagagaggaatttccgtccactccacgtctttttttctctgatttatttgtggtagcagtgacctcgcgtggttgttggcacgcaccagctcgcatcctagcttgcagccacacaacgacgcacgttgctactgcaaaatcatgctcatcatcatcatcgcagtggcacgatcctggaatccaagttgcgatgcttcttcaagcagatgaaagaatgggggaaaagagagagagagagagagagattagagcaagtgtgtctgccacatggatgatctgaagatcagaaaattcaggaagtgaggttccactaatgtttgttttcgcaatgcgtttttggacaaggcattattgcaattaggaacctggcaggtcaaaggcttttgggtgaggcgaacatgggcattggcaatttaggcttatgcgtctagtatgcgtgtgttcggtagtgggcttatagttggacatgacatcaagcaaaggagaagtggcagcttatcctgaccgtatcttatctcagttctcaccatgtggatgtcatgtccattgttcacaacttattttttctgaagatttcttcttttgaggacttgttctgaacctgtttctctgaagaactgttctgaacttgtttctctgaagaactgttctgaacttgtttctctgaagaactgttctgaacttctaattgattggatatttagttggcatagtcaaacctgtactacttacatggtacacaataaattatgtctactggttttaaaatggttgatgttgtcatgcgggccaagagacagctggtaccggttaattagaacgagatgttttctttttctaagcctttcctttcaagttcctttcagaagtttgttaggttctagtttacctatcaacggatcattggttggtatctgcttggcgtgcaaagtggagatcacatcaatttcagtcgccagccatgcttcagttctcctgcatctttctgttcatcaaccactactataatgaaacccaaaccaaaccaaacacccaaagcttagctagtcttctagtattaatcaataccacaccatcatgtgaagcaagtgtcaccatcacataatgcaggattagcatggacatggcatctcaagtaccaagttgaataaggaggtatccaattagcactgctgcatctcagaaagcattgcacaattcatagttagaacaggccaaatgagtggtccatcaacctaattgctgtcactggcttggaaatgtttggtggcccatcatgtgaaattgtgaacaagaaaagccacagttgggtgactgctccagttgctcaaagtccagcctgaaaatcaatcaaagaaagatggcaatggcgtcacaagtcaatcctaacctttgtcccattaaatttgaagagtctatctgaccaaaccaaactctagttggtacagtaggtacaaatcccaagactctttggtttggttgatggatgcagccgccagcatcctggatatctttgtgaagtttttacctttttttttactttgaataaaacttagaattctaccagtgctgcaaaaacaacagaaaattcagaaaatgattgccacttcaatgctggcaccaaacaagaatcacctgaaaaataagttcagtaccctgccaattgccatgtgcatgtacacatctgaaaaccaatgactctccttgacgttaacagttacagcttagctctgccatgtgcgtgcatgcactgatgcaaagctggatccgatgtttcctttggattatttgatctgcagtacagaattttgtcaccactgaaactgtcttctccttcagaaacagcaggaaatgattcttggccgtactgacgagctgtggggaattttgcaggctatctgaatgatcctgaggcgaccaagaacaccatcgacgaggacgggtggctgcacaccggagacatcggcttcgtcgacgacgacgacgagatcttcatcgtggacaggctcaaggagatcatcaagtacaaggggttccaggtgccaccggccgagctggaggcgctgctcatcactcacccggagatcaaggacgccgccgtcgtctcgtgagtccatctctgatgaaattcgccattgattaatcgcgagagaatgtagtgaactgtcactgattcagttgctggtgaaacttgttttcaggatgaaggatgatcttgccggtgaagtgccagtcgccttcattgtccggacagaaggctcagaaatcaccgaggatgagatcaagaaattcgttgcaaaagaggtactaatcacatgcaaatgacagcaacaaggattctgatttaaatcttgctaaaatttttctgacacgtttgcaacaggtggtgttctacaagaggatcaacaaggtgttcttcaccgattccatccccaagaacccttccggcaagatcctcaggaaggacttgagagccaggctcgccgccggcatccccgacgccgtcgccgccgccgccgccgatgcgcccaaaagcagctaaggccaacgccgacgttttctctattttcagtcacacaaccggtgaaaaaaaaatgcagagatatgatgttgctgtccatgaaaatggaggcagaaatggagcagaggaagtttatagtttggtttgttggttggttgatgctgctgcagcagcttgtgcaatgttcataaaatggcattaataatattattattattattatacatagatgatgtattgtttttgaccataagaacaaggctgattacaaaataatacagtgtattaattacgccctgtttctctctactttggagattccagatgcttccttttacacttggcctagtttcggaccaaaaaaatgggtgaaatttgattgcatttgagtggcatttcagggagaaaattattttctggaacatatgcttttgaaaaaggccccagtatttgagtatttcaacctcaaaatggagctggcccactatatttcacgtgaagcccaagagacatcgaggcccatgtaaggcacagtaaacgggccatttcgaagggaaagcctcacggtcgttggcctcgtttggtttcatggccataccatttgtgcaacaattggctaaccattttccaaacaaaattcagttttgaagaacaaatacctgcaaaaatttcacctccctccatttttcatataaccgaaatctatgataaggcaataggcagactattgatttgtctatagttagggctacatagtttgtgaatgttcttttcaaattatgcaacagattatttgcttcacattcaaaaaatatgtttttttcaaaaaaaaatagagactttcttccactgggtagtgtttgaatatcctgaaaataaagatgaagataaagattaagtgtttcacgtaaaatgaggtggtaataatatgtgattaattgagtaactcttacaaacttgaaaaatgaattaatctgatagtttagaacaactttcacataaaaagttttcgcacgaaacacaccgtttaacagtttgaaaagcgtgtcattttaatacaaaatttcatccactcttttcagtggattcgaacggggcctcgtgaattgataagaccaagtaatctgttaagtttctttctcaaaatttttaatttatctataaaactaaatagataatccgtgactcttaaattcttaataatctacaataaactgggtatggtagattggtaggtagctagtcgaggaatcaggacttcttctgtcacctatttatttctctagtcaaaggtttgctatctatcacctattttatttctcttcctttcgattgtatatgatctatgtagtgaaagtgagatcaaaaaacaaaattggagttcataacttttttatttttgctcttccattatctgaaaacttacatagtctgcaatgtcagacgttgctaaaaagcagccatacgtagcttcaaattacatatgtacttgctggcctcctatagctagtagctataattctgagatgtatctgaacatacttatattcagattcatctctatctctagaattagagatttctagtgcggagaggtagctagtactgccgcgcgcgggcagctgcggcggtggccggccggcgagtagaggcggaagaggcggcgggcggagaaggcggagaggacggccatgccggcggcggcgaggaagctgcagagcatgccggcggcggcctgctcgcagaagcgggtgtagatgttgcagagcttgctccactgcaaggcctccacgccgatcagccccaccatacacgcctgcagcgccgccgccgtgctcgcgaacaccacgtacgcgcatccctgcgtgcatcaccaaatcgatcacaatgggaagaaacaaaacaaactcatgatcaattacaaatcgctattatgctggtttttttttctagctagctagctaccacttgaccaacaagttggattcttaattaattttactgcaagagttttccaccatggaacttgaagtcaagtactacctccatcgtgctataatataaacttttagcgttgacacgagtattaataaaatatttaaaattcaataagaaaatattgtgagtggtcgataagtagaagcctacgagaaaatcgaatggtgaaaagttatgtttggttgaaaagataacattgatcgagacgtcattatattttaagataaattatatttcctccgtcttaaaatataagaatctagaactggacgagacatttcctagacagagaattgttctatccgattttaggttcttgtatttgtattttagaaccgattttaggttcttgtatttgtattttagaacggagagagtaaggatggattgaataaaatatattttgaagaaaagatcgatgtggactagnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19843 - DNA, 2074 bp, Oryza sativa
tcaaaatatatccttggggttttgtgaaattttgatcgtaatacctaagattttgtaggttttgttttagaaaaaactaaggtcttatagaatttacttaaaaaaagcatatacaacagactatgctttttggtacgtagtgtgtcttgatgagctcaaccttagtctctcgcaatctatactacaggaatgagcatcctatgctgttgagatctctctatattttctcttgttgagttttgagacacgctgcttatctagtattaattgctaggggactgcatggtactagctatagcaagtgcggttacttataaaaaaactagaatattagggaaggacctaatatcaaataattagaaggggtgaggttttgaacccagatcgtctagcccaccaccttgtgaagctagctggaagacccctggtcatttctcaagtgcggttacttataaagagaacaagacactatagagccttaattttcaacacacactatcatattttttgcattagaagcacaagattggaatagttatgtcaatcgatagtacacgcttaaatgtgtatagcctagtacttctcctgacataattgctatcattaaattttgatcgcatccaagaatatatatgtccaacaaaaagctcgatcgcttagcccgccaactttgcaaaaatgaaatgaaaaaaataggagtattggcctaagttattgatcggtacctcctcctcaagaatcgtaaaggagatttcatataaacagtaattaagaagataccacaaaagcaaatacaggtacatttcatcatcatttggaaattgccatgtcaccagtcaccactgcattgtacatatatatcaccattgcatgtaaaacttttttctactttaagattatatatagttcacatcaacagaggcgcgattacaattaataccatccacaagaatttaaatcttggtgttcatagatatatgcacgttactatgcttttaatcagagtttgtctccttaagtttaagtgtgtgtccacgctcatggtcatgggtgtgtggatatatagtggtgtgtgcgtctttctctatatataaattagtaatatgcctatgttttagaataggcagatcctatataattgggaattgcatggatagttggattatattgaggataaagcatgggactgtttgggtgagtggattaagaataaaatactatatcctacatatgtgtatgtggttaattatgtacgtatacataaagaagcggatgacttcgtttttaaaagtagtagagataaaataatatttttttcttttgaattatatgaaaaaggagtggtgagtggatcagttctcactgcagcgcggctatacaaacgctccattaagtttgggtatagacatgattggatgttcctctaaataaagaccaatggtttccttagagaacctgtttggacgagcagtacaggccagtaactcgacatgcagtaattttgtcagtgcattaatgccaattataaattttgttatatcatattaattataattaatcatgcatgtctctttggtacaagctagggcactctcaacgaccatggacagtgtcaatagaagtattatcgacatcctaattaaaatataaaaaagttttagggttagatacgggtatcaaattaaaaggtaggtaattaaatatgtgatgattgtgattgattgagaagggaataagttgttactattttaggataggaaaaagtacgaattaccccccgaactatcatggtcgtctgaattacccccgaaccataaaaccgggcattcttcaccctcaactatacaaaccggacaaattacccccctcgacccaatccgcggtggttttggtccacgtggcgtacgcgtggcagtctcgtcagcactctatttataaaaaaatattgtgggacccacctgtcatctcctcatcctctcatcctctctcttctctctctcactcttcctctctctcaaacgggaggacgcgcggcagcgtgagggggaggacacgagcacccggcggcggatgc

SEQ ID NO: 19844 - DNA, 62172 bp, Oryza sativa
  unsure (1)..(62172): unsure at all n locations
cgaggggggtaatttgtccggtttgtatagttgagggtgaagaatgcccggttttgtggttcgggggggtaattcagacgaccgcgatagtttaggggggtaattcgtactttttcctttagaataaatgttagaggctagaagttgttatattttgggacgaagggagtattactacttagcaaagaagaagcagtaatatggtacgtatctataattctctgcatgatatggtatggtaatacaacatatatatgtccgataatgttaatattgattatatccattatagataccaagcattaagggtgttgcacctaagactaattttagaagacatgaaaattatgagcatggtaattgattaggtggctagtccgggaaaaattgaaagtgatcctggaaatgatatataaacgctatctaatcttatatgaaacttcttggttcgtatcctagcttatctctcaagttctttttgacaggggcatctagaagtataaaatacaagacctctcagaagaaattaagacatcataatctcaatatgatatggtataataatttgtatgagtcataagccgcattgaatcaacttctgaaagatcctcaagagctagctgagctaggcctcgaccatatcgtctagatctagtgtcactgacgacatatagcttagggttttcaccttataccatatactcgttcctgtactcgcctagattcatatgtccacaacatacaaacagctagttttgcaaaattaattaatttactcagattaacagttttttcttctgtttgatccacacaatattaattgtctagtgtgaccacactgcctactgcctccgatgagatcattagaggatcgagcagcagggaaatctgcagctagctcgatctgcaatatcaactggtagctatctgggagtatatcgttggcgcatatgcatcacgcatgcttatcaagccgcatgcaccgcgtgcgtgaaccaggggagaatgatcatgtctcccacctgtatgtttctctccttacatcgtgtgcaaaacttcatttaaaaaaagtactccatccgtcccaaaatataaaaacctagagtcggatgagacattttctagtgttacgaatctggacataccacatgtctagattcatacctgcggtcctgttcttttctccaacaagagttggatgaagattaagattttcgtggcacgtttttcgaactgctaaaggtacgtttcgtgcgaaaactttctatatgaaagttgctctaaaatatcatattaatctatttttcaagtttgtaataattaaaactcaatcaattatacgttaatattacgtcgttttgcgtaaaaaacttaatcttcatcttcatcttcattttcaggagaaatgaacacgagtattaccaccatttgtcaataaaagttatcgtatttgcttagcattaggtgatcaaaatctttatcacacgtaacttatcaagtctgagagaatctttccacacttttttttaagtcatgacgcgtgaaacctagctaatttattggaaggaaatctctccacaactacgtctgaaccaagtaactcttaagttgatcaagcttatctaacccataagcatgacaaactgtaacaaaatgtggctaccagccagacaactcctaaatataaatatttctagtttggttagcaaagattaatgataaggagaaccagtcacctcattaatattagtccctcctaacacttgattggctgaaaataattcgatttcatgcaatgtacttatatagtgtgtatataatttaaataatagaaatgcttgtatttgggagtggagggaggtacatagttggaaatattttgatgatatgcaatgtgcagcaagtgcagtacaaacatcacatgcaatggcattactgttcactggagagtatcctaaattccagagggggaaagatttgacagcacaaagagggtatttaagtgtgggcaggcaattactgcctaaccaatttactgttacatgcgtagtatgcatgtcgacgggaggagaggacagaggattgtggtagagctgctgctcactattatatggctgtgtgtttagatataaagtttggatctaaacttcagttatttttcatcacatcaatctgtcatacacacacaacttttcggtcacatcatttctaatttcaaccaaaatccaaactttgcgttgaactaaacacagcctatgtgtagtattcacaagtgctattcctatacctagctattactccatgtagctagctagggagcttgagtaggagtatgaagtaaggaacccacataataattaatagccgtttgtggtttttaaaattaattaatgctactaattaattgaacttgtttcagtcgtaacagtaatctccaccaaaacaatccttttattattttcaagtaaagagtgttttgatatatacatatttcccaatttcaattttgcattgtgcattctagaaattaaaacagaggtttaaagtgagaacaataatgaaaaccgtatcaacttattgggcacgaaagctcttttttctccaccgagaaaactaagtattcttcacttaaaatcgtgttctgcactgtaatttctaaatgtttttccataaactaatttatttttaataaataaataaaaatttagtggtgtagaattcgtggaatgctcagatcacttatgctacaactcgatcctaccccctcatgtcttaagcgttgaataaaagtgtttacaactttttatttaattgaacctaagacaagatttaaattcgagacatttggttctgatacctattaaatcgcctacatttatataagggttaattgaatttataccattataaatttgccatttttaataaatgtcattactatattcatcgatgtgtatccatgcctcctaaatatgtacaaaattagaacataccatcacatcatattttctgtcatcatatagaccaaaatatctctagatgtgggaccgacatgtcagttcaattttcttccttcatcgtcccctctcctctcttccccatctcgttgagctagatgcggtgggcggcgagaagggcactgatgagggaggcgaatggggaggtggcagccagcgcggtggcgcaagtgctggctccaattcacacgtagaacatctacgccgtccagctgccaacacgtggccatctcggtgcagtacagggagtgggagccagctcctgcaccgacttcacggcgacggggacaaccaccacacgaccgactccctatgtaggcaatgacggggcgatggcgtaggcatactactgctatggccggccttcccgtgtccccacgcctcacggtcaccggcgtgtggggcggcgatagcgtcagcgccgctgctgtggccggcctccccgcgtcctcacgcctcaccatcaccgacgtgtggggtggcaatggcgttagcccgctgctatggcctatggccggctagcaggagggaagggagagagggaggaggagaagaagaaattggggatgaggacggaaaatatgatggtgatgatgatcgtaatcctattctaatgacatggatataaatagataaataataatggcatttatctaaaatgacatatttagcatagattcaatttaatcctttatataattaagcaccaatgagtttaatcaaaagcttaatacgatgaactaaaagttgaagaggtaatgacagacgattcacttgctctgacgctctcgatcgatcgttctttttcttatttatttttcaaattaaagaggactacatagctagaagcaagtatgcaacagctaactaaatatcgtgcacattacgtggatcttgctttagctagggatcatatctgtagctgcgtcattaatgtatttgatacgaaattacgccgctgtcgatcgatgcgaaggagttaattaatgtgcgcgaggtacacttgtacgtttacgcatggataccgacgcccacaaaacgcctgcgaattcactaccagagcttgtgaagctgccgtgtgcctcaccctgttaccgggagtttttgctagtactcggtgacttaccgagagtagcacgttgcacccggtaacattgcaaacataccgtgtgttagcgacgaaaaaaactcgggaagacaaaaatacgctatgccatgccaaaccgctcggtaaccatgggacccaccgtttctaccgtggcttggcgcagattttttttttgcttggcgggcggtgatttccgttggcgtaggtggatggcgcgcggtgtttttttttggcacggggtgtgttttttttttacgacgcgtgaaatttccattggcggggccggggtggacggcgcgtgaaatttctttggcgcccgatgatttccgttggcgcgagcggatgacgcgccacgatttttggctgcacagtaaattttcgagtgggccagtaaaaagttggcccaaatagcaccacaaaaccctacccctgaactgctcccccttctcttctccagtctccccctccgccgccgcctcgctctcctctcatcgcctcctcacatttcccctctccgccggccttgtcgcaggcagccatcccagccatgcgaccgcgcgtccctatcctcatcccttcacacgggcggcgagcacggccctgcacgtccacgtccatccattgcgatttatacgccattgtctatccgttcaacaaggctcccaatcatcatcgagctaggcattgaggcctgctgcaactgcttcctcccaatctgtgtggtatgcgtatgttgagtggttcttgcatctttatgcaaatatggttcttgattttggaaaaatacacttcattttctctttggatctagtaatatggtgacatcctaatgggcgctatgctgcatctagatccacgacgccgtgacgtgccccatccagttggaggctgcagctggtgccgtgcatcccctttcctcccggagggacgcaacatttttcaggttgtactgatttctctatgtgcctgcaattttaatttatatgagagatgctctgagcgacacaactagcagcacaggaatgctgcggcggcagcagtcgcgaggcttgccgactggctcagggagttgatgtgagcagagcaaagagaaagaatgcacaactctggtttcttaacagcaaagaaggatgtaattcttttccacttttattttctgttgcttaatctttggttaagtgtttccccggtcgccaagtttagaaattgtggttagaaatttcttgttctttagtgcacatatgtacttcaattatcacaagtgaagttctgaattctagctcatcctatttcttagttaatactcaattattatttctctgtcatcaaaagaacacagttgagataatttgcaactaaaaaaatattattacaaaaaaaagaatagtttatttttcacccatatcagaggcttacattctagatgaaatcttaaatttcacatccatatactttggcctagtttagttcccaactttttcttcaaacttccaacttttccatcacatcgaaactttccttcacacataaacttccaacttttttcttcaaacttccaattttagtcaaacttccaatcctttgttgattgagtgcggacaatgcataatcatgtcccttgatacaaatgtcactgcttagcctactggtggctgtagaccatgcatatcctcatatcatattaggaaatctagctagcttcagttctgaaactctagaatagtaatgcaaaccaattaattacttgataactttagttctgaaactcaatatttccataataaacagtgccttggtcaagaacttgacaatgattttgagaaggttgccattagcaggaatactgaagaaatttgcaatgacaaggacttgaaaattctcaatgaatcatctgttcaacatgatgacaatgactgcaaaatcctactgttctaattcatccatagaaatatcttgtttgacgaatatttctaaggtacacacttcacttagttggagatcacaatgcaaaattgttgtaacctgcctcccaagtcccaaatgaaaatttattttgtgaactacccacaaatagtgacctctaaataatctagttgtgttgtaatcttatttggcactaaacatgtttttttataatttcaggcatataacaatcatggcaaaacactaaagagttgatctgtgatgtcaatgaacacatttggttagtcggccactagcatttgtctatatattgcctcattgggagaggttgtaagaattgagaatcatatattctactgcatcatgtgcagtgagtttgtagattcattaatattttgttattgtaccatgatgttcctattaatactgggagaatttgcagctaatgtccacatgacatgttcctgtgatgtatccttgcgctctgcttttcatgtttgcctattgctgcgtttcagtgttgtacgataatgaatttatgaaatttctagaatcacgtattcaatattacctagtgttaatagctctcggtaagttatctaacggtaccgtgtgtttgactacaacacacggtaacattttattccttcccgtgagttagtacctctcggtaacacccccgttccgtttccgcaacccatcctgtgccggacaatacattgttaccgagaaagtgctttcacccggtaatttttcttgtcataccgagtgtacaagcgtagtctcacgggaaatattgcacggtaaaggtgtcaggccgctgagtgtctgctctcgggaagctctgttcccgtgttttttcgctgtgttaccgagagcttttggcacacagtagcttccctctccctggtagtgaagttgcaatgcgtttatgcttccctattcgagctgtgtttaggctgtgtttagtttctaaaattggggagaagtttagaaaagttgatagtttggaaaaaaagttgggagtttatgtgtgtaggaaaattttggatgtgatgtgatgtgatgtaatggaaagttgggagttgggggaaagtttggtgtgaaataaacagagccttagttcacgtcaaaattgaaagtttgattgaaattggaatgatgcgatggaaaagtttgaaggttatatgttgtggacccccgtttttataacaggaatcaatcgtgtaaacagtatcatttccctagatcaagtagtctggtacgcacgaactcatagctgaaatatcaagtgcacatacacgagagtctagtacgaattattacatcataagcccgcaggcacagtcttaaatcatcggaccgagcggttcggaatacattccaaaaacagaagtaggtaaggcagcggagttaaagcagcggcacgccattgccacaggcaacgaccgtaactaagacctactgagtgccatcgtcttcatctccctcctagtagtaggcatagggatcctccgaagcttcatctcccgcttttgattaattttatatttgcaagggtgagtaccaaccgtactcagcaagacaccacagcaatgatgcacatgacagaggaattcaaaggatggctatggttcttttgcgcaaagcaagttttgtaattcttttcacaagcctaagacctagcatagactgatcaagttttaataccagtgttcatattaaacaatgacggttctgtccaccatccattgtgatcccaaggatagcttcccaccattgagtcgttatggttttctcaggacgtccacattcccgcctctcaggaagtggctccatcagcataaaaatcatcatgcaatatcccatcccacacaagttaaaggatttagagtctagccaagtgtaatacatgtcccggtgctcaataaccgcgagcatggctattcgaatagatttggttttactcacactgcagtggatgtacactttacccgcactccgcgactgcccaacacatgagcctcgtcccaacacatgagacgcgccacggcaaagccttttgataacctcgcattggcagtacccgctccatgaacttaaattctcatgcactctaggcgtccatgtttctagcagtgagaggagttctggcgctcccgggaaagagaagtctcacacacatattaaattatggctcaagttaagttctctctctcacacactcatggcagtcctaccaatggcgacaccgatgtagggcacgcctctcggccctacctcaacggctatcccaccgtagcgcacctgcctcactcaggggtgaaccatctatgcagggatactgcctccgctcggctatctactccgctaggtctatacccatacgagaagtacggttgtacgagggtcgtttcatgcttaacttcatggctcggtccttaattgaccggggacggtactagccttttccagataccacccaaatcctccgtccgccccagtcgaaaacagttatttagtttatttctcctttcacaaatcatgtcctcaatatcatggcaatgtggcgctcatgtctccacatgccgcatctcaattaccttcccaaagataattgcccaagcatatagcatttgacaaatatgagtatgcatgattctagaatagcatttctaagcatttttcatagttgactagggactcatacgtaaacatggttacgaaggaataaggggcaaacaataatcaaggcatggcataatcacaagtaggatgttcatcattgcatgcaattttatttgtaaacaaaacaatttcgcaattgggatcaacatgttcaaggaatagtgatgacttgccttgctcaaagtcttgcgggtcttggccttcacttggatccgcaactccctcgggctctatagttacgtgcgaaaattgatttgaattcggttagaattcaaataaaaatccaaataaatccaaatggaagtcgaacgcgtaagtcgattcttttatattaactttactattcgcgaactagggcaaacccaatttcgatttttatatcctaaactattttgcgggtataaatattttgttatcataagtttttaatttaatctacccgagcattatatccatataataggttggaaatttctatcgcaagctaaatatcggacggaatcctaaaattatcttataatattatacgatttaatttttgtctaggactaaacgactaaatataatatacgtctaaaatttctagtgattaaatccgaatttctaacgtgaatcaattacttatagagattacccaaaataatctataatagtctataagaattcatctaatcgtttagttcttaattacatttaaactactaccgcgaattgatttcctgtagaaattacctagaataatctataatttatattaaatttcttaattctacgtctataactagtctataaccaaatgctaattattttaaattttctaaacttccctaatctccctctaatttcctatctatttcccttttctttttcttcccttctttttcttttttccttcctttctttttctttttttttctttctctctctcttttcttttctttttccttctctctctcccttttcttttctttttccttctccctctccctcccggtttctctcctccttccttcgactttctctccctcggtttctccctctctctctctctctctctctcggctctctgctacccggggcggcgacggcggccgagcaagtggaggaagcggcggcttaccgacggcggtggcggcaacggcggcgacggcgacggtggcgacgtcnacgcaaggtgtggcgcggcgcggcggcttcgtggcggcggcgcggaggctctatgcgatggcgaggcggcgtggaggcggcggcgtggtggcgtggtaaaggagaggaggtgaggatgaaagggaagagtgggagtaggggggcttatataagggagggggagagagataatggggaagaggggagaggggcggtggcctcatggcgtcgacggggtggcgcggcgcagggctcgacacggcgatgtgacgaccacgcggcgcggtagggcgcagggcgcgaggagaagcaacagcgcggcagcagcgacggcacggggctcgagggcgcggcgcggcaggtgatgcaacgcgcgatgccgatggcgcggcagcggcgacgcgacggccgaacggcgatggcgcgcggcgatggaacgggtggcgcggcgcggtaacagcggcggcacggggctcgggggagcggcgcggcacggggcgcgaggcgacgacggcgacggctcggcggtagcggcggtgcgcggcgcaaggcgatggaacggcggcgcggcgacgcgacggaaacgacggcgacggcagcacggggttaggggcggccaggcgcggtgatggcgacggcgtcggcagaggggaggcggatcagcgcgcggcgcggggggcgcgagggcaacgcggcaaaggaggggctagggctaggggacctcgtcgaacactttaggtgcaatgaacagtgccgttttctaattaacccgatgttggcccatttattatttaaatttgattctttaattcccaaattttgcataaatgaagtatactcaatatttgtgccattctaatccatggattcattctagattaatttattccatgttttatatattattattgtaatttacttgaacttaattagagttaattctcattccattgcttttaaatttgatggatataaatatggtcgtaataatattttactcatttctatcctcaccaaatcttattttaaattgcactttaattatttactttgtccatttaccttttagggtttattcttaaccaattatccattattcgcgatttataaactccgaacccaaactccaataaaataatcgaataaaatcggcatgatgcaatttatttaaaaagtttttgaaaatccgcatttttagagtttagatttttgttgtcgaattttcagggtattacatatgtgtaggaaagttttgatgtgatggaaaagttgtaagtttgaagaaatattttgaactaaacacggcgtcgattcgatttcatatgcaaaacgcaacgcacgcacgctagcttagctctagctacatgtgctactatagccacacaagtacgtgccatttaattacgcgcccaattcgatcgggatcatcatttcattaagacggggagtcttgtcgtcgcgtcgtacagtgtaaactaatgagggggggctgtacgtactactgttaattcgatcgatcaatggcagggtaacttggttaattaattctccccatgtcaatttattggtgctttgcatgtacacatatcggtctcttgccctgttgcatgccaatcgttatcattgttacacttaatgtatctctgaagaatcatcggttcatctaggacagtcctagggcaagccactgtgggtgggtttataagatcatgtggttaccacatggttatcgtggttatctcgtgcggtaatcttttcggtttttgaaatcttacagttttttaagttaagttcatggatttgacggtaactatgcggttactgcgttaaccgtgatacaaccgggtagaaggtaaccctcaccaaaagggtaagaaattaaatacatattgtctataagcatcattctattcgagattcgaccaactcaaactattgtatgtgtccaaatatacttctcaactccaaaattgagtattgagtacctctcgccggttccaaatcaagatagttaaaaccctatatggtgcttgtgtggtggtagttcagtcatccaaaaaccacccccaaatatcgggaaattattctaatccctcgaggggatattccctcgtttccttaaaaaccatttaaacggttataaaaaattctggaaaaatttgacaacattcatatatacaactacacaaaatcttaagttcaaactcaactcacacatcgagatataaaaaagagaaattcagcgtatgaatagtagcgtactgtttatatctaaatttatctttttttgtttctcgatgtgtaggtcgaatttgaacttgaattttggtggagtagtaggtatcattatactccacattatcaatttttttcagaatttttcactactatttgcatcgaatttggaagaaaaaggtatacgaggggatatcccctcgagggattagaatccattcccctaaatatctcccccccccccctaccaaaaaaaaataccgaattaattctaaaatcaagttctaaataccctcacaagtcaagttctaaaatttaaaattaattgattatggtttataagccaaaacacaaatgggcaagacaagtagttattactataagcttactgctacatggcatatataactcccagtattcaatatctgctgatgtcctggaattaattgcacaatcacataggcaaaagagctggtgttggcacatgattaatattattttatacacacaaaatataatattttttccatgtaattatttcaaagcctagttttgcataaaatggcacataaaatcggacattttccataaatttagcaaatgtttttttctaaaaagttatatattcctatgcgcatggcacagattaacaccacacgacatatgtccggttgatcccagtcactgtggcagtctgccagcaggaaataacttattacaatgtggttttactctgcccaatcataagtaaataaggcagcacccgtacaaaaatttgcacgaatcccgacatcgatcgatcgaatcgagactggagaaatcatcagaaatgtaatgcggcaaaagtgaaaagccgtacgttgatatctcgagtctgaattattaattgaccaacggtattgcttctggatagagaggccaaatcaattctcttgcagttctcctcagctagctatcgtcgtcgatcgatctacaccacgattcatctgctagctagccgcagctcaaatcttgtttaaagctgctctcttcagtcttcactgctactgccacacacgcattattccggtccatattgatcatatgcattcatcagtttgcagatttgcagttgcgcagaattgaatcaattttaatcaattcatctggatcatcgcagcagctgggagagctatgggtgtatttagttcgcgaaaagaaaatttttcggtgtcacatcgatcaaacgtttgaccggatgtcgaaaggagttttcggacacgaatgaaaaaactaattttataacttgcctgaaaaccgcgagacgaatttattaagcctaattaatccgttattagcatatgtacttatggctaattatgaactaattagattcaaaagattcgtctcgcgatttccatgtaaactgtgcaattaatttttttatcaatatttaatgctccacgcatatgtccaaagatttgatatgacgtgtttgggcaaatttttttttttggaactaacaaggcctatatgagctaggctgcatacaaatgttcatcgtcagaactgttcagagattaattcagagcttactcgagtccaaattggcgattgatatcgatcgattgacttgtagatatataaatattaatttcctccgtttagaaatatagcaacttaattactgatcaattagacacaatctattactacgaattcgatcggacagtggtgatagcccttttgcagatttgcagtggcagatcgaattaaatcaatttaatcaattgcagcagctgggaagctatactactccagctatgtatatagagccaatcgcttagctatgtatataggctgcatatgttcatcgtcagaactgttcagagattaattcagagtttactcgagtcgaaattgacgatcgatccacaacttgtagatataaatatattgctagatgaacagtggctgtagcccttttcaaaggcaatcatctttttgctgatcgaaaaaagaaaacagttacacatatattgtagcatgtgtaggcatggtaccatggatatggcccaatgctgatgtgacatatatatatatggtgtcagggtgttttacacatgcatggtcgtttgcttgtttggatcgaaggtttcagttactactgctatacatgaaaaagaagtcaatactgtagcaaatggatgcatgcatctgcattctagctaggtgatagacagaagagttcttcttcagaacctgcatggaatagcctgctccatgagcaatttttttctgactctccttatttgctttatggctaataaaccatgaaaaaaatgaatggataaataaaaataattcatagttaattaaaactgttatatttttgttcctataagtttaaaagctaatgctagaaaataaattacgatgaaaaaccttaaagtaaactctgaaactaagttttaaaattcaaattttgattgcgtcagataaaccaacaagcaaatgatggagcattttgtttttgaatgctataagtaaattgaggttgtgtttttctcccaatgggttgggagaaaagatatctcattctcaacacgcatgccttctgaactaaagtaaattgaggttgtgtttttctcccaatgggttgggagaaaagatatctcattctcaacacgcacgccttctgaactatttgacagtacgttggttgcaaaaaattctctataggaaagttgctttaaaaattatattaatatatttttaagtttaaaataataaatagtcaactaattatgtactaatagctcacttggttttacgtatcttatcaatcttcttttcccccttctctcacagcctcatcggttgcccatattatctaatataagttgtttattagggaataaaaaataatatataggtaaaacttttgtatatgtgttcttagcgacttaaaagccaatataaaaaaactgcgtcaaaattgtcttaaaattaacttcaaatttaagtttaaaattttaaattttgactttatctttgattaataattaggtcaacagtcgaaacccctcaattctccaacacaattaggtcaacagacgaaacccctcaattctccaacacaacctgagactattgggctttatttccattatgtgacagagccaactgaaaggcccaaaaccaacagcttggcccattttcaagacagcccaacaggcctctcgcaatttccgttgaaagtagtagtaacgttcgttttcgcatcttcttttttcttaacacagtttttttttctttttttttaaaaaaaaacatgctcttgttggtgaattgaatcggttgtctctgctgcagggtgtaactcaggtaggatagtaaagccttttcaagttggctattcttttaggtttgaagtttctgttttcctttgctgcaaaaaaataaatacaaaagtctacaatggctcacagctggtcagaaaattagaccaacataatgaaaacgcatgacctgttctgatcaacagcagcacatagaaatattcttcttcttcttaattttccagccaaaaaataacctaaataataccctggaatcaatctacatacgtgcaagcactttgctgctttcaaaaaaatattataattttctttatgtacgtatgggttagctgcggcaaaccttgaatcagtacttcaacagattttttttttttgaaaattttattatatatgaaattgacgtgaaacaattcaaactctggaacaattttttttccctctttgtttcgccagcgcctataaatttgagcgacaaatcccatcgtttctcctcaattccctccaatttttcccccaccggagttcaccgccggtttccgtttcctccccggcggcggcggcggcggctaggatcgatggccggcggggtgtcgtccgtggaggtcgtgaaggacggcgccactgggctggagaagctcgtcctgcgcgaggcccatggctgctccgtccaggtcgaccccctctcctcaaccctagctttcagttgcagtatttctagcactggatcgatctgttcgtcgccaatcctccacaaaattatttgtaattgagatgtaattagttagggggaattggtgggaattaatggagttgattctggtggtggagaaaatgtttgagtattactgtagtttagtttgttgcgatcatgcgagggaaggtagcaggtttggtcaaatgcccaattggtgtttgacctttggcttgtctgtggaggtggatgttcatatctacgcttaatttagtatcatttgatttcattctttaagatgtggataaattgtttattgggggtggacaccatgatgctattgttagctgtggttttgattggccttttgccattattttaagtattctcggcaacggtatgtctcatctgttttagacccaatcatttggacatgtttgttgtaaatattgctctaatgaataaggcaagttgcctttcgttcaaacaaaaatcacttggacatgtttgcacattgctcatgctttgtttttttatgacctttttgttgttgttgttgttgttgtttcagttatattagataaccttacaggttccttattatctttttttttcctcagaaatggtcaagtacgttatttttcactattttcaggtatttctgtacggaggccaagtgatcttttgggaaaatgaatatcgagaacaactgctctttgttagtagaaaggtattcagatcttttaatgttcagtaagggcattatttctgccttgcaggcctatatatcgaatgcatttttacatttatgcactctacagatttggcagcaaggcttccttttcttagataagtggttgttttaccattcttttttttggtcgtttttagtttttcaggaaaatgagatatgttatgagtgtcaaacgttttatcttccaattacatgaattgacacttaagccatttacaattacccaataattccacattttttaaatttcttggcaggcttatttcaaaccaccaaaggctattcgtgggggcatacaaatttgctttcctcaagtatgaccctgggactgttcattcatagtccagttatgtttttcaagaattttgtctcccctgtaatacccaaaatggacgatccatcatgcagtttgggaaccatggagttcttgaacaacatggatttgcaaggaaccgattatggagtgttgatgaaactccccctccttttccagctaccacttcaaactgtcatattgacttgatactcaagcagtccccagaagatttgaagatctggccgcataggtgtcctctagtaaatccttaacattatttgctatggcattggtagattagaatgttccatttttgaattgatatatcctttggctcctgctaaattgatgaagttgattatccatatatttcagttttgagtttaggctgcgagttgctcttagccctacaggagatctgatgctcacatctcgaataaaaaataccaatgcagatgggaagccattcaaatttggattttcatataacacatatttttcagtctctgacatcaggtacattttgtcgtggtaatttgcttgtattatgtttatatgtaaaattaggcatttcttacattctttgactgaggcatatagctcataggatatgcacttctatactaagtcgtgctgatttttgttgacaaaagttatgttcggacctcttttggattttatcactccaaatattattcaaatgtacagaatgaatgatgtactatatgggtacttggcttctacattgtatttttcctccataaaaattgttttcacattccagtgaagtacgggttgagggtttggagaccttggactacattgacaacctgcaatgtggaaaacgttgtactgaacaaggagatgccgttgtattcgaatctgaagtaagcttcataattcatttgcaagtttcatattttgcagccattgcagtaagattgtgtttcttgttaatgctttgattgctaaggcggagaaggtatatttgagtgctccacccaagattgtgatcattgaccatgacaagaagagaacttttgagttaaggaaagagggacttcctgatgttggtaagatgctaatttctggattacacagcacggttgttctggtccttttgttttgcttacttttatgtgtgtgtgtgtgtgtgtgtgtgtatttgccgggtcaacaaagaagccacccacaaggggccttctgtatatatatgtctcgtcagtatacttttttttatgcagttgtttggaacccatgggacaggaaagcaaaaacgatactggattttggggaggaagagtacaaatgcatgctatgtgtaggggctgcaaatgctgagaagccaattacattaaggcctggtgaagagtggcaaggaaggcaagagatatctgttgttccatccagttacagcagcggacaatgggatcctgaaataattcatcggatacaggacatctgaatttctcagggattgcattccgtcattttcgcgcaagtattatggacttcccttagatctttttttttatatgtgtaaaagaaataagtgcataagtaatactgtttgctacttacactgaaacatcaagttttgctgcaggaagactcaccaaacagtcacagttggtagtactcttcaataaatttatctgaatgtctgtctgctccattccaaaatcaaaagcatatgctgtggttttcctggaggagtcaaagtcaccatcgtgtttttatagaaaagatggagaatttcaggttcaatatagatatgtaatcctgtactggatggtttactgtattacaaaaagtccaatttgacactgtgggaaagaaatgtacagaatgatgattttcgttgttttacactactacctaagaggctaaatcaccagaagatcatttagctctcatcaagagctgctcttaattctgacgtgcaaattcaagttgttataaagtggagagacaggaaatcgagagcttgaaagcttgatttttttttcaagattttgaaatatgcagtctgctcaaactaatctctctcctttccattggtaatttacaagtcacaacctggtatttttggtagaaactcactgcagattcagaaggcatcaagaatgcctggcctgttgctcccatcgctatctgaataacctgtaagtgaacagtcttatctgtatatttcctagattaaaaaagaagtcaaattacttttagtcattgtccactaagttgagttcgacctcgaaatattttctgcatctctcactgggctcaatctagtgctggctgctgggccgtcgacacagctaagcctgatctttcctttggttaaatgggcttttgattttcaaaaacattgcaaatatgtactccctcagtccaaaaaaaaccccaacctaattaaggatgggatataatctattacgatgaatctaaataattactaggttgggttttttatttggacgaatggagtacaattgtgtaacccctctcatcattgatggtccatctctttaccttcgatgattcttcatttcatctcttttgccttttgttttaatctaaaaaaagatggccagcttgccctggcgcgttattaccttacctttgccaaagaggaataaagcgagctccgcgtgaatgatgcaaacgcagctttcatcttccccagcatagcccaaactggaatagtgtgcatctggataagatttaacccctctgtttcgaaatataagcagttctatcgtttaaaatttatactcaaatataagcatttcttgtgctacatattcttattactactactcatctcatcaaccaacttctgtttattttttctccatcttactcataaccatatgttgtttaattgtatgaaaatatttttcttgtgattttaacatctgctaaacatgttagaaatgcttgtaccataaccatctcttatttaatgagatgtatcaaaatattttctttctgattttaatctctgctaaataatctaaaaatgcttatatctcaaaaccgggggggggggggggggtctaaagtgctagcaggataatgcagcctgcaggacctgacgccgatctgctaataatgacaatgtgtgtgcaaacaccgggagcaggtgtaaatagcacttgcaaactcgtctaagtaaacactgtcatgataggataattatatattaaacatgtgtattatatgacataatcttgatctaccattgttacttttcactagatggcaactgttgtagttggtgatcagtaatgtcgtacgtcaggtgtggtcggatgtaatgcatcatggatgatcaaatcgaattaatgcgcgattatattagttaacgcaacctaactcccaatctaacctgcagctactgctaggctagctagtagttcgcttgatcgcttgatcgaggcagatgagctgcatttctgagccaggtggattacccgacttaaacctatttgagacctaaatgtatgttctgagaagcagttaagtacttaagtatccagttaatcagaatctataagctgagtcgatggctactaaattatttttctcttatgtactccaactgtcctataatataaaggattttggagaaatatatatgttatttaaatttggggtgtgtttagtttatgccaaaattgaaagtttggttgaaattggaacgatgccaaaattgaaagtttggttgaaattggaacgatgtgacggaaaagttgaaagtttgtgtgtgtaggaaagttttgatgtgatggaaaagttgaaagtttgaaactaaactcggccttgtagtattatgatgcctcacatccctctaaaattacttatattttgggacatatgaagtagttactaagtgtccaaatcgaaacaaaatttatatcttttaaaggagctagcgatttttaagtagctatagttgtcaaaagtacccaagtactcctactacctccgttcgtaatttttaacgttttgaataatgacaccatctctaaaatatatctataactatagctttttattacaaaatatatacaataaataaatacaattttaattttatcatagtatactttgtgagataaatctatatatttatattttgccttttaagctagataatttataatagtttagccttaattttatctaaaacgctaagaattatagaacaggaaggaacaggtcctaaagctattacgcatgcgaccaactggcctgcatgcaggaggctttctatcgatctatcggccggggacctagcatatgcagttgcgaaacactcaagctaggaataatctggctagatatatagatcgatcgagttgcttgcagaagcagacagatagaaaaggagatcgatcgagagctcatttgtgattgcccgagaaatgccagggattcctgactgctcaacaaggtgacgatgggcttagttggctgagttcgaagtctagcctcttctatttatttaatattaggttacttcctaatattcgcgttatgtttttttcatttgtgattgtccatttgcccttacatatcaaagagaagaagacaagatactatctttaattataataaagcgatttttatatgtgtatctgtacttattaggagattagtttttattaattgatcgcttttacaagtgcaacataatttgtaccgtagctgttttgttgattttttttttgttgcgatgacaagtgcaagcacttgcgctagtggagctgttgggggtcaagtagtgcatgagaaacttatcccgtagggaactgaaaagctgagttcttatctttactttctcaccccacatctcttgttttccacacgcactcttttcaaactactaaacggtgtattttttaaaaaaaattatataaaagttactctaaaaatcttattaattcatttttttaatttattttagttaatacttaattaatcatgcactaaactgcttcgtaaccctgctgcttcgtaaccctcgcttccaaacacaccccaagatttgttaaatataacgttcatccgtacgtcatgtcgcaggtaacttagcttttcttcttcttttttttacaagaatgtaatcaagggtatttttgtttgagcttaagtttacaagtgacgataattttgaattttaactatgacttaattttaagattaatttatggcttttaatcatctctttttatgagttagcttttttccgatgacatggtagacacgtacatacaacactacacatgcacgtaataacgtactcacaccttcataaatacacccttaattaacctacactcaagggaaaccaactgattgtatgactgctaaggcactgtttgattctacttaccagctgcctatctagctcctagtttttttagcacgcttttattttttaaaaatattttctatgtaaaactttttaaaattaaataaatttactttttaagtttacgatagccttaatcaagctactgattggtctctttaaacatgcggatgatatcctcagccaagaagctgaagtcttgaagactttaaaattgccttcggcttataatccgcttcccaaaaattgcacaaacaagcaggcttaatctaccatcaaaggtatatactactccgcccatttcaaaatgtacgacgtctcgcataatgtttaatcattcgtcttactaaaaaaattgtaaatatcatttattttgttgtgacttgttttatcacaaataaaataaattataattttaacttatgtttttacatatctatattaaatttttaaataaaataaatgataaaacattatacgaaaagttaacggaaatatatattattttggaaaagaggttgtatgtactggtccctctcacccgaaactcactcctcacacatgggttgtgtttagttcccttcaaacttttaactttttcgtcacatcaaatatttggacacatgcatagagtattaaatgtggataaaaaaccaattgcacagtttgcatgtaaattgcgagatgaattttttgagcctaattacactatgatttgacaatgtgatgctacagtaaacaattgctaatgacggattaattagacttaatagattcgtctcgcagtttacaggcgaaatatgtaatttattttattattaatctatatttaatacatttgtaatgtgtatatataaaatttttttttaccaaaacaactaaacacggccatgttctacgttcgttcgatcttcccctaaaggcttatcaaagtcggccgctttcggccacaaaacgcgtgatggtaccgagaatctcgaccgttccggcagtgtatatcctttgtcacctagatatccaaaaaaattgtaaagtgttttaacaatgtagtacaggttaagatcgatcttatctatatcacttcacaaaataaaatacttaattcagtttatacggagaaacataagagaaccaaaacaaaataaacatcttgcatatttataaaagtgaaaaaataatataacttttttttagaaaaatgacagtttggatgccatgcacaaataactaaataagagtacgtgtgttcacgttagttgatgatggtttgaacatgaatatgtagaccattttttaaagaaaaatgttgataatagtttggaactttggatagcacacgcacgaaatgagagcatgtgcactggcactgcgtgcaggaggatggctgcttgaacctggaaatactcttttttttttttgagctatcgccttcgggcgctttcgttctagcttgttacaataaatgtaaaaattgagcattgaaacaaatagtttaagcgctcagttataaatatttaatatttaatatgatatttggttaaacttgaagaattccaatcattaataattcaagtgcttagttttaataaaatgctatcagtatattttgctcaaaaagtactattattatagttgctaaaaagtactatcgtaaagttacagatttcattactctattacaaaatcaattgttttaagagttgtaaaagttcgatacattctttctcctaaataataaatactatgagggagattgtcgacgtttgatgtcacgattccggtatttacatagtatggggatcgttgataccatggtatatgcgagattgaggtaaaagagatggagatgggaatttttatacatgttcgggctcctgaattgtcaggtaataaccctactcctgttgaccgaagccagtcgttactcttattcaccataatcacaccaatacaatatttggggtagcctatctaacatttgtcgacatggtggcttgaagtatcatcacgtagtcgacaacagggtagccttcctcctcaaatccgtgtccagcgagatcaaagacagcgctatgtctctcctgacagtatctatagacatagtaggggactagccatgcttatctttgaagttgatatccggcggcgtgtcttggcgtatgttggcttgttgttgatcttgtgtcttggtctattgttccatgtcccctctcctcctagggggccttgtatttatacccatagatgtctccttgtctaaatagaactagagaaaccaatatggatataatccaagtagtccttgtcgtttccacgtagaactctaatcattcttccttatgcggaactcctcctgtattcgaagtttgtttccgtataagacatggtatgtaagtgggtcctgccgagatttagtcgactactattaagtatgtggtattcataaccctgacagagatcaatatacaatatagacagataacaaaacaaacataatcccatatatgtcattattatctccaccccacacttcgctagcttcatatatgccttattagagcacctctcaccattgttttttttaccaacgtgtctgtacatatataacatattttttatgaacttgataatagctataactttacatgtacaagataaattaccttaggccatacacaatgcaccaaggtgcaaagcaacctcggacttccacatcagttcgcgtacgccagcaaggccgagattgtcccccgtgatggcacttgtgccttgcagagggcatgggtgactagttgtggtgcactgcaacccccgtaccactatcttgttgtgcgtcctcgtgtagtcgtgtctggtcctcacaagaagaaggtgccgtgagagaggagagagggagagggatgaacaatatggtatagattgggggaaggggtgattttataatagttttagtttccttattggcgtttagggtaaaatttgagtttatatgtcaattgaaagaatatgtgaacgaaaatttaaaatattagggacggacttgtaaaattaaagccacacttaagtcattttgcactacaatattagggggtatagtcttagttcacgtggtgctctctctcttttaaatcactcctaaggccttgttcgatttggatggggttgaagaggattggaagggattgagagagaatgatttcacaccatgtggaataaatcccctctaatccctttctaaaggggattaattgaataaggcctaagactaagactaagagtgtgttgcaacatgaatgtcttaggctacattcatttctgcataacaggaagtgctatttctttacttaaggtgagcgcacgcacgagtgctttccaaacttaattattataaacttaaaaaataaattcacttaatatttttaaacttctatatagaaaatttttacgctgagacatatgtttcagcttggaaaatgtaggccgtgtttagttcctcctccaaattttttttaacgtatacggacacacatttgaagaactaaacatagattaataacaaaacaaattatagattccgcatgtaaagtgcgagacgaatttattaagcctaattaattcgtcattaccaaatgtttactgtagcaccacattgttaaattatggcgtaattaggctcaaaagattcgcctcgcaatttacatacaatctatgtaattatttttttcgtctatatttaatgctccatacatgtgtccaaataaatatttgatgtgatggaattttttaaagtttgaaggagctagatacagccgtactcaccaaagagtgagtagttcatgttccattcgaaggaaacttgcctgaaattgctccgggtcgtctcggagaccgagatcatggacgccaggtcaggtcggttagctagccgcacaaatgcgatcctctgccctgacgacctatctatccctgggccactcatgcatgttctactttggtcaagtcatcgatcaatacctttgcaaaaacataggcatacatagcgaatgaagcagcgcggaaatttctggcgaaaatagcgaattaatatactccctccgttcgaaatgtcgatgccgttcatttttttaagcatatgttcccgttcgtcttattaaaaaaaattaggtaactattaattcttttcctatcatttgattcattgttaagtatattttcatgtaggcatataattttatatatttcacaaaagtttttgaataaaacgaacggtcaaacatgtgctaaaaagtcaatagtgttaaacatttcgaaacggagggagtactatatattgcagtgatcctgtgcttcataagacaaattttgtatatgtagacatgtagtattgcataagacaaaatgtgtacatagatatactctcaaatatgctttgagtgctcaaaggggtggattgatcgtcacgacggcagaaaagctaggtcgttacatttgtcgcaaggttcgtctacgacatcagacaaaagtgatagtatatctttaatttgtgatcgatctgcttaggcaagcttatatgcatggttgcaataatctgccgcccaaccgatgatgaacgtaaccgctctagcttagctgcgtcattctactcttttactgatctgtatacatatcaaacttaatttcgaacattaatatcgtgcccgtgcatgcatcgatatcttaattaatccgtgtgaatgaatgatttagcgacgacattgtgatggatctagttgcaattatgctcgatcgagcaactagatcaacgagtaaaaagtagcaaaggacggcgacacggcgtacacacatgcatgacatccaattgtgttccaagtttccaacaatttttttttgcaaatataaaaaacgaaaaattgtgcttaaaatactgtagataataaagttagtcacaaataaaataaataataatttaaaaaatttgaataagacgaatggtcaaacgttataagcaaaaacttaaaatcccttatattatgggacggagtaagtaattagtagtagtactgcatatgaaaagtcggattaattagcatgagtactaacgacctagtcaattaagctactgcatatgaacagtgggattaattagcatatatccagttgcaaaagcatgcgaacagcagatcgatcgagctctacgacaccctgcctgccaaatcatcgatatatacaggtcgggacgaggatatagatatccatctcctccaagatcctagctagtcagtatatgtcagtatctgatgttgctgctgttaggagagattctttcgttggtcgtacgtgactctttagtacattctattactactaattaagatcccgtctacaactccccctctctccctctctccctctcgtgtatttacaccccagtgtgtagtactccctccatattttttttatgttggttagctcaaaattaaactaatcaacgtcgtatatttgtgtaagaaggtaatagtattcattcaattcatatatatcaatacgtgaagtgaatataatcacgccgttattaactagttgagccctactcgagctctagacttagaaaacttgcactgcacaaattaaaaaccataacggatatgtagcgcaaaaaaccgtatacttaacagttaacaccgttcttttcttctctctctataagagcaggtacaatagcagactataagccagctataaacatattttaaggagaaaaaggaagagaaagaagaacagtgggctatagatctgtagtcagctgcagcacggactccaagacataatgtgcgtatgtcaggtaggaccaggtattaatagtatagtaagtaactattgtatgaattagctattacattggctatagatgatttggatatagctgatttggagctagcagttggctatattgttaaacttgctctaaaagagcagagcgatagcacaaggtgagagcaggcaggcagcgatgcaaatgcgcaaaagctagctaccgacatacttataaagcagagaggcgctcgatcgcttccttgttcaccgccggaagcaagcgttttgtgtctccactctctccagtaagcccctttaatttggacggatggagctagcagagcgtgtagccgtagagatcatctcatatatgtagccaaattaaagagggcggcgtgaaaaaacggtagctggtggcctagttgagcggcaagagatcgatcgatcgagagtagcaaggatcggagaagctagcttagcagcggcgcgcggcgagaggaccggcggatcgagcgagcgagctaggaagctctcagccgaccggcgatcgaatcgtgcttgattgtttggggttgtgagctggttttcactctgtacgccgctcgccgtcgtcgtctcggggcgcgcgcacggcggatcgatcacctacccgaggtacgtacgtatatgcgtttctctcgtccatttgcacatgcgcccgatcgcgtgagctcctttcgcggagaggaatcgtacgtgccttcgacgcttacatgaattccttttcttatgcgtaattgtgcggctagcatccatataatatataatctatatatatataattttacttgaaattattaaatatagctatattattatcttatgaatttgaatgaccaaatcttaccatgcccatgtttcttttttttttagagttctaagctctttctaatagagtagtatttttttcggggagggatagagtttgtatagccaccagcctcctccacatacagaatcctttaaattccctacaacccacccctttttttgagaaaaaaaaattcttatatgtgatggtttcttctgcaatattttcttaacgcacctcttaacttgttgcgccatatccatttatttttatactttggcatcgcttcatccatatacatacccaatatcactaatctcccctactgttgcatcctctctcccttacttgaaatattatcgtactcaatctctttggggccaccataaacataaaaaacaacagctaatgatgtgaagtggggaatgctcggagatgaagaggataaagtgggggaagtaggggaaggagacatttgattcatttggtttggcagatctttaggtttgaacatatgccaaccaaatttgttagaagaaaaaaatgaatgtttcggatcggtttttttggcttttgtaataaacagatcgaatgtggattaccgattgatgcaatggtcgaatggtaggagccttactaacgagagtcacaactcaggagattacagtgactaactagacgacgatgatgcttctaaaattgatggcttgtggctggtgtgggatgtgacgtgccttgtgaacttaatgtataggtctggacatgaattagtgaggctaaggtggaattacaattaagtacggtattttccgggtttcaatatccttcgcctacaaaccaaactaactagtcaacaatttagcattgagatttagtaaaaaaaaaaaagaaaaacccgacacaacgctttagttgacaggttttcaagaaatttccgcccccctattcttatagaactagaatgtaaatatgatagagacaaaaagacaaagtaaaaaaaaaaagaaacggaaaacacccacagtcccagccacagcacatttttggtagcttgtcttttggctagttggcctggctctggccgatcgagaggatcaggaaaacaatcggacttgaaaacaaaaaccagctacagccgacagggtcgtcgctccgttccaccgttggttcgcaaccgaaccaacgcgtgcccgcacgacgccgtgcgccccagatacaaagtcgccaacgcgcaatttatttagcccagcccagccaagaccgtcgcgcgtgccacgcacccagcacgtacgcgtgacggagacaccgagccaatcgcgccggttcgatcgagcagttgggctcgttaggtcaggtcaggtcacccccgcgtcgtccgaccgcgacaccattcatcacacaagtcacggtctcgaactcgactcggccgcgacgtcgacgacgagttcaccactagcccaccaccaccacgactacactctcccggctccgagacccgccggaaaatcccccgggaacttcggcgcgattcctctccgagttaaagcaaaaaaaagcggaagccgaagcgcccccgcctccgcgtcgtctgcgtgaagcactccccctcttcaagcgggaaaagcgggggagggaagcaacgcggaaattaaagagcagagcagagcagagccctgagccctcgattcgcttcgtttcctacggcggacgcccattcctcccccaccccctccccccactccgactccgccgccgccgccgccgccgccgcctccggctccggctacagctcgccgccccccaggttgctctggatttttgcgcgtgtcgctgttggttttggggggcgaggggtcgggggatgggttgggatttgtgcttgttttttttttttgtgcgtgtgtttatgctgttgctgatgagggtggtgtgggaatgtgcgtgcagatcgggggcggccgccgcctggtggtgtccgtgtcatctctcctgaggaatcatgccggtgggagtgcaggcgcccgaggcgtcgccgggaaggtaccatcggcggcgggacgacgacgatggcaacggcaacgactgcagcgacgtgctcggcgtcgacgtgctggacgagggggccgaccccttcgacatccccgccaagcgcgcctccgtcgagcggcttcgccggtggagggtgagtatgagttcctccccttctctccgctaactgctacattctactgctcatgcttccatgtgcaatgctgtttaattccgtgcgggatttacctttggctgccacttgcgcttttaagtttttagttatactccctccgtttcgtaacataagtcattctaatattgtccacattcatataggtattaataaatctagacatatataatgtctagattcattagcatctatattcatgtgggcaatgatagaatgacttacattatgaaacggaggaagtattgaactattattatgatcctgtatacctttttcctattttgtggctcctgtaaaactcaatcgtggaactgtggttctctaaagcttccgaatgatctgaggattgccaattttactctaggaaacaatactacgaagtaagaaccgaatgttgctggtgttagtattttgctctgttgctaccacctagaatctaatgagatgaacactgactgtgaatatgaatggtcggttcttagttctcttcaggtactgtgaaatgttaaactatgttagtgaataggtatgcatgtataggctcattcatgacccttggctacatatgcaactgttgcgggctgagacattgtaatgaacctatccctcatgtacagagacattgtaatgaacctcgtacacagatgggaaaacaaatgtcctagttttaatgttttgaagacctattgatcatttttttaggtggatcctattgaacttgtaaaatcgttagaactgaatttacaagttaaacaatctcgtgaaaattattttaactagcaatgcatatacaatcttgactaatgttgtatcctgctcattatttttacacaatacaactatgttttccattggcagcaagctgctcttgtgctcaatgcctctcggcgattcagatatactcttgatctgaagaaagaggaggaaaaggaacaaataaggaggaaaattagggctcatgctcaagtcatccgggtatatgtttaaccttatatttgtgatatgcatatcatgtcatggtatcttgtttgacggtttcagttttgaattcaatcaggccgcattacttttcaaggaagctggacaaaagcatgatgttgatagggaattaccaggtagcttttgtggactcactttcaggctggagacataattgttagttgtgtttttttctcttgaataattgttagttgtgtttacctttgttgtttatcaatatgcttgctatctttgtcgaggattaatagttcacatagtaaaggactgaattgcattgtgatatatagctgtgcaaagagaaaaagagagaaaaccttacacattcatataatgcagaaattctccctcgcgggttcggaattggagaggagcagcttacagctatgacaagggatcatgattattcttctctgcacggatatggaggggcatgtaccattcatactgcaaatttaacttgaatatcatttttagaactactaattaaggcatggaattcttctttaataaacattaggttaaaggactcgcaaatttactgaaaacaaacacggagaagggagtccatggagatgaggtagatttggcatgcagggcaaatgcttttggggctaacagataccctcgcaaaaaggggagaagttttttggtaaatttatttgtccatttcaactagtaagcgtgtcttagtttcagtactgatatctctctctctctctctctctctctctatctatctatctatctatctatctctctatctgtctgtctgtctgtctgtctgtctgtctgtctgtctgtctttctttctttggggtccgggggttaacaggttttcctctgggaagcttgccaagacttgacactagttatccttatcatagcggctgtaatttctctggtattgggcattgcaacagaggtgactcctataaccatcctcctttcttatatttcttatgcactgtatgttatctaactattggttaaatattattttcccttctgatcttgaaatccaatttcattaatgtccacaaacgatggtttagttgagcaccctcactgccagcaaaacttttgatcagtgttttctttagttctaagttctgtcttaaaaaaattcattagggcatcaaagaaggatggtacgacggtgcaagcattgcatttgcggtctttcttgtcatacttgttactggtatgctattcttcgcctgttcatctctatgctaattgatcttctctaagcagttcaatagttgagatattaataggtgaatacaccatcattatactttacttagatgcaaaccattgttaaaggttctttaactttttctgaagtttgagtcatgctttaatttgtaatgataaaagactagatgttttttgtgttattctttggcaaagtgattgcagtttatcattagctcttttaaatagaacaccacttctatttttgtcatgtactttttttgaacagtaacaaataatactcaattactgcaataatggagttatgatagacgtccccaaataaattattacacataaggcttgtacagaacttgttatgaagattcaaacaatccaagtctaaatatctcaggcacccttagttacattatgcacaatacaacgaaaaggcagctagagagtgtagatgctttccctgacaacaggcccagtaacccttcttcacaaatcattacctattgcttgtttggttgagccacttccatatgtcagctagagagtgcaggtgctttctctgacaacagggcaacaggctcagtaacccttgttcgcgaatctgctacacgacattattacctattgcttgtttggttgagccgcttccatatatcagtatcagacgaccctctgatgttcccaactcgcctatcctgattctgttaactgaagcctgcacgctattccaacgcctatgcttgaagagtctcagctctagccacaatagcttgcttcacaacattcttttgctgtccgatatttcattaagaacacactgtatgcaattttctcaacagatctaatcaaattgttctcaaagcatgctcagtttttagtttccacgttgtttgtcatttactaatgtttctgcagcatgttttgtttttcccccatatccttcatttttcaatgttcaacatttttttccttctgcttagcaaacccatgcaagacactctagttggaataatttagttgctttactaaacactcattttgttttgtattagctgtgagtgactacaaacagtcccttcagttccagcaccttaatgaagagaagcaaaatatacaagtggaggtgcgccatatgaatatacccatttctcagataattagcaacaatattttagtcctctaatggggttgtatttgtgttacacttgtcaggttattagaggtggtagaaggattgaagtgtcaatatttgatattgtagttggtgatgtagtggctctaaaaattggtgaccaggtaagattatgtaaatccatgcattctgatttgatttatgttctatgctgtttgtatttctgagattataatgaaactaaatacaccttttaggtcccggctgatggtgttttggttagtggtcattctcttgccattgatgaatccagtatgactggggaaagcaagatcgtaagcaaccttttcgacccctattgtcctatataggactgacttccccatcatatgtaaaccctgtttcttttattaggttgtcaaggaccataaatcacctttcttaatgggaggatgcaaagtagctgatggttatggtaccatgttggtaagtaaccatatcttgattcaatggcctcactcttccactttttttcttatgaaaattgcatgcctgttaacaaaaagaggcaatttgaggcccatctgtcacctctgatcatcgatttaagtactgctgtttagtccagtaaattaattcacaagctagagtaaaccaattcggtggactttttaacagaccctagtgaaatgatatgaaatttcacccctacttacacgactgaagtgcaaaaatatcaacgtcattactttgtctcatgtatgttagtgccttataccctcaagaattaagtttgtgacgttttttttctaacatttgtaatgtggtgtggaagtcttttgtatatgaaattttgcagtttcttttgtaggtaactgcagtcggtctaaacactgagtggggcttattgatggccagcatctcagaagacaacaatgaagaaactccactacaggtttttctccaatccctgtgctatgacctgaatgggaattgtgggctggtttggttttgcactaccaacaatttggcaacttcaatatgtacctattatgtgttcgcattgaagccaatatttgtcaaatccatatagttgaggcacctctatcctatcgaaaatttggtagggtcaaaacttgcccaagatttggcactaccaaataaccaaaacatgatagggtagagaaccaaacttgccctgcatttgaacagttgcccatgccatcatttacatcttatgattcattcatgttcttctcttttctgttgaaggtacggttgaatggagtggcaactttcataggtattgtggggctttctgttgctgcaatggttctcatagtccttgttgcaaggtaagcaaagtgaatggctatctatgcatcttcttgatgtaaatttagtatagctttggtgattaacccatacaagcaaaaatcaaattgtcggcatgacactttttaccactaaacttatgcgttttgaattgtactggaacctggagtgcaatatggcatatcattacactgcttggtaaagcaataaagtgctcactctgcaatgattatcatctgaataacttaaatataaactggactatacatgaaacagatgaaaagagacactactgcacttgtaacaaggtttagtctctttgcatcctccccccatccccgaccaacccccaccatgatgtatgatccccaccacaatacatgcacacacgcacaatgatgtatatgatccctatattgagaaatatataagatactataattaggaatcgccatcatgattgtgtatatatgtaatatatgatgtttgttgcccatgtatccactatgtacttagaacttctcctttgctcccagatattttacagggcatactacaaatccagatggctctattcaatttgttaaggggcaaacaagtgtgaaatctacaatttttgggacaataaagatactaactatcgcggtatgtagtggtttagtgttcagtgtatctgaagacccttctgttatcccattcttatattacaaagtaccatgtaggtgactattgttgtcgttgctgtacctgagggactaccacttgccgtaactctaacgtgagttgatataggttgatgttttcattcatgtttaactttatttgaatcattcaacctcttgttttattttatcaggctggcctattcgatgcaaaaaatgatggcagacaaagctctggtatatatttctcgggtttgtttatgttgtacccttttggttattacatggttccactcatgtgattttcaggtgcggaggctttcagcttgtgaaacaatgggttcagctacaaccatttgtagtgacaagactggtacactaacactcaatcaggttagttgtttttgcatagtaatggatatacaatttactctaatactcagttgtaaattaccatggtacctttgtgattatttgactctgaattttggttgcttaagatgaccgttgtccgatctgttgttggggggataaagctgaaatctccagctgatattgagaatttgtcgcctgttgtttcctctcttatacttgaaggaatcgcacagaattcttcaggcagcgtttttgagccagaggtgatgccacgtgtttattactactgcagtttacatacctgaacattgttcattattctaaattaggctattcagtagctggtagatttggtagattctagttatctatttggtaggtatttaacatcctggtctgatttttttatgagttgcattctcttgaagaggttcttctatgctctccacaatagtgtatagtgtgaactttaaatcatattgagtgtctgtttgcaacaacacacagttccactactaaggatgctgcttgcctgcttcaagatttgtgcaaatgaggaagcacatgagcactagtcagtttattaccaagttgataccattttaaaaggcatgcaggggaagcgttttaaatttgatctctaatgtgagacatatgtcttttttcgtacttgtgtactggtgccattgctagtggtttcagtgatctgcattctttacatgcattgtctcatattggtacctttatccttctatgttatcctgattcttgattcatcaggatggtagtcctattgagataacaggctcaccaactgaaaaggctattctttcttggggtgttgaggtaagtttccttgcattctcatactttgcttctcttttggtggctacatttttacttatctggctgatgcctcctgtagcttcatatgaaatttgcggaggagaaatcaaaatcttctattattcatgtctccccattcaactcagaaaagaaacgtgccggtgttgcagtgattgtggtaaatccatcttttgtcactaatgttatttgagatctagtttttggctgttagtttgttcgtggcatcctatttcttgaaatgatttcatagacacatactcattagatacacgagcttcttcctgtgtcgtcaatatgtacatgtacttcgatagcgatgaaatggcaatgggccttatctcaaatatggctccctagaatttgatgattacatgctttatttttgttggttgattggcaaaaggttcatttctttttcaatttaatgttatgtatattcattgcatctccactattgcagtttagtttttttccaaacatcttcttttacttgtctaatgtctatgataatatgatataatatcggttcagaacattttttttcgtgattttagaatgtaacaaaaaggatcttatgtatcagaagttctcctatttgttaacagacattcttgttgatttgtttgaacaaaaggtcttgcactgaaatgagaaaaccattctttacatagaaatactgcatggcaggttgagcatgctctgattactcagtaatctgaaaaacactatgcttggtttatggatctagtttagctagagtacaaatattttcatgatttgcaagtgccttctatttggcatgtaacacgctgcaaccttataatattgtttgcattcaggatgattcagatattcatgtgcactggaaaggggctgctgaaattgttcttgccttatgtacaaattggcttgatgtaaatggcattagtcatgaaatgacacctgataaggtattaaccacataggaaacccttctcaggtttatttaataattctcatgtctcagctgggtctttcaggctaatcagttcaagaaatacatagaggagatggccgaggaaagtcttcgatgtgttgcttttgcttatagaaatcttgatctgaattatgttccaaatgaggaagaaagaatcaactgggaattaccagataatgaactggctctcattggaatcgtagggatgaaggtacatgcaaagcaaaccatgatatctgaattatgatatctgttatatttaaagcaatgttaaaagaagtttctacatgtctaaaacaatgtgttgaaaagcagtaagcggtttcgtgtggtcaccccaccttgtagtgcttatgtggcataatcggtcacttatatggtataattgaccactcatgcagtttaagatgtacaaggttgggacaaatgttccttgtatgcagccttgtaaaccttttttaaaaaacactggtgtaaaggcaagaaattaacttgttaatcagaggaaaaagaaaaggttatacaaaatttaatatggtgggtctagattacagtataaatttatcggatggttattagggccttatggtcataaaaaaatgtattctttgcaatatgcatgagtgatctagtaaatacaactctattttcaaatacaagcatgcattagtatctagccatgcgattgcatttgtgtttggctagttatatattatagctcacttttcctttattactgttctggtaacattgtttgtctttgtttgggacatccatattttttgcaggacccctgtcgccctggggtaagaaatgctgtagatctgtgcaaaaatgctggtgtaaaggtatgtagtttgttgaattcatgtgtactggaggacataatgggcatttttacaaacattacagtcccattttccttacagcgagtgttgatacttgaatgttccttcaaatattgactgttatatacaattatagaaaatcagatttagatgtacaattacgctccagtgaacataagatatgtgactttcttgattttcttgcctttagaattcatgttcttttacttaaggaactaaatctgtttatttgttcatgttggatgtgtaggcataaaactatgagcactagtaatgttggcacagtgccacttgaatagttgtagctcttctcatcactattacctgacaaactcctgcggtttttgaacaagcaggtacgaatggtaactggagataacctacaaacggccagagcaatagcacttgagtgtggaatactcacggactcccaggcatctcaaccagttataatagagggaaaagttttccgggcatacagtgacgctgaaagggaggcagttgctgatcagattagtgtaagaacaatctcatttgtgcttgcaaaaatattaaagtgtgtaccaagtttatcgatgtaaccttataatggtgcttttagttcttaagctggttcattgctcattgtgtatgttattttcccttgcttttttggtttggcaaaaaatggaaccataaacctatagctcggttgcagaaattgctgcagaatgcctaacgatttatttcatgtagtaagacagatatatctggagtacatactttcgagtttacacattaccatgttcagtacttgtactggctgttagctcgatcattctaggggaagcaacctgatgtcaacaatgcattgtaggtcatgggaagatcttctccaagtgacaaacttctcctagtaaaagcactgaaaaagaaaggcaatgttgttgctgttactggagatggaacgaatgatgctcctgcattgcatgaggtacatacataattgggaattttgttttgaacaaataaaaggataaacataatggttttatttcaatcagatgaagacaatcgatcatgcatgttgatgcacatttctaattttgatctcttattcctcctaatttaggcagacattggtcttgctatgggtatccaaggaacagaagtagctaaagaaagctcagatataattattctggatgacaattttgcttcagttgtaaaggttagggaagttggagcttaataatcttacacaattaatttaacaaatgccttaacatttatccatatgtaacgttctaggtggtccgctggggtcgttcggtttatgcaaatatccaaaagtttattcaattccagcttactgtaaatgttgcggctcttataatcaatgtggttgctgctatttcttcaggaaatgttcctctaaacgccgttcaggtttgcaacaacacaatgctcttagaattttctttgagaggaaaatactcttagagttactgctatgtactatgccatattagtataactttgtttattgatagtttaaaactcaaattgttagccatgcctgaattgccatgactagttcggccactgctctctgtagtaaggccgcaaaaagatattgcgagataaactctgttgctttaaactcttttttgttttgggttggtctgtttgctttgggagttgcgaagatggattctttgagaactttgtttctttcaatcttaatgcaatgatgcacaagttttatgtgcattccctcaaaataaaactagtttgtccacttgctgctgtgtctgaatcattacattggctaatggaaataactatggagtatgtgcttgttactttagtggcaatgtggcactgtacggagtttacttcagtatattatcattttttgctactattggggactgtatcctgcttgctcactgtaccattctttaatcacatgagggcttcacttggaatctggaatttggcggtgtcttgttgaaagcatacctaggatgcaaaaccagttaggacatgaatacgttttctagtgtattctgatatgttaaatcttaaatcaatcaagtttgttgaagggacatttagaagatgtcctgtaaataaagatggggttgaaaaaataattttaccatgggctaaggggaaattgttagtgaaaatgaaattaagatacttaactgtattgatttgcacgtcggcacatggctgaatgttttacttccgtttgttgttgatttagcttctttgggtcaatctcattatggacacacttggtgcacttgcattggctactgaaccaccaacagaccaacttatgaagcggccacctgttggacggaagttagtacacctgaaaccaacccgtgctcactataattcttgattgtcttaaatttgtaaaggaataacaaaattctaacatgctttcacatttaacacagagaaccacttgtgactaacattatgtggagaaacttgttcattcaggtaggacggacttgtcatataatgcttctgcattgttaatccaattattttttacttggctagttgctgagaatttttttttctaaccacaggctgtctttcaagttactgttcttctgacactcaactttagaggccgggatcttctgcatttgactcaagatactcttgatcatgccaataaagtgaaaaatacatttatatttaatacatttgtgctttgtcaggtaatttgtcttcggtgggcttcttgcaccttttgaaagcatgttactgatttttgttaaatggttatcttttcttttcatatatagcatagatgtgcaccattttgcagcttgagaaaaatcctaacttctccatttcttttacaataggtgtttaacgagttcaattctcgtaaaccatatgaactgaatatatttgatggggtttcaagaaaccatctttttttggctgtagtgagcataactgtcgtgctgcaggtatgaaagggtggaaatactcaatccaccttcaaatgctgattaaatagttcggggagcagataaaatttaactaacatatctctgatactcaggtaataatcattgagtttcttgggaaatttacatcaactgtgagactcagttggaagctttggcttgtttctgttggtattggttttgtgaggtgagatacttgtccactttgtagaacgtggtgcttctgttgcagggatgattaatacttttccaaaattatttagtgaccttttcttcctccaactattgatctgatagcaatcgaagaaaacagctttagtttgggatggataaattataacgattgactgtagcttgcttactgtgagctaactattgccttgttcatgcagttggcccctggcttttgctggaaagttcataccggttccccgaactgaattgaaaacttacatctcaaggtgtttaccgggaaagaaaggtacccactatattttagccagctgttgtaaacatttgaaacatatctgttctctagcaactatgtttgcttctatgttttgtttccttcgctgctgtttatcagaacaccggcagtaacattatttctttttagttttaccaatttaatcaccttcctttggcccaatttacagataacgaaggatcaactccacctccacctccacctccacctgtgtgattgtgcatgtccaagtgaccaaaattatcagctctgaaattagtggtggtgcacatagatgcttgtataattttgaaggttgacttctaaccatgctacctcttaggctgactgtatactgaggttgaagccaatccgacagatgtttcatcctctcttactcatgaattgggcctgacgccgatgtaaacaaagattaggaacttagacatacacttcactagttggctagggatgagtgtgggctgacccgtggatactcttttacccacactagttcaactaaatgaactaaatttcacttttagaatcacaaaaaatgaaatgtagttcgtttatttggactagagtgggtcaattagtacctatgggttggcccgtggccagtcttggccgcattcatgcatcatagtacgctactgagcacatcttctttcaaagtattacacggagatgtctaaaaatttgagctaaatgactgggaggtttattagtgttactgcttttgatttttgagagctgctcatatttttcaggatcaacatacattttgtacttgaatgctgtacttttatttaggtatgttctggcgcaaattatataatcctttataggcctgttttgactttgatagtagcttgtttgttggaggatttaagctaatctggctagtaaccatcatggcaaactgaccatccagctgatagcttcattacacatacctggtaagtacatatggcacatgataaaaactaggatgttccatagcaaattagtcctatgttttgcctctaatactgatgtatggagtatttctcttgactgaacaaagtgcaattgctagtcgtacaatgtttgcctagagttctatcactagcttgccatttcggtaacttttctagtaacatgcccatctttcagtatatctccttgctttggatctatgtagggttgatgattataaggctgcgtttgagcgcaggagaaagagagaaagatagttttgttttccgcgcgcacacttcccgaactactaaacggtgtgttttttgtaaaaaaatttctatagaaaagttattttaaaaaatcatattaatccatttttgaagtttaaaataattaatactcaattaatcatgtgctaatggctcatcttgttttacgtatcttcccaatctcctcaatcccctccttctcaaacacaccctaatgctttaaggagtcaaatatgacctttcaccaaaaaaaagaaaagaaaagatagcaaggcaatgcatgctatgcttggaaaaaaagggagaatagctaatatagtccctaaagtttcgctcctgggtcattttagtccttaatctttcatattatccaaacaagtcctttaaatttgtcatgtgggctaatatagttcttggtcccaccagaatcgccatatggacatgccatgtcaccttcccatacaaaatctatatgatttgtccaatttaccctttgcataggaagataaaaaaacaaaaggaaaaaagttacaaaaatatatggtatatgtaagagaaaaaatatacctcagaagggtgaaaaaaagaagtatttttttcctatggttatgtctaattcacccttatattttttttatgatatatgtaagggtagattggacaattcatcatagattttgcatgaatgatgatatagcatattcatatgatgattttggtggacccaaagactattctaggccttatgataaagtttaaggatttctttggaccatttataaggttagggactaaacagatcctacagagaaactttagggactaaagtagctattcttaaaaaaaaaaaacaccccctttttcatttgtttacggaggagtaatctaagcatgtcgccgagccacacaataagtaggccacatgcccgtgctcccacccaaatcatggtgcttagtttgcgtgctccctgcattgccctttcccctttacattacatgcaagcagccatgaaaatattacttgtagtactagttacatgacttggtcgctttccattaccgggatcgagatcgtactgatcagcagtactcctgttgctaatagcgaggcagattagcatcggtcgtatcgacgtattgcatctaactcggggtgcttagattaattaagcacaatcgtactacgtactgctccagtagatggttggttcttggatctcgcactggatggagcatatgcgtatgcgtgtctcccggtgtacggacatgatatctcctggtgaagtggtgatagagctagcagtagctctaaacatccggatcaaatgatcaaaatatgggtttttgagacgttctcatgcattgaaaatatgataagccatagaaaaattatggataaaacttttaatcatgtattacgaatctttaaaacctgaacaaacctcctatctgattttcacaataataagatatgttttatctgattttagatcactaatgttgtgcttagatccaggggtgaaaagttttgacgtgtgacatcgaatatacgggcacacatttgaagtattaaacatagactaataacaaaacaaattacagattccgcatgtaaattgcaagacgaatttattaagcataattaattcgtcattagcaaatgtttactatagcaccacattgttagatcatggagcaattaggcttaaaagatttgtctcacaatttacacacaatatgtataattagtttttttcctatatttaatacactatacatttgttcaaatatttgatattcgatatgacatggcgaaaaattttgctaaatagaccctaacatgcgtacggagattttactcctactactctttataagttcagaaagcattaaaatcaccttataatgtatgagtaacatatatcgctacacgtgcttgtcagagccgctccatacaccagcattaatttctagagtatttttcttcaagtatattaattggccgggaacgcgcatgcttgcaagacacgcagattttttttatgttgcaactaataacgaacatcgatcataaatgcaagtcaagttttggattttctcctcgcaaaataggaaaaatgttttggctttcttggatccaccacacaccgaattttaatttggtttcaaaacaaattactccctccgtttcaaaatatttgacaccgttgactttttaacacatgtttgaccattcgtcttattaaaaaaaattatgaaatatataaaactatatgtgtacatgaaagtatatttaacaataaatcaaatgatatgaaaagaataaataattgcttaaattttttgaataagacgaatggtcaaacacgtacttaaaaagtcaacggtgtcaaacattttaaaactaagggagtaagtttgtaaaatacaggagcatgatactaatatataacaatataacacacacgcattaattaatctggttttgctcattaattctgtgttaaccgtttgttttagattttttttccggaccattttctttgaacatactatacttatcatcttaattatgggggaaaatgacatattgtatcgagtatcgacatatatattgcgcgtgcttcatgcgtgacggccggcatgtacataaaaataattcggatatggccctacgtagccttgggattgggcccacacctgacagtggtccagggagagaattggttgagaaaatacgttgccgggcccatgtggttatattatgctacaatggaggcaacgcgggttttcattattataataaaaaattagtttatttgatattgtagagtagtttctatataaaaaatttttacacgatacacagtgtttgacggtttgaaaacatactaaaaaaatcgagatagaatctacatcttaatcagaaaataacgatatataggccatgaaaccatagtttttttttccacttagggactgttcatttgagcaaatggtagtggtaactttcttgttatccattatcatgcttactaaactgctaaacaattttctttacaaaactatgtatgtagaagtttctttccaaaactcaattgaacttattttctaagtttataataatttgtactcaattaatcatatactccctccgtttcaggttatatgacgttttgactttggtaagagtcaaactgtttcaagtttgattaagtttactgacaaatatagtaatatttataatactaaattagtttcatcacatgaataattgaatatatttttataataaatttgtcttaggttaaaaagttactactattttctataaatttagttaaacttaaagtagtttgactttgactaaagttgaaacgtcttgtaacctgaaacggagtactaatgacttgtttcacagccaacagcggccgagaacacagcctaaaggcatggtggacctagaaatttcatagagcataaaaacgttcacaaaatggctagatgttgggatcgtcaaacactgataatgcaattttcccgtcctttggccgtgccaactaacccgggcaactgctcaaggtcgccatacattggatcgactgctgattcgggtggtcttaccatgaactagtacatacaattgacactcgaacttattgtttcttttaacttgtattagttgaaattaaacatgtatgatcgtggagtgatatatgttatattaattcatcttattaaatatttttagatttatgatatataaaacaagaggacatccctcgagggacaatcgggctatattcgtttgcagaagaaatatcttgttatccgtttgcacgcttctcggactgttaaacagtataatattatagaaaagttgtttctaaaatcatattagtccattttacaattttaaaaaatgacatattaggctcttcctttctcctcttctcaagcacacccttaaactttcatggtctcacaaaaatgcactatactcatgatctggatcacacacttaatttcacatattcaccctacattggtgacttaattaaggcaagatccaacttagtttaaagctgagtactactaaactaacaaaacctaattattaacacactccaacctagacagcttaaatctgatcacccccaaagcccaaagcttaatcaccatcatcatccagccccccacttcattcctctcacaatcatcagtatcacctctatctctagctccccctctctcttctctctctaaccttttgcacctgcctgcagtctgtctccatagaactctctctctctctctggatcgccacctttgccatcatcatcactgccatcctctccacgcctgctccccgcatccatccacccctctttaccccaccattgccgctgcttccctcctccatcgctcactcgccatggcggcgagctacttaagtagagctcgagcaaccctaccttgcttcttcttgcctcctatctaagcttctcttcgatcttgtgtgacacacacatgggcctcgagctcgacctgctgtccgctcagctcccgccgatccgcaccacggcggcggcggcggcggcggagatgccggagttcgaggaggtggtgctgtgcagcacgccgacggcggcggcgagcgtgctgcgggcgccgtcggtgtgcccgccggcgccgaggaagccgccgaggccagccgccaagaggaggaagaaggacgctcgctttagccgcagctgctactgctgcgggcggcgccgcggcgggagggccccggcggcggcggcgttcgtcgccgtgccggacgatctcgccaaggtgttcgtcccacggcggccggtgccgtgccggccgccgctggacggcaagaagatcggcgtgcacgtcgtgggctgatccatgtatccaccattgttggtctcgtctgagcttgaagctgtccatggcgagtggcctaaaatactctggctatacgtacatacgtgcatggccatggagtggtgttggttgcttgcaacgagagacggtttagtttagtaattaattactcctagtttagcttaattagcttactttaatctagtttttttactacagggggttatttgaataacaaactgtaaatgtagttcattattatatcattaccccctagctagctagctgactggatgttcagctaattcaggtaccaattgaatggtcatcactcatcactcgattgatcatgccattacttactttgacaaggaatattgtgcttgcattgcataatatatactgtatgtgcaaaagttgagcaatattatttctttccttacttcattttgagacctcctttcgggaattttacagggatttagttcaatttctcaaaaaataatttctccatcccaagcgtgtggctctagcttagagcttaaactaaaaaaaaagccaactaagacaccatttgatttaggttattgagtggattattctagtagattatctacttattttatatatggaatgttttaaatattttaaaaattaacttaacaaataacttaaaaacaaatgaccttggcaatgtattagaagataacttttttgagaaaacgaatttttcgaaacgtgtactattgcttagatcgcttattttaagttaatttgaagtaaataatctgaaaaaatcgaaaattgattattattttttaataattcagtaaataatctaaaatacctccctttctctcactctgcaaattcatgaatgttgcatgcttattagttaaatactagtagatgcatggtgcgaaatgagcgtaactcaactagttagatttcttttggtggaatcaatccatccggattcaggtcctagatttgaccggatgctcgcttttacgactatttattttttcagtggtaaccgacgtacatacccgtcggcagcgggacgtccgtaataacttcgttaatatcaagagatatcgacacagtcgtccggagatgctaatagggaatgcagggtcagctgattgagagggagatagagagcaggtaatggctggaggggaaaggagagtgtgcactgtgcagagcttccaaagggtgaccccccccttggtgtacctggctggtccttttgatacctaaaaagggatgcatatatgcatgaggcagagagcaatccatgcagaggagaggagaggaggcatgcagcagtggcagaacatactactccagatctggggaggaaagctgcatggttaatgccactcagatctgaaaattttgtgtgtgtggggccgggccattgcaatttgcaagaggggattcaatgatactgtccatggtgaactaacagtactgctgctgtccctgcatttctccctggacaataagctagcgggtggcagaaaagatgagcggcaggcttccaaccccatcatatatgtccctaaaaatgctgccatttaagtccacatggtccatctgatcatgattatataaaagttgttttagttaaattgcaaggtgtatttttattttttaatagaagtttttattgctaattaaactgtggctaatagtttgtcgtcaaatatattctcaatagtttcatatgcacacataagaaggttaattagagatgcacttgatagtacagtggtaagtaatgtgtgatttcaacctcaagatctcgggttcaatcttcaaccagctataaacttcatgtctcggaattaacacgatattctcttttctcatatttttataaagataaaatattgattctcctatcttctaagcctctcatcatttggtagtttatcaaccacagtcacagataaaatttaaacttgaaacttaatttctgaagttgatttttggatatatattttttaattgtggtctattttttagaattggcttttaaatttctgatattaatataggtataaagttattgtcaataaaaattgctttgtctttttctttttcacggtttatctataaatgtgtgtaagaacatggagtacaacagttcagacgaccatcacctacattatgtcttcacatttatggcctacgtgggcgcgtagttgaggtttaatgtgcttcagttcagcttgatcaaacagcacacgtagtattaattggacgcccactcgcgtatgcacgcacgcatgtactctccataaaaaaaagtaaatataatacaagacatgatgtatcctatgaatttagataaatagttatctcgttctataaaaaacaaatataatacgatatatcattatgaatttagataaacagctaatctagatttataattaatattactataatgtatcagacaatatcatatcttataccagattttttttatggggcggaagagtgccccccacccaattaatatggtatttttgtacattttctgcgaagaggcatatgcaagagggcagctagctagcaacaatttttgccgtggctaataagtaaagccatttccctttgcggcctccctttttttacttccttttcttgcatgcccactatagactacaccatcaaccttttactagttctacattcttacacacctagcaccaataataatgatgctggttttaccttttcatttttattttcaaagagaaaatgaagcaaacatgcacttgagagctagctttgctctcattgtactttagttaggacaaataagaagtataaaccatgcactttctaggtatcttaggtttattacatcttattgtgtgcaagttattgtgtccaagcaccacctaatgacatggctacatcataatggaaatattgtaatgcctagggccctcccacgacgatgcatgtttgaagcaaatgtattgtattaataattccctatcttctaaagaaaagaaatacgaaagcaaatactcagaataccaactatattgcagccttgccgtgacagaccaaactgctcctggcaggctagcatagcaggccatgctagacatggttgaaaaggaaaaggaataagttcacattaggtctcttatcttgacgtcgagtttgaatcacatgcttgaattgtaacaccagatgtaacgtttacctcaacttataaaatcggatcactcgaggtcctaggacagtattttgtcaggttttagctaacatggtgagttgaatacagtcaacccagccgagttagcatgggacccacatgtcagtggctaagtcttcttccatctctcttcacctatcctccccatcttctccaaagcgacaaccgatacagtaaagggtagcacgtggcgggaagaagggcatcggccgatgggagaggagctagggggctccgcttgttcgtccctgagctcgatttaatgatagccgaccttctcaccttcttccgcttcatcaagttacgggcggagcacgtgaaagccgttaggcttcttgtttggggagtccatgggcggggccatctaccttctcattcacctctgcacatcgtcggaggagtgggccggccagcacgtcctggtggtgccccatgtgcgagttcttcaccttcgttgcatggttcgcgccgacactccccatcatgcccattttcgacctcaccgagaagtccgccaaggcaccgaccaagtgccttagctgtatgcaacccaatgtactacaacaactggccatggattgggtctttggtgcagaccgcagggcacccccttggagaatatggggaaaagagaggggagatgggaagagaggaagaggaaagcgccggccgtttacatgtggggtttgttgttggctccgccaggttaaacatggtcaattatccatgttaaccacaatctagtacaatactgctctagaacctcaattacaccagttttacaagttgaggagcacgttataactgatattgtcgttcaagaacaccattcaaacttaacgtcatgaggagccaagaaatgaacttagaaaaaaaagaacacaacgcccaaatattttcctcgtaggccgaacaatctagcccaaccagggcccaaatatattccttcatgggccgaaaaatataggcccagcatccactggccacagcccaaccaggcaggttgacccgtacacacacgacgtccaccaacaccaaagccgccgcttgttttctcgccctcctcctctcgtcttctcctccaccttgcttgtacccgcatccacctcctcaccctttttctctctcatcaatctctctctctccacatccatccaaccctacccacacccacgcgaccaaaccctcggcgcggcggcggcggcggcgaggaggcgaggaggaggcgtatcagccgccgcgttggcaagcgccaggtgcgggcggatcggatccggggggcggagcggaggtgtggtggtgggggggagctatggcgtacgtggaccacgccttctccatctccgacgaggacgacctcgtcggcggcgccgtggggggcccccgcggcgcgcccgtcaaggagatcgccttcgcggccgcgctcctcgcgttcggcgcgctcggcgccatcggtggcgtcctcatggccgccaacaacgtcggcggcgaccgcgcgcacggtgagcgccctcctcttaattcgcgcgtctagggcctgggcttccatacaatttccccccaattgatgctgtggtagtagagatcttgcgggattctagcttggggggtgtggtttggcttcagtgcattgggttgtgaggatgaaattaagggggttattgtttgactgcgcaatcatccattttggtaatttctcagaggaaatttattattattagtaatttacttctggtattctcatttgattttgacttggtcaaccacatgcattttactacagctgggtggcaattgggggaaataatgtactttatgtatgcattgcaatttggtgacagttcgtagaacatacatttattttaatgctactagtttgttgtcaattacattcattcatgtatcaagtttttgtaatatactggcattttatatccaaaagctccagatagcaatcactggaagcaacagggcttgactgctggagtagtgtttaagattcgaatgggttctctagtttgacaactttataggctaaaaaaacttttaacatttttaagtgggtgggcacaaagtgattcagtcatcaagttttatgtttggtaacataacatttgtttagcatacaataggtagggttccccttgcatagaagatagaacctttgctgttgaaactttattctttctttacctgaagccatttcccttttgttggaacaggaatcttcttcatgattctgggtattgtgatgttcatccctgggttctactacacaagaattgcctactatgcttacaaagggtacaagggcttctcgttttcgaacatcccgccgatctaaagaaagaggtgtatcatacgccgacttggttcatctcatcacgtccaatggcgaacaccatttctcattttcatcttgtctatttcttcttctgctgcccccctttgtaggatgaacttctagacatgtacatataaaatgctactcccataatgtatcattatggtgtggtgagctgaaaggttgtccattgtgtgattatgttgggttactatgacacatgtctgataagaactttatgatgttgtgttgctctcatgctgtctgctgtttgtgttaagataactgaagttaccgcactgtcatgacagtttggtccccttatcagataagaacaccattgtgtgaataaacgttccgttagctttggtgtttcgctcattttactgttgatttaccttcagttgttttgtatctgtcaactgctgttctggaactgtggtctgttgtgcctgatgtgttttactgcaaaaagttgcaccttactcgtctttggaattcagtggattcttctcttgtgtcgatctctgataatctcaaatccacaaatgaaaccgtagaatgatccgagtaatgttgacacagaaaagtggcaggacaacctcaaatcaacagacaatggcaggtgaaagacgatctaaacaatgccttgctttagttactactattacgaaaatagaaaatagggttaacgcttagagatttcagtttttttaacgaacttacagatttcaagtttgaactttaataatggtttaacgcgagaataaagaattgtttcattcgcttgatgaactatggagccgtgtacagtactcgtccatgctaagggtgagttcgaatatcgagaagattggaaagatatgcaaaaaaaagataagctattagaatatgattaattaagtattaactactttaaagtgtaaaaatagattaatatgattttttaaaaaaaaattgcaaaaaacgcatcgatgtgctatctcactcatcattgtccatggaacgaacgcaccctaactccctaagtgtccatccgatcaacaagaaatatttttaagatgggcatattttatatggagtacccattgtccattagagttttacagaaatcatccgcctagattagtccctcagttgcacaagttttttcgatccgcagtgactgacagcaaaaacaagcaatcgattgaaacaccaaagcgagcgaattaatgaaaaaccggacagatctatgggatacagatacaatatttccgcttgaaatttggatggatctagaaaggaaacacccaatcgtgttagcggcctgcgtctctctcggcacttctgcaaagggtggctcgcccatggaatagatcggcagagcacccgttcgtctgagagccgtccaaaacatacaaatcaccatacaaaaaaacagcaagaactgaagaaaagaaggcgatgttttcgattgggggatgatttgggtttgtggccaggtattgtggcttggaactaaagaagatggatctccaaacaatcttctcctggcttaggcatcgatctgggctccaagcggcagacagggcaccattgaaacggcgcctgctgttgactcataatatagagccctattattctcaccaccaaatcatttgcatcccaaacacgattcaaaaactatatcaacgatgcgatgaattgaaatcttcaaacaaacaaaatggaagcaaaagcaaatcaatcgttcaacgagaaaaaaaaaagagagaaaaacacggaagcaattaccactcggagaggaaatcaagaaggaaaaccaagcgaccgagatctgaatgcgcttgtgctgcggcggcggcgagagacaggtgggactgatgggtttagggttctgaagcgccccgtgttttatagacgccttcctcgatgtccagcctataagagtatgacacgtgtcccgtgcaaatctgtctcttcctgggccgaggcccaagcccaacaacaaattggttggatactgattatttgtatatttatttattatttatttttgtgtaaaaacgtagtatacgtgattatcacgtttcacgtacgcgtaaaaatcgttatcccatccgaatacgatttactagcataatataacggtatatctcgagggattaaatactctctacaggggcgtatatatacgtacacatacgtacgcgcgtcgatcgccgccatggctaagaagaaagacagcgacgacgtcgccgcggtgtacaccgccgtcatggaccacgtcgtcggcgaggtccacggcgacctcgtcgcccagggcgtcggcgacggcgttaagctggccggcgtcctcgcggcggtccgcgctcgctgggaggccaagctggcgcggcggcgcggcggccccgccctggatggcgacggcgacggcgacggcgcgccgccggagtacaagccggcggccggcggcggctactgttgcgatgcgcctagcagtggcccgcatcatcacgatgcagtcgttaaggaagaggaggaggtagccgcagccgtcgacgacgacggcgctttcttcccgacggcggcggcggcgccggaaacgtcgaacgacggccccgcttctcgggcggtggtcaggcgtgatcttcttggcacgcttggcgcgaaacgcaagagggatacgtgtaactaacaacgtgcatggaactgctcgaatttgtgataaatttgtaacactggcagtttgtgatctatactcctgcgtttctgattacaagttgtttttgacttttggttaaattcaaattatatcaagtttgatcaggtttatagaaaaaatattttttaatccaagacaaacatattatgaaaacatattcgattattgatttaatgaaactaatttgatgttgtaaataaataatattatatttgtctataaacttagtcaaacataaagttgtttgattttcactaaagttaaaatgacttataatctaaaacggatggggtactaccaatgttgtgtatggagaattactaactgcagtactataagataggtggaggaagaaattattcgtaatttatttgataggattgggaaggaaaaaaaatcatcggatttgctcttcagtcggaatattcgaagccgttcagaaacaggttttttttaaagaaaaaggccatcggaatatttgaacttcactaaagagattgaaattggcagttcagaaaagaaaacgatattgaaattagagaaaatttgggaagtagtcaagtagaagaggttttacagttaggggagcgaggagagatctgtactgtacggttgaattttaggtctgatgcatggtcagcaaatgactgaattcattcttctaatgacttctatacgtgatcaacaattgagcatcatagatgctccctttcttcacctgcttggcagattacttttcagttactccctccgtttcagattataagatgttttggctttagtcaaagtcaaactactataaatttaactaactctatagaaaaaaaatagtaatatttacaacaccagcatagtttcattaaatctataattgaataattttttataatatatttgtcttgggttaaaaatattactactttttctataaaattagtcaaacttaaaatagtttgactttaaccaaacgttttaaaatagtttgactttgaccaaagttaaaacgttttataacctgaaacggagggagtacataatttacactttggagttaattttgtaccacatgagagttatttacagatttacagacattgtttgatgatattgcttgctgaacaactagtggttgtgggcctagctagctagtatgctattcacatcctatctcaattgtgtataattgagctaaaaaaaattgttgcgtatacgaaaaattcgtagctgggcccatccaatggaatctgtctaagctaaggcccatccaatggaatttgtctagggaaaaattcctgaacttggccacttcagttgttcagttcttcaggataataatgagctatggtccggtgaacttatcatacaacttctgtaaaaaatgtagaatttcatttagcaatttgtacattgcaactcctttggttcagatgactgatctactttcacagtaatttttttttatacgattacttttgccaactcggattttatgaaccgccatttcagtgggcagttaaataaatcaatctcgtaccgaatacgacacatcttgtatgattatgtccagattcattgtatcaggatgtgccacatcttataagatgttggtttattttggaatgaatggagtactacataataaatgctatagtatcctctaggatacaaagtagctatccaagaattatctggtcctagaaagtcaagtacccgaaaggagagtaggttctcttctgttttatgccggcctttttcctccttttgttctcaccttttacacccccttttccattgtttagcttgactagaatctttctactagctacataaactgctatactcctgaattatcaggagtgcttttccggtggtctctactagaagtacaaacggacatacggtgatgtaaatttccggtgatcgagtatcatttatataactggtcgtaccgttttcgactgaattttattatagtcctataaaattttgattttttaagtttctgttagaatcatattaatatcaccgctaaataaataaattgataaatatgaaaaaaatcactagatatgacatcgtgtatgaccattttcattcccggtcagataatgattatataattaggagggtgtaatcgtttctcttggtggtacgataatgaatcaatggatcgaattctcgttaatcattgacccgttttggtagtctgacgtgttaggttaggatagtgacgtcagcagcaggcccatgacgggacgaatcgttgaaatcatcatgacaacttggtggtgatgctaagcattccctctgatccttgtggctaaagttgatctcgtctgtttttgtttgtccatcctgtttaaatgcacttagcttagttcggtatacccaacttcccatgatgcaccgaaagatctctttgaatgaacccagcaattaacgccggcatactatgattctattagggatgaaaacggataagatataggtatactatatcttgaaccatactccatccgtcccagaaaaataaatctagaactagatgtgacatattctagtacaatattctagtacaataaatctggatgtgtcacatccagtactaggttggttttttatgggacggttaagtatatttttagcggatatggatataaggcagattttttcggatgtcagaaatggtgtggactcaatttagaaacagattaaatctgttggacgttacattattgcaatcaatataacatcgagttagcaatgggacaacaataaaatgatcaataaatgacctatcgtaataattatatacttaagtgctaaataatatgtatacaatgtatacataatataaaaatacagcaatgcaagtgtgaaatgagatgatgaaagccccaaactaaaaaatctaggttaattgatgaatcagatcattggatagtctggctcatgtcacatgcaatggatagagtgattacatagattgataattctggattattcaacaaacggcttattagataatctgatagatatatcggataattcacatccgttgaattttagagataccacgtttgcatccatatccacattatactatctgtatttgcaactatatccgttagatttcttaaaacccgtaccaatacgaaagtcctaaggggcgatcgatcgctccaagcgatcagtccccctccccacatcgatcaccccctcctccatgtggtttccttttttgcaccgcattacttcactattttagtaaatttatacacctaaagtttgtacacatcaagttttcacatctaaagtttatgcacctaaagtttagagacccaaagtttacaagtcaagtttatatatccgattcaaatttgaatttgaattcaaatattttttatatatagtatttctatacatctaaaaattatacacctaaagtttatagacccaaagtttataagtcaaaagtttacatacccgatttaagtttgaatttgaattcaaatattagtttatagacctaaagtttataagtcaaaagtttatgtacccgtttcaaatttgaatttgaattcaaatatttttttatatagtatttctatacataattttttctaactttgtttttttttaaaaaagttatatggtgtagtaggaagagaagaaggggaggaggaagggggagagagagtgtatagaggatcgatcgcccattaaccacacccgtaccaatatcctttgtttcggatggattcaaagtggatgggatccgttttcaccactacatgctatcgtatttacgtattattcgacaataattgatctgttaaggtcaaactaaactaatctgtcagagagtaaaccaaaattaacctgagcaacatgaaagagagagcttcctttcaccctcgtggcagtaataatcaacataatgatagatcttaattgacatagcaaatattgttttgtttgcttcccaggacacacgagatatatatgagtaagtgataagtactgtcattaattaactattgcattctccaatcaccattatattgacccaatgcgctttcaacaagtatatatactgtcatggcggctggctaattgacgtggggccatttgatttgcaggcctcaggtttgaaggataaggattgctcttaacttgtccccttccaagtgatgctctcactaaaagcatgggttttatgtgcttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19845 - DNA, 11000 bp, Oryza sativa
  unsure (1)..(11000): unsure at all n locations
ctgcagccnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtgtaaccagcttctcagcacaagatgtacagccagtgctgtaagataaataaaagtatcatggctttgccgttgcacttgctactacatgctttgcctgcttagcattatggttgagtttactctttcttcatagaaatcgaaatgtgctgcctgcctgtcaagctcaccagccgttcaatggaccactgaacaaacatgtttacaaaaatcattatcttaagctgaaacaggtaatagtactgtactaatcttctgcagaaattgcagtagatcagtgccttaatgaacatcaggagcagcgtgagagccgtacggtacagatgcccaaaggacggggaccgtatgcacggccacctatcctgtcccaaaatcgagttcaaagtacgggagagaattttgtatgggtggtcccatccggccagatcaaggtgggtcccggtgctcagcggcacaaaagagtgccgcgtgggcccagcagcgagctcttcgaatattttgtgctgggctgggctcaaagctccaaaagatacagtagattggatcttgaggacggatgccaaggtggccggtgtggcggcgccgtggccgccaggctggctggacgcctccggctccgggccgacgaagcttcctcgcggcttcgagactcgctgtgcgtcacctgccatatgctctacctgatggaatctggatgtgtgggcggtgttatggcaaaccacagcaaatcagcctcactgccgatggcgttttttttttattaagataatgaattgtttagttaagaaacaaagttaagtacatcaagtctttacacctatcaaaatgcaagtacctaaaagaaagaaggaaaagaaaaggtcatacgatatcttagacataacatgctctctatgacctatttcccagtactacaaatctggacgggtggctattatattcataatactatggacagtcctccgtttatattccgaccactagaatatgtcacattatattctagatttgttatttatgagactgatggagtaacaataacgcaacattagggcacccacaatggttatctataggctctctacaagagatctatgtcagcatattttcctacttggaaggtattaaatgaagagagagagcaaagctatctactaacgtagagatagtctatagagaaaaacgaggcaatgcatgagagagctatagataccaatgtagacatactattaaggtattttactattaatcgagtctattgctgagatgtacatgtttttatagagaacaccttactttatcattgcgggtgctcttatgtattctttgaaaagcattcaataaaaagtagtactccctcttatcccaatttgatcattacataaggtatttaagatcttctcaaaatgaccatcatctaacaagtaaatctttttttgcgccaaaagtaaatgagcatcattgaatgcactgcatgcaaccaaccatgagtaatttatattggtccaactatatgcaatatttaaaacttgatgctccacgaaacacgaagcgacgtagcaccttaactgatgagaattaattacagaatgatgaatgttttattgttcttggtatatgtgctctttacttaggtgatgattgaaatgggatggaaggagtatttccttgttgaaggcttttcaaagaataataacatttattacgtcatttcaactttgaatctcagcagtagaagaattgattgatcgtttgatggcacttgatctagtataggagtaaataagtaaattgcactgataatatatgacacatatatacacaaaattgtaagccgctcatcctagtacacaaacatgtgtggtgtgtgtgaatcaggactaaaattataaaccatagctaatctttctgacttagagatttatgacgccagcatacacacgagaatgacaccatgtagatatgtatagaatctagaaataatgcatgctgactgtatataaaaagatgtataaaaagaagggagttatagtgataaaaacagaggtaaggtaaactataagggtaattttcaattataacatttctcatgccctcacgcgtgatatcctaattagagttcaacttaacaagtttagctatagtgctttatttgaccttggttcgtatgcggtgcatactagctagttcatctatctaaacgagcgtttcgcaagttcgtgtattgtcaatacaaattactcgttcatgcgtggtgcttttggtacatattttcatttttaagttagagttagtcttttcgtcccacaaaaaaccaatctagcattggatgagatgttttctagtacaatgaatttggacaagagtatatccagatacgttgtactaggaaacgtttaatccaatactagtttaaattttttttggacggagggagtatataactatattagccaccgtacacactagtgaggcttaacaaaattgcatcagttttaagctatcctagatcaaatcccatcaaacgatttgctcaaataattaaccctcgcctaatccaagcaaacaaaccagccggagtgacaaatcactacctgcctctttttggggcagcaacatgcaaaaatcaccgcgagacgtctcggaggcgcagtactctagagtctagatcgccgtcgatttgctgacgctctactctgcgcacgtctctaccaccgttgtgcgtacagcagcagtagtgctgtacaggggcctccgccctccagaaaaaaaaaaaccgcactcacttggtacggtactgtccgtgtgccactcgtacagccgcagccgacccccgacaaccgcaacggcatgcgccccctgcacctgcaaccgcccgtcgtcgcaggctggctcgctcgctcgcagcgtccggcacgaggccgcgcgtgagacctcccgggggcgcacggccaccttttcccacccggagcccggtgcggctgcgcccaaaagcgctcgcacgccacagttccccttgcccgcttgcccccctcgcgcgcgcacctgtgcctccccaagtggccgccgcccgcgcgcacagactagtagcgaaccagctagtactagtctctagccgcgagcgtgacgtgggttgcacgctcgtgtcacgcacgcgtttgatacgcccgtgctgcttgcgatttgcgggcggctgatgggtgggcgggggcggtgcgggcgtacaatggcgtgcgcgtcaacgataattctgcgtggattttcgagggattctcggcggtttggcggccggggagggacgtgcccaggttggcactcggcacttggcagaattggcagcaggcaagctttcccggtacagtactggtgtgtcgccccgcaggcaggcagcttcgtggcccaacctttttgacgacgttactattggacccgtctgcctttttagcctgttctctgtggcttgacgtgacatggagacatatgatgcctgctttcaacctggattaagttagaccgtgtttagatgggactaaaacttttaagtttctatcacattagatgttttgacattaattatcgggactggctatatcttatgtgacagattttttagcctcctatcatgcatatttcttatcctttagataaacatctaacggatgacattaatatacacaaacaaaatacaaaaaacaaacaaacggaccacatgaacaatctgaagctcacgtgggctcaagtagatttcagacttacatcgtaaataccctaaaactacatatgtaattatagtgtaagtacgatgtaattagtacgcgtgggatcatacaatatcggatattctgtgaggaacctcacgttaaataacggtaaaaagagtaacagaagggtcttatggtgtgaacacgttaatgatcagacattggagtccaattccatgcagccataggacatacaaaaccgaatcttagcgtcaaatcgaacggatagaaaagtgacagatttttgggaaaaaaactgtcgacaaagatatagcaattccgttaattataaatattaaacataaactattaataaaatctatttataatcttgaactaattcgcgcgacgaatctattgagcttaattaatccatgattagcttatatgatgctatagtaaacattctctaattatggattaattaggcttaaaaattttgactcgcaaattagctttcatttatgtaattagttttgtaagtagtctatatttaatactctaaattagtatctaaatacagagactaaagttaagtccctggatccaaacaccaccttaaacattggagtatggatttgctgcctcctcttcatttactctcatcatctaaattatctaaggctgtgtttagttcagcgcaaagtttggattttggttgaaattggagatgatgtgattgaaaagttgtgtgtgtatgacaggttgatgtgatggaaaaggactgaagtttggatccaaactttggatcagaacacagcctaaattaggcctggtttagttcccaactttttcttcaaactttcaacttttccatcacatcaaaactttcctacatacacaaacttccaacttttctatcatatcattctaatttcaatcaaatttccaattttggcgtgaactaaacacacccttagttcgtttttcatatcttcatttatcaaattttaatataattagttctctcttccaatgcatttatcatatttcttcataaacgaccgatacaatgattacttaaaagtaaactttttttagattaataagagaagcttaaaataaacttattttggaacgggtggaataataaattcctcttttaagtaacaatatgggtttgctgcctcctcttgatagagattcctctatcttttctggaaccaattaatcttgcttggggaaaaagatgttaggaatgatgaagacgaaatagcaacgttttgcgcacgtttttaaacggatcaacaggaattccaaactggtttgccaacatgccgtccgtcaaggttcatcatcatcaaggtggaacgtcaataaagttcatgtggcaacattctttcttctcgcgagtaagctgggaggaatgttctgcccgagaatcatatcgtaacagcctaagagctgatcagctcaagtttgttttctccctgatatagttttgtgtgtaccgcgagagtttcctagcagcttcctgcacgaaatgaggggtgttatctgacccactaatcaagcacttggttgccgtcttggcctctgaatctcggggtaaaaatagtgagagataccaaaggcatctcagaaagggggagaagagacagatggacagtggagcaggggtactaaacaaaaagggtttaccgaagcctgcaagtccaacggaacatgatgcaccgtgcccctttttgtcttgcctctgctagatatggttgaggacaaaaatgtcttggtttcaacacgatggcaaattggcaatgctacgtgcactcacaagcaagggcgtgggcaacctcaacgttgcaactttgcagaggaaggttatttcaaagggagatttattttgctctttttggttgattccaaatttccaatcgactgattttatgcagcagaacagcacaacattttagttttctagaagtagtacacctccaacgcaaatcaagaataatgatataagtaactccagtacatatcaaacggcgctagtttgcacttacagtcaatcatgacatcagataaatatgtaatgcagatgaaaaaaagaaataaaaataatcaatgccgtctttgcaaaataatgcaaaggtagtaattacttaatgttgatcaacttaccataatttctctaaagttgctcaatgtttatttttaactagatagtaacttgattattgccttaacgaatactgcttgcttcttgggtggagcgttaaaaacgtaaatgcatatcgattgaccaaaacatccttttttaagagcaagtttaataatatcacccgctgttagctgaaatttctttccatgacatctgtaaccaacatacatactaatatatacaatagggtcagctctgtatttatcctccttttactgtagcaaatgatatttaattgcgctgcgccaagcatctcctctcccgcgcaaaacggacgcacttttttcttggagtacacgtatcggcgggcgactatttagtcgccggctcgtactctctctcatctgcgctcccggccaagtcatcaacagaatttacgtggcttgcttatcgctagcttttctacccctattgaacctgctctaagtagcttctgacagttatatcttctctaagaatcttcaatacttccaaatagtaagtttttttcacctagtttctaggaattcggaagctatagaactatgtctgagaaaaaaaaagaagctatataattcagaaaatggaaaaaccccctagcttttctggatttcaccaactgctttcagaatctccatctcctctaaacatggcctaaatttatctataaatagctatatactcattgcgtatactactaacatgttaacgtgacactttgctagaaaacttccgcaagtttttttcccctaaaatttcagatttgtaaccatcgaatcgtctcgagatttgtgcatgaagaaaaaaaattgctagaaagaaattttcacacttgtcacgcataggattctagcactaactaactaaatcatagttgaatgcaaatttatataagttacatcataattatagtatagttacattgcaattatgaatgtaattacgctttaattatattatagttacatctgaaagttttggactcagaaaaacttgcggcagttttttttagatactacccttatcggagacattgtacgtggtgggtcgactggtcgtgtgcccattgcataatgcaatgctactcacttgagcgcaccatgcaccaaaatagaagcaacaccctcgaaaatagctctatatatacactgcccgtgccaccctcatcatagcttcactcagccacggtctcctcctcctccttccatctgatccacctgtacgtacgcagctcagccgccggccggcgagaaggagaagaagctagccagccagccatggggaacagcctgcgctgctgcctggcctgcatgctcccctgcggcgccctcgacgtcgtccgcgtcgtgcacctcagcggccgcgtcgacgagttcaccagctgcccgctcaccgcggccgacgtcctcgccgcgcaccccaaccacgcgctcaccgccgcctggtcgccgggcggcgccggcgccggcggcgcgccctgcaggaagatcgtcatcgtgtccccggactccgagctcaagcgcggccgcatctacttcctcatcccctccgcgtgctccgcgcccgccgccgacaagatgatgacccgccggaagaagaagaagcgctgccacggcaacggcaatggcaagggcggctccgccgccgcggcgagcaccgcggagcaggacaactacctgatggagctgctgtccgagaagcgggggacgagccaccgccggcggcgcagcggcgcccgcgccggtgtgtggcggccgcagctggagagcatagcggaggagccatcagactagctaggcagctagctagtgaaccaccttttgaccattttttttccttctttttttttctcttcgtttcttctcctctcgatcttccgctgtgaatatgaacggtggatgatgaggacccttccaattttggggtctctctcgtgcgttcgatcccctgacgagctgtaaaaatcttcagggttcgaacgctgtgtgtgtgtctcggaagtcgagggaaaatttggagaaaaaaaaaagtaagatccaagatgtacaaacagaattttagatggagtgcagtgcattgatttgtttatttccaagttgctgctgtaaattgttctgctcatttttgtttgctggtattgtgactctgagcgatgaattataccaaattcaaaccatttgccatgcaaaatttacgagggtttactgttcagaaacgactttaattagtttttttttctttacttgatccaggtaacagttggcgtcggacagctggaatgcataatccgatgaagattctgcggctgagacggtgtacgttcactgcaccggattaatttgccggtcaagtcatagataccgccagtagtgtaacagagtgctccaggcgcgcgacgtgtcgacgacggcagcgccggatccgaaatcggcgaccaccttgtctcccggctgcccgaccgggtttgtgcccggccagttgtcaagaatcgcctgctcggtgttaacttgcgcaaactcactacgtcaagacgtcaacaactcagctctaactctggagatgaagcctaaccaaacagttttactttattaaaaatgggagcagaacttagtagagtgctcttcaaaataaactagaaataaattagagatgtggagctgggtttaggctgctactgaactccacttcagactgaactcctagagctaaatttaggaattggagctctaccaagcagggcataacgctaaaaagtcaaatagtaaataaaaggcgccatgtatccaagtcttaaaaacattttctacttaaaatctaaaataaggctctcctaacatatatatttttagaaataaatggtcatggtctcgtgagtggcacaagagcataatttttaatagcatgtcaagttattatcattcaaccatattttttttttactcgggacaatagtgaggatagtttggataaaaggttcatatccaaaaatgatactatgatagggcttactaattaacataataagaaaggtttgaaagtaaagaagttattttggatggttatgattgcttcaaacgtctttctctagaggcgccatcggcaaaccctcactcacctatgtgatctattaacattgacttactaagatatatcggcctagctaccacatctatggtacatagtaaacatacatgttttctcttcttactactcttcatcatcattacgcctctcttatcttcaatgtctacgccattttcttagcactagcacctcccacgccaactagcttatagctttcctgcccatatcacattcatagttgatctcccccccccctcccccagtcccccctttccctttagagcatatgggatttacatcacaagaggtgaattagaatcaatttatgaacctatgatttgatataatttagcatttccttatatttggagattggctcgtattcttcttattcttctatatccccccctcccttgcccaaattccccaccttttatcttctcccctcacacacttgtttggagctcgaagaacactaccaaatattggtttattaagattgaagaagatcctattatatgtaccaatcagttctgatactatattgagttatactatatgacaacaatttatcaaaaatttaagagtgaataaccaacatggtccttgaacttgtgcttaaggatcaatttagtccctggcatttagtattgtccaaacaagtccctaaagtttattgtgtgatttaatatagttcttggaccctctaaaaatgtcatgtgtacatgccacatcatctatgcatgcaaattcaatatttaaatgcccattctacccttacactttcataggaaataaggaaaaactattgagaaaaaacaaaaaaaaaagttttggccattggcattttcctttgttttattgcttattcttgtttttccctttgtttttcttttctttttttaataaaaaatgtaaggttaaaatggacatttaaatgttaactttactacatgcacaaatgacatggcattttaattgggcccaatgacttatattaaaccacatgataatcttcagggacttatttggacattataaaacattaaggactaattcgacctctgagcaaaagttaaaggactgaactggctattcacccaagatttaaattgacgagaaagagccaacaattcaccattcattgtacttcaacaaattaacgcctgacaattcatacatagcaaagccatagaacgaaatgttaaatctaccacaatggggacatatgaataatttaatacaatatatccaaattgtgtttacagtttacatttgcatactacaacaaatttttcatttgaaaaaaaaaagttaagcagctaaaaactgatcttaattattttctcgttctccctatacgccctctgtgcaattgcaacgcgttaaaacgaaggtcaccctgctttctgcagacatcagctgcatggcccgggcctccgaaacaaatgaaacaaagtcacaaaccttaccggagctaagctaactcactccacatacacatgtacacaacatccatggatcatgcatgctgatcaaattgacggcccgattagatgatcaaaacagcagcggctgctcaaagaacgacatgatgccgtcgtctctcggctcatccttggctctcgacgcgtagtacaccgcgtcgttcggctgctgctgctgctggct

SEQ ID NO: 19846 - DNA, 5173 bp, Oryza sativa
agagcacagatgcatgtcagcccacacgtacacgcgtcgaacacctacgtgacagatcgatatatgtttacgcacgcatgcaacgtaccttgggtttgggttgcccttgaccaccttctgcccgtacttgcgccaccggtagccgtcgtcgaggatgtcgatgtcgctcatcgtctgcacaaccaccctcggctcacgcaccgtccggttgccggccaccagcgagacgccctcgccgtcgccgccgtctctcctccacctcttggaatcaggctcgtcgtcgtcgagatcctcgccgccgccgacgctagaggcgacccgcagcgacgagctgacgccgttgaccgcctcgtcgtccccgaacgacgccgacgagttctcgggcgtcgccaccggcgtgccggagagcgcgtcggcggaggagtatgcgtcgctggcggcgccgccatgcagcgcgtagccggagccgccgcggccgcggccgttctgcggcggcttggggtggctgtgcgcgcccttgtagacgatctcggtgacctggccgtccggcgactgctccaccttcttcttggtcgggcagccagggaaggtgcacttgtagtagctgcgcgggttctcgctccccttcatctgcttctgcccgtacttgcgccagttgtagccgtcgtccgacgaccgccggctctgctgacggaagccgccggccgccgccggcgccgccacctggctgtagctgccgttcccggccacgtcacccgccgccgccgacgaggtgaattccgctggcctagtgtcagcgtccatggtcggttcttggtagctccatggctgctgctgctcgccattgtacgggtcccctccctacaatattgcaaacacaacaatatcaatgatacatgcatcttttttttggagtgcatcacatgcagggtaattattttttccaagggagttttgactaattgatctagtttagaactgtagcaagcttgactaatggtatgtgcttaggttttcatggagaacgtgaaaatgaagtttgcttttgcaaatctagcctgagtgtcccttatcattaaaaaaacatgttgattaagatatcttggccgcgagatattaatgcatttcatcatatatgtatgctttggcataaaagtcaaaagagaacctccaatccacaagaaattcgtaataatgcaaggacgtcgttgatccggataagcttatcattacttttttttagtaaaaaagtttgtgataaatcactcactaccatgcgactactggcccacatgtcagtccctgttcgtaatttcttagctctgcactaataatttaaaagttgagcttgatgttcgtcttaccaatggagccattagcatggagtcctgcatgaaggagttggacgtcgtcgcggtggctccggccatcgtcgtcgccggcgccgtggacgccgtcggcaggaacgtgaagtccgagtactgttgctgctcgtccttgacccctccttgcacctggctctccggcgctatcgccgccgtcgccgtcgccgtcgtaatccagctgaacaatgcgcccgtcgtcgtcggcgatgggaataactgaaacaaacacgatggagctcaataatcagccacacatgccggtgcaatttggcaaaggaaatgggatgctcgatcggctacggcggccgtgcttgcttacactgggcgtgaggaggatcggcgagtcgagaaacccggaggacgagacgccgccgaagtaggacgacggcgacgacggcgggagagaagacggcggcgtcatgaggttcaacgacgagccggcgccgccactgagcaggctggagaaggacgacctgctcgccgccaaggagagggagacgggcctcgagttcaccagcgggaggctccccggcgcggcggtcatcggagacggaggagaagaagaagaagaagaaagctagcgattcgatcgagcagagtaggatgccaggatcgatcgggtgtgcgtgtgggtgtggctactgcttcttccaacgacgacgcctccggtgatcattatatagacctttgaacgtttgaccgttgactggtcaaagctccctcgaggtttgactggcgggctgcgaccccgcatgctgctgtggactattcgcacccaccaatgggagagcgctgagcaggtgacgtggactatggtggggcccggtgcgggagaaggcgggtacggtttctggtcgcgggggttcggagcgtgcggagtgacggtcgcgaatcgtttgtctgactagttccgggcgtaccgtatacccgtatactattacaggcaaaaaaccaaaaaaagaaacacaatgttctcgtttcatttgattaattaaatgcaaattctgttgcggtacatctagacttcgtgggtttaactacaaaacacaacatagagtaatttttaggagaatatactctgagttatttaccaatggacattgcatacattaatttagtgtttctaggatacaagataggacctgctcttataacattggtgtgccccaaattgctccttggtattctttatggtaacaactaaacgataattgtacatctagtaaataatcatatttttagagtattttttttcttaaaatttacttcgtgtggtgtcttacatatagaaccacgaagtagcgtagcaaaatttgctataattaaattactagtggtttttttaatgaattggggacctgccttctgaagtattaaaccatgtcagatggttgggtagcttatttagtagagtatagttatttgggttttgtatcgctttttacctgtttaatttcttgcccctgtttatatttaatcagcttgactgtttctactgttgtattttgcatttcaggtgtctgctcggactgtatgtcagtgacagttgtagtcccaagacattgttctacgtggatttctttttgttgttaagtgcagcatggtgccatggtggtgaactggtgatcatcaaattagcagattgaccgcttcttagattataaattatcgaagatgagatagtactacctcaattttcaaaagggtaatgttttggacatcgacataccttccattgcatatgttttatcattactttctcaaactatatatttattataaaaatataaaaaaataactatatgcaagagtttttattgacaaaactactaatataatttccatattttaaatagtgatatttttatccattaataatttaatattttgagatttgactgtaaccattgcaggacgtcatgcatccttttgagagaacggagatagtacatttctttttttttttagagaatggtattttttacccggcctctacatctaactagatatatatggccatttaaattaggaacctagccccacaaacaatccaatttgaaattcactttctatggaggcttgaactcaggatcttggggtacatttaaattagaaatttagccccgcaaacaacccaatatgaaatctactcctatgaagatttgaactcagaaccttggggtactactcaggtcactgcaaccactatgctacagagaaatagtaaaagaagagctcaaacagtttacacataggaattgtgattctcatataggtttttatcaggggcaaaattaattcgcttaagtttatcaggttatgaaactttgcagtttgttttcgttcttcaaaaagaaattgcagattgaacttgtacagacatatttcaggtctatatatccacagagaagctaataaggttatgagcaaatcaccatatatagaagtacacttgtgtgaagtatagagacgaggtgagacttgtataacaagcaacgtgtgcatccatacgattggcgtgttgtacatgcatggtcgatctcgagtagcgtgtgtacgtgtaccttttggatgcagaagtcacttggtcacgtggagaaatggaaagtttttccttgttctatagacaggcctcctcgaatatcttacccgtgccaaacatgtgcgttcactctaatgaggattatagcgtgtatacgcactagcgcactgtttagtccatatagtccctacgaattgaaggaactactaggaggatatcatcacttttttaaaccacaaaatcttgtactacttctgttctgaaatataaatagcaacttgtattcaacttttattatttagacgtaacctcatttagatacagagccagaaactattatattttgggacggatcgatgtaataaattttattgtacatccattgataagtggtgaagagttttaaccataggtaatcattcaaccatcccatgaaataagtgaattcattaagatctcgatagttttaaattataggatgcaggttatgtgcggattatttatgccacacttctaaaagtataatatctcaaaacaaaatatccataatccatccaattgtacatttcaaacactcctaatttatgaaacctagccataatatgttatgtgtttcgaataccaataaaaagaagtaagtcgatcattcaatggtatcttatatctaaaaaatgccaaataaaacacatcccaagcagaaatatcacaggtatcgctacgacctgggccattgcaagaatatttgtcactaaatatacttataatttggacttgagaaaacgttaataaaaaattacaaagtttgatttgttttttcaaaatattatatgcactataatttctttttacgaagggagtacctcttgctggctttaagatcactctattccttgaggggcatctcaattgttctagatttacagataacatccaagatttacaggggtattttttaaataagttgtaagggtcagctgcccacaacttgtaactgagttgccccccgctggattgaagcctgaaggcgcaagcatacgtggcctaagttaactccagttactagtagtggtaatgtcctttatttctaaagatggtgctacttgctagctacagaagcaagcatttaaacagtgcatgacactagctaatttggggggaaaaacagtgcatgacaattgactggtcagcgtggaaaagtcattgcctcgtagtgcaaaagctgcgagtactggatactgctcatgta

SEQ ID NO: 19847 - DNA, 2949 bp, Oryza sativa
ttttcatatgcgcatgaatatgctcccgtttatgccagctaatgtttaaggagtggtcagaagtaagaacattctcagaaattgcctcccagatagaagcagatatttataaatatgaaattgtctattgcttcacaaagtgaacaaaggggcaaaaataaaaagaatgacatatgttttcttgttagaagggttgaaccaagaaccagtcctcagggagccttcgtctgcacgtaccgctgctcgcgataacgcatgttatatacagaagctgtgccattcattgacctagcaggttacagagatagtagagtttttagttgtatcaacgtatcacatcagatgatttcagatgatggaacggactgacggcgctgaagctgtcaaacataggttcagtaccaataatgaaaaggttgatgtcgaatcctgaagcaaaatgtccattgcgtcacggttttgtgattgatgaagtaaacaggctggtcaggggagaactgaatgatctacagatggcatgagagcatattaaaaaattcacggacatcttcttgttagccatgaatttcccagcacaaaattggatagtaaattgacaactctcgcttaccattcacttcacctcaaaaagaaatcttacagagtagtacagaactgaactgaaatgatggtctagtctatacatttcataagcaatggcagttgcatggaagctgcagatgaaaaaaaaaaggtgtatggtagttttctttacatcaaatatacaaaatagactcaggataactaatgcttcattgcatttcccggtactacaattcgggctcaccgtctctgtggagaacagatggagtaggcgccttcattgtcctgtcgcccattgtcggcgaaccccccagagggctaggtccaggtgatctccgtggagctgatggactctccataatgaagatcgatggactagcagtgctgctcctgtatggcgaacctggatttgacctaaaaagaggcaaaccatcttcgcgcgacaatggggtcattacatgctggcttctcgcagtaatctgctctgtatatgacctatcttcagcaatatcataataatcagcagttctcacctcctgggcaagggagcatgaggagcagcacaaccactggaagcaatctgtggcttctgcactgcggcagcagaagttgttcgcaggtaggttaaatctcttcctcatctgtattctccaaaagccaccatacagtaagccgaaaaagcaaagtgcgagaccggtaagccctaatgcttctcgaaggttttcattgttaatattgacagcagccaggttgaagatgaaaaacggagcaaggcaaaagagcataaatgtagcaatatggacatacatgttaccaaatccaagcctctgcatattccatccaaacacacagcaactgcagaaaattgacaggtaggcaagagatatattgtcccagaaatccattagtccaccaacccactcaggcctactctccacaaaacggcgctcttcactttgaatgaaagagtatctcttttcaagtgatgttcgtgaggttgctggcctggtgagttcagtttgtgcttcttggtcaacttcagtcagttctgtgtcataatccttcccaagaggactgataatgttatacaatccagcaaatgccgctgccccgatagcaacggaaatggtcaggccaacaccgataggaggtcgttcagatctgcggtatcctaggttgagaccacataaggcatactgagcaaagcagttcaaattaaggaggaccacaaccaccatcatgtgcatccattcattgggcttgtatgttccatttttgcaatatgtttttctaaggaccaaaacatccttttgctcccatcgacacaacagcacaaagtaatatatccgctttgggtgttgataaaggcacatgagtgtgaataatgcattcaaaatctggttgtttacttcaaaccaggcatctctttgtgatttgctaggcaatgcacgattgagcattccagtcatgacaaggaatagtattgcaccagatacagtaacacaagcaatccaagcaaaaagggccatattaagaggctcttttatccaatccttgcacattacccacagatggccccaattaattttcctgataaactggaagtgctcatgattatcatggctgtcagagtggatggaacgtgagaactcatctcgctcaagtgcaagctgtcgaaacttgaatgaaggcgaaggacccaacttcttaaacctgtcaccactggaaaagcgattacagaaattcagaaacccattccgctgcttcccttgtcgtggaacaccttgagtaggaagagtactggcacctggggctccagtatcattgtccactgttgtcgactctactagttcaacatccgctttaagatcttcattaccattggagaccattctgtcgagccagagtctcagatagtatacgcaagctaaacccctttccaatctatttctagactgatgcaatgttccacagaaaggatcgctgtactataggtttgcaaggacaagcatatgtattattgtccgccaagctctgcgccaaacagaaagagacccataattaagcaaagcgcgccatattggtatcaattttttggacggataactggaatgtaatgcgtaattttacatgctaatgtttgttgctaaattagctgccaatggagaatagccagcagaaagagcaaaatttatcatccatgcaagcattagctactgtgcacgcctcattcgtactaagattatccattgtatgtctggcgcctgaaggttgaaataccaccaaattgggcaccgaaacgtttgtaatttgagccaataaagtgaataaacccccatctatcccaacacacagccatgaccgatt

SEQ ID NO: 19848 - DNA, 2954 bp, Oryza sativa
cccgttacggaccacacgcacgaaatgcatgcctctttttcctccgctcctccgtcgtacgaaacggaggttaacgaagcgaacggtggtttccacgtgagaaaagggggagcttctccgccaagcggttgaacggcgcgtggcgttgggtgacccggcgacacgcgggattttacgcctttttgtccgaataatatattttttttcaacggcttttgcgtacagagggatatgggaggggggattcagaggggcgggcattgggagctttcccggaatggcgattggaaagtagaataatcattaaggtggcagttgcaatttgttaagtacagctcaaaaatatactccctctcgttccaaaataattgtattttttgattgaagattcatccctaaataattatcactctagagcactaattgcccccataaatcatagtctttttttttctcaatagatataagtgtcacaattattttttgatggaggtagtacagtatttttttaatttaaattaaaagttattatattatggtacgaaggtgtatattacgtgaggatagtgcacagaagaacattgggtataatggcgtgcacatgttgagtatacttaatctttagccagttgcaaattattaggtcttttggtattaaatatttgaatgatcaagtgcgtctacagtttatttataatttttcgctgctaccacggagcttgacaataattattgcgtacaaaatcccttttcatgttcaactgccaccaaaatttgtttataaactttttatgctaaccagggagctatgagtcatatttatttcatatggcatccttgggggaaaggtgtcttaaaaaaatcagggaaaaagatgtttttggcccagtttagatcctccaaaatggtaaaagttttaccattttgtagcattttttgttattttggatctaaacactagtagcaaaagttgtcaatttggtatttggcatttgctagtccatagtagcaaattatgccaaaaagtgctttgggaccactccatctctctttctctctcacactttagtgctagaatggcaaaacttttacatacatctaaacaccaactagtacttttgcaatgcaaaaacttttgccaccaaaacttttgccatttgtcatttgtcattccaaatggatctaaacaggccttttatttatttattgctgtttctagtaaattatcttctagaattaccagccaaaattgtcggctagataactgcggctttgtgttcgtgtcgccctggcagagtacaagaagaccagtgcatgtcgcgtacgtaggccttttgggcccatacaccccatgtaacggcccactcactcagccagccttaatcatggcccgcaccacccgcgaccccgttccggcccaactaaaatgggctacacgtatgccgcaatccagttccgatcagaccaaaatggacctagcgtcctcaccagcgtgggccgtggtgggctaccaacttctcctcttctcatttttcacgcacacgttttctcattctttcaagttggttcaagaaaatcaatttcgatcttttcttagaaagtttttgttagctgatagaagcactgcgcactcaattaacggaatcatgtgttaattcatcgatctgttttacgtgtcaagagggaaaggttgactttaaaaaaaaaaacacaacctcctaactagagcgaaaagtagggcttgaagatgtttttctactacacgtcacgcgtatggttccagatccaggactatacgacaacacctgctcatcacttcatcagctcatggtacggaggacttcctccatctctaaatatttaacatcgttaatatttttaaacatatttaaccgtttgtcttattcaaaaacttttgtaaaatatataaaactatatgtatacataaaaacatatttaacaataaatcaaatgataataaaataattattaattaattaattttttaaataagatgaacggtcaagtatatttaaaaaatttacggcgtcaaatatttaggaacggaaagaatagttattagcccaacagtgttttcgtcatcatgcgtaaaggtgcaatatatcgtccaagactgatcaaggctagctaatggctagttgcggagtaatcaccgagtaattagtgtagaaaggacaacgagtagcctgcaaattaaatccgaatctatcgatggatcaggttgcgatccgaatgatatctgacaagacatcgatcaccgtatgtgtgctcgtcctgaagagagaaaaaacacgacatgacccaatcgatggagcctggctagctttgacattgtgcaactctatataagcatagcaactggggactggacacttctgccacttgagctgcgtggagttgccctcacaacaaatcactgaaatcaccatcaacaagatatctaggggccgtttggttgctatcttcaatttacgatgtctaaggttttacaatcgtttagttcattgtcacatctgtgactcgccacacttttcaaccatatggtcccacgtatcattgacccaattttttaagtaagcttgtctaaggtgttgctaagaatttatgagccacaacttttgtgacaagccacaacttatcttaattgtggtttggtaaagatagccacaaaccaaataaccccctagagcatggtttttcttgcgatcctgtagtggctatggttttggattctgcgaggcatctgttgcactacgtcgatgacaacattgggttttcttatttaaaatatggaatcgcctaagtttcatatgacagaaattttatggtagaaagaaatccaccattagatccactccacgattcatgctacattccttcttcagcttccctgaccgccaatgacccgatgaattaaggcttaccattctggg

SEQ ID NO: 19849 - DNA, 8350 bp, Oryza sativa
  unsure (1)..(8350): unsure at all n locations
nnnnnnnnnnnnnnnnnnnnnnnnnnnnnnnnnnnnnnnnnnnnnnnnnnnnnnnnnnnnnnnnnnnnnnnnngccttttggttttaattttttgacagtggtctcggagaatagaccagagtaattctcttttgaagacacattttccctgaccgtgatgcacacggttaatttggaccgtgtcttctccgatcattccttggctagtcttcgttgtctcaggattgctttggaccgtacattgaatcttacttaacctgcgcaacactgcagtgacatatacagacaggtaagttgatcgcttatgaggaaatccagaaaagcgacatgtgtgttcagcaatcagcacacaataatataaagttataaacatatgttgatatatgtcatttgaccacatactaaccctgttgtgatgatatctctctgtctagacagtgtatatattgtcttcagcctccagccagacatattcagtctcacagacgaagtgatggagatagaggacctagaggagagagaactcattggcgatgatgggtcatgatgaatcatgacaactttaggtgattagggagaggactgattaagtgatttgactagtgcacgcatcgtgaagaattttggccgttcgaaaataacgggatttatgacaggcaaatgggggtaatatatatgcccatatctgttgtctaaagtattattgcctcttatgatattagatttttttttcttggttacacagaacgattgaagacatgtacacactatgatcatgttcggataatgagttatgatcatgttttcgcgcagtcattgatcgatgtgagctgcatgagatccccctgcaaaacaggaagttcacttggagtaatgagcgtcgaaaggcaacccttgtcaagcttgaccgttgcttttgcaatgaggaatgggatcttgctttcccccaccatgttctccatgcctttcctacagggccatccgaccattgccctcttgtactgtccaacccgcaaggcccacatcgtccgaggaccttcaagtttgaaaacttttggacacgggtcccggggttcaaggacaaagtcaaggacatctggagccaaccttcttcgcacactgagcctatgcaccacctgaatcaaaagctgcaacgtacggcggtcggccttagagattggacaaaaggcatctgctcagaggctaaattgcaattccatatggcactcaatgtcatccaaagactcgacgtggcacaagagcacagagaactctcccccccggaaacgcgactgagggcggctctcaagcggaaagtcctaggactcgcttctatagaaagggcaaggaaaaagcaagcctccagggtaactcacatccgtgaaggagatgcgaacacgaagttcttccacctcagggttaatgcgcgaaggagaaggaatacaatccaaagattgaaaaaggacagtggttgggcggtgacgcacggtgaaaaggaattgacgatccatgatcacttcgcaagcttcatggggaggccggggccgaggccaaacgagctaaactgggagacgttggacatcacaccgattgatctagccacgctgggggaacccttcactgaggaggaggtgcatagggcaattaaggaaatgccagccgacaaagcaccgggaccagacggcttcactggggccttcttcaaagtttgctgggaaatcatcaaggatgacattctgctagtcttcagctccatctataacctgagatgtgcgcacctgaatttgctcaactcagcaaacatcgtcctaatcccaaaaaaggatggggctgaaagcgtttcggactataggccaattagtctaattcatagcatcgccaagatcttcgctaagatgctagcgctgcggttaaggccccacatgcatgagttgatctcggtcaatcaaagcgctttcataaaggggagaagtattcatgacaactacctcttcgtaagaaacatgatcagaagataccaccgcctaagacgggcaatgttgctcttcaagttggatataacaaaagccttcgactccgtgcgatgggattacctactggccttgctgcagcgcaagggcttcccgacaagatggatagactggctaggggctttactgtcgtcttcgacatcccaagtcctccttaatggctcgccagggcaacggatcaaacatggaagaggactacggcaaggggaccccctctcgccgcttctcttcatcttggcgattgatcctctacagcgtatcctttccaaggcaacagagttgggtgcaatttcaaaattacgaggaagaacaactcggctgcggatctcaatgtatgcggatgatgctgtgatcttcattaatcccacccagaacgatgttgcgacttccgcgaacatcctacatcgttttggcacagccacaggactcgtcaccaaccttcagaaatcccaggttgcggccataagatgcggcaatatagacctggaagaggtcctccaggcgttccggcgaagcgagcaaatttcccactaaaatacttgggcctcccgcttgttctcggaaggctgcgaaaaacggacttgcaaccggtcttcgacaaaatatcagggagagttgcaagttggagggggaaaaacatggcagcagccgggagaaccacgcttgtaaagtctgtgctttcagcacagccaatttatctcctcactgccttgaaggtgatgaaggaatccctggagcagcttgacaagcagagacgtcgcttcctttgggctggtacgggggatatcaccggggggaaatgcaaggtcaactgggcaaagacatgcttgccgaccagccaagggggccttggtgtcctaagcttggacaaatttacaagagctctgagattgcgatggttgtggaacgaatggagagatccaagcaagccttgggtgggtttggaaacgccttgtgatggtgtggatagggacctcttcgccgcctcaacaaagataactgtgggcgatgggaatacgacgcgcttctgggactccgcatggattaacggccgaagaccaaaagacctaatgccgttggtctatgagatctccaaaaataggaagaaatccctacggcaagggaaagaagacgactcctgggtgcatgacctgaccctcgatgcgggttcatctatcacaatcaacctcctcgatcagctagtccgcctatgggaggcggtacggaatgtgcacttagacagcgaggagccggatcagattgtttggaaattcacaagcagcggccactatacagcttcctcggcttatcatgcccaatgtttgggggcgccaaacacaaacttcaactccctaatctggaaagtttgggcgccagggaaatgtaaatttcatgcctggctcatcattcaaaatagagtctggacgtcggaccgactcgcgacaaggggctggcggaataacggacattgccccctatgtcgttgtgacaccgagacagccttgcacctcgtcgccatgtgtagatacacgaagagaatctggcgcctcgttgctacatgggcgggatatcagcagttggaaccggcccaatgggaggaagcccggtcagtccatcagtggtgggagagcctagctaatacacccggcattccaaagaagggccttcggtcccttatcctgctagtagtttgggaaatttggaaggagcgaaaccggcgaatctttgatcacaaagagatggcaacaggtgttctcctagcaaaaatcaaagaggaggccagcttgtgggctttagctggggctaaaagattgcgcgagctcatcccgcactctgtatagtgtatagtctaaagatctttttgttttacccctaggggttgtattttctccttctatattcaatgaaaaagcactactgtgctgttttttccgttcaaaaaaaaagagttatgatggattgaattagaaaatggaaatgaacgaatgggtaagatgaaatgacgtgagatgaatggatggctaggagttaaaaatatcctaaccatcaataagtgatggatgtcggcgatagttccatagcatcagtaataccatgacattcttattttctttttagagctccttcaaggttccccatagaaaataatacttcttccttcaaaattgtaacgcctatatttttacatgatttttaatagcataatttgttcaataagttattcgttattatattcctaacgaatataaaattagtatcatatgaagtatttaaaaatacaaatataatgatataacatatataatacttagcatagatatagctagtatgatcattagtcaaaagctaccaaatttatttttttttaaaaaatagaagcgtcctgtaatttgagtgagacggatggagtatgttggatttttttcttccataaaacaatcccacaaactgtctcaaaatccattggccacaagaaaaacaattcatagatacattctatacatttgatcttaaatacacccgaaaagggacaatattatcctatactgagtagaaaagttttccctaccaactttccctaaaatggtcagcctgtaagttgcctttcttggtggtacatccactaaaagtttgctggatatattaaaaccgtccatgtaaaaaaaaaaaaagctttgtccagtcacagtgatttgcagcgcatctagtaataaagtgagctgtgtattatcctttcctttttggccatatacgtatatacgtacacacaagttgagcttctcaatccaccatgggattactcaaaaagattagaaaaagaaactaatgaaacaaaatatttttcccagaggaaaaaaaaaggcaaatcatcaaatcctactccacatcactagctgtagatttttttctccacttaattaattacgtggcacctaattaatttgttaaactgctgtactagaaacttctggttctggtcccttgttatcatctcctaagttagtcgctggccgctggccggcgcatggcatcgtcgtcgacctcgccggcggcggtagcctcccggcgaagccgcgcgacctcgcgtacagcacggtgcagagcgccgtcccgacggcgcacgtggcgccccagacgaggaaggtgccccggtagcaggcggcgccggcgcagcggctggcgccgcgggcctcccgctggtagaggaacgcggcgaggtagccgaagcagagcgagccgacggggatgttggcgacgagcacgttgtggttcaccccgaagttcttcctcccgaacagctcccccgtcgccgacaccgccaccgacgtgatggcgccggtgcaggtcccgaccaccgccgtgctggtgtacaggaacatgtccctcgggtccagcagcaggaagaacgcccccgccatcggcgccatcagcgccgccatggacgccgtccttgacagcgagtagccactcctgcgcatagtcaaaacccaaaccaaaaattcatcccctgtcaggacatgcataaacaaagactccaacatttaaacaagttgtaaaaaacacgagtgatttgatttgatcggcacatgcatgcatgcatgcagcttggttgcttactttgcggtgtagtaatccaagaaggcgggaaggaggcggccgaagaatccgaaggaggacgacagggagacgagagtggacgggtcgctgagcccgcgggactcggcgatctgccccaggttgttgaggaagaccaaccccagcgtgccactgaacatgtagctcaggaagtagagccagaagtcgagccgccgcagcagccggatgccgccgacctcgtcttggccgccgctctcgccggcggcggcgtcgtcctcctccttgttctccgccgcctcggccacctcgagcaccgacacggccgtctccggcacgtcggtggcggcggcgacgtcgtgcactctgttctcccgcttcgcctcccgtagcttgtccatgctctcccgcaccttgagcgccgccgggatgagcaccgggagggcgagcaggatgtagaggctgatcatgtgctcgctggtcgagagcccgatggacttggagccgatgctgccgacgacggcgcaggctccggtggcgagggtaatcgcgaacatggcgaggaacgccgggtcggtccggcggtggctggtgagctccaccacccggagcgacggcgccgccacgagggtgacgagcatcggcacgacggcattgaggaggaggtacaccttctccttggagtacctcgccgtggcgccccggggcatcttctcggccatggtggtgtagagcttggcgctcaggccgaggtagctcgtcgcgaggctcaccgcgacgcggctgtccgacgggaagttcttgatgcagaggaggtagcacaccgtgttgatccagcagatgccgttgccggcgagggaggtgagcaggaacaggtgccagtacgcgagcccgggcctctccaagaagaggaactggacgccatacccgacaagcccgaacgacgcgccgacgacggcgacgagccacaggggcaggtacagggcggcgacgccggcgaaccagccgaagagcttcccggcgtcggaggcgaaggcgaggaagttgagctgcacctgggagatgcccttcacctccttgagctgcgacgagtacaccgggaagtcggcgttcgggccgttgatggtctggagccagacgcttccgaccaagctcagccaatgagctgaggaaggagaaggcatagctagcgtggatttttcctctctagctacctacagcctctgcctccctctcaccggcgccgctgtacttatgcgagatctcggtggcccggcgataaatgcaggggacgacggcgacggcgacggcgatggctgtggctgcctccgagcaatacgctctattatgtgtggtttcttgttggccattatggctcatggcgagcagcttatatagtgcgagctccgctatggtgttctgaccaaaggagtgtacgtgacaggcacctgacctaacagcagtggtcggtcagggttggcagcgaagaggagatgcaaactttcttgaacatctctgcaattaatctcaggaggggctcgaaactgcaattcagccgttgtcaatcggaagcagctgctgggtgctgtatctttcgtcagaaactggatcgaagagagatgccaggtttctggtacagtaacgtgcagcgtgtgctgctaacctgtagacgctcgtgcagttcatggccgagaaattcagatccgtcagagagaagcggctctgcaagccacgaggttcagacgccggcctagctgagatcgtaaaactacgattttactacgtgttggccgtcggaaatctgatcaaggaacgtgttaggctgcaaggtcgcaacgtagcttgtcatgtcacattgtcaaaacaggcctcatgtcttgaagagaccagcaagaggcggcggcaaaatcttcagtaaatgcagggcacatcataccaaggatattttttttcagtaaataccaggttaatcctcgtgcgtggcagatttttcatggtctctgaagtactgcgtctgaagatttttcagtttgtaccggacggcttaccatttgatgcttctgatgcgaaaggttggacacaatgcgagcatatatacaggttcagatttttggtgcagatttttatcagcctgcgtgtttacatacgtaggccgatcgaactcatctaattctccaatcttcgtatgcaagttctacagataaaactcagttgctgatgatctggataagagatcttttacggggcttgaaaggtaccccaggtacctccttaacgaattgttatccaccgttaatcttcaaagggtaatttaggaacacaaatttttattaacaagggtagcttagtaattgctcaaatcccacccgtcacccaatcaaccaagccgtcgcaccgttgattcaagattaaccctaatcaaccgagccagcgcgtgcgatggcggcgaccggctggcgcgacgggcttgtcggcggtgacggcgaccttctgctgcgtacgtcagctgcgaccggcgggcgctacgggcgcgtgcgtcggcggaggcgacggtgtccagctgctgctttcgtaggcgcgtatggcggcagcgagcggcgggcgtgtgaggcctcggcaagcggcggcgtttacggcagcgacaaccagcagatcatgtaggttcctctcgcacgcgagcgttctaattcttcctctcgtttttttcttcctcctgctgaaaatg

SEQ ID NO: 19850 - DNA, 5594 bp, Oryza sativa
ccacgcgtggggagacggcggcggacaaaaggccccgcgcacgccggaggaggaaggcggcgggcgcagagcggcggccacgcgtggggagacggcggcggacaaaaggccccgcgcacgcccccagatctggtaaggctcgctccacaaatcgctgaaaaaaaagcaaaaaaaggggcacggggaactcatctacgccggttggggacgacggcgaggggaaggcacaccggaggggtggtggttgcgaaagtctggatgggggcgggtgcgaaatggcgtgaggagagagatacgctatttttgcctcttctctctcctactatggcgcatccgccaattttggagtgtgggggtagcgcatctgctggagggcatttttttcacccatatacgccaataccgggatggaggattggttagagtatctgctgggcatgctcttaaccccctccaaaaccctagagcagcagcaactggtacattttgcaacttttccaaaataaaaaataaaaaatctgaattttttaaaaataatttctagattttcagaaaaatctaaattttcatatacattttctggtagattttcaaactacacatcatgcaactctcaatctatcctcccccaaagtacactgctaccatacatcatattcttttcttttctccagcgtagcttataattttgtggcctgaggggaattcttgtctttttgaaaaaaaaatcccttcgattggatctaaaatattaaaacaatgagtgtggtgtcgttcagtaaattaccattctgtaggtgtcctctagtcatcgcacgtttttggatgtccacatgtaaattaaataaacattgactatcatgtagcaacatttgcctataattatatcccatcaatttttggaaatgaactttttatgttgagcattctgtttttcttaccatgatgtctcactctcttgtgtacctctattttggtttgatcccttctaaatttgtggagtatattgttggatgtgttgcagtttgttgtatgagacagttatatttacgagtgtcattatgtgaggtattatcacgacaaaaaattttttagacgataataaagtatatttctatttattaaaaagcatatgtatcatatttttgtgacagtagcacaaaagatttgacacattttgtatatattatctaaaaatgctactatacaagacgaattgtcatgtttatcctttaaaaaatgctaaatatatttctttaaatatatgttagattttctgcatttaatactttctcacacaataaacttatgaatattatagttatgcaataaattacttacttccaacggtagatttcataaataacttaggctattcccaacccaagacactagacatagtttctataaactccacattatcaagaattatcaagaaactagtactagacactattcttccaatgcaaacaccactatttcatacttaaatttaatgctacttatctcatatgatgtcttggatgttgtgtagaaaccatgtctcatgcaagacatgtcttatgcaagacatgatttccttctctttcctcatgtattcacttgccacatcatttttcattctagttggcatattatttaatgggagcgtatcctatgtacacagaccttcgcgtgtacacaccatgtacaccaactaaaaattatcacaaaaaattctaggataattcatacatgtactttcaatagtattacatctacgtgcaaagtcgcatcttcaaattcattctacatagagaataacaaaaaagataaaattctgacaaaattacaaccttaaaactgtcagattttttgtttttttgttacggctaaaatataatgaatttgacgttaagattttaaccctaggtgtaatacaattgaaagtatgtgtatgattttttctagattttttggtgacattttttagttggtgtgcacgtgtgtacacatgagggcctgtgtgcataggatatgttgccttatttaatgctgtagacatcatcctagtcattgggttgggaatggccttacatgcccaatggtaaaactaacttttcttatacattaaatggtcaactgatgaaatgagcatggaaggaattaaattaatatttaagggacatgacactaagggagtaaataaaactcaacgccatggaagggattggctaaattgttaggggcatacaagaaattatctacaaaaaatgatcaaaataaaggggataaaaaaagtaaaatttaagtacatagaaggattaccgcgtaaggaatttttttcgataaatatgatgggtcgactgattggttaacttacctgtccttggatgagtggtctgctgatacagtgcggttcaataacataataaataagttataggtttatgaaatacaacccatgtatcaaaataaaaggttattagcattggcacccatataggcctcaacatctaaatatataagtactatttttgtatttaaatatataaaattgttgactttagtctatcttttattgtttgaaggggagactttactttgtctttgatgcgcaagtttaagcactatttttctattagaatatagtgatagtatccaacaaaattataatattgcaaacgtacttaaaacgaaaaatctataaaacctactcatattatttttatgttttcaaactaaagagagctattgatgaggggaatttcagaagtttaaccaaataagttaacataatcatatatttaatatggagggagtatgccactatatgtatacaacatcatatattgtgtcttcagtaacctataccaacagattaatgacatgtcaacagctgcatgctctagctataattaatcgatgtaatgaccacgcatgcaaaatattgctcctgtaaattaaaagggtgtaaacgagttataaaattagccggtagagaaggagccatcacatcaatgaccccaaacaatgatcaccagcctggatctcctagttattagaaacgcaccagcacaccgccatcaactaactccacctccgaacttaatactcgctccgtatattttaatgtatgacgctgttgacatttttaataaacgtttgacatttctgcttatttaaaaaatttatgaaattatcatttatttatttgtgacttgatttatcatcaaatgttctttaaacatgacataagtatttttgtatttgcataaaaaattaaataaaataaatggttagacgttggttaaaaagtcaacgacgtcataaattaaaatacggacggactacgtttttgattcaccgggtaggtaaacattattgcatttctgccatgcatggaagttcaggacggtgtgtttcgtgagccgggtgtttcctctgcccaaagtagagggccctgcaatgcaaagcaagagtcaacgcggcgcactgctcgctggggatgcggcttcctgtcccgatacctgttcccttccctgttcctggcgacgtgtcaccttcttattcgctgggttttttctggtgggtcagtacgcatgcgctcctctttcacttaaacggcgtcatcgtcccatgttatactatcacaattaaattggaaacaacgcaatttaagcgctaacaaaaatatgacgccaagcaaataaaattagtggcgggaaaaaggattagagcggtacataagtacaaatacacagttgttttattttcatctacacagattgcgtctccacactaacaagaactctcccaaatcttggcaccatgatgaactcccgattcctgaaccaatgccatcacaattgcagaatacaggaacatgcggtacgttcgcattcttggatgatacttctgcccccatcatcatcatcatcatcatcatcaaatcctgctgagtccacagatccctctgatggcctgagaagaaatcaattagaagctgtaagatccctatctattctcctttacattttgttaaattagttgcatctaaactgtaagatccggacatgtgcacgtgcatatgaacaactatattcatcgttcctttttttttttttgcaattttttgatggaaactattaccacggataaaattaggatgaaggaacaaatgaagctgctcatacaacaaaatatctggaagacttggtgccaaagattggcatgaaatttagctctgaacaagaagcttatgatttctacaatgcttatgctcttaagaaaggtttcagcattagaagaagcagctatcattacattggaaatactaaaattataaaaaacatgacattttgttgttctcgtcaaggtaaattctttgtttctttttatagttacattaactttcaattagagacattttgtttcaattagtgcactgtattaacaggaagtagaggtattgacaaaagagcagaagcttcaggctatggcgatagttttagtaagccagaaactcgatgcaaatgccaagcatgtatgaagataagtctcatagatggattctattctatctatcactttgtgcctgaacataaccataatcttgccactagaagtcaggctcatcagttaagatcacaaaggaagataaatgaagctcaagttgcaagcattgaagtcgcaaaatccatagggatttctactaaagcagctattgatttgatggcaaaacaagcttgtggatttgagaatctcgggtttactcgtgttgacataaagaataaattatactccaagaggtcactacaaaccaaacaaggtgatactgggggagtgttagaatatatggagaagaaagcatcagaagatgtcaagtttttttattctattcaggttgatgaggatgacttaattacaaacattttctgggctgactctaaaatggttgccgactatgaagattttggtgatgttgtatgctttgacacaacatatagaaagttggatgacggacgcccttttggtttgcttgtaggagtgaataatcataagaagactactatttttggtgctgctcttctatatgatgagaccgctaatagttttgtctggttatttaaaacttttctaaatgtcatgtcaggaaagaagccaaaaacaattttgacagatgaagatgcagctatggctaaagcaattaaaatagttcttccataaactcatcatcggatatgtgtatggcacatgaatcagaatgcctgcaagcaccttgctgggtgtgttaaggactataagaaatttaatgctgactttcagaactgcatatatgatcaggaagaggaagaagaatttttacgtgcatggggccaattgcttgaaaaatataagctccagcaaaatacatggttgcaacggatttttaagaaaagggagcaatgggcattagtatatggccggaacacgttttctgcggatatgagtaccacccaaagaaatgaaagcctgaataatgaattaaagggttatattagtgtgaagtatgacatgcttactttttttgagcactttgacagattgggggagataaaagatatgaagaggta

SEQ ID NO: 19851 - DNA, 3118 bp, Oryza sativa
ccaatgttaaatgcagttgcaagaagtttgaatttgctggcatcttgtgctctcatgcactgaagatacttgacgtcaacaatattaaatcagttcctcaacatatatattaaaaagatggacaattgatgcaaaagtattgcatataagtggcaacagcaatatgcatgatgaccctagaataaagatatcagatcgatactcctcattgtgtagaatgtttgttcgaatagcttctacagctgcaaaatctgaagaaacatactccatgtctactaattgtgctgaaaaattggcagaagatatagagaagttcttgagaatcagaagtgatccagatttagacaagtcgccttccccacaaggttcgtatcaaagttctatatgttaattataagtaatattatagtctgaccgatacaattctaaacatattatttccagttgggaaagaaaatcagatgcccaaaaagccaagaggcattaagctcaaggaaaagggcatccatggttcagctagacgtgttggtggcttagagaaagcatcatcgcagaggaagagaaagaagaaggatgacgatgttccggaccatgtgctagaaccacaacctgagatgcagtcacaaccacctgctacagtaatggtatatttctcacataattaatctccaaaatcgcatgctcttgttatcatccctgacctttcctctgttttttttttgttatgttagggccatctggaggttcctagcaaccaaacttttttacatgtatcacagtactatgctgctctggaagcgtcaacacaccctttatttcatactcctatctcagtgactccagaaagtcaggggctgcaccaagggaggccatttcaacaatttgacactgatttccacaatatgttcccctgacctacttgcaatattaatttcttttagtgcaacaacatttcgtatttttaatttactgaacactgcaatgaagtttacttattagtagtaatatgtgtttttggtcagattttgaataaacgatgtgcaaactatacagcaatcctcttcaggccacaagatactatctaaatcatgcatagcattcagaagttgtcaaaaattgaacagatctgaaaaacaaaggcaacaacattgggattgggatcttactgaacaaaatcaagtcacacgggctggattggatccacaggttggcgtaatacttgacgatgttagcatcgatcacatcatggaccttctcgatccaagctcatgcactttgatgcagctggacattgattaatttgcacgagctgaaccatgcatcagctccaactcagcggcaaggcgcttgatcagtggtggcgagctcgagacaatcgactgctcgggcaagcggtgctcgagctcacccgtaaagcggcggaatctggcggagttcatctaggtcaaggtggggaatttttattttgttgtagtaatagtagatcagcagcatggagagagacgatgccttctgttgggggagggaagggatcaagggattacgccgttgtgtgaaaaagaacggagacgttgacgccgtttaagtgaaagagaagcgcatgcgtactggcccaccagaaaaaactcggcaaataagaagatgacacgtcgccaggaacaggaaaggaacaagcgtatcgggacagggaagccgcatccgctcgctggaggcatgttaactgatatcctacaagtggaatgctgattgagatttgagcatatctgaatgaatatgtcccaggagaactgtaccaactaacactgcagcaccatgttggatttactcccacatttctatttcgaatgtgcaaaaaccttgcaagtcaatatattagaaaaagaaaagatgtttataactgcaatgtgctgacgtagttagggaggattaaagggaaggggaaaaaacactggattaagtaggagaaaatcgagccctaaccagcaagtggaaaagtgaaaaagacaagctagggtctataatagtggggagcacaacttatggggatagcactcacccaaaagattagtgtgtgtgtaaactaggacttaaaagttgtagctctagttagacctgtgtggtaaaagacccaatatgatctagatgacccacggttggtgggtcgaactacgcactctaataagtggtattagaacccatgtttagtattccaaaacaatttctatggatcacataggaggagctatgataacaagtttctagggtcacatgggctcagcacagattattaggcttggctcgaaacaagtgtctatagttatatgggttgatgtgataggggagcttgttaatagttttatattaaaaattatttttggggggaaggcgatattctgtattttaaaaactaatattttaggttgtgtagtcttatgacttcaaatgatgatttatgttggacctatagcaggtccaacgtaatttggggccacagttggagagccactcttcctggaggtttggatgggctgattacccgcacgtaaaatgagaaatgtgattagcacatgattaattcagtattagtttataacattttgatgaataaatttgttggattttttaagcaacttctttatataaagttttttttatgaaacacaccgtctagcagtttgaaaagcgtactaacggaaaacaagtaatagctaatccaaactactccttccgttctaaaataaatcaactcctagagtttgaaatttgtcccaaaataaaccaatttctaccttcttacctaccaccaatccacaaatcgagaaattttattacttcaatacccctcacctacctaccaatcaatacaagttttacattaattaagggtactatggtgttttgtttctttccttaatagtttcttgggatacaggtttgtttttttttgacagagagagtagctacaaagaacgcagccttaacatagtatgtgggcctcaagtgtcctctgtctttgccatatccagtgctctgcagttgtaaacaacagtataacaccgttgaaatcatgtcaccgggaccgggacgtgaatttttttgaaaattaatattattttta

SEQ ID NO: 19852 - DNA, 16104 bp, Oryza sativa
  unsure (1)..(16104): unsure at all n locations
tcgaacaatgggcgttcgacaggccgatttaaagcccggtccactcaggccaggagttcgatttgtgaccacatcgccagccaccgccgagagtcgccacatcgtcgccgtgagcgccggagggagcgaggggaggggatagcaggcctgagaggaggccgaggaggcgccgtccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcacatatttgttattgctaaatgttggtagaggtatttaagtaattgtacagttaaattagttcttagttagtacatattattgatatgttgtgtgttaaaataggtacaaaggtgttatattttatttggattattaaactagttgtttgttactaatagttgtaaattagtacacggcaatatagtataagttgtaatagggtaattatcgaatgattaaatgattaaacgtgagactatttgtcatgttttatcaggatgtcaggtgatatgcccattcgtctgtattatggcgatgctcctatacaaatatgtaatagcggggtggatttgactgtatatgccttccatgatactagtctgaatgcaccggagcatatgggtttgaacgacgtgttagggtggttgtataatatgtttggggtagatccagtgcacataaatttgtcataaatgccgtgtggccagtgaggggtcaacatggatggcagtggagagtagtggaggttgcgtcatttgggagttggaggaagtttgttagtaaagtaagggagaaaggctatagcctggcaatagtggtgcagaagacaacatgtgttgatcgatcgggggagtcaagtcatgccgtggtggaagaaactccgttggaaggtggacaagctgaaaatgtttggcggactgagcaaggtcgagggcaagaagtagtagagggtaatacacaagaagaggtcattgttcatggtactaatcgtgaggccaacgactcggacgatgaagaaccggattcgcctatgcgtgttgatgcagcggaggagaatgaggcggtagtggatcagatggaagtggaaaacgaggaataccttgcgcttgtagtggaaggagaagatacaacactgtgggacaacgaaactaacatacccgatgattggacgaccatatcaatgagtcgtatgaaggtaaacgatggtttagatgcccactagtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtagcttcgagggttgagcaacatacgtgtttgttggagaatacccgtctggtgcacagaaacctgacagcggcatttgtggcacaaatggtatattcaaaggtggttagaaaaacatctttctcccctttcaccataatgcatgacgttgagaaagagtacggatatgagatatcgtacgacaaggcttggagggcaaaacagaaagcattggagatgaggtttggaacttatgaggattcttatcacaattttcacccactattggaggtgatgcaggcaagaaacccgggcacacacatggctattctcgatgaggtgaatgaatatggggagaatgttcttcgtcgggctttctggtcatttgggtgcatgatagaggcctttagaaattgcattcctttgctctgtgttgatggcactttcatgacaggcaagtacagaggaacaattctaaccgcgatcggagtcgacgcggatagccatgtcgttcctgttgcttttgcatttgttgaaagcgagaacacatcaagctggctatggtttttgtggcacattaaaatgtgtgttgttgaaaacagaccaaatgtgtgtgttctgcatgaccgacacaccggtttgctatcagcgatacagaagcttcaagaagatgtcacacagtccgttccatggccagatttacatagcagatggtgcatgcgacattttggggctaatttttatagacaattcaggagtaagagattgatggacctgttcaagaagttatgcaagcagaatcaacaaagaaagtttgatgccatatgggatcaactggatcgtttgaccactacacacatggaagaggttaggaaaaaacctataattgccagacaggaggagccggagggacttgaacccattcctaatgaagcaccaagtattactcggcgcaggaagcgtggaagggccacgaagtgcttcacggagtgggtagaatttgagccaagggagaaatggtcgttgttgtacgatacagatggatcgaggtatggtgtgatgacaacaaatcttgctgaagtgtataactgggttatgaagaatacacgacctctaccacttgttgctatcctggagggcatcacgaggggtacacagaagtatctctgtaaaaggtattccattgatagtcttcataggttagttcacatcacagttgtttaatcctacattttttaaaataaatcactgcacaacattttttctgatgtgtgaatttgttgttgtgcaggtactccagaaaggggctcgggctttcctacgagctagttattgtgaccacggttcagccgacggtacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcacctagatcagcttacaactcaatggtacgtgtttatttgtggaatttgagcaactagttcaatatttttaaaaagttagcaagtagttcagtatgtctaataaatgtgcaattggttcaactagttccttttcttacataaatgtggaactagttcagtatttataaatgatgtgcaactggttcattatttctaacaaatgtgcatcatgttaaatactcttaataaatgtgcaactggttaaataattttaattgccttgattatttgtggaacaggcggaatttgttgagcacgttcacgtggagtccgacaccctgctgcaaagactagaggcgagacctccagtcgtcaggcctgacgacgtggcgagcatccttcgcaacttccgtgcacgtgctgccgcactactacgtcgtgtctcctgtcggagcgcggcagatgtggtgcagacgtcgggccgacggccatcaccaccactaccccgacgttccagcgtggatcggagtggtccatcctcttcacgtcgcgggtacgaagcggcccacacatctcacggtcgtccttcctttcagcacaccccagcaccggagtacaccagggggtcagccggatcaggggtacccacgtcgagcacggcaccaccacgtccgcaggtattccaaactccgccttatgttcacccctcgcagggagcatctgggtcggcacacttcccttacatgccaacgggggacaacgtgttgaacacaccagcatggggacttcatatcactccgcgtgcgccagagcagggccacacacagcacacatgtaagtcattttaaacaataacacgctttagtttctaattatatgtatcgttactaactacgccatattttttggtttctccctcttgtgcaaacagatgatgagtacggttcggcgtcgacgcatcacggaatgcctgcttactcccctcgcacagcattcattgaggacttcttttccactgatcctccccagggggaagtagcgatggattactggcacgcagcacctcaggtcacacagccgacacaggagacggaggccggtcaggggccagacgtgacaccacagcaggcagctagagataggcacccccctgataatttgacatatcccactgagcagattaggcgtaggaagaagggaggacctagcaagcgtgcgaagggcactgatcgtccttgacttatctatttgtattaaacttttagtcatttatgttctgtccgtactatttgagaaacattttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcaaaaccctaaatcaaaaccctaaatcatatacatataacattacaaaaatattttcctttcttacacactaaaataaattacatattattaaaaaaaataacttattacaaataaatggagaacacgaccctgtcgaactgcgccagttcgacggatatcctgtcgaacaggggcagttcgacagctgcctgtcgaacgggggcagttcgacagccctgcctgtcgaacgggggcagttcgacagccctgcctgtcgaacgggggttgttcgacaggtcctgtcgaacggcagccttccgatctcctcgccagtcgcgctctggccgttcgataggcgccctatcgaactgcacccgttcgacagggacctactttcgcgattttccccggttgaccactacttttgcgattttccataaaaataatattaattctcaaaaaaattcccgggacatcggctagctgcaagggttgggaaaccgagccaaccgaagtgggtcgcctttgcccgtttcgccatggcgtcgtgtgtgttcccaaccgccggtgcatgcatggggcatatgcccttttccagttagctcgcgttactagacacacccatgagtgaacgcacgcacgcacccacgaggtgcgcgtgctgattgcgccgtggactgcacgcctgcacggaggaatctactccgtccaagtccaatctaatccgccgggaggaatcaggaatggagtacgtgatcaatagtggtctgtgctgtgccgtgcgtgcaccggtggtggtggcgcaatgcacatcaggaggagggacacgacgaccgtggttgcggcaaaggtgaattcaccgtcacccgtgtccccgtcaccgtggtgaaaaaatttcaccgtccctgtccccgttcccgtcaaccacgacgggctacaatttcttcagccccgattaccacgtggtgaatttttccccttggtgaacccggttaaacaacaaattcatcaacaaatcatataaatgcaatggaacacaaatcagcagtacaccacattgatatttttccaaaataatatactcaacaaactgctggtcatatcgacggcgacgaacggcggaggaatccatggcggcggatggcgtgctggccggaggcggagggtgccgcgaccatggtctgaggcggcgagcgcgcggcgacgacggccggaggcgccggtcggcgcgatgacgtccggacgcggcgagcgcgcatcgacgacggtcggaggcggcgagtatgtgtcgacgacggccggaggcgccggtcggcgtgacgatggcaggaggcaatgggcggcgcaacgacggccggcggcggcacgcgtgcatcgacggctgggggtaggatcgcactcgcgcgaggggagacggcggccagcggcgctatgcatggtgccgtggtggctggggagaaatttggagatggggagggttgattagggttagaagatatatacatggttactaggcttcatttttatgggccaaaataactataaagtctagaactggactctagctacattacatgcgggtcaccgcgggggacggggatggtgaatggtgcaccgtccccacccccaccatccccgatggtgatgagttttggaccattagattcaccatgggtggtagatatcaaccatccccatcctctaatatgtgaattcatcgtggggaatcggtgatcgggtccccattgccgcgattctttgggggcggtgcgagacatgccaagcccagtcgaaacgatgagaggctctcgggctctcggcacgcgacggcccagctaatagtcgtctggtcggtccggcgcgggggacacgagcacggggccgggagcctgcttttttgctcaaccgcgcgcgtgccgagtcgcgcgttgcctgccttggtgagcggcccacgcggacaatgggaggcgtcagcgtggcccgtgcacctgccgtgtgcgtgtgtgagtgtcgcggatcgccaaggagacgtgagaggcggctttgattttaggcccacgagaaggcaaatgtcttggccggactaatgagatatacaccgctacacgcgactacgccgttggttcgtagccgcacagctggttcgggtagttcgctgctcccagcctccagccagccagcgtgtcatcggccgcatcgggtccagacaaacgagcgagccatcaatctccatcgagagattcctcgcacaagtcatgcatgacatcagctaatctgtctccctttccacccccctctactcgtgtgtcagtgccagatcgccggctggcagtacattcagtaagacgcgacttgatcgcacgattggccctttccttccaaacaagagagtgtacgaagcggttttccaacacaagaagagatttcacgcatcatccggtgaagctccggttactccccagttcacgacttcaagatttccaaaagtttggtactatatctaattttgaggaaacatgatgcatgtctcgtaaagaattcatatggatcggtgcctcttcatattttggcgcacatttatcactttcaaaacttgaataattaaagattaactgatgatcaaaacttaaccctattgattgcatgtattctaaaacatcgcttatttatggtaggcgaagtataaaaacgtaacccatctaagatggccgacagatcgacggacctgctgagcaaacttaagctgagttcataagcgaggattaggaatcctccttcccaacatgtaaaatagagcagtagattaacgtatgattaatgaagtattagctaaaaaacttcaaaatggattaatatgattttttttaaaaaaacaacttttctatagattttttttcaaaatacgcaccgcttaacagcttaaaaatcatgtacacataaaacgagggatagaagttgggaaagtgtaaaaaaacacaaccttaggttgagttcgttccttatgctcccaactccactctgttgattcccgtgcgcatgctttcctaactaatactgaattaattatgggctaatatgccatttcgtttttcttgcgtgggggattagttcttagcccacaataaagaaaccttaacctatctatgggaggtcgaccatctttccttgtggtccaccacctaccccaagtagccggcttgccatcgttgttgatgcaccagatctgccacctctctttttccccgagcttgctccatctccccttgtgtcatctagtagcacgtctgtcactgtctcctcctctgtgcacctcctccttaacttgcttcgccattcgctgttgagctccctcaaatgcctcccctcggtggcgttaagcaacatggccaccaatgtaaactcccgatgtagtcatgctcactctaacacttgctagtgagctctctcagccacctccaccttgtgccgaggctttctcatacttggccaagcttcgtcaaccacccacaccacacaccacctcacatgacatagccagtggtatgggcaatggatggggtagatggataggggagatcataagagtgggtaaagaagaagggaaagagaggatggcatgtgggacccattggagaagcagtaggagtcagaaggaaatatggatatcgactttttctagccatatgaatatttggagtgccaaaaatagtcagaatgctcttagacaagaaatgatgaaatatatgcattgggggtactatgacgatgttcaaaacaataaagtactacatcagtttcgaaatgtagctttttctagcacaatagtatgtcgaaaaagaagttatttctccactcacctttcatataaaccattcacaaccattcttcatttaatttatctatttactttttcttctcaatcaatcccaaatttccccaatcatttctacctattttttttaacatatatgtccgatttaagaaaattcttatattttgggacggatttattaaaaaagaacggggtagtattttgaaaggtttatgacctagaaactctgccaaacaaacatattgttttcactgcatagaattttacaactagaatttagtattcccatgcatcggaatcactactacaaaaatcgtttttctgtacgaggaggtcggtaggttccatgcgggccgcttgtggtggcgcctgcaaaaaccaccccccgggggcgggttgatttgccgcatgcgaagatccattatcgcatgcggctgcttaagacagccgcatgcgataataggtctattttcgcatgcggccgtcttaaggggccgcatgtattagggcatgcggctccttatatggaccgcatgcgaagatctattttcgcatgcggccgtcttaagtgaccgcatgcgaagatcgatcttcgcatgcggctgcgacggccgcatgcgcaaatggtgatatttgcagaccatttcgcgcatgcgggccggccaaccgcatgtgaagatcgattccgcccgtatgcaaaaacgctttctgtagtagtgaatgctgatcagtactgaagaagaagttgagaagttccaacgcccaactgtcttgtgaagttgaataatttctgctgacattgaaatggatacgctggacggctggaggtgttcaggttcaccaacctcactctaagattcttaggtacaatagcaagctataagccagctataaacatattttaaaaaaataaaggaagagagaaaagagcagcgggctacagatctatagccagctgtagcacggactccaagacgtaatgtgtgtatgacaggtgggaccaggtattaatagtatagtaagcaactattgtatgaattagcaattacatcggctatagattatttgaagctagcagtgtgctatactattaaacttgctctaaaccaacggtagaagagccagtggcaaagcacgggacaaccggacaattaagttgttggttatcgatgcctcgcataaataatcacaatacacgtcatcacttacgtttcacgcacgaccaacttgactgtagcaagctactccttgctaggacaagcggacacatcagctcgattggatcgggagggtgactcgcaccagtttaatttgcctctggacaagccaagcacgccgtctctgatcgctatctgctaatttagtcactacagcaagcaagctagtgactgacgaaacgcagaaaaccttatcaaaattatctcccaaagctaatgtacatgcagaggtgaactgagctatcttgagcaagagatccccggccgtgcagtcgtgatctatcaacatgtaaatatttggaactgaataaaataagattcggagaggagaaatggagggagaaatgcaggagaggtagatagaagttcagtttaatttggtgacgatcatcgcgtcgccatctcgacatcgtacaagctcaatcagtgatttaagatcgtcgaaatactcgaatgcatcaaccaaccaaccaacaacaataccagctggttagtagtacttcactagtactagcattgataaatatataattaaggttcatatcagatgattaagcagcgtagtgtttcccttaaaaatgattactgaagtgagttctttaacatcgtcttcagaaggtgcttacagagaaccaacaaccttgactgcaggagacaacaccatcgccggccgtcgtagtcaggattgccccacgacgaggtgtccggggacctcaatcagtcgatccatcaatctccatgataaggcaataggataagcagccaatagacgtttccagaaaggagcaaatggcacactcagccaatgttttaagtactgaaactctcaaagcttacataaatgaaaaggcagttttttttttggtgaaaagaggataaatgaaaaggcagtactatctgacgatgaatcgatgataactccctgaactgaaaggttaactcagtgattaatttagttgtgttttcctatcagacatgaaaagatggcgacctactatgctataaagaacatcgttactacatgatacctacatgatacagcacatctctcttgcaaaggtaaacaagttgtcttttcgtcatgaacagcaatgggttgttcattcgactgatcggacttcgttgggagcagtttcttgacctgcgacacagttagccagttttgtagctagctggagcagaagttcagaacagttcattttgtttccttttttccccccttcttcttcatttgcgattaagcagagccgttcattcacgagggcccgtgaacaactttgctagtgcgttagttttgtccatactgtgtgctgtgctagggacgctaattggcagctattgaagctgaaatttactactcctaccagtaagaaaccttggatcaactgattattaccaggttgtactgatcttcttttgaaagaaaatggcaggaggttactaaccagtaagaaaacggtaggattaccaggctgtagtgatcgtgtttgttgataggattaccaggttgtagtgatcttttttttttttgtagaaagaaaatggcaggaggttactaaccagtaagaaaatggtatatgattaccaggttgtagtgatcttttttgttgataggattaccaggttgtaatgatcttttttgttgaaagaaaatggtaggagattactaaccagtaagaaaatggtaggtttacctggtttagttttttttttttgaaagaaactggcaggattaccaggtggtagtgatctatcaatatacaaggatttgagggggtgtgaatgcgtgatcatgcaacatggtacaaattgggtataatcagacatgcttttgtaaaagctcagcgagagcgattttaccgatttatcactggacttcatctctttgaacgtacctccagtaatatgtacccataaatatgtaaatgggcgttatcaaatgaaaaagaaaaatactccctccgtcccataatataaaggattttgatggacgccccataatataagtgattttactcaccaaaatcccttatattatgggacatggtgtgtagctgagagaacttgtaggtgagcctctcgacactaagaccctccacgtctcacactagcctggttgagtaggtgataagaatatggccctgtttggtgcagcttgctgcaccagctgcaactacaccaacaataccagtgtgtagaaacaatatagtcaccgtagcagctgcagctgcgcaggtacacaaaagttacaacgaatagaccctacaaaaaaactaagttttctaatttctgacttatacgcattcgttttaaaatatagaaatctagtaccggattaaatatatctttatcctgatattagatttgagacggagatagtagtttattttttaaattttataactacaaattttgagaatatgaactattttggagcagattcttcagctgctagtctcattctcacgagggatttagatttaccactcgaagtctatcatatgtggacctcatgtgagtccaggataacaaatccttaatttcattaattattcccattctgacacgcgcccaaaggagggaagggcaagctcgtcatttcaccctttcttcctccctgccaggctgccaccctgccaccccccgtctatttataggcgcggccatggcctcagtggcatcaaccacttcacacgcgcgcgccgcccgccgggaaggaagccaacgccgacgccgacatgcagcgcctcgcctcctcccggaggctcctccaggcggcgctcgcccctgtccgtgcccagtccagcctctccgccgcggggggcgccgccgcgcccgcgccggagaatgccttcgccgccgccccgaagatgccgncgttcgactacacgccgccgccgtacgacgggccgcgggcggaggagatcttccggtagcgggccgagttcctcagcccctgcctggtgcacttctacgaccgccctgtacgttacgccacgatcttttcaccgctcccatttctttggaacgatttggggggaaaacactgtagtattacagatcggattcttgattgtttataccttaaattagaaagaaatactgcaattttgtctctataacaagacgcatttttccattttacatccaaatgctgccacaaatgcatcggcgttcggcgatgttcagagatgatcaggctcgtagcttaaacaaatctccttaatttgtttgcaaaggcggttgttttctctgtttttttatgatctcttgctggtggcttattagtgtatcttgttacaagaaaaggcagcccttttgaaagtgcaacgtctttttctgtcgctattggataggtttggttggaatgccattttacctgttcttacttcttactctgagcatttcttacttcttaccgtttggagtgggcttaccgccacccgcggtttggcagttatcgcgattatcacaaggtatcccgtggttttaaaaactgaaaagattaccgtatactgtttggtaaacctcacaagatgctctgcagaatctccaagatagtcgtactactaattgtagtatggggaattgtgaatctagtacaaaaatgtagttgtcttttctctttcccataacatagatgttctgttctgcttagtaaaaacgtcagcctctatgttcttgtctgcaaatatgcatagttaagaagaaataatttttttttatcttgtgaatagtagtaggtcagtttgctcaactacgtcttgtgctagtagtctgctagatctcaaacatatgtggctgcgccaataacatatgcatatgtctctctctaaaatagcttcataactgacacctttccattttaaaattgcacatgcattgccaagtactctataaacaatgttaaagattggattcctgaaggaggatatagcaccaaccaaactgtgcacctaacattgtgtcttgctgactcctctcatcactggagatcatgcacattgctaaactcctcgtgaaccatctgaaaaatactttttgacagggacgtttatctggttgataaaattggtaggaagaaaaagaaaacaacaatagctctttgagatcaccttgaattctttagaagagggttattaaaaattttctaaaaagggaaaattctcgttctaaaacatatcaatatgtgataaagatatggtttttggagatttcaagttccaaaaactgaccatttagtatgtaacaaacatttcagttgaacatagtcgatgggaaaatgcagtacctgttcgacgaggatggccgccgttacctggatgcttttggtggcattgcaaccgtttgttgcgggcactgccatccggatgttgttgaggcgatggtcaaccaagcaaagaggatacaacactccacagttctttacctgaatcatgctattgcagattttgccgaggcattggcagccaaaatgcctggtgatctgaaggtagcttgagaaaactggactttctctatccgaatattgctaattgtttagaaatacatgaagattgttttgcctgttgaaagctttacctgaatctgttcctttcttttcaggttgttttcttcacaaattctggcacggaggcgaacgagcttgcactgatgattgcccggctttacactggttgccatgacattatttcactcaggaatggataccacgggaatgcggctggaacaatgggtgctaccgctcaatgcaactggaaatttaatgttgttcaggcaagtgttggtcctgttttcgcttacagcattaggtattgagtaaacacgcaggacttaaaactgcgacttttgttgtttcaaaaaaaaaaaaactgcgactattacatgtaaatcattgaaactaatgattattcatttataatttgttcagacgggagtgcaccatgcacttaatccagacccatatagaggtgctttcggttctgatggcgaaaagtatgcccgagatgttcaggaaatcattgattttggaactacaggaagggtcggtggtttcatttcggaagccatacaggtacatatatcaatctcaatgcattatcatacaatggccatcttatttgtcatttcgatcaacagtgatttcttatcattctgaaaacgagttctttttcctcctccagggagtgggtggaatagtggaactggcaccaggatacttgcctgctgtgtacaatatggtaaggaaagctggcggcctctgcatcgccgacgaagttcaggcgggagtcgcacgaactggaagccacttctggggatttgaatcgcacggcgtcatcccagacatagttacaatggcaaaggtgaatcttgaggatccttccataacattcagagtttcagactcaattcatccctcctttgacgaatacaatctttgggaaactcacatgttccttctcttcatcttcagggtataggcaatggcataccgatcggagcagtcgtcacaacccctgagatcgctcaggtgttaacccgcaggagctacttcaacaccttcggtggcaaccctgtcagcacagccggtggccatgctgttctcaaggttctggagaaggagaagctccaggagaacgcatttgtggttggctcctacctgaaggaacggctcaacaagctgaaagagaagcatgacagtgagtatcagtaactaagataaaatcagtaaaatcacgttgcaaccacatggatccagggtagatttgttccttacattttggcttgtatggatggattttccagtcattggtgatgttagagggaaaggcttccttcttggggttgagctggtgaccgatcgccagaagaagacaccggccaaagttgagatcggtcatgtcatgaaccacatgaaaggtactactgatcctctcagcctcttccagttttgttactgaaagatctcaccatgagtgatttctgaactttcttctttgacacagacatgggtgtgctggttgggaaaggtggtttctacgggaacgtgttcagagtaacacctccactatgcttcaccaaagaggactccggtaagacctgctactctgctgctgataaattgtcaatacatgtttcagtaatttctgatccatgactgtaacatggtttgatgaacaacgtatcttgctgcatgcagatttcttcattgaggcgatggacatttcactatcgaagctgtgagtcggagagggactggcaggatcaacctgtccgcatgtgatccgtatccataaataatgttggggattggtgagatagcacctcgttgtctcgtaatatgtcctgcaaacccaccatgcgctgctcaacacatggtccaataggcgctcctccggtctctaatcagatgtgttgtgactcgtgaccaataagcgcatgtcaatgtcagatgtattgttatagttattgtttacatgctgaacgacaaaacgaaccaatcacaatgcccaggcgatgtaaatgttgaaaaaaagttatattggcaaatgtcagtgatttcgcaatgatgttgtgcaaaagttgtttcag

SEQ ID NO: 19853 - DNA, 2695 bp, Oryza sativa
tgagaaacaaaggagttgtactgttgcatcggtttggttgcaggagatggcacttgttgccttggcggagcagcatacggcgatgaaggagctggataggtatttgtgggggcaacagaagcaacaggagggttctgcatctggtatgttgcaggctgaaaaggattggttgagttgacacttgctggcatcgcccatggtggtgctgggtagctagatccatattgttgcatgggctgagtttgatatgctcctccagcctgtgtgccctgtccagcttgggcccaaggtacaacataattgttgtatggggtgtaagcttgattcgttggatatgcctgctggttagaagagtaatgtgatccatttgatgcagcaggctgatagtttggtggtaattctggcccatttgacgtgacagactgctgcgtgccattttgggtctgtgaagaagaatctgtagatgcttcaggggggctgtacagggtgaggcttagaaggtcgatcatgtcctgctctcttgtccgagtaccactggcaggagacgagtcaacaggcaccactgcattgcttgcaacagaagatgaggcttcagaagttactgggtcaacgggtacaagggcctgatcaccagcactggatgatgcctcatcactacttatcacagatttgttttttctgcagatataaaaagcattaagactaaatttctgataatgaatgaatagattgcctgttaaaggatacttttaagtaccttcttgctatctgagcgaactcgtcatcttcatcctcttcaactggaggtgcggatggaggtgcaatcggaggtgcagatggctttatttttggatcttctctgggtatctcgtctttccttggtgtttcgaccggcaaaggagctccagaagcaatggcatcatgttttgcaagtacgctctgtaagtgatcattgatttctaggccttgcttcagtagctcctcatttctaaacaacagaaaccacaaaaacatagatattaatttctgcagtctggattatagcaccaattatatggcataaaattagcagaatgcttatgcatgtgctagtgaaaaacagcaaactttgaagtcacttcagggaaacaccaagtggtgattggaaaaaggaattatatctttgtacagtttgagagaccgagtcttcagaccttttttgacattattcataagcaggaaggaacacaaactagaaatccaacgagcttaccctgtggaactgacaaatcgcatgagcttttgttgatttgatcggcattgggtgacaagctctgaaataatttcatctttaacagcctggggtcaccaaaatgttaatagatcatttgcgtgaacttcaacaaaactagttttgtgttgagaatttcaccctaccatgcgatcagaaggattcaaagcattcaccatatcacacagaagttctgttgtatctctaatattatttaagtcccctaaactgatgacaaaagcaataaaaggttataatcataaagtaagataacaaaaaggacagctggaatgagaagagctaataagtagtagattgtaatgcaacctcagagtttcaacatcggatgtcattctctcatttagacttccagcaggatatgtaggtgaaccataagactgagtatgatgtgttgcagggggagtaaatattggaggagcatctacagggcgcctgggaaacattattcctgacctctgtaacagattttgacatcagctattatggtaaatgagatttatgtcctaagtagattataagtaaactaaaaggttgatgcataccttaagttcaatgtatgaccagtaatactgtggatatttgcctccaggtccaccaaatgcttcttgccatgagtccagaagtatcaatactttatccctcacttgagtatcatgctgcatggacattcagaaaatgaatattctcagaaaaacagcatcattctaaatatcctgacacaattatatacacctcaatcttactggttactcaattaaaattcagaaattaaagcttccataaattcttaacacagaaagaacttccactgtttgggtgaggtaacttctttttagactgtttatttagttcaaattcctaaggatttagatacaagttcccagtatccaaacaggcctagtgccaaaaaaaaaagtacttttacttttctttgctaattaaaacaacatgagagcagtaacgagagtagtggctataaccaaagcagggagattaccttcttctggacaattctaaccatttcttgcaaaatatgttgttcaacaacttcaaaatggacatattcaccacagttcttcatcattgtctccaacaactgaaaagattttgcagccaacgtcagacaagaaaaatcataatcatgaagtagtgttgatagaagaataatttgatatgctcccttaccatgtggatagtcaggagcagataaataaaacaatatatgtgtaaatgttcattcaatcgaacaaattgacgtttgtcaaaaaacatccacataccgtcaaagtgaaaaactgaactcttggatctttatgttgcaaccgcttcttcacagcttttaccacatcctttgtttgcctgattcaaagtggaaatactttagtaatcactaatcattgtcca

SEQ ID NO: 19854 - DNA, 8550 bp, Oryza sativa
  unsure (1)..(8550): unsure at all n locations
tacatctgatctcaaatcacgattccttgactggctaaaagttaactgaaacatacggacatgccaccctaagctgaggttaacatgcaaaagtcgtccggttggcgccttacacccccttctagttctcataatatgtaatcgctaccggaggcggaaaacaatccatggctacatactggaggctacttcccaaaatccatctcaatttaacctcaatcaggtagcaacagcgcgaaatcgatcgaaacattgaccagcacacgccgaaccaatcgagtcaacgctccctcctaaaaccaatttcgacgaggacagcagagccgcgacagaaatcagaaaagctaaacagacaaaattccccgttccccaccgcaaaagctcagctccaagcccccgcagcacaacaatccatccccgcacaaaccacggcggcggcggcggcgcgagctagcacggcgagaggagaggagaggggggaaggaggaggaggcgagcgagcgagcgagcgatcggtcaccagcggtcggcgttgagggtgtcgcatatctcgaggttgatggcccagtcggggccctgcagcaggtggctcgtcgccttgtccacccgcgtcgacgccggcagcctcgccgcgcggcggccccgtcaccaccgggtacatcccgctcgcctccgccgccgcagccgccgccgcctcgggttggggggttcggctcgggtgtcgtacgcgatacggagctcgagaaattcttcgatttttcgccttccttttacgaggagggcaggtggactccggaatcgcgaggagcaaagcgaggaggagacgggattggttcgttcggtttctggtgcgtttaatgcacatcggattattggcaatcaggtggatgacgggtgggcccggggcccacctggcggcgggccatgtttagccggtagggggaagaaatcgggggatggtgttgtgtggaatgttttgggtttaagcggttttggtccaaggggttatctatccattgacgacagtttagtagtcgtacttgcaagttgcaaatcctgttttctcggcttgtctcgcagaggctgattttgtcatttttggaaggaggagacgtctagattgtttcagatgatgaccaatagaaaaaatgtgttattgttgatctttttatggttttatttattacagaagaagggcatggaataatagtatacacgtttctcgagcttttaaataataatatgtatttttaataaaaactttctacatatgatttttctttatatttatttttaagcattataatatcaaattattttgtttacaccctcaaatggagtaattatttaaaaatcattataattattcaacgtaaaagaggataaccatatactcactccgtcccgtaaaaaatcaatctagtactggatgtgatacgttctaatattataaatctggacatatctctgtccaaattatagtgctagatatatgtcacatcctattttagatttgtttttttatgggacagaggaaatatgtgcttatgattgaacaaaggaattatataataccatgacattataatttttttatttaacattcttatggttaaaagggagtttagctttatgcaaatggttttcaagttttagattaaataaatatagttttgaagtttatcattaattttcagtttttccacaaagccattttttgtagcaaaatagattaatttcgtccatggaaataatccccttatatatatccctaacctccttacgtttgcacgtacctgtactgtatacgcatcattattatttattacatagtaatataaagaaagggaaacttattctggccttaatctatttgggcggcacgtaaccagacctttcgagctttccgacagcaagggccagctagaaggattcgccaagtattcatgtcccatcgccgctaatcaacgaggctttttagctttgatcatactataagtataacataaagagattaaattccacataactggaaaccaaagcgtcgtaacagttaaattaagaactacacgtatagaacgatttttgcttatcatgttgcgtgtctaggccaaaactgtgacccagcaacacaagaaaaaagaataaaaataagttattgtaggtttaaaaatttagatagaaatattaaagaaaaacaaaatgaaatgcatggtagttagtattttttaaaaaaaaatggtagtcagtagtatgattgaactcgtagcttcctaaagttttacttttgaaaaatggcgcgaagcatctgccgtcacgccttatcctttccaactgattatcaatttaactaataactactagtaaactactatcgcatatttgactaatccaataaataatcaaatcggattggcggcttgtccccgttggttgcttggtgaggagaacgaggcgcatgggagaagagaacaaaaacgttgacttgaaaatgcgagtctcgcgagtcgcgagtaagaaagcgaaatttacacgagctagatgcatgggtccacgtcatcgatccggacatgtattttccacctgtgccgtgtctcgccgccaaagctgaacgaacgatatatgaaaaatatgcatcgtgttctacttccgatcgcactttccaggtcagtcatgatcaaggacagcatctcctgggtgggaactaatctctgtagcatataaaacggaacaactcattagcacataattagttgagggcctgtttagatccttcaaaatggtaaaagttttaccattttgaaacactttttgccattttggataacactagtagcaaaagttggtaatttggtatttaccatttgctagcccagggtagcaaattgtgccaaaaagtgctccaagaccacgcgcgcatgctctctatctccaccaaaaagtgctaaaaagaaaaactttaggatgcatctaaacaccaactccataccaaatcttttaccaccaaaacttttgctatttgccattacaaatagatctaaacaggccagtattagctattcttttgaaaaataaattaatataatttttaaaataactttcgtatattttttttttgaaaaaaatgtatcttttattagtttgggaagtatacgcaaaaaaaaaaaagagttgagctggaaaagccaacgaaagaatacaaccttaataagactccactctactttaaaagataatttttacatacgatccttcaaatttctacggggagctttaaaaaaaggaaaaagtacgaattacacctctaaactattgtggtcgtccgaattacccccataaccacaaaaacggacattcttcaccccccaactatataaaccggacgaattacccccctcgatccaatccgcggtggttttggtctacgtggcgtacgcgttacagtccaatcagtattctatttataaaaaaatatgggacccacctgtcttcctctctctctcacacactttctctctcttctctctctcactctctctcacttttcctctctctcacacaggtcggcggcggcgggtgactagcctcgtcctggagcgctactgcgtgctgccgcacgcgccgcaagcgcggatgtggggtcggtggagcagagcagggagacgagccgagggaactcgccgcgcgcgtctgcgtcggcttcgacctgaacatgcctttaatattactccagctctgtttcacctgcttgcttggaagcaatccctgcaccctgcttctgcatcagatcaccgactgttcacgcagctaactgatgctgagtgctgctgctgcttgtgtcgtcctcggacaggaagcaatgcgaccttgccgccggagcagggaaaggagaaggcgtcggctccagctccaggcagagcatctcggactggagcacggcgcagtagtggccgaacgtctccggcggcacgttcaggtcgaaaccgatgccgagcgggctgcggatggcggccacgaacccattcagcgcgcgcagcggcgccggcgaggcggacgcggacgcgaccagcgcgccgacggcgcgccccatcagcaccggcccgacgagcacgtcctcgttgaaagcggaccagcgctagcacgcgccgcagcgcgcccgactacctcccccgcacccgccttcgccgcgaggtccgctcggcgcgctacgacgctggccgcgcgcggtggctcgtcgacgccgtcgacctcgccacgggacgcacggagcggtacgcggcgaggcacctcgtcgccgccgcgggcgaaaacgacgagagggtggtggccgggatggacacgttccccgggaaggtcgtccactccgccgactaccgttcagncggcgcgttcaaggggaagttcgtgctcgtcgtcggaccgtacgttgcacgcgcgccgacgacagccgcacgccgaccgcagtgcgcgctttgtgcctgagagagagagagatagagagagagagggaggaggggaggaggaggtatgaccgcctctccgccatggccgccgccgcagcctgagcgtcgtcctcatcgtcgtccaccactccttcgtcaacatcctcgtcgtcctcctcctcatcccccgccgccgcctccgcgtcacccactgccgccgccgccgccgctccgtgtcccccgccgccgccgacctgtgagtgagagagagggggaagagagacagagagtgagagagagaagagagaggaagagtgagagagaggaagacatgtgggtcctacagttttttaataaatagaatgctaattggactgccacgcgtacgccacgtagaccaaaactaccgcggattaagttaaggggggtaattcgtccggtttgcatagttgggagtgaagaatgtccagctttgtggttcaggggggtaattcgaacgaccgcgatagtttgagggtgtaattcgtactttttccttataaaaatctgcaagtaaaaaatgtatccttttctcggtaaaggtccattagtgaattttttttgatagatccatctgcaaaacaatattattttttataggcaggtctattaagagattttttttttaacattctattaagagatctgcatatgaattttcgcagcctcctgactacacatcaaacgtaaagctctcaatactcccctccctaatcttcctctcctcgctctccctctctaacataagacgagcgcttccctgtccgacgaccggtgactggagtccaccgccggaggcctccggatcgaggagcgcgtggccggcgggcgacgggtggatcttttttacccgttactccttttactgtttgagagaaaaaaaatggagtaataatcaaaatcaagcaggggcgccgagatccatccatccatgtctacccgaaatgtattaatcgcacagttgcagtgtcatcgtcgtgaaagccatagtacgtcgatcgcactgtatacggccggagcgcacgtacgtaactacagtatgtacggttttcttgtccttcttttttctactacgacaagatcgcgagctgacgcgagtgcgtgacatgtgcagtacgtgtgcgccagcagagcgctgcatcgcgcgggcagagcaagcgcatgtgttcatgtctagcatcggccggcacgcagcagagacgtacgtacgtcgttcggtacgcgtatgtactccctccggaaaaaaataactctatcaaatactccctccgtattttaatgtatgacgcggttaactttttaaccaatgtttgactattcattttattcaattttttttgtaaatatgaaaatatttatgtcatgcttaaagaacatttaataatgaagtgacaataaaagaaatgataattacataaattttttaataagacgaatggtcaaatgttgaataaaaagttaacggcgtcatacattaaaatatagaagtagtacaacgaactcaacatactttatctgtaaactcgttatgctagaattcacattctaacatgaggttggttttttttatggaggaattactctatctactcccttagctagggtcacgactcacgaatacgtgaggttaacttagaacaagatttgatctcagatttttttttaagttttggtcattggttatttcatgcgtgttgtatgtgtttcaatacaaattaatgatagaaatctaaaattgatcaaacttaccctaaacgttgaatatttattggagagtgtggtccatgagtagtggcggtggttctgccaccactccgaccaacttcctattttgttaagaggaaaataaataggtgaggctagagggccttcatgtaaaccatccccatcaactctttactttttgtgagaaggtaaaataacagtatgactaaaggattcacatgtcagtaaaaaaaatctagcaattaaaaatagtatatcgggttaatgatattcttttaattaaaattcggttgcaaacgcatggggaattaatatgctagttgtgcaaacatgtatatactccctctatcccataaaaaaacaatctatgatagaatgtgacgtttcttagtacaataaatttgaacatgcccttgtttagatttattgtactagaaaatgtcatatcccattctaagttagtttaaaatataaatctagtgatataacatgcataatacttagcatagatatcttagtatgattattagttaaataagggtgccctataatttaggacagagggagtactttatatgtatattacattttgataacattaataatagcacttatataaggtataattataattgaaatgtgtgatggtaaagtggtacacatcatttttttttcatgggaattttgctcggattcaagcgtggaattataaattttcactcacctagaattgcacattgcaaagcctaaaatgtaacatgcaattttagttcattgttacttcatttttgttgttatatatgtggttttaattttatttttatctaagctcgatttttttgcatgcaagtttataatttttatgagctacaaacttatttcatgtaattttgtagattttttgtatgtgagatatttcattgtagaagcattggagagtggtaatcaataagtagggggatggcgagagccgtagaattaccattgattcaatggttagaaaaggtgacttaaattttcaaaaacttcaagctagcgtcttattaaatctagaaactctctttaacatgtcatcacaataaacaaatggtcaacattaagtaacactggtacgcttgctaaatttagaatgaaatattttaaataccaataaatatcacctactattaactttagatcttaccactatagtgttacaaatttacaatcagtagttgaaggtatcaacgttaaaacgctcttttggtgtatatatatgcgccgtgcttttaaataccactgtcagctagtagtatataggagtatagtgtattggtgttgctcttctggtttcgcacaatcatgcatacatcttcagtgccagacacgttctttgtgcttttcaccagagaaagacgagagagcatcataagaaagatttactacttgtagttagcttacgcattattgcatgcgtacggtcaaaaggcgtgtgtccaaggaacttgtcatttctagctatctcagcaagtgcagaagctctagctcgcatatgcatttcagcgatgctactcatctggcgactgaacaagccaaaagagaaccccaatgcaaacaacttattagattaattactcacatccatctgccaggtccaaattcagaagtttgtgtacatacatgtgtcgaggacatatattgcataaagtataatttgaaaaggtgtactccaagcgttgtacacaacaatttaactagcttatatttagcttacgctttgtaattttgctttattatagtttttttgtaatgcaaaaaatttgtctgaagttaagtagagggacgatgtaagaataacacacattcatcatccttattgaccgcgctcaactaatcgaaggcaaaacaaatagtattaattaattaatttgctttcgaaaattaaagatccaaaatcctattatgtgcgtacatgtagccatgtactagttgaaggctcacagtactgcaaatgaggttctctaactctaccaaattaagatgcctgtagatatatataggtcaagagaacttgattaatcatggcatagaatcatcaatctttcgaaatagaaaacacaagggaagatcgaaacgatgagaatggcatggccatcaatccagtatagtatgaccaacatacctgcacatatctgcatgcccctgcctgtcttcttctccccaaaaaaaaaaccgtggccggaggttgcaatcttggaaaatttgcgaaacggccatgcaaagctgcagctggcagctcttgctaccttagtgatcagggactcaatcccatgcagtgctgagctagcccatgtgctcgaggtct

SEQ ID NO: 19855 - DNA, 8680 bp, Oryza sativa
cctcgccatcctcaacaatgacgacatagccggcgacatggagcaagctactagccgacggcgccgtgtcaatcaaggccggctttatacctctcctactacttactcatctcatcctcctcctcctacctgtaatcacacaaggctttgaagactaattaaggagaccggttagccgctctgctgtgcttctaggtagtagtaactactgtactgctacggctacatatatacgcactagctagccggagttatggctgtctcgtttcatcactgcaagcttaagcaatcaatcttagccaagaaggggaagaagaagaagaaggaggaagagaggccaccagcgaggcaccaacaacccggccggggtagggtccagtacagcatgcaagcaatggctgaattctactcaaaggggaccatgaattgacagccgagtgaccgagtgagtgagatatatacacatgggaggacgacgacgagtgatgctagcgtgctactggccttttagggtgtgtttagttcacgccaaaattaaaagtttggttgaaattagaacgatgtgatggaaaagttggaagtttatatgtgtaggaaagttttgttgtgatgaaaaatttagaagtttgaagaaaaaatttggaactaaataaggccttaatttgcctttcgataaaattaacagggcatcctccggtatccatacatgttgccttcggtcttgtttagataaaaaaaatttagccaaagacgccacatcaaatgtttagatacatgtaatgtttggacacatgtatagagcattaaatatggaaaaaaaactaattgcacagtttgcatgtaaattgcctaattatgccataatttgacaatttgatactacgtacattaaatatttgctaatgacggattaattagacttgataaattcgtctcgcagtttataggcgaaatctgtaatttgttttgttactagtctatatttaatacttcaaatgtgcgtccgtatttttcaaaaattttacacccaaataactaaacacacctgaaatctccctgaaccatgcagctaataagctactcctaggtactactagtagctggctatagcgctgctaccgtttgtctgacctcagaaagcgtcatggagcctgcagcgccatgtgtcgtggatgcatagggcgacgtccctcgtgggactgttcggttttgaaggattttcacgaaaattttagagagattattgaactgtttcttatcaatactcctgtaaattatattctttcgtttcgaataagccctaaagcaatgcaagcgaaagggttaaaggcagctcactgctggcactatatattgagagcttctccttttggaatccgtttggtgcacgatcgatcgagctctccatacttttgctttcgatgttccttccgaggcgagctttgagtgcgagtgtggctgtaaaggttctgtacatagtacatgcaagtccaacgttgttttgttcctgttgcaacttctgtttaagatatttgctctactagctcttaaacgggtggtcatggtttgatatcaacgttcaacatgccaggcacataattctcgggaagtcctattgcaaggtcaactgaaagttaattattagctcacggtcacatcattccatgccatggccccatatatatgcccgacaacctagccagccgatttggattatatatgctcaccgttgtgagggcctatttggttggagggaccctccactttagcctactttaatgctaaagtcccagacaggggtgactagaagagactaaaaatatgttagttcattaatccctatggaagaagcttatatagactaaaatgtttttcttccacctcttgccccgctgccatgggctctctttgcatgggctttagaggtaacatagtctttgtacagtgtaattaatgacctttagtccctacatccaaacaagtatggactaaaatttttagtcctattttagtcctagaactatccaaacaccctctgaattacctctgaattatgagcactatgccacctgctttatgtgcatatatatctttccatcttggccctgaaaatttctgagttataaaatcaccgttgtgacttgtgaattaggagtactatatgccaccagctttatgtgcacataatctgtgtatttttaatagatgacaccattaatttttaaacacatgtttaaccattcgtcttatttaaaaaatttatacaaatatatacaatataaagcatgcttaaagagttcaccgcgtactatactactcatgggaagatcggagaagtgagatagcttgtggttatatgaaactagggttcaccaaaccgttttgggtggggttatcattgccccaccatttagcggtaaccacacggttatcgtgaaaaccatgcggttaccgcgaggtatactatggttttaaaaactgagaaggttacaacatgtgaccatgataaccgcacggttttgtaaaccctacatgacacccgctcgtttgcaccggggtggcaattagttcctccattatttttttaaaaaaagatagagtgatataacttattcctaactttactttatgaaaactacaaccaattatgaacaagattgcagggcaaataattaaggtgtggttaaatcacatattaatcccgcggagaagcaccaaatgaaatggtggtggaatcatgagtgtatgactacacccaccaaaattaaaattttgatgtccatgaatattacgtacatgtaggtggactttcaacaggaatttagtgagatcaagaatgtgtcgtcgatttccgtctcttggagcatgtgttaggggacatactcgtagggtgtgagtgtgttgttgcatgtataaagatgtatgtgcgtatatatgcatgttatgtacaattgcaaaaagaaaaagcaattaatcctgcatattctcccttgcttgcaagctacacttcgatcacgtacggacgggttggttatgaatgcaccttaatttttcgtaaatgtaaaaaagattgcatgtcaatatattagaagaaaatagagttttagttacatcaagcaaaaaggtcggaaaaggtcattgtcaggagataggaaaaaataaaaggaaagaaaagactgatttataaaactgtgaaaaagaaaacactactcctatattgaaccccactatcgccgcgccgtgtttagttccaaattttctcttcaaactttcaacttttccatcacatcaaaaaaacttttctacacacataaactttcaacttttccgtcacatcgttttaatttcaaccaaactttcaattttagtgtgaactaaacacaccatatagtcctaacagacccaaaaaaatatataacatgatctcagacaatcttcctgtaggatggacggcgccttatataatttcctatcagtaatttgcaacgtgcaacaaacgtcgatgcatgtgtaacaaactgtgcggatgctcgccgccgtacataggcagcacatactacgaattgaagcaccggtattgaatactgcgtactgctgcttgcagtcttgcagagagcagagctcgattggtacgagggcgcgccattgaagcgaaagctatcgtaccggttgctttgaagcggagcaacctacgcacgtactagtacgactcgatccttacgcggatgggcatgcaagcacacacacaatatatatatgcacgaacagaaacgtacgtgcagtgcgtacaatacgcggtacaccgataaatttgttgtctccagcaaggactagtagtagcaacaaattgaatggtctggacgccgtttgattgataatcgatcgaccgaccgacagatggccggtgacaccggcccgtacgtgcgtcgacagattgatggattatggggctatatgtttgtttccttctccgaaagggattgccaatgcactggttgctcagcttccatagatgtatacgtgccacacatctctcactctcacgttcggatcgacgaacccgtgctggcttattaaccctgaccatgaaacaaagaagattgacgaagagagaaagatatttacatttacagtgcatttgtggacgagggatgttaggttccgatcttccgatagatatcgataaacagttgatttggacggagtcgcgacacaactcgatccggcttctgaatgaatacgttactaagccccgcaatcgcagcaccacgtctcctctggttatcaaccgtgccgaaacccggttgacctcgccgagaaggctaatcccaacatacgaatcgaagaacacaagcgagaataagatagattgcgattaagcactcgaattaggggttccacaaaccgatctagcggctaaactgttcttgacagattaatctaagcaaaacccgacttaaaacgatgacgtctactgaataaatataattatgggcgtctagggttgccctagggcgcacacccccttgggctaagcccacgacgcaattacaaggtacaaaacacaaatcagattcggactggataatatatgtggcttgttttgcatattccgggcagctcggtaggaattttgatgtaggaccaaaaccatatgaaagtagactccataagctttccaacaagtactcatgggccccaaaattctttctagatcagcggctaggtccgtttgaagttgatgctgtcagaaggcccgaatccgaatccaaaacgtgtaggtttatctcttgtcttctatggaccaaaagtgacgtggtgagatgaaaaaagacttggaaaaggtcttggtttgatccccaatcaaattcttcaatcatccatgcattccttacgctcggtctcttttctttcgcccaagtaagtacctctgcaagtaaaaacatacaaaacttattgtgtagtaacgtttgttcaaatatataacaagtaaatctaatatagaacatatacatctttggtttattaatacataagttagtcattgttatatccgagctagttgtgttctcatcatttgttttgttattagtctacgtttagtattttaaatgtgtatccttatacgctaatttttttttaccaaaacaactaaacacggccgaagtcaaatttgtctctccaacggcatgtgtgcccgcgtgatgcatgtgagtatgtgaccactgaccagcaacactgagtcactggcaatcctatggaggtacctcttcgtcctatcaatcctaaatactacctcgtctcaaaatagcttaatctataaatatgacttgttctaacccaacgaatttaaacatcattttatttatattcgtcgtattagaatatattatggtatatcctagcttaacttattttgggacggagagagcacaaatttgttagataggtctcttttttcttaatgagcaaacaaatgatcgtgcatactccagcgttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgcagcggaaaagataaaagcgagctaaaccgggaagcttgacttcagcagcgggcgactccactccacaggcaatccttgacggcagcgacgaaaccaactttgacaaaacagctccaactaggaagatcttcagctctggtgtgggggaaaagagagcaagactgagtactacccactgtactcagcaagtcataccggaagaggaggtatgatgcaggatataaccaaaggaggctagaggttcttttgcataaagctagcatttaaaaacagtagttgaaggcagtaaaatagttgtagtaattaatcaatattaaccaaacactgtccaacgctaccccacgttgcaacaggcccaaccaaccacctgaactacaccagttcattaagctaaactaggaatgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaatcatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagatcaagcagttacccactcccgcttgtggaaagcacggtaagtctcccagggtttcccgtgaaccggtccttaactgccatgggtgcgaccagcaaaaccatgcacccacagcccaccattcagtgtattttaattaactaacaccattgcggtggcaccaatctaaagctatgccaatagacaaagtctatgtaataaggtgatccccatttgtgtgctagttgaactaagcatggctaagcatttcctaaaccaacatctagtcattttgatacccaagttatcaacggcatatggtaaacaatatgtggctgaggaataggacccatcccacattacattgtaaaagaatgcaacatttaatagaaatgcgggatatttgtaaattgggtacaatatgatcaaacgtatttcatgacttgccttgctctcgcactgacgagacctcagcaacgtcttcgagaaaccgtggatcgacaaaacggccgaaacctacgcgacaaacaaagcacacaagcaaaacaggctataagacaactgaaacagggaacaaaaccatttttaatggattctttgcatttttcttgatttactgagacttgaatggacttaaacggagctcggatgaattacttatgaattttagaagataaactgtgtttttactaataaagaaaagtccttaatcaatttattgcgcaataaagcccagggctgacgtcagcgaggggagggggtggcgccgacaggcgggccccactgatcagcggcactaagggggggagagggggcggctggcaagcgggccccacgggcagtggctcaagggggagggagtgggcggcgacatgctcggcacggctcaagccggccggccatggcgaggcgacgacggcgcacgaccgccggcggtgaccggcggcgcggggagacggcggcggccggcgcgaaggcggcggcggcagccgaagacgacggcgcacgcgcggagggcggcggcgctcacggggggagaggaaaggaaggaggaaaggggattcctcaccgaggcgatggcggcgaccggcgtgggaagagacgagcggcgatgaccggcgacgcggaggcacggacgggcggcggcgacaccctaggagaagatggagaggcgttaggagaggagacgacgaccacggcggcttgaattgccggccggagatggaggggagggaaaaactcaccggctcgcgaggggagaggtgctccggtgggattccggcgacgcgaggcggcggccgggaaagctcttgcggcggcgaagctaacggcggcggcggtttggcgcggcggcgactctagcggcggcggctcgcggccgaaggcggcggcaagcggcggcactagcaacaagcggcgcgagcgcgataggaggcacgggagagcgcggcgagtgcgaaaaacgagagaggaagacgcggggagcgatttataggtgcgggagggggcggacgtggccggggaggtggccgatttggccggcgacgtggggagtggagggagagtgagagaggtggattcgaaatcgaatcccgccctctcgagcgcgcgcgcgggccgggagatgcgggggaagaggcggcgacgtgggcgcgaggtgcgggtgcggagagggacggagaaggcgggcggcgtggggaggtggggcgccggcggttggggctcggctccaaccggctagaggaggaagacgaccgacaggtgggccccacctgtcggcgcccgaaggagagagggagggagggaggacttcggggaggggaaaggggaacgggccggcccacaaggggaggccgagcgcgggcgacgggtggactgggccgacggcccaagaagaggaaaaaggaggaaacaggaaaaagaaaaagaaaagaaaggattttcctgggatttaaaaattgcactttggtgatttttaattggttaaaattatttccaaggctctgaaaattccactaaaaatcctgttaatatattgtgacatgtagaatccaagaaaaattccacatgccgattctgattattatttgcatttattaattagagaattagctctaggttaattaagataatttcttcggacgatttatttagccaatttttaaagcaagcaaaaggggggaaacttcagggcgtgacaaacctaccccccttaataaattctcgaaccagaatttctaagctgaatgtgcattaaatccctgtccaggaccagccagggtacccaaacaacaatt

SEQ ID NO: 19856 - DNA, 300 bp, Oryza sativa
actttatgttgtattttttaaatttttttgatatattatccgaagacaagtgaaggcaagcgagcgaggcaacctacagcgcactccatcaaagcgagcacagaagcaagaacagatccagtagctaaccgttactagagatgaacgagagagaagcggtcactcaccagctgcaggccgcagcaagcaggacgacggacgctaaggaagggaaagagaggcggcctctcccgccggatccttgccttcctcctcccgccagccgccgccggtgctgcttcgggggggggggggggggcc

SEQ ID NO: 19857 - DNA, 2316 bp, Oryza sativa
cctgttaatatattgtgacatgtagaatccaagaaaaattccacatgccgattctgattattatttgcatttattaattagagaattagctctaggttaattaagataatttcttcggacgatttatttagccaatttttaaagcaagcaaaaggggggaaacttcagggcgtgacaaacctaccccccttaaacggaatctcgaccccgagattcggaagagctggcgaagaggtgcgggtgggtggccttcaactcatcttctctttcccaagtggcctcttcctctgagtggtggctccactgaaccttgcagaatcttattactttgtttctggtctttctctcgctggtttcgaggatacgagttggcttctccacatacgtcaagtcttcctggatttcgatttgatccggacttgcctgttcctcaggaactctcaaacatttcttcaactgagagacgtggaacacattatggatgccaagcatgttggagggaagctcaagctggtaagcaacttcacccctgcgttccaaaatccgatatggtcccacaaagcgtggtgccaactttcctttggtttggaagcggtgtactcccctgagcggagtgacacggagatacacataatcccctacttggaaaacgagctcccttcggcggttgtctgcatagcttttctgccgagattgcgcgattctcaatctttccctaacagctctgactttctcttctgcctcatttaaaacttctgtaccaaacaactggcgttcccctgtctgatcccagaagagcggagtacgacacctccgtccatacagtgcttcaaatggtgccatctgcagactagcttggtaactgttgttgtacgagaactcagcatacggcaagcttttgtcccatgccccaccaaagtcaagcgcacaggctctcaacatatcctctagtatttgattgactcgctcggtctggccatctgtttgtggatggtaagcggtgctgaaattcaaccgggttcccaattcttcttgtaatttctgccagaactttgaagtgaattggcttcctcgatcagacacgatcttcttaggtacaccatgtaaacacatgattcttgatagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtggctgtagcaaacctgctggcctttggtgttctgcctttactcgttgacagacgtcacagagtgctacgaactcagctatttcccttctcatgctgacccaccagaacttttctttgaggtcttggtacatcttagtactaccgggatgaatggaatattgagtttgatgagcctcggttagtatcaggtcttttaattccttgttttcgggtacacacaatctttctcccatccagattgttccttgttcatcctcaacaaaacctcgggcttttccaaccctcatgttctttttgagctctgctatttcaggatcacttgcctgagctatgcgaacctgctccaccagcgtgggctgtgcctctagggcagccacgaatccgtgctcaactataccaaggttcagatgttccaaatcgcgttgaacctcaccacatagttgctctacccatgcaacattgcagtagctcttcctgctcaaggcatccgcaaccacattagccttgccgggatgataatgtattcccatatcataatctttaattagctccaaccatcttcgctgtcggagattcagatcaggttgggtgaaaatgtactttagacttttgtgatctgtatatacctcacaacggttaccgatgagatagtgccgccaaatctttaaagcatgaacaactgcggctaattccagatcatgcgtcgggtagttgccttcatgaggacgcaactgccgtgaagcataagaaaccactttgccatcctgcatcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggctttagcaatttagagaagttctcaatgaaccggcggtaatagcccgcaaggtcctaagaaactccgaa

SEQ ID NO: 19858 - DNA, 3911 bp, Oryza sativa
catcaacacacatcctagcccctggcgagatgcatcacaatagacctggaaatctttcgtctgatcaggcaggattaagactggtgcagacaccaaccgtcgtttgagttcttcaaaactcctattgcattcagcagaccagataaacttttcttccttcttcaatagctgtgtcattggcttagcaattttagagaagttctcaatgaaccggcggtaatagcccgcaagtcctaagaaactccgaacctgagtgactgtccttggtggggtccatttggtaactgactccacatttgctggatccacagctactccttgagcattcacgatgtgaccgagaaactgaacttccttaagccagaagtcgcacttgctgaacttggcatatagctggtgctcttttaacttttcaagtaccagccgaagatgctgctcatgttcttcctcggacttggagtagataagtatgtcatcgatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactggtgatagcctgatcgcaggtctatcttagagaacacagtagctcctttcaactgatcaaacaggtcatcaatccttggcaaaggatacttgttcttgatggtgacctcattgagtgcgcggtagtcaacgcacatcctcttggttttgtctttcttctccacaaagataaccggagcaccccaaggcgacgtgctcgggcggatgtatcccttctgtaactgctcatcgacttgcttcttgacttccgccaactcgctggctcccattctgtaaggcctcttgtggatcggtgcagttccaggtaccaagtcaatccggaactcgatatccctttttggtggcattgttgtcagatcgtccggaaaaacctctggatactctctgactatgggaatatcctccagcttcttagtggttttctccactgctacctcttgttcttcaccagcagcctggtttaaactgatccctggcttccgcggcactagagactggaaggttaccacctctccttttgcattggttaacttgatggtgcggctggcgcaatcaatcactcctctgtgccttgttaaccaatccattccaagtatgacatctaggtccttggattcgagaagaatgaggttggctggaaaaatcaacccttgaatttcaactgtcacagatgggcagtagtgagttgtggtcatgccacctccaggagtatgcactcgcattggtatcttaagcttcactaaggataacccatgtgcaccagcaaaacgcttggaaatgaaggaatgggttgcaccagaatcaaacaatattactgccggtgtcgagttgacggggaatgtgcccaatataacctctggtgctgactgcgcctcctctgcagatgcatgattaacacgggcctgaacgaacttgggtccagcacgtcttggcttcgggcactttccaaccgtgtgtccgggtttgttacaattgaagcagagttcgggtttttctcccaacctcttgggctgttctggcagagctggctgaactgattgagctggaatctttagtgaactcggagtagggttgagactgtgctgctcactgttgttgtgactgccattatggtggttcttgttgaagctacccgggtggtagggacggtgctgtcggataatcatggtggaaggtccaccgtgacgtcccatcgtgaaacgaggcttctgactcttcccctggggagtcctgaactgagctgccttcctcttacggtttattttgttacagtgctcctcctgacggatagccttatccaccagcttctcaaagtcctcataatctctagagatcaactggttagtcaattcatcatcaagaccagacaaaaacttctcctgcctctcggcatcggtacgcacgtcctcaggggcgtagcgcgcgaggaggttgaactcatgcaaatactctataactgttctggttccttgttgcagggaacggaactctctcttcttttgtgccacaattccctcgggaacctgtgctttattgaaactatgacgaaactctgtccaagtaacctctgccccagctggacgggtcaccatgtagttgtcccaccaaatagaagcgggaccttgcagctggtgtgtagcaaaagcaaccttctcttgctcgttgcattgcaaaagattcagcttcttctcaatggcatgaagccagtcgtgggcctcgattgggttggtggtgcttgagaaggtgggcggcttgacacgaagaaattctagcagtttggactgaggaggtggagaaccaaactgcaggttctgctgctgcagctgtgcttgctgctgcacctgttgcaacacctgatggtactgttgctgcatctgttgcatcatcattgtcatcatctgagtctgattgtccaacacctgagcaattgttgggttctcgggcggtggggacggactgttgtcagatgcactgttggcacgtgctccattgatcggcttttcgctgccactggcgttgttcgagtcgcgtgaaccattccttgtctccatctgaaggggataggtagaaatatgagaaaaggaagaaaaacagggggctcagaaactaatctttcttatgaatttaagtgcaattatcttaatcttgattaaaacactgaaaaagaggcacgcaactcctaattgaggcagtcataccactgacacatgatatcgaccgccgactagcccacaagcatcaaacctaaacacgaaaactagcaagcaaacagactaagaaggcgataaagctaagggcggcgactctgaagctcgaggcggcgcttgcaaacgagggataggactgacatctaaagtagacaagggataggaaccaattcatgctcaaatccaaattaaacaaagcaaaagaagactcaaatcaataaccgagcaggatgatttttatgcatagaacatttttcatgaactcaaataaagacactaatgcaactaaacaataaattaatgcatagactagttgcatggaaaatgatgcgcataacattgcccccatcgaatatagacacgacctaatgcataacccccaataaattcccgactgactatcgaataaactccaactaaaatttttctaaagccctaggctgagctcatttttttttttaaaaaaaaatccgatccgaatgaacgaccaagatttttcccgcaaaccaaagaggcaaaactccaaattttcccaaaacaattccaggtgcaaaaaggcatatgcagatgaaaaaggggttcagagggctcttagggtttccagttggcttgtcctacggtcaaggtcggctctgataccaacttgtcacgcccagaaattctcgaaccagaatttctaagctgaatgtgcattaaatccctgtccaggaccagccagggtacacaaacgacaattgttgacatacagatccacgtcttacaaaaatagaaaagattacaaatgccgcggaaaagataaaagcgagctaaaccgggaagcttgacttcagcagcgggcgactccactccacaggcaaaccttgacggcagcgacgaaaccaactttgacaaaacagctcccactaggaagatcttcagctctggtgtgggggaaaagagagcaagactgagtactacccactgtactcagcaagtcatcccggaagaggaggtatgatgcaagatataacccaagggggctagagggtcttttgcataaaactagcatttaaaaacag

SEQ ID NO: 19859 - DNA, 28997 bp, Oryza sativa
  unsure (1)..(28997): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnataaaagcgagagggagagggattccttaatggataagaataaccgatgacacggcattgtttcgatcgctcccaggtttggttccatgcactggcgcggcatgattgcctagatgatagggttccaggagagggttcattagctggggagggaacaccctaatatccagcggtctcggttatgtgcgacggcatggcgacacgatggtgactcgattggcggcgatgtgcagtggtagcggccttgataggggaggcgcagggctatgccctagggtgacgcgcggtcgtcgtggcgaccgttatccctcaatcccgaaggcgacgcgcgaggggacgggatgacgcgggctctcgtggcggcgcagctttggcgcgggtcttcggcgcctcggtcggcggcgggcccacgcggcgtggcgtgacgcggtgcggcgcacgggcacgaccagtgcggcgcacgagtcggaaaggcagccgcgcggcacggcagtgattggagagggcggcgtcgggtgttcggtcgggttaggcacagatcgaacacctagcgcgtaatgaacagtagcaacccgggaaaaatcacaattagggcttttcctagactttttgtgtgaataagttttagatgttttaatctccttatttcttttagatacttacctatatttcaacacttccaatcttgtgatttattgcaccatatattaataattattttttctaattccaacatatgtttctattttccccatatttaaggttttagtatttgtcttgtcataccaatatatttgtcttctcacattatttaatttaaacaatacattttgcaacagagaaacgaataacaccagcatgatgcaaaagtttttaaaagttcgaaattttagtgatttttattgtcaggaattttcaggatgttacaagaacagagtatgcatcggctgcgaaggcatcggctggagtctgcataggctgagaaggatcggacagaggacagctgacacagctgatagaggtggtgcagccgattgcgatgaagatggtttcagggctgtttcagggattgatcaaagtgcttcacggggattgccacgatggagataaagctctcagataggcaattgtatttattaattaggatatttcatgtaaattccttagagatatgtttgggcaaaagtctgccacgaagacttatggtatcgtagagtttgttagagataagtgtcgtgtccggcaaggacgtatcttgtatctcgggtataaatagagcccgaacccatgtaatcaattaacaacagtttaatacaatctcggcgcatcgccacccttttactttcattttgtttcgacgagttcttgctttcgggttgagctgcatcgattcgatcttcaactagaggtaaaacttgttatggcggcttgcgttctcgggattaatgcttccatctttatgacactttaatactgtttatgtaattcgtcgagttatcatatgcatgttgcaatctctgttagttgcgctatataacttgttatcggctgattcttattgttaggaagtgaccgatagagttatgttttgttattaatttagattgtatcgtgtatctaccatctcttataggttttcatcatcttgcctagatcttatacttgtctttatgcttaatgctgcatcggttgagttcgatctattaagtaatatctataattatgatatctggcttgttttatgatcatcgagagagatagtatcggggtttcagccgatcttacctgatttagctttatatcttatatgcttaattgatatgctagatctgccctttatattaagatcttatcgcaataaagtatattaggcttctgtttgatatattctatctgttttaatatcttaatatagagtggtatcggagtattagccgatacatgctagatctatttgatcggctatgctatatgcgtttataatcttcatgttaatatatactttgatctaagtgatttatattgtctcggcatggcgaccgatctatcccaatcacttgatttaaatatatatcgacagaaagattatatatcgttaatatctatagctgatcgagtagatttagtcttatcttgcttatttataactgccgatcgattcacatatgacatcggctcgaaaataaatgatatgtcatcaacgactggccgatcggctatcgtttatggatttaactgcggtttttctcatctttgtttcttgttgattgcaggatcaaatcaactggcaggctcacgaacctaaaagtaagattttggacccgcactgaagttaagcagatcttccaggctagtgtgtttttcgcatcaatagaactcaaatttgaaaagtttcatctgaagattttatgaaaatttcacctgatatttgaaatctttcaaaagtcaaaatttaaaaactttcaactcgtgtttgaaatctttcaaagtgaatgttagaaactttcaactcaagattttttggaactttcgactgagattttaatattgtcaagtccaaatctaaatactttcaacttgtaaaatataaaactttcaactaacgatttgaaactatgaattccaatttgaaaactttcatagaaatatttttttgaaaatttcaaaacatacaaattgattttgaaaactttcaactcgtatttgaaaacttttaaagttaatatgtgaaacttgaaactcaagattctttttttgaaaagtttgaagttaaatttgaaaagtttcaaaagtcaaaatttgaaaactttcaactcgggtttgaaaactttcaaagtgaatatttgaaactttcaactgaagattttttgaaactttcaactgagatttgaaaattgtcaagtccaattctaaaacactttcaacttgtgaatagaaaactttcaactaatgatttgaaacaataaactaaaatgtgaaaacttttcatcggaacattttttgaaaatttcaactgatatttaaaaactgttaactcaaattagaaaactttcatctcggatttgaaaactttcaaaagtcaatatgtgaaatttgcaactcaagattatttatttcaaaaatttgaacttagatttgaaaactttcaacttgggattgaaatctttcaaatttaatgtttgaaactttcaactcaagattttttgaagtttcaacatatatgtgaaaattgtcaagcccaaatctaaaatactttcaactcggaaaatataaaactttcaactaatgatttgaaactatgaactcaaaaatctttcatctgaagatttttttgaaaatttcaactgatatttgaatactttcaaagttaatatgtgaaacttgaaacttaagatttttttttgaaaaatttgaaatgagatttgaaaactttcgaaagtcaaaatttaaaatttttctacatgggtttgaaatctttcaaagtgaatgtttgaaactttcaactcaagattttttgaaactttgactgagattttaatattgtcaagtccaaatctaaatactttcaacttggaaaatagaaaactttaaactaatgatttgaaactatgaactcaaatttgaaaactttcattgaaagattttttgaaaatttcaattgatattttaaaactttcaactcgaatgtaaaaactttcaagttggatttgaaaactatcaaagtctatatgtgaaacttgcaactcaagattttttttttcaagaatttgaactcagttttgaaaactttcaaatgtaaacaaattaaaaacttttgaatcaagattttttttgaaacttccggcatagattttaaaattgtcaagtccaaatctaaaatactttcgactcgaaaaatagaaaactttcaacaaatgatttaaaacaacgcgcacgagttaagatgttgtgtgaataatgcacacaagatattatctactcaagctgcttccctcggatccaaaaaaatcggtgaaaatagggggtgggtggttggttatggtggtggaggcctggaggtgtgcaattggctccacagatatatttgaagatgatttctcaatgagtaaaacttttactacgcctgttacgcaagaaaaaaagttccgggagggagggggtggggcgggggagggtgtcacaccctgaaaatcgctaaattataaatcgttgtgaaaaaggaatttttagaaattatttaatgattaaagtaagtgtgtgaataaaatctatgaaaaatttgaacataaacttgagctagataaaattttattaaatactttgtgtgcccaagtattttcaggatttttcttggatttatttgagcaatggaagtatttttaataaatgaaacatcatttcagtaattatttaaattaaaaagttaattaaattccctctcttgtcttgggctgaatccgacccactcctttctctcccctctcgaccgaagtctactttagctccctcctctttctttctcactgacgcatggggcccactcggctacagtgccgccatcttcctccggccgcctccatcccgagccgtgcgtgtgcagcgccgctcccgcaccgaatccgccgctgcattgctcccgttccaaaattagttgcgggaacatattcccctcgatctcctctatcttatcacaagaaacccccttgaatcccgttgtaaattgcgtggattcgacgcgctttcgagctccgttttttcgtcgaacccaaactaatccgtcgccgattccatccgtttccgagccgatctctccctcttccagctataaatagcagcccctcggcatcctcttccgttttcccctttttcccgaagttttccctaaccctagccgcctccccgcgagctccccctctctctccacagccgccaccatctccagccgcacctccttgtcgaccccgtggtcgccggacctcgctgcagtctctgccggcatcgcagcaccaagccgaagcccgttcaccccttcgccgccactgcaaatcactagggctacgtgtcgctgtcaacccgaggcaatcttccgtcgctgctgtcgacgggggatacccatagaccggatatagagggtattggggtacgctggtatgaggatctacgtaatacgacatcaagcaaatagaagataaggattatactggttcaggccccttgataggtaatagccctaatccagttggtatgggattatatggtagaaaccacagattacaaagggaatagcagaactcgatgataccgacgagaccgtagtcgagttggttcgactagatcacccggcaacttggctcctgttggcttcgatttcgtaggctgtggtggttgtattggcggtgagattcgatgccttaggccctcccggggggtcccttttataccgcgggtcagttgatctccaagtagaacttggagatatcggaccccacgcgatacagtaacgacccagttctgtccgagtaggactccttccatccgtggactctgtttctgttacgtgatggatttccttaacgtgtacgcaacatccgtatacgcgcaggtataccgtatcaatatacaacatacatccaagggtagagggtatacctctgtaaccctgaaagtagcccccgacttctgcttaaatgaactcatgtgaccgatcgcgacttctgatctcggaatcattatcgctctcaactggtcgatcttggtatgagaaccgtagagacgtagagttatcgataacattgcatgaagttcaacggtcatgagtgaatttaaattgaagtccaaaaactgctgcgggtaacggacccagaaacttctggcggccatctctctcctttccttggaattcgcaccatcggtagtgcgcttatttacgggagttttggggatccattttgaagtccgtttgctgcaaaactttccggccttcaaacgcccctcgtcttctccgcttccgtagaaaagccctagctttcccatcttgtcctgttctccggcgatcttccggcagtgatggacctcgacaaatccacatccaccaatgcgtccctgaagaagctgcaggacgacggtgccctccctggtcgtgggaccatgcagagggaaacaggaggtactgaccccaaacctgtcctaggccacatggttgcggttgaggattacattctttgcggttttcttcctccgccttctgagtttcttcttcttgtcttgaatttctacggcctttccttgcttcatctgaaccccaattctatcgcatttcttagcattttttcctatctttgtgggccctacattggggtagagccatttcttgatctcttttacttctactatgagttgcgctggatggaacctaaaaaggtatctggatgtgtcggtttctaacttcaggatggcctgaagtcgtgatacatccccttccagtgcccttcttctcgtagaaaatggcgagcgatgtggttctatcttcagatagaaaattcggatccagtctttgttgtccatgaggaacaaccagacaagattccggaatggaccgccaaacccgccctaactccctcccttaagtctttcatcgatatcatcgatgacctccgagtacgagagttgtcggggtatgaagttgctgtcaacttcatcggtaggcagatccagccgctccaggctcgagcccacccagcctttgactattctgggccggaggacgcgacccgggtttcttctcggggtatttttcttgtatttcagatttcattttttatgtgcatgttcctgctgacttatcgagttctggttctcgatcctacaggtttgaacagcaaaaccgtggagcgccgcgtcagtcagcggccctacgacggtgagcaacgtccccgttcccctttgcaagaaggggacgaccgagtgcgaagctgcaatcaacatgagtgtactcgatggctcctttacttcttctttccttggatcgcattgtgccttcatgtacgcaagctctccctctgatagacgtcatcgggccgctcgcggatcacaaggcggaggcgtcgttaaaggagggcgttgccaaggaggcgtccgatattgctgttgctgctgccacgatgaatggcaacaacgttccgaagaaagggaggaagttctcctctgtacttggaaactgttggaaagtgcctactccgtcggtaagcctctcttgtttcttaatcatgtagtcagaatactttgacctcatatcgtgctatcttgttcaggcctcggatgcgtctcccccgcctctgcgaaggcaaaggctggtgacgcttggcgagaagtaggtagacgttttagaagtcatcctattcgcaaactcttgcttgcctgtcttcatgaaattgcagaaatccttcgcagggcggcgtgggtgaaggcggcgcaagacgggtccggtgcgacctccagcgtgtctcctgtggcggcctcgacggatgtcgtggtcacaactagggaccgggaggcgacgccgagtggacccgctggcggtcttgtgcccgctcggggcccgcccattgatgccctcacctagggggagctccaagctgagatggagcgcatcctctaggctggtgctcgcggcgtgggctacgagatcgaggaagccagggcggtgacgttgtcggcaacccaacgcgccagcaactggcgcgcgatctgtcggagacccgcgaggacctcctcaagatgagggagttggtggccggcaacgaaaggcagcggcaggggctcgaacaccggatgtcggagctcgagaacaacctgtcagagatccgtggcttgctgcgggtgtcttacaccggcctacaccaactcgccggggagtgcggcgtcacgaccaccatcccggcaacccccaacgagttctcgctgacgtcctcgctcgcggagctcgctgcggcgatggaggagatcccctccaagcatgcggccaggatcggcaaggagacgtcaaataggatttacaccggggcgtgccacgtcctcgcttgcgtgaagctggcataccctgaactcgacctctagaggattctggatcagggggccgccaatgacgcgcgcaagggcgtgatgaaagaagtcggtgacttgggggagtccattctccccctttttgaagagtagggttgtatttcccttgtactccttaatcaattatgcttgtaaaactttcgtcggttcaaactgcctttgtgtatgcagttgtttccttcgttttctttagcatgttgattccgagtactttgctgtcattgtagagatgttgatatcgaggatgtccagcagcgtgggcagcctgagtcgccggtagtcgttccggcacttgcgcttgagccgtacgtgccgcgggacgatgtcgatcaaagcctgtctgtgaaggcggacgtggcgacgacttccttaggttggtactttggttttcatctcctttattcttttgttcggatcgacttaatttgctgtgttctcgaaagaggagaacgacctgacttagtcatttccgtattgagcagacctcgagagtacgttggccgaccgagatcgtcgaatccaatattggaggacgaagttcgaggtggccgaactcgagaggactatggtggaagtgaagaaggaccaagccgtggaagcactccgaggtcgcgaggtgtggttcaactcgtacctcaggagttgttatacagcgatggctggagtctgtagagagctccaagtaccccgcgggaatctcgaggagtcagcggctgggtatatctcgtggttgaacggggcctgcactctgcttgaaggcatcgggaagcgtatcgacgaggccttgaaacaggagtgtcgtcggtcgagccgatatgtcggagggcatgtgctggcctgtatccgagatcaccgcccacagctgcacctcgagttcctccacgaagggtttgcacgttctcggagggctccacgtgtactctcctgattacttcctgatgacggttgaagggtagttaggacatttaccatggccataaccgtcatatggtagctataaaaggaggactccatcacacttcgaaacacacaactttgagctgaattataagaggctctattgtatcttttgtacattagaaaataggtagagagtgaggagaagctctggaggagtgcccggaagtttggcactctctctgacttcttcctcggcgagtgtagctttctaggaggaatttgggaggagtactagagctgccggtacactctgctccgggttcggagaaacttcttctattaagttagcattcgggatactttgttatgttatttaattatttagtataagtaagtgtcacgccctgaagtttagccatgctctaatatgctaacatgatttttagtggaattttcagagccttttaaataatttttaaccaattaaaatcaattatatgcaatataagtccctggaaaatcccccctttttttctttttcccttctttttctttctttttctccctctccctacctcatgggtcgccggcccatctctcctgcaccctcccgaagtcaaccctacctccccctttctctctcgggcgctgacggatggggcccgcctgcagccccttccccttcctccaaccagcggcaaccgccatcccaatcgccgccgcgtgccgcccgcgcccactctgtgcccatgtcaccacccacgcccccggttcccgcccatacacccgcgcccgcaagggcgagtttcgatttgaatccccctctctccccctccccacgtcaccggtgcaattggccgcccaccggccacgtccgtctctcccaagcacctataaagctcccccgtactctcctccactgttttcctttttttcaccgccctctcctgtgcccccaccgctcccacgccgatctcccctagcgccgccgcctaccgcccaactccagccgccgctagggccgccgccgccgttagcttcgcctgttgaatagtccccattggttgtggaagggcaaaggacctaacatataagtgggggagcccctcacctcaatggctagcttttggggtgggaaaggccctttacgatcctaaaattggtatcagagcctggctagtttaacatctctggcccgatggacagtgcgtgaaggcttgatggaccgtgggtgcttgcggggcccatatacctgagggaccatggtgaaatggtgaaggggcggtgaagggctgagggacaccaatatgtgaagtgggagattgttgaatagtcccacattggttgtggaagggcaaaggacctaagatataagtggtggagcccctcacctcaatggctagcttttgggggtgggaaaggccctttacgatcctacatcgctgtcgtgagagctacctcggccgccgcctcccatcgtcgaaatcccaccggaaatcatccttcctcgcacgccggtgagcccctccatttccccccctttggctggcattgccgctcaccgtggacctcctctctccctctaaatcctctcatttgcttccctaggtcacttcggacgtcgtccacctgctcgtctcgccgtccgccgcttgccaccgtcattcgccgtcgcaccttcccgcgccggccagccccacggtgagaactccctctccttcctccttccctctctcccgtatgcgccaccgctttccgcacgcttgccatcaccctcggccgacgccgccgtcctatgcgccgtctgccgctgctggtcgccgccatcggaggccgcgcgcgccgccgcccacgccatagccggccggccgtcttgaaaccgagtcgtccgataggccttggggccgatccgggctgttggtcccgtggaccggtggtggaccacccacatggtcctggtccacggtggaccgactgtcccttgagccgctgacatgtggggcccgcatgccagtccccccttgatgacgtcatcacctgggatatattgcgcaataaataattaaggctttttcttttttatagtaaaaacagagataatcttctaaaaatcataactaattcatccgagctccgtttaagtcaattcaagtctcagtaaatttataaaaatccctagaatccattgaaaatggttttgcttcatgtttcagtagacttatagcatgttttgcttgggtgtttgtttgtcgcgtagttttcggttgtttcgtcactctgtggtgcgtcgaagtcgttgcagagatctcatcagtgcgagagtagggcaagtcattcttgttaattgaccatattgctcccatattgcaaatgctctactttgctctaaatactgcattgttttacaatgtcacggtatgggctttttacctactgttctcagccttattatttgtatgccattttgctttgttaacttgggatgtaacatgcctagatgttggattagaattgctgagccctgcttagttcaactagtacacaaaaggggaaaacacattaaagcctagacattggttattagcatagctttggattggtgccaccgcaatggtgctagttaattaaaatacactaaatggtgggctgtgggtgcatacttttgctagtcgtgccatggcaattaaagaccggttcgcgggaaaccctggaagaacttatcgtacttaccacaagccagcgtgggcaacggctaggcttgtagtatagctttcctctagccgacgtacccaggctagggtgggtgtgatggagttgggtcggtcggggttttcggttgatcggctgccgaattcaccgtggcacgaggggggagggggctacccgttgcctgctggggacggggcgaaacctgaggtgtggttcaattagttagagggggttatgtgaagggtcctgtcacggactctttctgttatgtcatggtggcatgtcgacgcacggaaacgtgttgtcacatcttgattttcgtttcaggatttataaattatttaataaataattattagaatttatattaaatgttcattaatttacaagtgaagttaaatgtgggaaataaaatttcctcaatataaggcatggttggatttaatttttattaaattctccatgattaattatactctctggaattttctcggatttttctgagctcaattactaattttgataatacaaagaacatttcagttattattcacatatttagttaatcattaaatggtctgcttataattttgttaaatacttatagtgttcatgtaatttcatgatttttcttgaaattattagagcattggaagtatttttaacaatttaaatatcatttcagtgattaatttaattggaaaagtaataattcaataataagctaaaattttttttcatcggattatattcatgtgtggtcttgttttaaagatttaattgcaacgaatttagtagtgcaatcggatcgtgaattggataagtaatttgagagaaaatgtagtttaaagtttatttaaaaaacttgacacatgcatggctgcatgttctgtgaatgcatttcatcgattatattcatgtgtggtcttgttttaaagatttaattgcaacgaatttagtggtgcaatcggatcgttaattagataagtaatttgagagaaaaagtagtttaaagtttatttaaaatagtggacacatgcatggctgcatgttctgtgtatgcagtgagtacaaataatatttctgtgcatgcctgtagtagttttgggacctgtgatttttttctcccacatcggatggctcccgatttttttctttcggatcaggccctcccggtttttcgcctccaaatccggcctcctctctcctgtattgcgaaaattagttgagggaaaatattcccattatcctcctctatcttttctcccaaaaatccgactttatccctttcaattcgatgcgaatctggattcgttttcgagtttatctctcctgcaaaccctaggttttcctggcgcaattccttgtgttccaagcccgatctctccctcccgtggctataaatagaaccccaagacctcctcttttctttccaacccctagcacgagctcccgtgccctagccgcctctcccgcgagcgccttctctctccgtcgccgctagccgctccagccgctccagccgctccatccatcgccgctgctgccattgggttcgcaagaaggagaagaccagcctctacttccccgaagcctaaatccaccggagctccatcgtcaccatcaacccgaagttcaccgtcgcgttttgatctccggcgaggccctgctgcacctcccgtcgtcgccttcggtcgccgccacctcctttggattcgcagctgcgaggagaaccccgtccacccctccgttgccgccgaaacccgctggagaaccgccgacaccatcgacccgaatactaccaccacctcgaccttgccgccggccgttttccgtcgtcgtcctccgtagcgtcggccctcggtgagttcgtctcgccatcctcttcacgtagatgccctcggtttgcaccgacgtgccctagatcgccagcggtggtgtggtccagtgctatgctcagtggtgatgtcatcatgacatcattaatcctttatttaaatcgtaattcctttttttataaggctaaaatcagtttaatcttgtaaaattcataactaattcatatgaggccgttaaagtttataaattcatctaaaatcatgatctacatgtttgtttactttttatgtactgtttatttggagtttcttagtctttttccccgttttgtgtgatagcttgtcgtttctgtcgttgcgaaggttcgcgagtgcgtcggaagtggttctgaagactaattaaagaccgattattgcaaggcaagtcacatagatctcagacacaatcctttgaacatgttggtcctatatttaaattctctatttatttcaactgtgcatttattttcgaatgtcatcgagtggtgtgaacctattcctttgttatggccactttgcattgattactctattccttgataccttgggttattataatttgactagttgagatttatatattggttcagctagatgttagacataattgcttagccatgcttagaaacattagcacatgattgggataactaatgttacactaccacgtatgattatatttaatggtagctctcgatggtcaatcgtgatgaggacataactagctcggatataaccatgactaccttatgtattaatcaaataaaggtgcatatgttctacattagatttacttgttatatatttgaacaaacgttgctacacaatgagttttgtgtgttttcgtttgtagaggtacttgcttgggcgaaggaaaagagatcgagcataactaatgcatggatgattaaagaagttgattggggaccaaaccaagaccttctccaagtcttcttttatctcaccacgtcacttttagtccatagaagacaatagataaagttctacacgttttggattcggatttgggcctcctgacaacatcaatttcaaacggacctagctgctgatctagaaggaatttcggggcccataagtacttgttggaaagctcatggagtctattttaagatggttttggtcccacatcaaaattcctaccgagctgccaggaatctgcaaaacaagccacatacctcatctagtccgaatctgatttgagttttgggccttgtaattgtgtcgtaggcttagcccaatggggtgtgggccctagggcaactctaggacgaacctaatcatattaattcagtagctgtcatcatttagagttgcgttttgcttagattattctgtcgagaacagtttcgccgctagatcggtttgtaagaccccaactcgtgagcttaatcattcatctgtaattttggttgttttctatctcgttcttgtttgtgttcttcgattggcaaacagggattagccttctcggcgaggtcatccgtgttttgacacgggtgataatcagaagagacgtggtgctacgattgcggggctcaagagtgtgcgcgttcaagaagccggatctatttgtgtcgtgactccacccaaatcgttgtttatcagaaccttttggaagatcgggaactctagtgcgcatcaaatcatgattgattaattaattacttgccaactaaaacttgataatggtgggttgtgagcacatggttttgaaggtcgtgcttatgtcaattaatgaccggttcacgagctactgttgtgagacatttaccgtactaacaacaagccagaatgggcaacggctggacacatggtatagcaaggcttgttgtggtgcgccagactgagaagcagcgagaagtccgtgggggtcgctggggagtccatgcctctggttttttttgagggggtgattattatccaggaaaggtgcgctgctttgagttgagctatgcgaggggtcttgtcataactacacaaatggtgacatgttcagcatgggcacatggtaatatggtgacatattgtggagttgagtcttatgggtaaatttgtacacctcttgtcgcgcccggaaaaataccttttccagaatgctagtgtattaatcctcatcccaggaaaagccggggtacaccacacaaacatgatataaaagacacatctttattatatcgataatatttacattattacaaaggcacttcaggcctgacaatcaacaataaacagcagtggactagcggttctacggttccatcttcacaagtgctcaactggggtataagccaggactccacctaggacttcttctccaaatcttctcttactgaagggggggaaagatagagcaagaatgagtacaaccaccgtactcagcaagccacaccgggagatgcatgattaatgcaagggggtacaaggggtaataataggggttatgttttgcagtaaacagcatttaaaagacacttagttgctcaaagctattttgtaaacacgatcctagagctacacaatattattaatcaaggctgtgaacccacacgaacctgccttaaccaaaggcctacgatgattcagaccaaactagtaacccgacctgggtcccagctcgtcccatgtcaacccaagccaaccattccacattttagttgttaagcaagttttaagaattaaaccactaacttgggaacattgctaggcttgcccataaccgagagcgcggctattcgaatagatttactctgatcagaggtgtgcatctttacccaaagacacatctttactccgcattccatggccttggaacctgtcgtaaacatgtgacataacccttcacccatcctagccgtgaacaaaagtaccgacccaaccctgcctacggccagtatcccggacaggcagggccaggattgagcccctagcaacaggacctagaccgggtgcgccacacacataggggtgagaccacccgcgtactaatccagtgccatgacatctcgactaacggacatagagctgaaggttgaaccgagctttagattccaactgtttaggttaacttcttgacttccttgtcctcatagaagtacttctacctgtggtcatcttgcttactcgcaaattcttctaccttaatgacagggtgactgttgtagggtcgattgctatcgggagtcttcctcgagtgacacaaatcatgtttctcgttatcctttatcaatcacctttcgacctacttcttttcccagtaaccaaacatattttccgatctcttccatcaatcaccttttgacctttctcaaccaggtactcttcgctccgggtgttgtgggtgcttctggggcaatgaggtccttgggccctgctgcctttcggagaaaccttgaagtagttcgtcaaaagctatactgactgtcgttgcctttgatcagaaaaagacacatatgaaactcttagtccaaacaaatatctctttggttgatcacttgattttcttttctatctacaactaggttatttgattcataatagagtaggagctcacggaaatgagaccctaggtctccttaatcatcaacaaaacgtacataactcacagcacttgcaatcttaacatggatccttcataaacatgccaaactcattcattatttcatgtttctctcttattacatggttgacggggaatagctataaaacaaaagttcttgaacaccgatacaagagtattatggttgctactgactagcactaggcttaacaggtactgcatttgctccagtgaccctgatattgtggtcatgtcttcttcgtgcataacgaccggaatgatggcgcgggttacgctttggttgtggacaatttctggagtaatgtctttcttcactgcagttgtaacaaacaataactttcttacgcccaagttcttcatcaagtacttaatttctcggctgctgtactggaacatccaaaggtacaacgcagatattggcctctgtcttgtcaactggtggctggggctgaaattaagcattgacacctttgtggtagtgcactcagttgttgcaactcaggctatacgactgcttcgggatgcatggatgacaattcgctaaggaacaagcttctgattgtggggagttgcatggactgacatgctggcagctatgtttctcagtttcgggcacctggcggcgaaatgacccaatttcttgacaatttaagcaactgatatcttgccgaactcgggatttgcttttcccattttgattcctctgtcctactctggagttaggctgaaaactgtattcttgtcgaggatttacgtggtcttgatgcttctctttgttggaactggcggggtggttggccatcttcttcgtcagcagaaaactgaattgacaatcttttggtacatgatcagttccttcacacaagaaacaagtgatcctgctcattggacactcgccgggtggatggtctttctcacaatgaaggcaggtagtgacacatgagctagcaacatgaccgatttctccacaacgagagcatgccttatgttccattttattctgcttgaaaccttagggagacttctcatcttcatcccctgaggagacttgatctgaatcttcactatcagacactctacctccattagctaaaagatgttgggtcaactgtggtgcaccacgaaagaaatttcctatctgacgttttgtcattcctggtggaggccattctgtgccggtaatggtcatcttacggacttcatcatcggttcgcattggtgcttttcttttctgctgaggacagttccttgcatagtgcccttgttcatcgtagataagacaaatgattatagcttcttttgagtccacatgtggcatggcacaatgggcctgttgggatgctagtggcacgttgtctggcgatgtgggtgcttgatctgcctcaaattgcacttgaggttgcatctgactcgggttcagaattggcgtctgatgatgttgtaatagatctatgagcaatttgttctggttaattaggtgttggaccactaccacacaactggtgtctggtgctttattcacttgggagcatgaggcacccttgtcctgatttctgaccttactgcctttttcattgtcagccatctgttaccaggtttggagagggagagagggaaaacaaaaggggagggacagatcagaaactaaggatagcaccttaacagatctaatctttttctgttatgatgtatgttaggtttattctacaagttgattaagcaaacaacctagcatggttacatcacaccccactgatgcaaaccacgcgctacgcacacaagcaaggaagcacacgactatgactctaccctagagggtggcttaggttctgtgacgggttctccaagatcttcactcctgcttcacagctggcttcacagcttcctttgcttcgctagcggacccaacagtcttccggagctttggcagacaattgacggcatcttcttcttcgcaaagatgaccatctagtactagttgaaattcgaagaaggaagaagggagtaaaccttttgcaaatagcattagggaatggagaaaaaaggaactttcacaaatagtttcatgtataaaatatgtccttaggttttatccacttggcttaacctacagtcgagatggctctgataccagcttgtcgcgcctggaaaaataccttttccagaacgctagtgtattaatccccgtcccaggaaaagccggggtacagcacacaaacatgatataaaagacacatctttattatatcgataatatttacattattacaaaggcacttcagacctgacaataaaaaataaacagcagcggactagcagggactagcgggcctatggttccatcttcacaggcgctcaactgggatataagccaggactccacctaggacttcttctccaaagcttctcttactgaaggggggaaagatagagcaagaatgagtacaaccaccgtactcagcaagccacaccgggagatgcatgattaatgcaagggggtacaaggggtaataataggggttaagttttgcaataaacaacatttaaaagacacttagttgctcaaagctattttgtaaacacgatcctagagctacacaatattattaatcaaggccgtgaacccacacgaacctgccttaaccaaaggcctacgatgattcagaccaaactggtaacccgacctgggtcccagctcgtcccaagccaaccaaggccaaccattccacattttagttgttaagcaagttttaagaattaaacgactaacttgggtacattgctaggcttacccataaccgagggcgcggctattcgaatagatttactctgatcagaggtgtacatcattacccacaagacacatctttactccgcattccatggccttggaacccgtcgtaaacatgtgacataacccttcacctgtcacaccctgaagtttcccctttttcttgctttaaaaattggttaaataaattgcccgaagaaattatcttaattaacctagagctaaatccctagttaataaatgcaattaataatcggaaatagcgtggtggaatttttcttgagttccccatgctccaatgcattaacaagatttttagtggaattttcagagccttggaaataattttaaccaattaaaaatcaccaaaatgcaattttaaatcccaggaaaaatcctttcttctttttctttttcttttccttcttttttctctattgggccgttggcccactctctccacgcgctcggcctccttcctttgggccggcccgttcccctttcccctctctccgggacgctgacaggtggggcccacctgtcaggtcgtccccttcctccagccgcccgccccacgacggcaaccgccgccaaaaccgtccgcgccgctgccttctccgctccacgccgcgcccccactccgcgtccccacgtcgccgccctccccgccattcccgcccgcacgcgcgcccgcaaatgggcgggattcgatttgaatcccccccactttctctctcttcccccacgtcgccggccaaatcggggcgtttcccggccatgtccgcccctctcaagcccctataaagcttccccgcatctcgctctcccttttccccttttcgccgcgctctcccgtgcctcctaccggtcgcgcgccgctcgccactagcgccgttgcttgccgccacctccggtcacgcgccgcagccgctagagccgccgccgcgccaagccgccgccgccattagcattgccgccgcgtgagccaggccgccgctcggtttccgctaaaccccaccggagcccggttctcctcgcacgccggtgagctatccattctccttcgtctccggccaacaatggtggccaccgtggtcactctctctactcctaatccttctcaactccctcctccgtaggtgccgccgccacccgtccgcccctcctcatcgccaggtcatcgccgccaccttcatcctccgctccggccgccatactcgccggtgaggatcctcccctcctccctcttcccctctctctcgtttgcgccgcctctctccacgcgctcgccgtcgccttcggtcgacgccgccgtcctgtaccccgtccgctgtcgcttcccacgccgccgattgctgtcgccggcgaccgtgcgcgtcgccgccggttgccatggccggccggtcggttttgaagccgagccgagccgtgcctagccgccgccgtgccgtccgatcggcctcccggccgatctggaccgtcggtcccgtggaccggcggtggaccacccgcgtggtcccggtccacggtagaccggccaccttgagccactgcccatgggccccacctgtcggcgccccccttggatgacgtcagcctaggtattattgcgcaataattaattaaggactttttctttattaaagaattcataagtaattcatccgagctccgtttaagtccattcaagtctcagtaaatcaagaaaaatgcaaagaatccattaaaaatggttttgtttcctgtttcagtagtcttatagcatgttttccttgtgtgctttgtttgtcgcgtaggtttcggccgtttcgtcgatccgcggtttctcgaagacgttgctgaggtctcatcggttcgagagcaaggcaagtcatccaatatgtttgatcatattgtacccaatttataaatatcccgcatttctattaaatgttgcattcttttacaatgtcatgtgggatgggtcctactactcagccatatattgatttccttatgccattgacaacttcggtattaaaatgactagatgttggtttaggaagtgcttagccatgcttagttcaactagtacacaaatgggggtcacattattacatagactttgactatgagcatagctttggattggtgccaccgcgatggtgttagttaattaaaatacactgaatggcgggctgtgagtgcatggttttgctggtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcagccggggtgtccggttgtctagctgccggattcaccgcggcgcaagaggggactgcccactgccttttgaggggtgggggtgaaaccttagcgtggtgtggatggttaggggagggttatgcggagggtcttgtcacgattttcccctttgcagtatcatggtgatacttcggggcatggcgacatgtgtggaatcgtgtcttgtgggtacagttgtacacctctggccagagtaaaactattcgaatagccgtgctcgcggttatgggcgatcaaccagattcaccgtgattagtctcacccctagtttagcttaatgaactgctgtagttcaggtggatggttgggcctgttgcaacgtggtgtagcgttggacagtgattggttaatattgattaattactacagctgttttactgctttcaactactgctttgaaatgcctactttatgcagaagaacccctagcttcctttggttatatcctgcatcatacctcctcttccggtatgacttgctgagtacagtgggtagtactcagtcttgctctcttttcccccacaccagagttgaagttcttctcagttggagccgtctcagaaaggttggtttcgtcgctgccgtcaaggtttgcctgtggagtggagtggcccgctgctgaagtcaagcttcccggtttagctcgctttaatctttcccgctgcatttgtaatcttttatattttttgtaagacgtgggtctgtatgtcaacaattgtcgtttgtgtaccctggcttgtcctggacagggatttaatgcacattcagcttagaaattctggttcgagaatttctgagtgtgacatcacccatcctagccgtgaacaaaagtaccgacccaaccttgcctacggtaggtatcccgaacaggcaggctaggattgagcccctagcaacaggatcttgaccgggtgcgctacacacataggggtgagaccacccgcgtactagtccagtgccatgacatctcgactaacggacaccggcccgtgcagccttcatttgcctagacatctcgattaccgagccgcagctcacgtagccttcatttgcctcagagatatccatcgtcgcaacgaattcatccatctctatccgtgtccttttgttcaggactagaccgagcaccgagttaagccttaccaattagtcatgtggttagtacggtagtgctttgcaacagaggcctgagcttaatccttggccggggttctacttcccacaactggcatgcacccaaaccccaccggaaaacaggttttaggggttttgaaagaggaagagtggggcatgtccaattccaccataagccaaccattccatagtgtccaagtgatatgagaattcccaaagtctaaagttataaaaccacctagtgttgcctaattaatcagcgaagcatctacctaaattcatacaaatggaaccatgaatggagtacccactagttggggttttattttccttgggtgaacaaggtaataataaacaataacaatgataaggctataacaaggattaataggaagtgctaaataaaatagtgataatgcgggaatttaaataaagcggtaatgcaataatttaaatcaaaatagttttatatactaggattcaatatgctcaagggtgatgcgacttgccttgctcagagagaacggccttccgaaccatcggcgacgacagcgaaccacgcttcgggaacctccggaatgacataagctacgcgaagcacacaagcaaagctacaagcctataaagaagcaataacaatacataaaaagaaagcacatggttctttgggttataacaaacattaggagacttgaacgggtcgattcggggttcgtatgaccaagacatggtcatccaaagtttactgctgttacatgaagatttgcggattattataattaggctttgcaactataaaacatgtgtaagcgctagcctggaaaagacaggaaggctgcgcttgtcgacatgcagaccccacatgtcaacccaaaggcccacggtagaccgagtacacagagacggtccacgggtcgacggaagcggaccctgtttgtcaaccaaggtgagtggccgacaaacggactccactagacaccatgcgggctgcacacgtggaaaccacgcgactaccgagcgggcacactaacacggtcaccacatgcacacatgaacgactactgacaccggtacacgggtacctgggtcgacaaccgcacgacgggcacggggcgacaccaaaaggacgagaacggggtagcgagaagagggatccttaccaccacaagacgaggcgcggaacgacgatgacgaacgggcgcggcggagacggctcggggacaacggaggcgaacggtgatggaatgacttcggtggtgatccttggacgaaggcgagacgaggcctgcacaaggcttgacgacacggagccgaggacgaagacgacgaagaggctgcagcacacttgacgaaacgcgatcggcttgacggagggacgaacgccatgacgaccgggaatgacgagagggcgatgatgaccgggccggtggggaggcgacgagggcagccggcagcagctgcacggatgcgaggacggcatggaacacgccgctgcaatgccgacgacggtggcggcgcagcaagatgacgtgccggcgaggaggatcggccgaccggaggaggggatggcgacgtcggatggagacgacgatgacaaacaccggcggggtacgggtggaggggaggcgaggccgagggcgacgttgccgctgcgatgccggaggagacgacgacgtcggccggcacacgggcacggaggaaggagtggccgaaggaaacgtcggtgaggtggaaggagaggctagggtggaggtcgatgccgcggtaccgaaggaggagatggcgacgtcggcaactggaggtggtgcagtggcggcaacaccactggacgtcgacgaggacgcgcctccggcggtcaccgcgcgaaatggagggcaggccgggggagaggaggcggctgcgacgccgagaatggtgacagcacggcctaccggtgcatgggcgaggcggcaaaggcggctggaggtggccggcgacacgggagagagagaggagggctgcggggagaggcggtgcggccacggggtggcacgggaggaggctaaaatgagagaacagaggaagaggatcccattttatagcggaggggagctagccgggcacgggagagggcggaacggcgccgagaatggctgccggcggccatggaaggtggccggggatggcgcggccgttccgggcgattgagggtgccattcaaggtggaaattaggggggattgaagaggaaggaaatgggattaattccccctaatcaatttggaaagaagggaattgattcgcgcagatttgagggaggaaattgatagggtttcatgggagaaggaggagccgggcgggaggaggacgacgaccgggtgggtgggacccaccagtccgcgcggtcagcgcgcgtgcggcgcgcgtgcgcgggagggctgcggctcggcttgggccggggcaggcctaggcgggaggaggagaggagggagtgggacgggaaggagaggagagaagtgcggcccgggagaaagaagggagggggagggagatgggccggggggggggagaggaggcccgagagaggagggaaaatggagggaggagagaaagactttgggatgaactcggcccaaaggcggaaggaggattatttttagttttctttttaataaactttgataaaggttgttgttgcttatagttatttccggtgttctgaaaattcaagtaaaatttgagggctcctttttgaccaaggagaatttaacaaaaattctccgggccacattcgaatttttcttgtttgctttttaaggttgccaatttcttttcgagttttaattaattctattattccttttagagaatgatttttatttcgagatgaatttatcaggacgtgacacctctggccatagtaaaactattcgaatagccgtgcccgcggtaaatggcgggttgagcaatatttttcgtgattagtctcacacctctcacaataattattgatgctataactggtaataatttgcttagctcctggtttggagttagatctgtacagccgggtatgtttgttcaggatggttgggcctaagcagcatgggtgtgctgttcagtgttgattaatattgatgattaattactctactgttttactactcttaaatgtttgcttaatgctagttttccaaatgagcctatattatgccatccttcggtatccttgtgcacttgcatatttgctgtgtggcttgcggagtattccatgtactcaccttgcaataatcaatcaaacctcagttgaagagaagtcgcaaagaagaggacgtttggcttatacccaagttgagcttcctgtgggagtggagccggagcttcgctagaccattaatccactgctgtttttcttttcttttgtaagtatgcaatgttattattttgatggacttgtatattaaattgtcagtttgtgtacctcggctgattcctggacgaggattttatgcacaaataacttcagaaattactagtgaatttctgggcatgacacgacgtgtcgtggggttgtgtcttgtgggtacagttgtacacctctgatcagagtaaaaactatttgaatagttgtggccgcggttatgtgcggtcgaccaaattcaccgtgattagaatcacccctagattagcttaatggaactggttagttcaggtggtggattgggcctatctcaacgtggtgtagcgttgagcagggattggttagtattgattaattattacaattgttttactactttcaactactgcttttaaatgctagctttatgcaaatgacccctagcctcctttggatatattttgcatcataccttcccttcctgtatgacttgctgagtaaagtggatagtactcagtcttgctctctcttccccacaccagagctgaaaatcttcccagttggagctctcccggagaagttgggttcgtcgttgccgtcaaggatgcctgtggagtggagtcgccccactgcaggagtcaggctttcaagattagctcgcctttctcttttccgctgcatttgtaatcttttaatgtttctgtaagacatggatctgtatgtcaacaattatcgtttgtataccctggctggtcctggacaggggttttaatgcacattcagcttagagattctggttcatgaatttctgggtgtgacaagttggtatcaaagccgaccttgattgtaggacaagctaactggaaaccctaagagcccttcgaatccttttcatttgcatatgctctttgcaattggatttgtttcgggaaaatgagggtttgttcttgtggttgatgggaaaaatcttgatcgcttgttcaattgaaatttatgaaaatgagatcagtctagggttttagtaaaattctagtttgaatttatttgacagtcaatcgggatttatcggggtatatgcgttaattcgtgtctagacttgatggggcgcaatctttatgcgcatcattactactatgtagtatctattttgggcattaatttattgcttagttagtgtcatttcatgtacaatgctctatgcataaaaaaaatagtgcttggctagatacttgagttatttgttgttttgtttaatttggatttgagcgtgcattagttcctaccccttgtcttccttagatgtcagacctgttccttgatcacaagtgtcgctccaagcttcagagacaccgcctttagctttattgtcttcttagttgtatgcttggtttctgtgtttaggtttgttgcttgtgggttagtcggcggtcgatatcatgtgtcagtggtatggttgcctgaattaggagttgcttgcctcctttgtagtgttttaattcaagtcagatcaattgcagttaaatttataataaagattagtttctaagccatctgttttcttccttttctcttatttctatctatcccctcaagatgaagtcaaggaatggtcgcagtgtctccaatgacgccagtggcagctgaagagcagatcaatggagcacacgccaacggtgcatctggcagcagttcatcgccaccgttcgagaaccgaacgatcactcaggtgctg

SEQ ID NO: 19860 - DNA, 6673 bp, Oryza sativa
agaagcatgagaagttcatgtcaggtcttgatgatgaattgaccaattagatgatctccagagactctgaggactttgagaagcttgcggacaaggctatccgtcaggaggagcagcacaacaaaatggaccgaataaggaagactagtcagttcagggtttccccggggaacaatcagaagcctcgcttcatgactggacagcaggttcgatcttccaccatgattatctgtcagcaccatccctacatcagcgtcaaccacaacagtagtgggcagcaccaccaccaccaaactcctcacccactaatggctccaattcagtcaggtctgccagctatgtcagctaagttagaacagcctgttgacggtcgttaccgataaatttcgacagtcactataactaaaataatggagaactagctatgcatacaatgtatgtttatttgccaaataatatatttccacttgtacttggagaataacatgtagcaggaatttatgcaaataaaataaagagaaaatggagaaaacctcactcctaagcgagcaaatggataagatgggcccacatgtaatacgagtaactgggaagatggcaagacagaatctgtctcgcaacttttcccaactaccgtttacacatccaacggtagaggtgtaccattgcttcgctctctcttgaagggtgaacggaaataatttccaccatacaatttcttgtctcatgccacgaatcttaaggcatgagtagacttgttcaaagtcccgtagatgatggtggagattttctagatctaagccagaaaaagggtttttccttaaccatgctgatgagttcggcgcgaatttcatagctagttgtataaatcggctccgatgaaggaggtggctcatagaattcgcccctaggagcagacacctcgaagagaggttgctccatagttgagaagagtttaaaaggaatgcttctctgggtagcaggggtggaggaagaataaaaaacaaaaaagagatacgaggatgaactgggttcggaaatgattagcaaccgttccccagcaacgacgcaagatatgcttgttggtaattcttatggtcatggataaaatccgcaagcgcacggatataccgatgtctaagggaacgtgtacggtcagatcttcttccggttcatccaaggacacctagcaaaggataggctaggatagagaggatttactagtgagaaacagtgtcaagggaaagcttatgtttaatcctaacacaatacttcaggcgctggcaacctgctgttcctagatgtcgctctactacgtacccggatagggaggacttaagtgctattgagggctctcaccacctctacacccacctcaaacgtactgtgggatacgcagcaaccactggagattaattacccagacaccacgtctacgcaattaataactactctagtgccgatcaaacactaaagcaatcactataaataaatggactacagtgaacaatgatcccgtatgctaattaggaactaaccaaaatgtaattctcactaagtaaatcttaaatactcataatgatatttctattaaagcagagtaattaagaagatacaaaagtagaaagagattaccgacaactccgggattcctccgattccttctaccttactctctcgctattctaatatgcaataaagtacactagagcctcttgtaatttagctcatgctttggtgtgtgtgaatgagggagaggagaggggtatttattggtggagagttgccttgggagagtggagatgctctaagcatcctatgagcatattccctctagctttatctcctcttgacaagtgtcctctctatgacggtttccactggtagaaatggccacaaccatcattgggatgagtagtacaaccgtcatactgaatatgggctggactgggccagctaggggttcggccgaaccaccctggttggctcccctggcccacatctttcttcaggatgctgacatgtgggccccacttcttgatgctccattttttggctcaaaatgattgcacattttatatattgtagctcaaaaccatgtgagtttatcagagcaaaatatatttccattctttatgctcattctttcccaacttaggtggttgatcacctgcatataaatatacaccaacactcatggaaattgttagaaataaatcctacaactatgttagaagtttcacatttatggttttatgcaggttttgacggctttattttggcacttaactgccgtcaacaaaaccccccacactttgctctttactcgtcccgagtgaaggttaaggattaatgtggaataaaatttcccaagatataatacaagtacacaaattattctaagccatacctgtacctgtgaactattgaagtgtctaacttaccatcttgggcaattgatgaatggaacgatcgtgactcaagtcctccttaatcctcctatcaatctcttgggatttttatatattttcgcaaagtagctatactcttcgaataaatctctcaaatcactcacgtggtttgatttgcggatcctcaccaaggcatggttgccgatttgtccctattctaaaaggctatataggtggagctcggtagggatcaatcggggcatacctgcatcaggtatattgcaaagccaaaataccagacccaaggagatagcaagtcatactttctgatcaagaatgtgcatgtgtgtgatatgtgtatgtgtataaaaaaaatgtgtggatggaaaaggaaaataaaagataacaactcctttggtatacctcctcctccaattctttctcttggaaatttaagagagtgcatggctatttcttttcctctttttatttcatcatgccccatacttcgtatgagcaagattctctttattattattattatttttttcatcaatgctccattcttgtatgagaaagactttatttttttccttctttttcatagccacgcctttctctctgtttctttttttctttgaaagaattttgaaagaagaggcataaatgacatggagtatttattttgtggataatggataaaataaatgatggatgagggatgctagcttccagtgtagaagtttagcatagtgtgtgtatgtggagtgtggtgtgatcttgatcatgaaagtatgaaagcatctcacatgggtgacaataatttgacaaagctgaatgtaatgccaagcagcctaaacatatatcagaattttgcaatgagaattatatatggccttagtaggtaataatatagttactaaggagtattgctcgaaaaagtttttattttcgcaaaataaaatcccaagtatcatgacagttgtataggaatttcttttgtcataaccatatcacataacttagattagcaaggttccctatgatagatgttagttcacaagtgacaagtgttagcaaagaataaaaagtatacatgattaatcataggagaactttatttgttgagagttaaggttttcaattttcatttggagtcaaactaaatttgtattcaatttttccgcaaaagtttaactcacaaactagggaggataaggaaggagacatgcaaacctgaccacacggtagaagggtgacagagctggtccaagcaagggtcgggcgaacacttggttcggccgacctaccaggacatggttctgattgccgaattttgtgcgcggccgtcagctggtgttcatcaggttgtcatgttgagttgatgctattgcgcgtacgggagttccgaaaagactcccccacacttgttttgtaccttgtctttattcaacaaaaaccataaaaagcaaaatgggcttccaccgggttgaaataccggtgagccaaattttattcaaataactctaggcgcatgaagtgcctattttattatttcattttcatttttttatttttttatggcaacaatgagaatggtggttatcctagcagggcggatatatgacgtcatgattcacagggtgtttgagattcttaccagattgtacttaccaagctttgaaccaaatcgatggtaacaaagtgttgcatttgctttgcttggttaccctgtgcatctctctcataagccaaggatcttggtatggatgttggagttattgtacactgctccttagttgtcttttttatttcctgcaaaatgttagtggacaacaaatacccgagggactacaaagatttgaaaagattttatcatagcctcaagattagttgttcacatccatactaaaaaggaattggattctaaacttaaagcgcgtggatcccaccaatttgccataattttattttgtcatttttatttctttttactcgagagtcatttcttttattattaaaaacatttttttcaaaaaaaaatttttgttcaccaaacttttattcaagcaaaactcatacagggctgagataaacttatataacatagaaaaggagcatttggaaatatacgtaccgtgtaccttgagaggtgatatgtttctcctttgtatgttttggcaattgatttgttcctggcccttgacttacctccagtgtgactcgtgcttgagaactcacccatcagattgaataatttcctgtaggggttagtccacgaagggtatacatccaaagtccatgaaagtactggctctacggttcatttaaacaaacttgacaccatgtcaactttgattaaagcaagctatttatcctaagcatcatgcttaatttgagaagcctatgaatgtcgacgaccacccaaaccataacatatgaaaatagaccgaggacgcataaccatgcatgatcaagccagactcaactagagataagtatgagtaatagtaatggtgaatcttttgttgtatacctgagtatatttacagccagcatgatgtatatgttgaaatctttggagcggtggcacggtcaaatgtgattgttgttctttcctccatctggatgcaggttgtggcggaggaaggcactttgaccatgccaactcaggcgagtggttcggttatgcacacatcttgggtgcaagaaccttatgccttgaaggcatgttccgtcggcataatgctaaagagacataggatgcatctcttttcgggcaagtatgcaagtgctaactagagtggagcagcaaacagctcgaaaagaagagggcatttcctcttggttgtatgtatgtaggtgttgcgggagcgagaagttgtgcacagctaggattggatgaaggctaagccaagtcgacacatgagctcaagagaggggctgggtatagcctggcagcatggttactactagcaaggtgtatagccatattttaaagactcgcacataatgcggtctttgatctaaatgtagtccgtttgctctcttgctgtcctcttctcccatctcttttttttatatcttccgtctctcttttcttttcattttttttcttgttcttttttttcagcaaggtaaaactaacaccaactgcaaaccaagatggccttggttgatggaactcatcatacaagctcgtcaacctcccccacacttggactttgatgtcataagacatcaaaaaccatgtgtgttatgttggagtcttcataaagtgtgtttcaacaccaaggatcaccaaaatgtacatttgatgtagctcccgagttcttaggcatcgtacatccctcgttcttaatctcaacctgaaatggttagtgaccaagaatacccgaaggtgcataatatcctaaaaattggttttttcttttattggaaagacaacttaccaagataatccggggtatctcccggcagtgctttctttatggtcacaagctcgaccatggagacatctcgttacaagattagtgccacaaacacatacgagatttgcaatatttatgataaacaaaagcatccacaaccaaccttctaaacatgttagagataaggcccgaaaggtggttatggttctcacacaaggaagtgatactaatcggatagaactctaaggattctttatgtaagcatgaatcctagggtattttgaaagagaagttttcatgctcatttgtggagttctcatcctccagagttgatgtctctaacttgtccatggcttgcagtttctccttctcaagagatgcatcgtgcaagaacaaggttgtttcttgacaaatgtcgagaacaacattttgatggccagagggacaaggttcaggctcgataggaggttgtgatggtggttctttggactgcaattcaacggtcttgccagaatctttttgaatgaaatgaagatcatcctgttctataatagactcaggggactcatgaagcagaactgccattgcttcctctatcggtgcatcatcagggggtatgtctgtcaacgagttctcatgatcgttatggagatcacccctgaagtctagagcgcatcccgaagtttgaaattcttcgttcttcggtgctgatggctcgagagaggataccttagctgaaactgatggtgtggaaggatttgattcagatttggctattgaaggttcctcttgttttgacaccgataccttctggaggggttcagaatgttg

SEQ ID NO: 19861 - DNA, 1728 bp, Oryza sativa
  unsure (1)..(1728): unsure at all n locations
atagccgcgccctcggttatgggcaagccgagcaatgtacccaagtcagtgttttaattcttaaaatttgcttaacaactaaaatgtggaatggttggcctcggttggcttgggacgagctgtgacccagggtcgggttgccagttcggtctgaatcatcgtaggccttgggttaaggcaggttcgtgagggttcacgaccttgattaataatactgtgtagctctaggatcgtctttataaaatggctttgggcaactaagtgacttttaaatgctgtttactgcaaaacttaacccctattttattatccccttgtactcccttgcattaattatgcatctccggtgtggcttgctgagtactgtggttgtactcattcttgctcaatcttttcccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgaaattttcccggtcgcgacaagctggtatcagagccatctcgactgtaggttaagccaagtggataaaacctaaggacatattttataaataaaactatttgcgaaagttcctctttttctccttcccctaatgctatttgcaaaaggtttactcttttcttccttcttcaaatttcaactagtactagatggccagctttgcgaagaagaagatgtcgccaattgtttgccgaagctccggaagactggaggatccgcttcagaagtgcaggaagcagtgaagccagctgtgaaggagtgaagatcttggagaacccgtcgcagaacctaagccaccctctagtgtttcgtctgtcgtgtgttcctttgcttgtgtgtgtagcgcgtggattgcatcggtgggtggtgatgtaaccatgctaggttgtttgcttaatcaacctgcagaataagcaaaacaaacaacacatcaacaaaaagagttagttcctttaaggtcttatccctagttctggtctattctttccttgtatgcttcccctctcaatctctaccttgtgacagatggataacactggtaacaaaggctatgggaatgatggatccgatgactcaagaacccaagccaatgggaatgagaaaagcatcaacgaaacctcaccagagctaatccaaattgtggttaaccaaaccaacatgttggcaacagcctttcaactnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19862 - DNA, 504 bp, Oryza sativa
gcgactatttcaaagtacaccggagcgtcggaggaaccggaatctagcgacatacaaagcaaacaatgcaaacaggctataagactactgaaacagggaacaaaagtatttttaatggattctactcatttttcttgatttactgagacttgaatgggcttaaacggagctcggatgaattagttatgaattttagaagattcactgtgtttattactataaagaaaaaccttaaatcatttattgcgcaataaatcccagggctgacgtcatcaaggcggggcgtggcgccagcaagcggggcccaccggtcagcggcttgggagagggaggaaggggcggttcaccgtggaccgggaccacgcgggtggtccaccgccggtccacgggaccgacggtcccagatcgccctcggggccgatcggacgggcggtggcgacccggttcggctcaagaccggccaagcagctcacggccatggcgacggcgcgcgcacacgcgttg

SEQ ID NO: 19863 - DNA, 2514 bp, Oryza sativa
ctcaaaactgagcctccaacctttgccattgccatcgatcctatggaagccagtgattggttgcgcacagtcgagaagaagctagggttgattcagtgcaccgaccaggagcgggttggcttcgcaactcatcagttggttggaccggcttcagagtggtggaatagctacgaagcatcacggccagaaggacataccatcacctggaacgagcttttcagtcctgctactttcatggtagtatccatcatggtgtcccgtcaggtaatgtattacactaagaaaacgagagtttcgctacctgaagcaaggagatttgaccgtcacagagtacctgcacgagttctatcgtttggctcactatgcaccagaagatgtggaaacggatgaagacaaacaagagaagtttctccaggggttaaaagatgagccgcagtgcaactccttctagaggattatgaagattttgagaaacttgtggacaaagccatgcaactcgaaagtgagcataatcggatgacgaactgcaagaggaggattgtcaacatcccagtatttccatgtggtaaccaaagacagcgcactgagccacttcagatcaccggatcttctgttgtgcatcaagagtttccgcgccaagaagatggacacaatgcagacaacaacattagcaatactaatgatgatgatgttaccaccaacaaccatgcttcttgccccaatagtgaccactcgaatcaagcgtgcaatgtcaacatcattcaccaagatgtcgacgatagtatcaatgatggcacccaaaatgacaaccctagcaattgggactctgagaaagactccgatggtgatagcaactatggtaccactgatgccaatgttagcaaggatttccagccaccaattccaactccaagtcagaatgaccgtccccagacggatagctcagcaaagaagacgttgatttgctacaattgcaaagaaccagggcattactcgagggactgcctgcaaccaaggcaaagtcgacctccacattaccgccaatttacacgaagcagacatcccaatcgtattgtggtcactggagcaaacgctgtacccgtgaggcctcgtgttaatcagaacccatagcagaaacaatgtaccgatgctaagcacctttccttttaggcagtgcttagtattcatgtaataagggagaaatgtgtaatacagacaagttctactaggattcttttggaagatgcggatatgtgattatgtgtataattgcttactgataaaggagacctagggtctcatttcagaggaatcatatactaatctcgagttaataaccaacctgttgatggaaaagaaaaccaattaaactgtgttggattaaaaagccaaagagacttttgtttggactgagagtttcagatgtgtcctctttggaacaaaggcaacaaccgccagtctagcttttgacaaaccacttgaaggtttctctgaaaggcagcaggctcaagtaccacatcgtcaccagaagcatccacaactctcggagtgaagagtacttagttgacaaaggtcaaaagatgattgatagaagatatcgaaaaagatgttttttaccaggcaaagaagtaggtcgaaaggtgattgataagagaaatcgggaaagaacacatcaaggtcaaaggtgtaaaggaatacgttgaatgctaactgaggacaacatgaagagaatagtgggaagtgaaccaaatgtaaagaaagtgaatccgagttgcttgttcgtgagagctattcccagttatgaaccaagtgatatgttcgaagatagtctacagaggtcagacaacgaagcttcagatttggcaggatacgattaaacaataagaagtccagcagtaaagccatttgggaagacgtcaaagcatgtcaaatgggagaagttggttcagttgagaaacataattcaaaggcaaagttatcgacccttgcatcgaatagcagaagtagctagcacccggagagcaggaaagttaatatgaggcagttggtggcaagttagaagtaagtgacaagcatggtattctcatgacgacaagcatggtattctcatgatgacaagcatagtatcttagtaatgacaagctagtgttgacgcatgacatgaagtggtaacttctatgaggttgacgccaaagatatgaactatgcgaagttctggaactgaagccccatcttcaggtgccgcaacccagtcgaagtcagctaaaggttcaaccagggacaagtcgggtgaagagaagatcccatctgcaacaggagatcgagccaagcagtccagagtggagaagttttgctaggcaagtttgttatagaagacgcgacgaaagaagtccaccaagaagagaagaccgcccaacctatcttcttgctagcctcctcgaatctcggggacgagattcttgtaaggggggtggatttgtcacgtcctgataaattcatcccaaaattaaaaat

SEQ ID NO: 19864 - DNA, 4351 bp, Oryza sativa
  unsure (1)..(4351): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagtcgatggttatacagctttttgccaattatggataaagactcacaaatagacttcaataatatgttctccatatgttttgttggttatttttatcttgatacgctagttgctattatttttggactacacttgttttgagtgctagattgtaataatgggctgtagctcttttgagcaaagaccgggatattatattccattatctaaaaaaaatgcgagcattatttaagcgttttgattctacctcttacaaacggatgatagttggtgcctcatggtatatggtactagatatcttttcaagaatggtaaaaactctttttaagtttaagttgatatgaaaagccgcccaactgcaatagtaaaaaaaaggttgtcaggacgacatggaataggcctgatcggctgacgatcgacacaggtagttaggtcgttgatttgggcgatcgtgcaacgggcatactcccaccaattaacgaatccatgcacgctcacgcacacgcttttcgatcggccacccccactatacacatatgcgtcgtcgtctgtctgtgcactttatacgcactacggtgcgttgcgattggacgcgccactgatgcacttccactgcagctaccgctctacacacgtactagcaactagggcataggcaacttttgctcttttgttcttttaggtgttggccggccaccatcactattcagctcagcatcttaattggcacgtaggagatgagctagctaagccccctcgctagctttttggggatataaaacaggatggcgacgcttctgtgaagaaaagagcccgagagagaagagagaatcatgcttgcacggtgagaggtgagtcatcattcttcatcggaaggtacgtggaaactagacattgcaatttgcagctttagaccttttcttactcttgtatgcagagctagctgcaaataacacaatgaacatgttgcctcagctggtcggctatctcgtctaatggattagacttttctggctcatgcttttccattgctgtgtctttgcatcactttgagcttgatggaaaggcgatacaaaggataaatcatggcaaagaatacacacaagggtattcagtgttatgaaacatatcttattatggacgaattaaattataagtgggaagcttactgtagaagaaagcttacaccagaagtcagcttacagaggaaggcagcttatggcgcaagccagcttacagaggaagcaagcttataagagaagccagcttacgacgcaagccagaaggtccaaggcatacgacgtaagcctccaccctcctccgcctataaatagggcccagaaggtccaaggcgagaacaacggatctccggtctcctgcttctcctcttgtagcatgtacttaaatccagaagaaataaagcttccactcgttcatactttctgtgttccacaactctgtgtttggtttgcttgtgtgctgatcaatagaatagactggtttctcaacacgttatcagcacgagactctatcgagctaaaaaggtaaacatgtgagaaatcagtttctactgatcatcttgatctttatatgcaaatcattcttctgctatagttgaaataagcataagaacatggtacctaaagtaccatcccccgatatcctctcagcaatacacgataacatgatggcggctctgccgctattatcgttcaattgctagagttgatacatcctctcagcaacgcccggtaacatgatggcggctctgccgccgttaccgtccaaaggcttgagatggtacatccccttagcactatttgataacacaatggcggctctgccgccgttatcatctaaatgctagaggcgatgtaggtgcctgaagcaccggcatggcaacttaatggacggccctgaagtgtcgttatggatgtcctttgttttatggacatcacccatatgggcccttgatgccgctaaggtcggctctgtcgccatgaagcgtgggctcttagtggggaagtactatatggtttatcttacttttatacagtctgcacaatatgcatgaagtgcccatgtatgctcttcattttttttacatgcttactttgctatttgcatgactttcataacattaattttattgttatgaaattgatttcctagcatgattgataatagttaatcaagcaatctgtaatcctgaagattacttaagttaatttgctaggaaagattctatgggaaactgtgtgataatcctgaagattacgcatgaccaattcatgtcgaccctgcacatcgtatttacctgtcgtaaatactaaatgatgttgcagaacatgtcggacatagcaaagaaggaattcgccgagcttgccttggatggtagtaactacctcacttgggcattggacgttgagattaaactcgactccatgggtctcggtcatactattgtgctgcccgaagttggcactgtggagtctacgaaggccgagaaagcaaaggcattgcatttcttgcgccaccatctccacccagacctgaagtttgagtatatgaccgagaaagatccactggtattttggcaattcctgaaggatcgctttgaccagcaagggtcaattgtgctcccaaaggcacaacatgactggatcaccctacgcttccaagactacatgtctgtggcggcgtataattctgccctccataggatcatttctcagttgcgtttatgtggcctgaagatccctgacgctgagatgatcgagaaaaccttatctacctttcatcacaacaatatagtgctacaacagcaatacaggaactcaaagtacccgaagtactctgatcttatcttagtcctgttagttgcagaaaggcagaatgaggttcttctaaagaatcattctgctagacccactgggtctatggcagtgcctgaagcacacgccaatgttgttggaaactcgcgtggccataaaagaggccatggtgagaagaaagggaaacgtaagggaagtatcatattcaagggcaagagtaagggtaaacccagaggtaaaggcgaactcaagaaggttacaggtgaatcatctggggaaaagcaggataactgctatagatgtggaggcagagggcattggtcccgtaactgccatgtccccaagcacctggttgagctctaccaacaaagcatgaatgagaaaaagagccaacatgagtcccacttcaccattgagcctgaagctcagattgaaaagcatgatgacatgcttatcaatgttaaggatggtggggacgtccgtatggacgatgattgggacaaccttcttgaaaaagatgatgacatatttggaggcttgaagtaatctcctatatgtcagtcatatgcagtagaactttggtcatgaataatgctcctgaagagcacgcttagtcttttactgggcctgaagtccttgtaatgtttcccttaatagaatcaacttactccatgtttaatttcatttatgtttatgttccataaacagacttgggtgggaatcccatggcagaagaggatatatgtctagtagacagtgccaccactaatacaatcttaagggaaactagatattccacaccttaactaagaaaactggaaatattattaccattgccggaagtaatactcatatagtaggcaccagaagtgctactctagttctccctatgggtacctatatctttgtaaaggatgctctattgtatcctgattcaaagcgtaccctcttaagctttaaagatatccgtgcaaacggtttccatatagaaaccgagattgagcaagatgctgaatatctgctcataacaaaaatagatggatatcaaaagcatgtggtggaaaggctcctttcatcgccatcgggtttgtactacacgtacataaaacccactgaggaatatgttccgatgaagaccatatttagaaacccagagtcatttatagtttggcatgacaggctgggtcatcctgggttgggtataatgaggagaatcatcaacaattctcctggccacaatgttgaaactaaaaacttccctaatcctgaagattttatttgccctgcttgttcaattgggaagttgat

SEQ ID NO: 19865 - DNA, 3040 bp, Oryza sativa
cccgtttaggtatttcatggtactgattgatgcttctaccaggtggagccatgtggacctattatccacaaggaaccatgcttttccaaagctaattgcccaaatcatcaggctaaaagctagcctccctgatagctgcgtacaattcattcgaatggataatgctggtgagttcaggtcgaaggcttttgataattattatttagccatgggcattaaggtagaatattcagtaccacatgtccgtactcaaaatggcctagctgagtccttgatcaagaggatcaagttgattgcacggccactgttgtaggattgtaggctaccaaccagttgttggggccatgctgtgttgcatgcagcaacactaatctcaactcaggccaactgcatatcatagtatatcccctcttcagctagtgcgtggaaaaaaaccaagtatttcccatctgcgcaatcccaccaccacagcgtacttctatgggacccaccggaagttggggatatacgttggttatgagactttgtccataatcaagtatcttgagcctatgactagggatcttcatacggctcggtacgctgattgtatctttgatgaggactatttcccagcattagggggagaaaagcatccagaaaaatgccaagatataatatggaatgcaactgggatgcagtccttagatccacgcactagtgaagctgaactggaagttcagagaatcataaatttgcaaaatattacaaataagttgccagatgccttcactgattacaagggagtgacaaggtcgcatatacctgcagtaaatgtgccggaaagagtagaggtaacccagaaggatactgactctgctcttacccccccatcctaggaagagggggagacctccgggtgctcgggacaaggttccgcggagacgtcatgtatcggcaagtatcagccgatcatgcattaacccaaacacttgggtaatatttcttcaagtacttgtcatttagtgctcgtccataaacttctccatcgagtccttgcaacatgtaagctcccttggacacaactcgatagatttggaacggtccttcccaattcggcgaccacttgctgaatttgctatcccgaatttacttaacaaactcatcggacacgaaaattgaaccctgatcagttgtaatggtttgaggaataccaaatcgataaattatatgctcttgaacaaattgtatagcatccccagaatcaaccttcttcaaaggaattgcctctacccacttggtaaaataatcggtcgccaccaatacctttactcgatggtggattaatcatgccgatcatatcaatttcccaacctctaaatggcgatggcttaatgataggattcatagccgacgccggtgctctctgaattgctccaaacttcggacaatcctgacatcctttgtaatacttgaaacaatcctctagcattgttggccaaaaataccatgcacgtcgaagtaaccacttcatcttatgagccgattgatgagtaccacaaattccttcatgaacttcgccgccgatagcaccttagcctgatcggcactcaaacacttaagcaacaccccatcaatcgtccgataataaagttcatcatctaataaggtatacttcaacgctttatatcttaatttccgagaagtcgattgggatggattctgtaaatatcgatgcagatcatatctctaatcatcggctgttactgcagctacttcaaccttaacatctttgatcatcggcttataccccgatgccccttgggccaaatcattagcttcaatgttttgttctcgagatagatgcttcaaagtaaccagccgaaatttcttcattagttcttggcacttctcattataaaccattaatgtatcattcttgcattcatattctcctaccaattgactggttaccagcaaagaatcctccatgatttcaatcgcatcggcttcaacttccttaagtaattgtaatcctttaagcactgcctcatactcagcttgattgttagttggataaggtttgatagtataagcaaactggaaacatgcccccctaggggaaattataactaagccgataccacaaccattagtacatactgatccatcaaagaacaaagtccacggcactatctcaactgagccgatcgaatcatcacgatgttctataataaaatcggctatagcttgccctttgactgccttcggtgactcataacgaagatcaaactcagttaaggaaaatatccactttccaacctttcctttcaaaattggagccgataacatgtacgtgaccacatcggccttgcatatgacactgtactcattggacaatagataatgccttaaccttgtatatgaaaaatataagcacaagcacaacttctccacaggagaatatctagtttctgcatccaagagccgacgacttaaatagaatacaactctctctttccattcaagctcctgaatcaagactgagccgattgacttctcactggccgacagatataatataaaaggtattcctttctgtggaggaatcaaaactggaggagaactaagatattccttaatactatccaaagccttatgttgctctgccccccaagtaaactgttgatcggctttcaatcttaacaatggtgtaaaaggctctaacctgccagacaaattagaaataaaccttctatcaaaatttatcttgccgatcatttcttgcaattctgtcttgttcttcggaggctgaatcttctttattgcattaacactcctttgagtcacctcaatccccctctcatgaacaagaaatcccaaaaactggcaaaccgatacaccaaaagcacactttgttgggttcatattcaggccatatttcctggttctctcaaaaaccttcctcaaatcggctatgtggtcttctatctctttagacttaacaaccacatcatcaatgtaaacctcaccaaccagccgattagatcatgatatatat

SEQ ID NO: 19866 - DNA, 1705 bp, Oryza sativa
caagcaacaagctgtaggaacccttcccattgatgacaaagaacgttgtagggatggttttgttgccgactgtcagctccacattcaaaactcctttggtctctgatggattgccaccaaaatccttaagcaccatatttgtcttgatgagatcctgagcgtttctgcccaactttctgaatatagcataaggcatcaaattcactgtagccccaccatcgaccattattttggacatcaacttcccattgacataaccatttatatacaatggcttgagatgccgattctctgtaccctctggcttctcgaagactgcttgttctggtgacaaaatcaatttagccgattcttcttcaacatcatcgacatcggcttgcttgaccccaaactcggtaggcaacatgaaaaccatgttaaccgatgcagttacaacactttttcctttggccaatctctttgcttcatcggtcgtggcttcatcggctgcaggaacctgatttttaacacgccactcctgccttggctttgttttctttaaccgatgactgatttcctgttcaacctcctgaaaacgttcccggttccttaatctctgaacccttctcttctgattttttgtaaaaaataccagaaggacactgtcatgcccagaaattcccgaatagaattccaagcagaatgtgcattaaaatccccatccaggaccggccggggtacacaaacgacaatgttgacattcagatccacgtcttacaaacatcataaaagtcttacataaatgcagcgggaaaacggaagacaacaggagctaagccttgactagaactgcagcgggaacaccactccacaggcatcctcgactacacggacgaagcctactcctcggagaaaccttcatctgacacatactcgtgctctggggttgggaaaaatagagcaagactgagtactacccactgtactcagcaagtcataccggaataggggtatgatgcagggaattatcaaagaagagctagagtggttcatttgcataaagcgagcatttataaacagaagttgaaagatttaaacagttataataattaattaatattaatcatccactgtccaacgctataccacgttgcgacaggcccaaccatccacctaaactatccaaattcaaaagattacactagggtgagactaatcacggtgaatctggttgaccgcccataaccgcgggctcggctattcgaatagttttactctgatcagaggtgtacaactgtacccacaagacacagccccacgacacgtttccgtgcgccgacatgccaccacgacataccggaaagaggccgtgacaggacccttcgtataaccccctctaaccaagcacaccacacctcaggtttcacccccactcctcgcaaggtagcgggcagtcccctctcatgcctaggtgaatccagaagccgcataggccgtcgcagggcccatccaaactccatcacgcccacccttgcctggatgcgtcggctagaggaaagctacactacaagcccagccgttgcccacgctggcttgtggtaagtacgataagttcttccagggcatcccgcgaaccggtccttaactgccatgggtgcgaccagcaaaaccatgcacccacagcccaccatgtgatttattttaattaaccaacaccaaagcggtg

SEQ ID NO: 19867 - DNA, 14798 bp, Oryza sativa
tcggtacaaatttctagcatctttcggcctaagcccaaactgctccttcatcatatcggcccatggtcgttgctgaggtgctccttgaggttgttgtgacatgggctcgaattgattgtattgaggaacaaactggggttgagccgatcctccctgctgatattgaacttgcggtgatggaggctaatactgataattcaaattgcccccctggtaattttgaaaatctggctggatattacgcaccaaatgttcaggaacaacttgagggatcaccgtttgatctggctgtacatgatgaaccaagtgctctgggacaacttaattcgcagcatgctgccctggctgactgccaggtgttgcaaacccagccgatgcattcatcaagccttgctgttgaatcggttgaatgacctgttgccttgatggcgtttgctgaactggttgcaaaatctgccgtcttggtggcgtctgctgaattggttgcacaacttgttggactgcgggtgtttgttgaatcgactgcgcaacctgctgccttggtggtgtttgctgaatcggctgctgctgggttggatcaacagtaggttgaggaggtaagaacttagccgcaacctgatcttgcgttagccgatttacattttgtccactatgctgtggttgttctctcaccagcaaccggggattaactaattggcccggtgccgatgatggtgcagcaggtgaaggagccgataatggtgccgtcggctgagctgatggtgcattcagagaaattggttgaacagctggctgattatcagtgactaacggccgataattggggaacacccctcctggtagataaaccagtcctatagcctgatattcagccattgaaccatcaaccattgtcttcaccatgtttgacaaagtattgaccaatattccagattgattgatcaaagcatggtgcacggcatagtcaacctgatcctgaaagttgttaaactgtaactgcgccatattgccatcctgattagagccaacaccttgatttccttgagaaccatctgcagcacccttatcactcggttgagccacatcacttggagcttgtttcacttctctatccttagaagaaccggtcccagggacatcagcaactacctttacttcatatttctgcacaactgtccccttgcgggtttgcatgaatgagttcaagaataggttacgtgcttgttgcatcattgcttcaagatccttctgctgatcaggtgtcaacttgtccggagtgatattcacgatgttgccttcttcgacttcagatagacctagcttctggatcttagctttaacagagccgggttcaccagccgaagacaacgatgctggcggcttctcatccatgaggaaaactctgacttctaatcagtcccaccgggcatgccaaaagcgtgttgacgtaaaacacgaggcctgggagatctgcttaactccagtgcaggtccaaaactcgccttcgggtatgcaagcgtgccagttgatttgatcctgcaatcaacaagaacaaagacaaagaaaccgcggttaaattcataaatgacagccgatcgacccttggccgatgacatatcatttatttttgagccgatgtcatatatgtatcgatcgacagtcatgagtaaacaagaaggaaccaaatctactcgattggctgtagatattaacaatatatactccttatatcgatatatacttaaatcaagtgattgggatagatcggtcgccatgccgagacagtataaatcacttagatcgaaatatatattaataatgggactatataggttcatagcatagccaatcaggtagatttagcatgtatcggctaatactccgataccactctatattaagatattaaagcaagcagaatatatcaaacgaaagcctaatatatttaaatgctataagatcttagcataaagggcagatttaacatatcaacgaagcatataaaacaagtattgtagttcaatcaggtaagatcggctgaaaccctgatactaccctaatcggctaccaagaagcaggctagagattgagattctaatcatgactcataagatcaaactcaactgatacagctataagtatgaaaagaaggacaatattgtcacatcctgattttcgtttcaggatttataaattatttaataaattattattagaatttatattaaatgtttattaatttacaagtgaagttaaatgtgggaaataaaatttcctaaatataaagaatggatggatttaatttttattaaattctccatggttaattatactctctggaattttctcggatttttcggagctcaactcttaattttaatcatacaaagagcagttcagcaattatttaaatattaaattaatcatttaatgatctgattttaattttgttaaatactttgagtgtccaagtattttcaggatttttcttgaaattatttgagcattggaagtatttttaacaattcaaagctcatctcattgattaatttattaaattggaagtcctttgttgctcccttccggcccagcccaaaaagtctagttggcctccctactgctacagtgtcgtcttccagctccagacagagccgagccaacctgtgcagtcgcctcctcctccatcaaatccggtgcatccgttgcttcccttccaaaattgattgcaaaaacggattcctctctatctcctccacctaatcccgaagaaacccccatcaaattcgttatctatctcacgaattttggccgtttttattcgggtgaactcgggataagcccgactcttctttcaccaaatccatccgttcctgagccgatctcctccacccatgccgatataaagcatcccctagtcgtcctcttccgtttaccccaagtcccaagccgagccgtcgcccgtagagttgccgccgcgttgttttagccgccgccgtcgccggcgatcctccggtcgcgtcgcgctgccgctagtatcgtcgccgctgccgtccgtcgtcacagtcgggttcgtgaggaggagaggaatcccgtccgccccttcgcagccgccgaagaccgccggagcgtcgccgtcggggacccgagtcgagccgccgttgaacctcgtcgccggccgtcgttcgtcgtcgtccttcgttgttctttgcaccggtgagttcgcgtcgtcgtcctctacgcgtaggtgtcctcggatagcccaaccgagccctcttttgccggtggtcgtgtcaaccgtgccatggccggcgatgatgatgtcagcgatgacgtcataaatccctttttctaggttttctttattagatgaaaatcgattaaacttcggaacttcataactaaatcgtcgtaactcggattcgactggttctagttgctaaatttttctaaaatcaagatctacatgttaaaaatatccacatatactgtttatgcttgtttttgtactgtttatttggtttttattagtctttttcttcgttttgcgtgctagctttgtcgtttccgtcgttgcgaaggttcgtgagtgcgtcggaagtgttcaagaagattaattgaagatcgattattgcaaggcaagtcacacagatcctaaacacaatcctttgagcatgttgatcctatatttaaattctctatttatttcaactgtacatttattttcgaatgtcaccgggtggtgtgaacctattcctttgttatggccaatttgcattgaatgccctattccttgataccttgggtaataaattgattagcttgaaccttatgtattggtttggttcagctaaatgttatatatataattgcttagccatgcttagaaacattagctcactaatgggatgaatcatatatactacattattatttatggttatatttaatggtagctcacgatggttaatcgtgttatgataattaattggtaattaaaatataattaatggtgggttgtcagcacatggttttgaaggtcgtgcttatggcaattaaggaccggttcgcgagctactgttgtgagacattaaccgtgccaaccacaagccagcgtgggcaacggctttaccttttgtatagcatgattcattacggggcaccagactgagaagcggtgagaagtccgtggggatcgctagggagtccatgcctctggttatatttatagaggggttgattatgattcaagaatggtgcactgtggtgagttgtgttgtgcgaagggtattgtcatgatttccccctttgcagtgccgtggtggtacttcgaggcatggcaacatgtgtggaatcgtgtcttgtgggtatagtggtatacctctggccagagtaaaactattcgaatagccgtgcccgcggtcatgggcgggttgagcaatgtttttcgtgattagtcccacactactcattaatgataataatgtgataataaatttgactcctggtttggaatggtaaattcctggtttggaggtttgatctgtacgaccggggttggttgttcaggtttggttgggcctgagcagcatgggtgtgctgttcagtgttgattaaaatttctgattaattactctactgtttcactactcttaaatctttactaaatgctgctttcgcaaatgagactatattatgccatcctttggtatccttgtgcacttgcatatttgctgtgtggcttgttgagtatgtcatatgctcattcttgcaataatcaatcaacctcagttgaagaaaaaggatccagaaggagaagacgtttggcttataccccagttgagctgcttgtgggagtggagctgaagccatcgctagaccgttattccgctgctgttttcttttcttttgtatgtatgtaacgttattattatgatggatttgtatattaaattatcagtttgtgtacctcggctgattcctagacgaggattttatgcacaaataagtttgaaattactagtgaatttccgggcgtgacaaatatctagacaatcaagccattagaagtttcatagagtggtagatatcctatataatccaagccaacgtcactatttaacctaatcggctgccttctaccgatagatgttagccgattgtaggccagataacgatattgccagagattatgcaggatatatgataactcgatgaattacataaacaagattagagtgtcgtaaagatggaagcactaatcccgagaacgcaagccgtcataacaagttttacctcttgttaaagatcgaaaccgatacagctcaacccgaaagcaagaactcgtcgaaacaaaacgaaagtaaaaagggtggcgatgcgccgagattgtattgaacatgtgtgttcattgattacatggggttcagggtctatttatacccgagaattacaaactatgtccttatcggatacgactcttatctctaacaaactctaagataccataagtctttgcggcagacttttgcccaaatatatctctaaggaaattacataaaatatcctaattgatagatacaattgccttctcaggactctatctgtggagattatggataccccatacctacacggcatgtatatccgactgggtatggggtgccatgtatagatagaatatctttaaagggactcgggttaaattccaaacttttatgtcaaggaaatacccgggatcctagtcggttacgattgtatcttatctgtaactacctattccgttaggagtatgggctgtactttgtaatacggaccccttctcctatataaggaggggtccgggtgtctcttggggcacgatttttctcctagatcactcgacggatcaatccctggacaggagtagggtattacttcttattaagaaggcctgaacctgtataaaattttttgtctttaaacccatccacttttccagcttgatagccacccccttttagtattgccgaaatcttgtttcgacagttggcgcgccaggtagggtagtgtcaagttcttcgccgactagtgcgatgggtttcgtctccggcatcgacgacttcgtcttccctcccgggcaggcgttccggtttggcagcctcgacttcatcaccaacgacttcggcaagatttctctcctcgactcggatccgaaccagtcggggggaggccaggtctccgccccgttcggtatcccgaactcggccgagatctactccaagatcatctcaaccgagtcggcttcaaaccagtcggacgagatccaatctacttcaacacgacctgatcaagacaatggggcctatccctcaatcctgatgagtctccccgacgacttggccacagtcttcaccacaagggcgtcttcttcccgtaggcctaggccagatccagcctcggcttcgatccagcctagctccagggaagtcggcgtcatactccaacgtctcgggacggtttcgacggaagaattgtatggcttcctcagctcccccggtgtcgattctcgaccaacggagattgtagagtacgactacttcgactaccactacgactaccgcaacctcgacaacttcgacgaaggccacgaagataactacgcgcctctcttcttcggcgttttcatggccgacaatgacacggaagaacagcgtcaagcccgagaagcagaagaacagcatgtgcgacaagaagccgaacgtcgccgactggaggaggagcgtcaagcacaagagcgagaacggctacagcgtgagcaacaagagcacgaacgggctacgaaggaggctgaggaccggcgacagcgcgccttggaggccgggcgacgagcacgagaacttattgggcaacaagacgtcgaagggacggcggtttttcgcaccccccagcagaacgcggttgcagcgatcacccttctcgacactctccttaaggaagatgcactcaatcaggccaatcacgtcgtcaacatcttaaatcagatcaagaccatgatcgtcgcttcagtcccggtgaactctgcaagtgtccgtacgccgactggcagccgagttccgcctcttcgatctcaagactatcaccaaccaagcctcagcgtcgtcggcgccggatctagccgcaggagtagggatcatggcgaacgatatgtccactcgcctcctgaccgacacagggagcgtcgagccgaacagcctcgctccccacgtcgcagtcgtcccgtcgatctttgcgaaactatcaaccagcgccgcacggcaagaggctacatcccccaccattcactggatcattacgatgacgatgtggatggagatgctgccttcacaagtgacctgcgtcgagtggattggccgaccggcttcaaaccgactggaatcgagaagtatgatggcacgacaaatcctgagtcttagctcactgtctataggctcgcgatccgcacaacaggaggagacagcaaagccatggcaaattatctgcctgtggccctagcagactctgctcggtcctggcttcatgggctatcccgtggcacaatcggatcttgggcggagcttcgcgaccacttcatcgccaacttccagggcacttttgaacgccctggtactcagttaaatctttacaacgttgtccagaagtctggagaatccctctgagattacatccgacgtttttccgagcaacataacaagatctctgatatcaccgacgacgtcatcattgccgccttcaccaagggcattcgtcatgaactcttagtcggcaagcctcccaggactgtcaagcagatgtttgaaaaggccaatgagtacgcaaaagctgaagacgtcgtcaccgcatccaagcagtcaggcaccacctggaagccaaagaaagatacgccgacgacaagggggagtggaagtaccaattacaaagatcgcaagcgtaagcccgaagaacttgtggcaactactacaccatcctcccgacagcgttcgcgcgtcaacactttcgacaagatcatgcactcccaatgcccacatcatccgaattcaaatcacgcggccaaggattgcttcgtctacaaatagttcgcagagcaatacgccaagaactcaagcaaaccgactgacggagttcaaagcacgtcgaagaagaaggatgatgaagatgatgcccctactggtttccaagactcacgcaaggaactcaaccatatctttggcggacccctggcttatgaatgtaagcgaaagcaaaagctaaccgagcgggagatcaacgccgttcagcccgatacgccacaatatcttcggtggtcagagacagctatcaagtttgaccgcttagatcatcctgactgagtggtccacccggggcggtaccccatggtactagacctagtggttcgtaacgtcaagctccgacgatccctcatcgatggtggcagcgcactcaatatcctttttgccaagactctggacgacatgcagatccctcgcacagaactgaagccgagtaatgcgccctttcacggagtcatccccgggctatcttctactccacttgaccagatcactttgccggttactttcggcacttgggagaactttcgcacaaagaacatttgcttcgaagttgttgattttgagacagcgtaccatgctatactcgaacgcccggtgttagccaagttcttggccgtcccgcactatacctacatgatgatgaagatgccaggacttgccacaaggaaagctgcgagatggcccagacccgcgagattacgctcgctcgagaggaaatccgactggctgcatccacagcaaccgaaggagaagtgcctgcaaccaagatgccaaagaacggagagggcgatgccaagactaagaaaattcctctagatccctctgatcccactaaaactgttgtaataggcgccgagttagattgtaaataggaaagcgcgctcatcacctttcttcaaaataataaagatatctttccgtggaaaccatctgatatgcctggtattcctagagaggtgattgagcactctttacatgttaaggaagacgctaaacccataaagcaacgactccgctgcttcgcacaggataggaaggatgcgatcaaggaggaactgaccaagctgttagcaacaggcttcatcaaagaagtcctacatcccgactggctggccaatctggtcctggttctgaagaagacgggacaatggcgtatgtgtgttgattacaccgacctcaacaaatcttgtcccaaagatcccttcgggttacctcgcattgaccaggtagttgactcaacggccggctgcgagctactcagctttttggattgctactcaggatatcatcagatccatttaaaggagtccaactacttgaagacttcattcatcacgcccttcggggcctactgctacatcaccatgccttttggattaaagaacgcaggagcaacttatcaacgcatgatccagagatgcttttcaactcagattggtcgtaacgttgaagcttatgttgatgatgtagtcgtcaagaccaagcagagggatgatttgatcgcggatctagaagaaacctttgcgagcatctgcttcttcaagatgaaattaaaccctaaaaagtgcatcttcggagtaacgtcagggaagttgcttggctttatggcgtcccataggggcatacaggccaactcggagaaaatcaacgccatcctcaacatgaaaccgccgagttcccagaatgacgttcaaaagttaactggatgcatggtggcactcagctggttcgtttcacgactcggagagtgggggatgctctttttcaagttgccaaagaaagctgacaatttccagtggggacccgaatcacaaaaagcctttgaagacttcaagaaacttctcactactccaccagtcttatcttcaccgcatccacaagagccgctgttgttatatgtgtcgacaacatctcaggttgtgagcatggtcctggttgtcgagcgtgaagatgatggccatgtttaaaaagtccaacaaccaatttacttcgtcagcgaggttttggtcgactccaagacaagatatcctcaggtgcaaaaattgttatgtggtgttttaattaccgttaggaaattatctcactattttcaaggtcactcggtcacggtggtcacgtcgttttccactcggggacatacttcataatcgagaggcaaatggacggattgcaaagtgggccttagagttgatgtctttggatctatctttcaaaccacgaactttgatcaagttccaaaccttagcagacttcgtcgccgagtggaccgagttccaagaagacatgccgatagaaaagatggagtattggaccatgcattttgacgagtcaaagaggcttttaggcaccggagcaggtgttgtcctgatttccccgactggagaaaggctgagttacgtattgtggatatatttttctgcgtcccataacatggcggaatatgaggtgcttcatcacggattaaggatcgcgatatctttgggaattcagcatctaatagttcgtggagattctcagttggttgttaatcaagtcatgaaagagtggtcctgccttgactgcttatcggcaggaggtacgcaagttagaagataagttcgatggccttgagctaacccatgtttttcgacataacaataaggcagctgacagattggccaatttcagttcaaaacgagaagcacctccttccgatgtgtttgttgaacatctttatgaaccaaccgtaccaagcaaagaaacaaccgaggctacggacactcaagaagtaatcatgatcgaatccgactggagagagcccctcatcaaatttttgaccaagcaagagctccctcaagataaagacaaagccgagcggatctccaggtgcagcaaactttacgtcatacatgagatcgagctgtacaagaaaagtccatcagggattttgcaacgctgtgtgtctttggaggaaggaaggcaattgttaagagatatacattcaggcatctgcggcaatcatgctgccgcacggactattgttggtaaggcctaacgacagggtttttctggcctaccgctgtatccgatgctgacaaaattgttcgaacgtgtgagggttgttagttttttgcccgacagactcatttaccagctcaggagttgcaaaccatcccgttatcttggccgttcgcggtttgggggctcgacattgttggcccattcaaaaaggctaccggtggttacagtcatctctttgtagcttttgacaaattctccaagtggattgaagccaaaccagtcatcacaattacaacagacaagtctagagattttttcatcaacatcgtgcatcggtttggagtacctaatcggatcatcactgataatggcactcagttcactggcggagtatttaaagatttctgtgaagacttcggcatcaaaatttgttatgcctccgtagcgcatcccatgagcaatggacaagtcgaacgtgccaatggtatggtacttcaaggaattaaagcacgagttttcgaccaactgcatccgtacgctggcaaatgggtagatcagctgccgtctgtactttggtctctgtgcactacacccagtcgggctacgggccagtcaccgttctttctagtctatggtacggaagcaatgttgccaagtgaggtagaattcgaatctttacgatttcgtaacttcaaagaggagcgctagggagaagaccgagtggatgatctcaaccgactggaggaagcccgtgaagcagccttaattcagtcggctcggtatttacaagggatgcgatgttatcacaccgcaatgttcgatcgcgggctttctcagttgaagacctggttttaaggaaaattcaaactacacgagatcggcacaagttatctcccttatgggaaggaccgttcataatttttgaagttactcggccaggttcttacagactcaagcgtgaagacgatactcatgttgacaactcttggaatattgagtatcttcgtcgtttttatgcttaggcattacttttgtatcttcctctttgactgctaacatcaagttgttccttgagttaccagtcgggggctactataataataatggagtgtgattattatcaattcaattttcttacttgatttatcattgccttgtttgatcttttggcttagtcaatgaggactgaaagtttttaacaacttttgcgagttctaggctcaataaggtttgacgaaaacttttaagaaatcaggagctgagtttaaattatcaagcacagcataaattcatcagtattgtacaaattgtgcctccatcatcataagttaatactatacaatgtaaatcagactcagttttttcatcatcagaattaccagacccagtcggcccgagattgttgtcctgaaacctctcaactacatcagcagtaatcttgtctgcagccttttgtgcatcattgatgagatcaagggcatgttcttcacttgtcccatctgcaaagtcgtcgacagcatcaatatcgatcttcgggtacaaggacttggtcattgccaatgccaggctagcccccatgcatcccgcttccttgatgttcttaaaatatgtatctggagcagctcttagcttgtcgaagatttcaacagcatcaaaagaactcggaccattattattgaaaaacatggcttggatgagtggtgtggcggcgttggcaacttcatctccggctccttcaagcttcttaattttgttgaccaagacgtcgaattgagcttgagatttgattttgcgatctgcgcaaatggttcacatcaacgactatgcaagaagacaagaatggtttgaagtttcagcaacaagtacattcgacatctttcagagccgagtccctttgtttggtcaattcgcccttgtctttttctagagctttgattcgcttttctagctcggatatcttggtagcttgcactgtattattttccattgatcaattacatatggatagcggctttgagtaagataggcaggactgaaggttggcgttggtacctttttagggagggctgcttgcttgagcctctgcttccgggatgtcttcatttcgttctgtacccgactgatttctagtcgggggctcctgatcagtactgacttcagcttcggccgactggtttccagtcgaggttcattgctggcctgtacattgtcggttgctggttgattactactcaggcgatctttggcagtcggcccggtttctgtcgtaggactagtctccgcgccagttggttcagagtcttttccagaaggatcgatgtcataaggcttcctgcaaatttgagatatgctattaacaatacttcaatagtgaatgattagcgatacaagagaaaatgctaagtgacatgtacctggatgacttcctgattttcggtatgggacgactggatgttttcttcttcgggttagcttgtcttggctgttttccagtcacccctttgctgccagccttttcaacatcgtcaccctcatcgtcactcagaactaatttcctcttacgagagtctgactggttagtcggcttcgaggtgtttggttgagcatcggaccggatttttggccttccactagcctgaccagcctgccgacagggtgagcggtgttgagcgatcggaggatcagacttcatcaaggaaaattcctatgcatgatattccaagttttcaatcaaccttgcagaagacaaaaggatgtttttcagagaggccgagatgttagatacaaaccggtggaggagtgcttgggcagcctcatctccaattggaagcaagttccaggtgtcttgatatactggaggaagacaggtgtactcaggaagcgctggttcaggattctgcacataaaaccaatttgcatgccaacccttgttcgaggttttagagggcatggagaaatatttctggctcaaggttccccttagttgaaaaccggctcccccaacaatgcatggcttgctcttgtttggctggggcttgaggaagaagatgtggcggaatagggcaaaatgcggtctaatacctaggaaagcctcgcaagcatggatgaaattggcaatatggactatggaattggggtttaggtgatgcaaactaatcccgtaaaactccagaatcccccggaagaatcttgaggttggaagagaaaagcccccatagaagaaatgagagaacaccacgacctcatgtgtgtcaggggtcggaaatgcttcgccgcatgccggacgccacccgatgatctccttcgccggaagaacaccatgcgccaccatctccttcaaatcttcctccgtaacatcggagggcgcccactgactttcgaagctctctctctcctctgccatggatgcaagtgggatgatgcgatttgatttggaagtggcgaggaatggatgggaggttgatgcggtggttgcacggaagattttgtggaagctgtgaagttctagagagatggattggagtggatttgtgagccctagctttcgctggtgtggttttgcattgtagctgagggtggggaaagtggcgaaggttttggcggggaagacaaatcaactcgacatgatgtcgtacaccaagtcgtattgtcggaatcggctgtatcacctaacccagtctgactcggact

SEQ ID NO: 19868 - DNA, 12585 bp, Oryza sativa
cctcgtcttagattccgtttcgatctaatcttcttttccaatgctgatattaccaaatttggttgttaacaaaaggcgagcaagtgccaccctcactgatcaatctagctcgcccaagaatccaccaaagtattcaacgagatcatcccaccggcaacattttaggagacatcaacaagggagtatccactcattctcgtattgcaaatttttgtgagcattactcgtttgtgtcttctcttgaacctttaagggtggaagaatcttttaatgatccggattgggtgatggcgatgcaagaggagctgaacaatttcacccggaatgaagtgtggactttggtggagcgacctcggcaaaacgtgattggcatgaagtggatcttccgcaacaagcaagacgaggccggggtcgtaataaggaacaaggcaaggttagtggcgcaagggttcacccaaatcgaaggattagatttcggtgaaacttttgcaccggtagctagacttgagttgattcgcatattgcttgcttttgctagtaacctcaattttaagctatatcaaatggatgtcaaaagcgccttcctcaacgggcctatcaacgagttggtatacgtggagcaaccaccgggcttcgaggatccgaactatcccaaccacgtgtacaagctccacaaggcactctacgggcttaagcaagcccctagagcttggtatgagtgtcttcacaattttcttgtgaaaaacggctttgagatcgggaaagccgattcaactctttttactaaaagagacatgataatgatacttttgtctaccaaacatatgtcgataacattatatttggttctactaacaagtcttttagtgaagagtttagtaggatgatgaccaaacgatttgagatgtccatgatgggtgaattgaagttcttcctcgaccttcaaatcaagcaactcaaggaaggaaccttcatttgccaaacaaagtatttgaaggacatgctcaagaagtttgggatggaaaatgccaagccaatccacactcccatgccatcaaatggccacctcgacctcaacgagcaaggtaaagacgtcgaccaaaaggtataccgttccatcattggctcacttctttacctttgtgcatctaggcccgatattatgcttagtgtgtgcatgtgtgcaagatttcaagccgctccgaaggagtgtcaccttgtggccgtgaagagaattcttagatatttagtgcacacacctaaccatggtctttggtatcctaagggagcgaggcttgatctcattggctataccgatgcggattatgccgggtgcaaagtggatagtaaaagcatatcgggtacttgccaattcttgggtaggtctgttgtttcttggtcttccaagaagcaaaactctgtcgccctatccaccacggaagcggaatatgtttcggcgggggagttgttgtgctcaacttctttgggtgaagcaaaccttgagagactatggcctcaatgtatccaaaatcccactcctatgtgacaatgagagcgccattaagatagccaacaaccccgtccaacactcccgaaccaaacatatcgatattcgccaccatttcttgagagatcattccacaagaggcgacatagatatccaacatgtgagaaccgataaacaattggcggatatcttcaccaagcctctagatgaagctaggttttgtgagttgagaagtgaactaaatatcttggattctcggaatgtggcttgatctattgcatgcatgtttgcttggtagaataggtttgcatactactttgtgacaaaatggtcattcaactcatggatggacactagtcacttttgtggagaacttgaatctatgtgtattgggatctcatttttcaacaaattttggtcgtagcacaacttgaaatagattcacacattccctctctcgagggtgaattatcttgtctcatggtaattccctctcttttgatccctcggattgtccatttgacttgtggctattgttttgtgtgattgattgtgtgctagtcacaagttcaaatggaccctctagagctcgaccatccctcctttcctaatcctatcaaaaatctttgtgaaatgtgtttttgaaaaaaatttcccggtgcttgtcccctacaaaattcctttcaaatgtttgcaaaatagtttcatcaaaattcccggcgaaatccccttgcaaaactgtgttttccaggaattttcggactttccgaaaaattttcggaccttccgaaaatttcccatcctgtcgctcttctattcatgctattccaggatttttcggactttccgaaaaattttcggatatatccgaaaatcatcaaaaccgtgtgcttcccctctagatccgttcggacttatccgaaaattttcggaaatgtccgaaaatttcggggctcatatattttgacccgtggactcctctctctctctctcttcctcactttttcccaacgggtttgactccctcctccactccgcaccggcgaccccattctccggcgacctcccgcggctcccctcctctccaacattgtgggagcgcgtttggggcacttattgggacttgcgttgtcgatcatcaccgcgttcttcaagtgttcttcgtgttcttgaggtatccgccctaaaatcaaatcctttgattcctcaagttttatcttgtgattccctttggtggagatgttcccctagtgccctaggacctgcagattcattttcccaagtttttgttggcggatttgtgctgcatccggatgataaggttcggccggatttttccggaaaatccgaaaattgtttccggatatatccgaaaattcctggccgacccctatcacctcggttttgcacgattcttgccttcacttacttggtccttgcttctttggcttccattcactgattcattgtctatatcttgtttgaaggatgcctccacgcaagcaaacctcccacaagtccaagcaccaaagggaccgctctcccaccccatcctctcatgatgatttggacagtgattggtccgggagagaggatgcggttcctcaggttgcgcgtgtggcttgggccgacactctccctcctcggcggtccactcaagctcttggtggtggtggtgatggtgagggctcctctcatcaaccgcaaacaccaccgcaccaacccaatgtccccacaggtccttttcgcattcatacacccaagagggatccggcggtgattcgccaagtgtatgattggaagcggaagactgaggttgttgctcctcgccgggatgaggatccgcgcccccttcgccgcaccgccacggattcgcggttttggactctctttcaacaagactttgatgagtctgtgatcaagtccaaagctcatcccaccgttcccatgcaatggatcaactaggaggagctgcaggcgcatgatgatccggtgctaaactttgtgattgcaaattgtgagctcatgggaattcgctctttcgtgactttgcagcagaattggtgcagcgaagtcatcgctcaattatatgccaccgttttctttgatccttattgtgccatgcattggatgacccaaggctcttactattatgtctcctgtccgcgatttgttgagatttggggttttgacgtctgttccttgctaaaccttcctgatatgcatgatcttcccattcctgccaacactaatctcctccctctttacactccaaatgatcctaatgtggtgttgggtaaagtcgacggtctcaaaccgtactttgcctgcttgaaccggatgttttgccggtcctttgtgcctaaggatggtgatgccagcagcattaaccacctctccaggaccgtacttctcaggttcaatcccctcctcatcgctttcatgttttgcactttgtgtgggaggagatccgcatggcctccattcagtacaagaaggggttggtctatgctcctcacattatgcggatgatcgagactgtcactcagcttcagtttcatcatgatgtgactcattcccagcttcaacttgcgccttgttaaggcagtaaccccgacaaataaattcttcaaacacccgaacggaaatattattgaaggatttgggattgtacaagatgtacctgtctgctttgaagacaaggaggcagtcttggatttccacgtctttgtgaaagtgcgactaggcccctagtgattttggtgattaattacaatgcgattagagaggattaaaatttttattcacgtaaatgtgaaggttgttatgtcctcaatgagttaaagtaatgcatttcccacccaatgcattgacatgatgtgatgcggcaaatgagcaaatgctatattgtaccttttcttttccttgagttaataggaaagccgcactattaagagggatgatgcattgacatacgaggagtgatcaaagtgctcaaaatcaatttttaaaagtgtttctccttagtttggtgtgttctggaatttttttggagttttccgaaattcattttcggactttccgaaaatacacagagccagtttttcgcttctggaaattttcggatatgtccaaaaggcattttcggactttccgaaaatgactgagaaggcaaatatggttctgcatattttcagacttgtccaaaactgattttcggattttttgaaaaacatcaatagagtcttttcgcttctgtaaattgtcggagttttccgaaaggaattttcggacttttcgaaaatgtccagaagggtgtttttggttctggaaatattcggacttgtccgaaaagttttcggaatgtccgaaatatcttcagttaactttactgtcggtgccgagctggaattttcggacatgtctgaaagagaattttcggacatgtccaaaaatctttcggaatatctgaaaatcacaattattgtgcataacgggcataatttaggctgtggctataaatagccccctcccctcacttgtgagggctgctggtcacattggagattcttgtgctcttggcttgctcttgttgagattcacttttgagccttgcttttcttgtttcccctctcacccgtgttcgattcggatttggtgtgtgtgagagttgtggattcgagtttgtgtgagtgcttgttgttgacttcgtgaagatttgtgagcacttgcatcatctccaggagttcattgcttcatttgttactcttggaggctgaggactcctaggcggctaggtgtcgctcccgagccaccgatctacttgtgattggccgggagaagtttgtgatggtcagatctcacctccgaaagggaagagatacccttagtggaaggaggagtgcttagtgcaacctcttgaggaaagggttagctaagacccaactcttagtgagctcctcaacagagagtagaatccccttaaggatttgaacttcgggaacaacatcgtgagcttcatatttggtgactttacttcctccctctccactagctttgcttgtttgaaccgctataggtctagttgctgtttgtgctagcatattcttgttataggcaactagatctaggatttactttgagtttgtgctgactccgaaaattactgcttccgcttttaattgaatttttgaattagcctattcacccgcctctatgcctaattgatactttcactttgaaatctaagattttgacattctaatcgggcttcccatttgagaaactcctaataaacatgccctgattagatagcctcaagataactttgggaggaaacgaattctcagttgcattctcgcgggcatggttcgccttgaccggctctctcctagagattgagtctgcggaggaggttagagcagttccccctcacgagtctcccgaggcccttctggaaaatgaagtccctgacttcatcaaggaagaagcggaacctagtgagactctcgaacttccaatcatggaactgccacctcgacctccgtttgagcttaaacctctacctgaaggcctacgctatgctttcttgcacaatgacagagaagcccctatcataatcagtgacaagctttctgaagacgagactcaacgtcttctgtctatgttagaaaagcatcgtgttgttcttggctattcccttcaagacctcagagggattaatcctgcactttgcactcatcgtatccctattgaccttgagagtactccctccagggaacctcaacaacgactcaataatgcgatacgagaggttgtaaagaaagaggtcctgaaactcctgcatgccgggattatttaccccataccatacagtgagtgggttagcccagtccaggttgtgccaaagaagggaggaatgatggtcgttgcaaatgctcaaaatgaacttattctgcaacgaaccataactggatggaggatgtgcatagaacaaggctacgaaaaaggatcattttccgctacccttctttgatgaaatgttggaacggctggcaaatcattcctttttctgtttccttgatgggtattgcaggtatcatcaaattcccatccatacggaggaccaaagtaagactacgttcatatgtccgtacgacacatatgcttatcgtaggatgtctttcggactgtgcaacgctcttgcatcttttcaaacgtgcatgatgtctattttctcgaatatgatcgaggacattatggaagtcttcatggatgacttctctatctatggaaggaccttcggtcattgtctgcaaacgctcgacctctgaccaacctgttagccaaagatggtcccattgagttcgatgacgcgtgcctaaaatactttgaaattctcaaaaaggcactcatctctgctccaatcattcaacctcctgattggactctgcccttcgagattatgtgtgatacaagcgatttcactgttggcgcggtcttgggccaaaccaaagacaaaaaacatcatgcaatctgctatgctagcaaaactttaaccagagctcagttgaattatgcaactaccgagaaagagctgctcgcgattgtttttgctatcgataagtttagatcttacttgatgggacgtaagtgataatttacactgatcatgctgctctaaaatacttgctcactaagaaggatgctaaaccacgcctcttaagatggattttgctgctccaagaatttgacttagaaattaaggataaaaagggagtagaaaattctgtagcagatcatttttctaggctgcaaatcactgacatgcaggaataactgataaatgatttcttgagagacgacatgctgatgacggtacgtgactccaacccgtggatggaaacatagtgaactacatggtatcaaaatacataccaccgggagaaaatcaaaggaagttgaaatacgatagccgccgtaacatatgggatgagccatacctatatagggtctgctccgttggtttactaagaagatgtgtgccgactgaacagggacttaagattatagaacgatgccatgcctcaccttatggtggccattatggcgcattccgcacccaagccaagatttggcaatgcggtttcttctggccaacgatgtatgaagattcaaaagaattcgtcagaagatgtccaagttgtcagaggcaaggaggaatcactgctcgtgatgcaatgcccctcacatacaacctgcaagtcgagatattcgatgtttggggtattgacctttttctaagtcatgtaactgcgagttgcaagtttattctggtggcagtcgactatgtctccaagtgggttgaggctatgttgtgcagcgctgcggatgcgaagcataccaagaagatgttgatagagatcatcttcccaaggtttggtaccccaaggatggtcataagtgacggaggttcgcacttcattgacaaaaccttttgagacctcctacgagacatgggagtgaagcacaacgtggccacaccttaccatccacagaccagcagtcaagcagaaacgtcaaataaacaaatcacgaatattgtgcaaaagacggtcaacaaaatgggaacaggataaaaggagaaattgccagactcattgtgggcataccggacagcatacaagacacccattggaatttctccctatcagattgtctacgggaagtcatgccaactccctgtagaacttgaggacagagcatattaggccatcaggaactggaatatggactttgaaggagtaggagaatggaggatgatgcaaattgctgaacttgaagaatggagagagaaggcatatcacaacactaagatatacaaagagaggatgaagcgctggcatgataagaggataaaaatcaagaaattcaagcaatgagacaaactgctgatgttcaactcgagggttaagcttttcggccacggaaaattgcgcagtaaatgggaaggaccgttcgacgttatcgacacctcttcgcacggggcaatcacactctgcgacgactcaaataacatatttaaggtaaacagttaacgtttaaaaatttttcatgagcctaatgaatctttagatgaagaagtggatattattgaattaatcgattatgaaccataatgatctcatctaaagcatgcttaatttcctgtaaaattgtcatttctgagcttagaataagtttgcttgagcgtgtgaaaattttggtagccagctgagcccactagggttcggccgaacccctggttccattctccttcaaagtccatattccattctcctgctcccaccagggtagcacccatcggccccaagtttgaatagcttcctctccgcgctcgttcgagtttgtctagatgcgcattcggaggtagaacttttggatcagcaccataagacccttcttcctcctctcctccatctctgcaactcttctctccatcctagctcacttccttgatttacaccctcaactcaccaatggctggcaaatccctgatgccatacattggctcctcctcaaactccacctacaaccttgaaggagaaacaccggcgaatcaagtcatcccagtggaaaactacacaatggaagggggcattcaccccttgctacggtgcccagctccccagcaaatatggagccggccggcaaactcactggttcggccaaaccaggggttcggtcgaacccgtctcggccccgttcggctccccgttcggcagcacgatccctctcccctcgtcatgtcaccaagaccaaaatccgggggtattagcctgcacgacgaacaacgacgggtgaactcagcctattaaagcgagacgtcttttccaagacgatgacaaggccactccgcctcctgctgagcggtatgtgggcaccctctacaccaaggcaggggatgaggagctccacaactacatcacacccaccgccactccatccacccccaaggaggattggttttgcattcggagagtgcgaactcccggcggtaggtatggtaaaggcttgctccggccgttgacggcatcggagaaggaggggcagcggaatcccgttgccctccacctatgacggtgaagcgtcatttgacgccccctccaattgtaagggcgcttggccaatttcaagaggaagaagtgaagtcgccggaaccctcggtccataagctagcggcacaagtgaagaagctccgcaaggagaacattgagcttagggaccgtaacgcagaactaggggtagagcttgctgagcttaggaataattttgatactcttagtcgcggttcatgcgctagatcaagcgtgcattcgtagagatggggaaggagaataagtatgatgctaattaaatgtctcctttctcatgaataaatgtaattggtgcttggtcatttattttccaatcatgtaagcacttgctataaataatgtgactcattggtgttaaccccaatgtttgccaagatttgtttttgttttgtttaataaagatcaggttttgaataagtgtgggggagatatcctagcttctgacgtgcacatactctgaaatttgctgaatatctaaacacctgaggtacactgaactctgcagggaattgcagaggaattgggtaccaaggtggttgggctgaacccaaccagtgctagtcccaatccctctcaattttcctaggtaagcaggtgagcacgtctattatctgtatatctccaccatggtatagtactagagctgtgaattcagaaattaattagttcaagcataattaaaaagataaaatttccaactaatgaaattcttcctatgattaatcttgtatatttattattcttagctgaacttgtacttgtgaacgaacatccatgtttagggaacgttatgcatcaaagtaattgttatatgtgagatggttaaagatgaaggaagttcttcaactgttgtcattacttatgggaatttgtttttcaaaataaaattttgttttaaagagctcattcctccaattgactttattttatacctaccaaggccatatgcaagtatatcaatgataaactttattatgcatatgactgcttgacattatattgagctttgtcaaatctatgtgactcatgttagatatcttttatactctcatgatcaaggggtcatttccatatatataattaagctaagcttctacactggaagttggcttcccacaaaaattccattaaaatatacacctattttaaactatgttttcttctcctagaaaatccttggaaaaaggaaagaaaatgagaaaaggagggaaaggcatggctataaaaaagagagagaaataaagcttgctctcaaaacattgagcatgatgaaaaaaaaatatgcatatagccatgccacttccacattcatgcaagaaaaaaaaatggaggaggtataggaaaaaaaaggagacacatttctttattccatcattccacaaaatatttcacttttcctttttccaccacatataaagacccttgatctaggagtatgactgataatcttcttgagtccatatatttggctttgcaatatatatgatgcatgtatgtcacacttttacccctaccaagctccatatatcagccttagaataggggtaagtttggcacatttttgccttggtgaggatccacaagaaaaaaaattatttacttgagtgacaagggataaggtcaatatgaggaaaagagttagtttgtgaaaattcataaaaatcccatgagtctgaccggagaagcaagaaggactggagtcgagatcattccatttattaattacccaagatggcaagtaaccactgttaaagttcacaggtgtaggtatggttctgaataatttatatactcgaattatatcttggagaaatttattctacactaacttttactccgggacgagtaaagagctaagtgtagggggttttgttggcagttattcaatgccaattctataccgccaacatctgcataaagtccagacaataaaacatccaacatagagtgataggtgttaaatctcacatatttcacaagtgttggtgtatatttgtatgcaagtgataaactctaaagttgggaggaaaatcatactaaagtgagagaaaatatgtatccatacaaggatggtttttgaacttcatcaaaataccatagaatcaacacaaaactccgagaaatggatagagaagaaccaggagaggagatgggccgaaggccaggccggaagggcccatgtcacgtcctgataaattcatcccgaaataaaaatcattctctaaaaggaataatagaattaattaaaattcgaaaagaaattggttaacactaaaatatgtacaagaaaaattcgaatgtggcccggagaatttttgttaaattctccttggtctaaaatgagccctcaaattttacttgaattttcagagcaccggaaatatttattaagcaacaaaaacaattatcaaagtttattaaaaaaaacggtggttgtactcattcttgctctatctttccccccttcagtaagagaagctttggagaagaagtcttaggtggagtcctggcttataccccagttgagcgcctgtgaagatggagccgtaggcctgctagtccgctgctgtttatttttgattgtcaggcctgaagtgcctttgtaataatgtaaatattatcgatataataaagatgtgccttttgtatcatgtttgtttggtgtaccccggcttttcctgggacggggattaatacactagcgttcgggaaaaggcaattttctcggtcgcgacaagctagtatcagagccatctcgactgtaggataagccaagtggataaaacctaaggacatattttataaatgaaactatttgcgaaagttccttgttcctcctttccctaatgctatttgcaaaatgtttattctcttcttcctccttcggattttcaactagtactagatggttagttttgcgaa

SEQ ID NO: 19869 - DNA, 3263 bp, Oryza sativa
catgttggcaacagcatttcaactattacaaaattggaacaacccagcaggggcaaccaacgttcaagtacctacagtctagcaacagtacaagttattagaatttctcaaaactgagcctccaacctttgccattgccgtcgatcctatgaaagccagtgattggttgcgcacagtcgagaagaagctggggttgattcagtgcacagaccaggagcgggttggcttcgcaactcatcagttggttggaccgacttcagaatggtgggatagctacgaagcatcacggccagaaggacataccatcacttgggatgagttttcatctgtattcaagagatcacatgttcccgcaggaatgatcacactaagaaaacgagagtttcgctacctgaagcaagaagatttgaccgtgacagagtacctgcacgagttccatcgtttggctcactatgcaccagaagatgtggaaacggatgaagacaaacaagagaagtttctccaggggttaaaagatgaggttgcagtgcaactactcctagaggattatgaagattttgagaaacttgtggacacaagccatacaactcgaaagtgatcataatcggatgaagaactgcaagagaaggattgtcaacatcccagtatttccacgtggtaaccaaagatagcgcattgagccacttcagatcaccggatcctctgttgcgcatcaagagttcctaccccaagaagatggacacaatgcagacaacaacattagcaatactaatgctgatgataccaccaacaaccatggttcttgccccattagggaccactcggatcaagcgtgcgatgtcaatagcattcaccaagatatcgacgatagtatcaatgaaggcacccagaatgacaaccctagcaattttgactctgagaaagactccaatggtgatagcaactatggtaccactgatgccaatgttagcaaggatttccaaccaccaattccaactccaagtcagaatgatcgttcccagacgaacagctcagtaaagaagacattgatttgttacaattgcaaagaaccaggtcatttctccacagattgtccacaaccgaagcgtaacctgcgtcatcactccggccattatgcaagaagaagacaagtcactcgccttgtggtcactggagcaaacgccatacctgtgaggcctcgtgctaatcataacccatagcagaaacaatgtaccgatgctaagcacctttccttttttttaggcagtgcttagtattcatgtaataagggagaaatgtataatacagacaagatctatgtggattcttttggaagatgcggatatgtgattatgtgcgtaattgtttactgacaaaggagacctagggtctcatatccgtaagctcataatctatgataaatcaagtaacctagttgttgatagaaaagaaaatgaagcgatctgtgttagattaaaaagccaaagagacttttgtttggactaagagtttcagatgtgtcttctttggatcaaaggcaacaaccgccagtctagcttttgatgaaccacttgaaggtttctctgaaaggcagcaggctcaagtaccacatcgtcaccagaagcatccacaactctcggagtgaagagtacttagttgacaaaggtcaaaagatgattgatagaagatatcgaaaaagatgtttattaccgggcaaagaagtaggtcgaaacgtgattgataagagaaatcgggaaagaacacatcaaggttaaaggtgtaaaggaatacgttgaatgctaactgaggacaacatgaagagaatagtgggaagtgaaccaaatgtaaagaaagtgaatccgagttgcttgttcgtgagagctattcccagttatgaaccaagtgatatgttcaaagataatctacagagtcaagattaaaatcacatccaacaaagaagtttcagatttggcaggtcaataatcagaaaaatacaagtccaacagtaaagacatttgggaagacgtcaaagcatgtcgagtgggataagttggttctcttaagaaacataattcaaagttagaatggtcgaccctcgcagcgaatagcagaagtatctagcactcggagaccaggaaagctaaaatgaggcagttagtggcaagttgtcaatcttggtacccttggtaagtgggatatcatagtcgaatgcatttggtggtaagctagaaggaaacgccaagcatggtattctcatgatgacaagcatggtatcctagtaatgacaagcaggtgtcgacacatgacatgaagttgataacttgtgtgaggttgacgccgaagatatgaatcatgagaagttctggaacggaagcatcattaaactaccgcaacctagtctaagtaacctaaaaggtgcaccctggttcgagtcaggtgaagagaagattccatccgcaataggaggtcaagccaagcagttccgagtggtgaagttttgctggaagtttgtgaagacgcaacagaagaagtcagacaagaagagaagaccgcccaacctatcttcttgctagcctcctcgaatctcggggacgagattcctgtaaggggggtggatttgtcacgtcctgataaattcatcccaaaataaaaatcattctccaaaaggaataatagaattaattaaaattcgaaaagaaattagttaacactaaaatacatacaagaaaaattcgaatgtggcccggagaatttttgttaaattctccttggtctaaaatgagccctcaaattttacttgaattttcagagcaccgtaaatatttattaagcaacaaaaacaattatcaaattttattaaaaagaaaaacctaaaagtaatcccccttcctcctttgggccaagtctggcccaaagtcccctctctctctctctctcggcccgcagccaaagtcctctcttcctccctctctttctctccctctccttctctccctccttctcttgggcctccccttccccctcggcccagctcccttttcctcccctcccgcctgggccgcgtctcggcccaagccgccccacccagccgccccagcctcccgagccgccccccctcacgcgcgccgcacgcgcgctgaccgcgcgcccgcgtggggcccacgcgccgggtcgtcgtcctcctcccgcccgcctcctctctctctcccggaaacctagcgccattcctccccaatatccacgcgattcaaaaattgattagg

SEQ ID NO: 19870 - DNA, 7493 bp, Oryza sativa
cccacttgattcgtgccctctaacacccggaacggccgcgccattcccggccgccggccacatactccaccgccgttccccgctcctcccctggccggctccctccccgcgcctataaaatggaatccccatcctccgttctatagttttagcctcatcccgagcctccccatggtcgtatcacccctccccgccgtcgcccttctctttcccccgcgccggccgcctccaaccgcctgtgcggccgcgcgtgagcgtcggtcggccgtgccgtcgcttccctcggctctgtgacgccgccctcttctccggcctcacctcctcctcgcccgaagctcgccagagcggtctccttgtcggtgtccagtaccttcctgcctccggccggctactgttcctcatcggtgcggcagccgtcgtcgtcatctccttccccggctccacggcgtcaccctccaccccgaccgctgcccgtcttcgtccggagcccgccgccgccgtgccggcctctctttcctcctcgtcgacgtcgccttcggcagccccttctgccatccccgtgcgccgtcggccgtgccaccaccacctccggcatcgcagcggcgagccagcgacgtcgtcctcggcatcgcctcctctccatcctcgtcatcgccgacgtcccttcggtcggccgctcctcctcgccggctcctcgtctcgttgtgccgccaacatctctgtctggtgttgggaaagttgcgggaacatcaattgtatgccaagcttagcaagtgtgagttctggttgtccaaagtcaaattcttagggcatgtgatatctgctaaaggagttgctgtggaccccgaaacagtgaccgccgtcactgattggaagcaacccaagacagttactcaggttcgcagctttttgggtttggcaagatactaccggaggttcatcgagaacttctccaaaatcgctcgacccatgacacagttgttgaagaaagaagaaaaatttgtgtggagcccgcaatgcgagaaggcgttccaaactctcaaggaaaagctggtttcctcgccagttttaatcttaccggatactcgcaaggacttcatggtgtattgtgacgcttcgcgccaaggattggggtgcgtgctcatgcaggaaggtcatgtggtagcctatgcctcacgccagctacggcctcatgaaggcaactaccctacccatgatttggagttggccgctgtggttcatgctctaaaaatctggcggcattatctcattgggaatcgctgcgaaatatataccgatcataagagtttgaaatacatcttcacccagtcggatctgaatcttcggcagagaagatggttagagctcatcaaggattatgatgtgggaatccactatcaccctggtaaggccaacgtggtcgcagacgcgctgagtcggaaaagccgttgcaacactcttggcgtccgtggcattccaccagaacttcatcaacagatggaagccctgaacctaagcatagttgatcgtggattcttggctacgctggaagccaagcctaccttgctcgatcaaatccacgaggctcagaagaatgatccagatatgcatgggatcctcaagaatatgaaacaaggtaaagccgctggtttcacagaagatgaacatggaaccctatggaatggaaatcgtgtatgcgttccggacgacaaggaacttaaacagctgatacttcaggaagctcacgaaagtccttattccatccatcctggcagtacgaagatgtacttagacttgaaagggaaatactggtgggttagtatgaagcgggaaattgcagagttcgtggccctttgtgatgtgtgctaacgtgtcaaggcagagcaccaacgaccggccggacttctccaacctctccaagtaccagaatggaaatgggatgaaattgggatggatttcatcaccggacttccaaaaacccagggcggttatgattctatatgggtagttgtggaccgacaaaccaaggtagctcggtttattcctgtgaagaccacctatggagggaacaaactagctgaactctacttcgctaggatcgtgagtctccatggcgttcctaagaaaattgtatctgataggggaagccagttcacctatcatttctggaagaagctccaagaagagttgggtacccgcttaaatttcagcaccgcgtatcacccgcagacagatggacagaccgggcgtctaaatcagatcctagaagatatgcttcgcgcttgtgtcctagattttgggaagacatgggataagagtctcccctacgccgagttctcctacaataacagctaccaagccagcatacagatggcaccgtacgaagcgttgtatggccgcaaatgccggacaccactattgtgggaccaagttggggaaagccaagtgttcgggaccgatatcttgagagaagctgaagcgaaggtcagaaccattcgggagaatctaaaggtggcccagtctcgagagaagtgttatgcagacaaccgacgccgtgacctggaattcgcagtggatgactttgtgtatctccgggtcacgccgttgcgaggcgtacaccggtttcagacgaaagggaagctcgcacctcggtttgtgggtcctttccgtatcattgctcgacgcggagaagtcgcttaccagttggagctgcccgcctccttgggcaacgtgcatgatgtgttccatgtgtcgcaactcaagaaatgccttcgagtgccgtccgagcaggccgactcagagcagattgaagttcgcgaagacttgacctacatggagaggccagtgaaaatcctggacaccatggagcgcaggaccaggaactgggtaatccgtttttgcatggtccaatggagcaaccacgccgagctccggtccaccgccgtcttcgccccggaccgtttcccgccccggcgtcacctccttcggcttcgccgcaccgccgtcgaccccgtccaccacctcgccgagcccgccgaccgccggaacgccgtcgaccccgtcgacccgagccgcgccgccgccttcctccgctccggccgcctttttcgtcgtcaccgtcgacctagggtgagccgtagaccgccgcctcttttccccctttcctcccctctctcgaccgccgctccgccgcgccggtggtcgccggcggcgaccatcggggcgcgggggcgccgcctcccgccggccgcgccgagtggccgccttcgggcgtgccgagtggccgccacgtggggcccggccgtcagccgcccgtgccctcgggtgcggctgacgcgtggggcccacggcgccggccggtgcgagcccaggtgcgcctggtccactgtggaccgtgaggctgccacgtgggccccactcccgtggacccggtccgcacgcccctcccctcggctgacgcaataaactctttttaaattaaaatttaaatgaagaaattcgcaaatattcatttaaagagcatataaacttcaaatggccataacttggccatttaaactcagaattggaccgttcaagtctctaatttttccttaagaagtcaagaacccatttttgtgctttgttcctgcttgttatatagagtttattagagtaaaagccttttcttttccgttggtcgtgtagacgctgcagcttcggaagatccgctcttcgtggaggttgaagccgacgtttgggaaagcgagcaaggcaagtcacatcatccttgaacatattgaatcccagtttataaaattattttgatttaaattattgcattatcgctttatttagattcccacgttatctctgttttatttagccatgcctatttacctttgttatgaccttattattattgttattgttattattaccttgttcaccctagattaaacaaaaccccaactagtggacactctgctcatggtaccactagtatgaatttaggtagatgcttcgccgcttaattaggtaacattaggtggttttacaactctagactttgggatattcatatcacctggatactatggaatggttggattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttgcacatgtctagtgggtaaggcttagtttgtggctcagtctggttataaacaaaagtacacagatggagatggacgaagtcgggggtcgatggacatctctaggacaaatgaaggctacacgagccgcgacccggtagtcgagatgtcatggcacagggccggtgtcctgctgctagggactcagtcctgcctacctgtcccgggggttccggccgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgtgccctcggttatgggcaagccgagtaatgtacccaagttagtgttttaattcttaaaacctgcttaacaactaaaatgtggaatggttggcctgggttggcttgggacgagctgggacccagggtcgggttgccagttcggtctgaatcatcgtaggccttgggttaaggcaggttcgtgtggcttcacggccttgtttaataatcttgtatagctctaggatcgtatttacaaaatagctttgagcaactaagtgtcttttaatgctgtttactgcaaaccctaaccctttatattacaaccccccttgtactcccttgcatttattctgcacttatgggtgtgtcttgttgagtacggtggttgtactcagtcttgctcaatttttcccaaactcagaagaggaattcctggaagatgaaggctttggtgtctagctcgtgcctgccgtcaagcgcctgtggtcgtcgccctagccttccgctgtttcccatttgtctttgtgtgtgctgggccttcgccgcctatgtaataaattaattaattacgcttcagcttgttaaactctgagttgtatcaacttttggtgtaccttgcctcctgggacaaggaataatgcacgcacgtaaggaacgcccgttgggttatttccggtcgtgacatgtggatatgcctagctctagctctagctcttgtgtttctatttgtgatgcctcacttgttgttgagaacaatgagcgtaaggagcaagtggccaagctcaacaagagtttggagaggtgcttcaaggataagaacactcttgacaagattttgagtgagcaacggtgcatccttaacaaggagggacttggattcatttcaaagaagggtaagaaaccttctcactgtgccactcgttttgtcaagagcaatggtaagtattgctccaagtgccgtgaggttgggcatttggtgaatgattgccccggtggtaagccttctatgacatgcatgtttgattctcattatatgcttaggaaggctcatgatggtagcattgttgctagatatgtgggttcccctatactcagtggtaaaaagaatgccatttggttgcccaaagttttgatctctaacctccaaggacccaaacaagtttgggtacctaaaagaccttgatcttcttttgtaggtgaactaccgcaccggttggagtcattgggtgcttgatagtggatgcactcaacgcatgaccggtgatagggctatgttcaccacatttgaagtagaagggaaagaataagagaaagtgacatttggagacaatagcaaaagaaaactaattgggttaggtaaaattgctatctccaatgatttggcaattgataatgtctctcttgctaaatctctaaatatcaatttgctttcggttactcaaatttgtgatcttggcttgtcatgtgctttcttcccacaagaagtttttgtttctagatatggaaatctttatttggttgatttcaattctagcgaagcaaatttgacaacttgtttaattgcaaaaacttcattgggttggctttggcataggaggctagcccatgttggcatgaatcaattgagcaaactttcaaaacgtgatctagttgtgggcttgaaagatgtgaagtttgagaaagataagctttgtagtgcttgtcaagccggcaaggaagttgcatgttctcatgctactaaaagtatcatgtccacatctagaccattggagctcttgcatatggatttgtttggcccaacaacctatagcagcattggtggaaatagtcattgtcttgtgattattgatgattattctcgctatacttgggtgttctttttgcatgataagtctattgttgtcgagtgtcacgtcctgataaattcatcccaaaattaaaaatcattcgctaaaaggaataaaagaattaattaaaattcgaaaagaaattggcaaacactaaaatacgtacaagaaaaattcaaatgtggcccggagaatttttgttaaattctccttggtctaaaaagagccctcaaattttagtggaattttcagagcacaaataataattattaagaaataaacaaagttaaaatgattttataaaaagaaaaaccataaaaagtctttttcccccccttcccctcttgggccggctcggcccacctccctccctctctctcctctcccccgcggcccaatcggcctcctccccgcgtgcgtgccgctgacgggtgggcccgcccgccaccctcgctgacgggtggggcccacctgtcatccctgtcctcccgccgctcccgccgcctcgcccgtgccctagcgccgccgccgccgcgaatcccgccgcctcccgccgtccccgcgcgcaataaagagggggaaatcactccccgtgattccctctctctttcccccctcttttccctctctctctccctcggattcgtttggaatccctcccgaaatcttcgccggcgcatcaatggagcccgagatcgccgcgccgatttccttcctctccggccgccctctctcactcccacccctatttaagcactccccgtgcctccctcctccgtttccgccactcgccgctctctctctccgccggaatcgagctcgcgccgtcgtcctctctctccgccgtcgccgccgagcttcggttcgccgccgtcatcgccccggacctcctcccgcttcggcatcgcctccttcggcttcgccacgtcctcgtcgacctcgtccactcctccgttccgcccgccgaccgccggagcaccaccgtcctcgtcgacccgagccgcgccgccgcctctctccgcttcggtcgccgttcccgc

SEQ ID NO: 19871 - DNA, 11845 bp, Oryza sativa
ccgctccgtcgcgccggaggtcaccaccggcgaccatcggggcgcgggcgcgtcgcctccagtcggctgtgccggcgaggccgccttcgggcgcgccccgcggctgccatgtggggcccggccgtcagccgcccgcgccctcgggtgcggctgacgcgtgggacccacggcgccggccggcgcaagccgcgtgcacccggtccaccgtggaccgtgaggctgccgcgtgggccccactcccgtggacccggtccgcgcgcccctcccctcggctgacgcaataaatccgatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgcttgttatatggagtttattagagtaaaagccgtttcttttccgttggtcgtgtagacgctgcagcttcggaagatccgctcttcgtggaagttgaagccgacgtttgggaaagcgagcaaggcaagtcacatcatccttgagcatattgaatcccagtttataaaattattttaatttaaattaatgcattaccgctttatttaaattcccacgtgatcactattttatttagccatgcctatttacctttgttatgaccttattattgtgattgttattattaccttgttcaccccaggaaaataaaaccccaactagtgggtactctattcatggttccactagtatgaattagggtagatgcttcgctgattaataggacaacattaggtggttttataactttagactttgggaattctcatatcatttgaacactatggaattgttggattatggtggaattggacatacccctctcttcctctttcaaagcccctaaaacctgtttttcggtggggtttgggtgcatgccagttgtgggaagtagcaccccggccactataaggattaagctcgggcctctgttgcaaagcactaccgtacttccacatgtctagtgggtaaggcttagtttgtggctcagtctagttataaacaaaagtacacggatggaggtggatgaagtcgggggtcgatggacattctccagggcaaatgaaggctacacgagctgcggcccggtagtcgagatgtcatggcacagggctggtgtcctgctgctaggggctcaatcctgcctacctgtcccggaggttccgatcgtaggtggggttgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgcttaacaactaaaatgtggaatggttggcctcggttggcttgggacgagctgtgacccagggtcgggttgccagttcggtctgaatcatcgtaggccttgggttaaggcaggttcgtgagggttcacgaccttgattaataatactgtgtagctctaggatcgtctttataaaatggctttgggcaactaagtgacttttaaatgctgtttactgcaaaacttaacccctatattattatccccttgtactcccttgcattaattatgcatctccggtgtggcttgctgagtactgtggttgtactcattcttgctcaatcttttcccccttcagtaagagaagctttggagaagaagtcttaggtggagtcctggcttataccccagttgagcgcctgtgaagatggagccgtaggcccgctagtccgctgctgtttatttttgattgtcaggccttaagtgcctttgtaataatgtaaatattatcgatataataaagatgtgtcttttatatcatgtttgtatggtgtaccccggcttttcctgggacggggattaatacactagcgttcgggaaaatgaaattttcccggtcgcgacatcgagcttttcaaaaagtttgcaaaaagggcccaaaatgaatttaattgcactcttgtgaaaattagaagtgacaatggttccgagtttaagaataccaatatcgaggactattgtgataatcttggtataaaacacgaactttccgctacctactcacctcaacaatatggtgtagtggagaggaaaaatcgtacattgattgagatggcaaggactatgcttgatgaatatggtgtttccgattccttttgggcagaagccataaacgtatacacaccgctctttccaagagtcactcaattgaccaagtgttgggtgacattactaagggtgttcaaactcgatctcatgtcgatttgatttgtgaacatgacttgtttgtttcttgtcttgagccaaaacatgtagttgaagctctttgtgatccggattggatgaatgctatgcatgaagagctcaacaactttgcaagaaacaaggtgtggactttggttgaaagacctagaggccacaatgtcatagggacaaagtgggtctataggaacaaacaagatgagaacgggttggtggtgagaaaaaggcaaggttggtggcacaaggtttcacacaagttgaaggtttggacttcggtgaaaattttgccctcgtggcaagacttgaggctattcgcatccttcttaaatttgcatcatgctttgatataaaactatttcaaatggatgtgaaaagtgcttttctaaatggtgaaattgccgaacttgtctttgttgaacaacctcccggttttgaagatcctaaaaatcctaaccatgtttataaactctcaaaagctctttatggtttaaaacaagctcctagggcttggtatgaaatattgagagattttcttttgtcaaaggatttcaaaattggaaaagttgacaccacccttttcacaaaaattattggtgctgatttctttatgtgtcaaatttatgttgatgatatcatattcggttctactaatgaggtattttgcagggaatttggtgatatgatgtctagggaatttgagatgtccatgattggagagttgagcttcttccttggacttcaaatcaagcaactcaaggatgggacgttcgtgagccaaaccaagtacatcaaggatctactcaagaggtttggtttggatgatgcgaagcccatcaagacacctatggcaaccaacgggcatctcgaccttgatgagggaggtaaaccggtagacttaatgctttatcattccacgataggtagcttgctttaccttaccgcatataggccggatatcatgtttagtgtttgcatgtgtgctcggtttcaagccgctcctaaggagtgtcacttagtggccgtgaaaaggattctaagatatttaaagtattcctctactattggcttgtggtacccaaaaggtgctaagtttaagcttgttggctatttcgattcggattatgccggttgcaaattggatagaaagagcacatccggtagttgacaaatgcttggtagatcccttgtgtcatggtcatccatgaaataaaactccgtagccctctctaccgccgaggtggaatatgtttcgaggggtagttgttgtgcccaattgctttgggaaacaaaccttgttggactatggcatatccttcaccaaaaccccactcctatgtgacaatgatagtgccataaagatagcccataacccggtccaacattcaagaaccaagcatattgacattcgccatcacttcctaagagaccatgtttccaagtgtgacatagtcattagccacataagaaccaaggatcaactagccgaaatctctaccaagcctcttgatgaaacccgcttttgcaagttgaggaatgagttaaatgtcatagatttctctaatgtggcttgagatggtgcaccatggttgcttcttttgcagtgtgtatatttgctctcattcgcgcttatgctttggaattattgccatttggttcttcattgcaaaaatggagcatgtcacattaagggggagttttgcactcttgcatgtgctctacttccttttatatgtgagcaaatcaactagtgctgctagtagtatttccaacatgcccaagtcaacataagtcaaaacttttgcaaaatcaaagtaatttgaaaactatctcttggaaaatgtttcaaaaggttccctatatgttttccaagcctcacattgcaagaaaaattatttttgaatgaaaatgccattttggccctcttttgaagacactagattcttagttctggccaaaatgaaatttatcccccaaattgagattgagaaggaatttgagaaaagtttcaaaaaaaaattggtagagaggaggttttgaaatgtttttggtattcaaacctatttcaaaaaccaaatcaatcaaaagttatttgaaaaccaatttggcgcaaaatcccctatagaccataaaaggtcacctcctagcacttaagtgagttttgttgcaaatcatcataatcttcaaatattatggatggttcacaatatttaaactcacacatttcaaaatttgctccaaaaatcaaatttttattaaatttcattgtgtgggggttgccggcttgtgcaagggctgtgcacagccagctgggggcctggcagtctgaccggcgctatatgcgcggtctgaccggccagctgtggtggtctgaccggccacatagggccagtctgaccggccgaggtgggcccagggaatttttattccccctcttcttctacccgcacctacctctctccttctcatcccctcacttccccatctcgaaatttctaactctctctcacctcccctcaaaccctaactccttcctccaccaaatcccctcggtttgaccgtggatttctctccggttacactgtaagtgactctcctccgcttccactctctattccatggattggtttgtatttttgttgagtttttgatccatggcatggaaccctaggtgaagcacgaggtgttcttcgatttgcaccaatagagggtagtttcttggtgtgattcaactcctccaaccggtaaatctctctccctctggtgcattgctctcaaatcggtctatttcaatctctagggtttagggtactttcccattgttccaatcttgatgaaataggttcaaccctttgatgttcatgttccaatcctgtgctatattgttctagcaaattttagactcaaatgtgtagatatgaaaatatttggatgcttaaacttgtgggaggaggtctgcctggagacacaagcggtttgaccatgggtcagccgccggtctgaccggccggcagccgtcggtctgactggccaccatgggcggtctgaccggcctgatgccttcggtctgaccaccctactggctgcggtctgaccacccctccacaggatgtaggcaaatttttacctctccaaattgtttctagaattattgctaatatcctatcatcctttgttctttgacagtgatgcctccccgcactcgccatggtcaccgtacgcccactccggatcccgtgagtgagactgaggaatcgagcggagaggattacgctcaaagtgatgaagaggttgaagcaaatattgagggggctagtgaggtggcaagtggagatgatgtcagtggaagtggagaggatgaggatgaaggaaatgatgatatgcacattgatcccttcatccagtttgtggtgaacatgaggaatccatcgcagtataccatcttgaggcatcatgatcagttcttgaggcctcgagacaccctggatccccgttttcacaccgctttccagaagactgtgtatgaacaggtttatgcagggaaagcatttgcaaagcataagtggatttcttggagagacatcaatgagactccagagtttgagagcttgcaggatctcttcaagactgttggtattgaccggattgtgaccctcaagcaagactacaatgaatatttgatccggcagttctatgctacagtgtgggtggctggagactatagtgagatgaagtggatgtccaacaccctccagtgttctatctctcggaggcaattccggcggctcctcaatattcgcttggactttggagatgatttgcatgaggagcacactcacaattcactctccatagactatctctctcagttttatgaagattgagtgtggtacacacatgggaaggttgccggcttgaggactatcccagtgtggttaacaggattgtgagagctaccatccttcctcgccttggcaacaatgatgacattaggggggtggcttggcacgtcatcgatgcaatcattcagggtcgtcagttcgacattgtgtctctcatgatgcaagagattgccatctccaaggggaccttcactcagggaatctattatgccccttacatcatgaggttgattcaagacaagcttggggctgctgggcaaaatttgaagaagcacaagcagtacaagccccgccttcagcttggagctccccgtgctcctaggacggtgccctcttctcatcctggagctagctcaagctcagcacctcctcctcctcctgagtatgatccaaatgctttcttccatccacagtttgcttactttggaacgcaacccaatgaatacttcaacccggtacttggggctattaataccctaagtgaaagcattcaacgcttgtctaccgggcaagaagcattgcatgaggatgtttgtggcttgcgcaccgatgttggagacttgaatgcttccatggggagattgcacactagagtgggtgcattggattctcgagtccaaatgttggagagcacccaagcttttctatatcatcgtcttcctgatgctcctcatccttcctcttcggcgcgtcctccttctcctccacaagaatgaagacctttttggtacatgatgccaaaaggaggagaaagatgtccttaggtgtgctttatgtcttgtgggttgggactagtgctagtaaggttagtcacctcatatttaataggttaaggtagtttgtgctatattatgtatggatatgggctattactctatattgtgtgttctttatcgttttgttggactctatgtcatttggacccttcgtggtcttgtaatagcctatgtttttttgtgagcccttttaggatgatttgtgacttatctgatttgaatggttaagtgatgtgaacttgtgtgatgatggatggtgtatgtgatattgatatatatgtgaccatcttatgctcatggatgaatatttcttgaagttcacattgaaatattgcttatgtgtttgtgcttgttgaaatgtgatattgaagtgtgcattggctccatatttgttgtctatgattgatatgcacacgtttagggggagcttttgattgtcattgcaatatatgtccatgtgttctatgtttgattatatatatttgtggtgtttgtcatcaattaccaaaaagggggagattgaagcatgtaggcccccgttgtaaattttggtaattaataacaagcactaattgtggactaaccgttgtctttgagctatatattttaagttaggtccacgtcatatgtgcgcatggatgattatcgatggattaaaattgacggcgcaaagcaaagggaaagaagacggtaaaactagtgctttaatttttgaattgatcgaggtgtagggcgattaaatttgctagtttatttttagtttcgccgtaggggtaatgacctagcaaagggatgattttaattgccacattaggtcattatgcatttagacttgtgctcacatttcatctcacacactcaatcacttttcatttcactgggttcggcctgacaggggcggtcagaccggccacacagtgccagtctgacaggtgtgccctggccgatctgaccggccatactacggaggtctaaccggcggcacatgcgcggtcagaccagcccgctggaggccgggatggtgctactcggggtggctgatacagagccgacggagccgtattcggtcagaccgagctgatggcggtctgaccgagccgaggccggtctgactagccactcaatgtcggtctgactggccaggccgatgggccctctgacagggctacaacggctagttttctagccgttgtagagtagcacggtctgaccggccacatacctccggtcagaccggcagagcacagagttgggggatttcgcccccaacggctagttttggttggtaggaatataaatactccccctccagcagcaagggggctctcttggcacctaattcaattgcatacatcccttgcacctctctcacacacccttgagcttagtgttcatccattgtagtggttgaggttgttctagccaagagtcaagtgcatttgcttccattgtagagctagtgtggcacttgattgatcatctccacgccgggtcattgcttgttactcttggaggttgccgcctcctagacggcttgtggaggagttgcccggtgacctctccgagaagattgtggaggaggcccggcgccgatttgtgagtggtctggagtacaccaccttcggagtgaaggaagaactaccctagtgatcgaggcttgggtagtcctctccatgggccggctcccgccttgcccaccccttgacgaagggggcgtgcggtggcttcgaggttgagcactggagttgggatcgcctcaacggggagtaggaaaccggcaagttgccgaacctcggtgaaaaatctcttgtctccttgtctcatttacttgttgcatttacatttgtgcaatttacatttctagagatcatttcaccctaggattgctaaacattgacataggagtgtgatttactttcctagagatataatagagccactatcaccctaggattgcaaaacataacttagttacttagttagagttgaccctcaccaagcctagcaacttaggttagtttcgattaggtgtcatttagttttaaatcgcctattcacccccctctagtcaacatctcgatcctacaataattacgaccatgaaacatgggtagatgtctcgagcacgcagctcgtcaagaaactaaatgtctaatgatgtaattatcccattttgtgagctagtggtaattaagcaaggctaagcatacatataattctagcaagatcaacataagtatcacgagctagataaattatcacccaaggttgacaaaggacagataacaagtaaacatggcacaagcgagcagataggtaaaccctattcccatgtaattggcaaaacatgcatatttatttgcaaacggtaaaacatttataaattgggatcaacatgctcaaggggaatgtgtgacttgccttgcttcttcactttgatcttccgaacacttatcctagcgaccgcggacttccgaaatggcgaaagctacacgctggcacgcaaaacaaggaaaaacactaataaacaccaagaaaacagtacataaaaagtaaacaaacatgtagatctatattttagatgaattttgcaagttgaatggctcaattcggagttcgtatgaattagaaatgaagtttagatgttttgagccatttaaatgaatttatagaattattaatgatttattgcgcaattattatttattttctcaaaggacaagttaagcgctgacgtcagcaaagggccggcgtcgacaggcgggcccacacatcagcggctccaaggggaggacacacggtggaccaagcccaccgcggcctaggcggcaccgtggacccggaccacgggactggtccatgggaccgacggctcggatcggccaagagccgatccaacggccaagggcggcccggctagggcacggcacggctcaaagccggccggcgagtggccaccggtgacgtgggacgacgcgcggagggcggcaaaagggagaggaggaggaggcggttctcaccgtgcgaacggggcggcgagacgaagacgaggaggcggccagcggcaaggattaggcggccgcgggctccccggggtggtggcgatggcggtgcttcaacgacggcccgcggcggatggaggccgggatttcctggggaagaagatggagtggttaggaaggaaaataggcaaccggagcggcgagaataccacgccggagagttgaggaatggtggggctcaccggtggccgagagataccgagctccggtgggtttccggcgatgaacaacggtgaccgaggtgctgcacggcgctgtgaggcaagaggtgagggcggagcaacgcggcgatggctaaggcgaggacggcacgcggctggaggcggcgtatggtggagctcgggtgatgcggtggaatggttgttccagcggcggtttgagggagaggagcggttgccggggtgctacgcgatgcggcgaagctgatggtggcagtggcgcggcttagcagtggctatggcaggggtggcgcgctgtcggagtcggcaaaggcggtggagagaggtggtgcgcgtggcggcattgtttcggatgctaacagaggaaatggagtaggggacggggcgtggaggagcgcggtgatgccagtggtggtggcgtgtggatggaaggtcgccagcgaggggcggcgatggggatcggcgcggggagagcgagggagggcgtggcgggcttgggaaaaatgggggaaacggataaggagagcacggggaggccggggagtggcgaatttggggcggcaacggccggcgacgcggagctcaacgtgggcggagtggggctcgatttgcgcgagggggagtcgatcgggccgagaagggagttgtcggcccgagagggaggagggaaggagagaggtgcgagcgggccaaggagggagaaaagatcatgggccaaaaatggcccaaggaggaaggggagatttatttaattgattaaatgaactttgtgacttttaaaattagatattgagctccgaaaattccgaaaattagtatatcagggcacaaaaaatattgcaaaatattctcggccaatgatttttaaaggaaagtttaattccctcaatatttcacttgattaaattgatttaacttttatttaatttctagaaaatacattattaattgattttaaatcccgaacgaaaatcggggcgttacaattattgttcaccataatcaactaaaatatagtgattgctttggtgaattataaacactaaagtagatattaattgctgagacatggtgtttagtttattgttatctagtaattgctgtgtatcccacagtacgtttgaggtaggttgttgacagctgttaagtgcacaaataacgccgtcaatacctacataaaaccataaatgtgaaacatccaacatagtggtaggatttatttctaacaatttccacgagtgttggtgcatattagtatgcaagtgatcaaccaccaaaattgggagagaatgagcataaagaatggaaatatattttgctctgatgaactcacatggttttaagctacaatatataaaatgtgcaatcatttgaagccaaaacatggagcatcatgaagtggggcccacatgtcagcatccggaagaaagatgtgggccatgggagccaaccagggt

SEQ ID NO: 19872 - DNA, 1246 bp, Oryza sativa
cgaacccctagctggcccagtccagcccatattcggtatgacgattgtactcctcatcccaatgatggttgtggccgtttctaccggtggaagccgtcatagagaggacacttgtcaagagaagataaagctagagggaatattctcataggatgcttggagcatctccactcccccaaggcaactctccacctataaatatccctctcctctccctcattcacacacaccaaagcatgagctgaattataagaggctctagtgtactttattgcatattagaatagggagagagtaaggtagaaggaatcggaggaatcccgaagttgtcggtaatctcctcctacttttgtatcttgttaattactctgctttaatagaaatatcattctgagtatttaagatttgcttagtcataattactttttggttagttcctaattagcatacaggatcattgttcactatagtccatttatttgtagtgattgctttagtgtttgatcggcactagagtagttattaattgcgtagacgtggtgtctgggtaattaatctctagtggttgctatgtatcccacagtacgtttgaggtgggtgtagaggtggtgatagccctcaagagcacttatgtcctccctgtccacgtacgtagtagagcgatatctgggaacagcggattgccagtgcctgaagtattgtgttaggattaaacttaagctttccctagacactgtttctcattaggaaatcctctctgccctctgcccacattagctttgtgtccttggatgaaccggaggaagagataatcacacacgttcccttggattcgatacccttggaatactctgtaagggaagtgctacatcggtatatctgtgcgcttgtggattctatctgtgatcgtaagaaataccaacaagcatttctggtgccgttgctagggaacggttgctgtttatttccgaaccttgttcatccttatcctttttacctttttattcaacctctacccctgctatcccatagaagtattcctgttcaatccttctcgaccatggagcaacctctcttcgagttgtgcgctcctcgggacgaattttacgagccacctccttcatcggagccaattttaacacctagctatgaaattcgtatcgaattcatcagtatggttagggagaaatctttctctggtttaggccaggaaaaccccttccaccatcttcaggaattcgaaaag

SEQ ID NO: 19873 - DNA, 747 bp, Oryza sativa
aatggaaataaaatgtttaaaaaagagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaaggtaaatccacacttgcgaaaatattgcaaaagaatttgttaaaaatagtaatgacctttattaatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctatttttgaaagcacaggatatgttatcttgtggtcattccaccacccgaggacgtcgaaatcttgtgcttcgtggtgcatggcgtctctgtcaaataaccggacaa

SEQ ID NO: 19874 - DNA, 6411 bp, Oryza sativa
ttccatatgtagtggttatagttgtttctatttcagaaataaaataggtgatcccaagagaaggtggtcatgcaccttgtgccatatttgttttctcaacttggttttatgtttcttcaaaacatctttttagatttttccagtgtactgctactgcatccctctagcgtatctaactgattggagcatttactgaaacttttcaaatgaatacaatatccattgcttcgctgtcagcctatcactctaataagtaatgcatatttgttttcctgcttggcagtccttaaagatctaaaatatgctgatactcatgagtgggtgaaggttgagggtgattcagcaaccataggggtcacagaccatgctcaggtaatcagtttgatacatttgcaagctgcaccagcattttatcagccttcaatatgctatattactgggtctcttgctgagttgataacttcaacgtgttattgacatgcattacagcatttttcctcaaaatagaattttctgtgatagtgtgatggcttaatatgtcctgtttcaattccaggaccatttgggtgatgttgtgtatgttgagcttccagaagttggttccacagtatcacaaggaacgaactttggtgcggttgaaagtgtgaaagcaaccagtgatatcaatgcaccagtatctggagagattattcaagtaaatgatgaactaagtgaaaaaccaggatttgtgagtcgcaattgctacccttgctagactaatttttgagtaatcactgctatgttcagttgacaatttgcttctgcaattttacacagataaatggaagtccatatgagaagggatggatcatcaaggttaagataagtgatccaagtgagttaaactcgctgatggatgatgagaagtacaagaagttttgtgaggaagaagatggcaaacactgatcaatcccctaactgctggatttcaagaaactatgcagcaactcaccatcatgacaatgagccatctcgcctctcctaccacattatattattctggataaaggagtcccaaggaatgtaataagctgaaacattttctcttgcaaatcagacatgaaaattttgtagtgtcctgatcattccgtttgtgctccatttgaaattcagctcttgatttgcttatcatctgaatacaggtggaggattgggtttgtttaaactttgattaagtgacagtgacttgattgtattgagattgcagctcagggattgtgggtttgtttatcttctgaattcaattctggagatagctgcatgaaacgtgatccacccgttttccagctatattattccagtttgaataacaaaatcagatttataaaacattaaaacaagcatcattagacaagtcgataactctgttctttcaattcaatcgatcgttttgccttgagaaagtcaaaactacattacagcacgaagaatctagcttattaccctcgatccgtattgcaaataaatattgtggccgaacgattatgtaaactttagaggctcgaatcaagtaattacagaacgaccagacaatctcactaacagattctttgagcattctcacgggctctgttgtgaaggtatcattgacaacaaagacgttacagatggatagaaaacaccattcaccaatgcgggtattacttcaaccgatcatattgtcttactacaagagaacttaggcaatagtacagaaagcatcccacttggttaattagccagcaggccatttcatctgccttccacctagtacatgcaagtgcaggtgatagactgattgacctgtggacagagcgatgatacagtattagcataaatactgaaaaatatggcggtggaaaagagctcatgcatgagcatgggtatcaacaccgaaaatacgttgaaggatgatgtgtagcatgtatactgaaaagtgaaaacatgtgcaaaccccagtaagtagaaaagagatgtggcatgggagtgcttacatcctttaggtccattgtttatgacgacacggtacccttcagctataccttccttctcagccactattttcgcggcgtatagaagatagcccagaatttcgacatgccttggttcagcctaaaaatatgttcttccaacatgaggtgataatgtctgatggaaggcttgctcaaagaagacatgagtacatgaccaacaattttgcttccataggcagttaaaaagggcatcggcttgtactaagataagcacataacgaagtacatggatactgccatgctacacagttttagagattgagaattcctctcgcaaacactagtgaacaacattccataccttgtctagtccagtcaacccatctcttatctttgggatgactagaacatgcacaggggcttgtggattaatatctctaaatgccagcactttctcatcctcatagacaacattagaaggaatttcctttgcaatgatcttgtcaaaacttccataaaataaacaaagaggaatactcagtgccactgccacagaagggattatgaaatagtaaaatgagaaagcttacatggtcggtcctccagtatcagctgttgctgctgctgctttagcagcagcttcttcatttgtcgatgaagcaatgtggcgcacaaatctggaggaaaagggaaaagcacccggactcaatattagacaagaaccatcaattgtagacgatgggagagaactatgatttcatagcattaccgtaaacccaccacacatctaaatgccaccatattgtttaggcacttgtttaattttggatttaattgttttacagacttgagtttatatcaaatagcaatataactaattgggattcggtaattgctatttggtgatcaaccctttgttcattgcttatactttttttagtaccaaccgttggaaacaatagagcacactacactccgttgattgacccttcatggctaactaaatctagaatcatgcacatataacaggccaatgggcatgtagagagtctattgattctgttaataatcatctggtaattgattgctctaaagatagaatgaagtctcctaagcatccataagtacaagagaaaactgctccaaagttgcccaaaagttgaatgccagtagtaacacccaaccttggtccaaatttccaaaaatgattcgcaaaagaaacatgggcataagtcagatctctgatgaaagcggccacacctttggggagcgaagcggcgggagagtcggagaccgtgaggccgcagcaagggtgagcgcctgtgcacaagagacatgtaagaaaaagattggattagatatttagaagtaatatctgcttgactaacactgctgcagtagaccggactcgaaggaagagagagagtgagagctcaccggaggaggagagaggaggcggccgccgtgagcttcgccgccgcggccatggccgccatgagagaagcttcgggagtggtggtgggttgcggccgtgcggctcccaggccgcgtgctgggatagtggtgggtatccgactcgacgaccgtccgatctaacatcgacggcccagatggggtaacctagcatttcgaggcccaacaggccgaggctacaaggctaacccacccacaacgaagcccattaatcctttcccgaatcatccctctcggaaaaaatccccaaatcgatccgcctctctctctctccccccttctcgccggcggccggcgcggcgcggcgaggcggattcggcggcgatttccttcctagggtttggtcttcctcctcccctccggcctcctctcgcaccgacggcatcgccccctcccttctagatccgcctcgccatcgaaaaccctagacgaccacgagccgccatgaccgtcccccttcccaccacccgccgccgatggcggcatcgacgattacaacctgcgattaccgtcatgtcgtgcggttcgttcgtctccccctccgcggcgacgcctcgagcaggtaatccacggggttggggtacctagggttagcgtttgttcggtgaacggggggcgtccgttgcacggcacgacccgaccactggctcccgcatccatggcgatgacggcgatatctcccgtcagttgcatggtccccttgcacaaacgcccagaccaagttgatctcggaacctaatttacatcagatatcgttgccttgcactgattttagggattagggtaaagtaaaggccttataaatgtatgttcccatgaaatctaaccggacctgttgtttcccattcatgccgttgattgtagggcttgcttgtttaggttaggtgataaaaattagaaaatgcttaaagtaaagcagtagtgatgtatttctttttttttcttttttccaatctggatgttttagagatggattgttttctatttggtttaggttgggtttccttgtattctcttagattcgttgggtttcttatcaacaatgttgtctgttgactgtgttgtttgtgagggatatgggtttcattgttttgttccttgtgggattaaacatactttagataagtaaattgggctgtatttgtacaattggtagcatctgccctttggccttttatttgctactcagtattgtcggcatcatccggtttgtttggaatttattggataagattaatggggtttctgttaggatgcaagtatgtaactgggcttggtcagccaacccacacactgatcattcagttgctttaccctaatatctggctttgttcataaagatgccgtacgatagctataggccatgtgcagagattgagtaggtgggtcatccatcccacttgcatacgtactactaatatgtgtaagagtttcttgtatgatgttactaatagatggctctgaaaatgtacttttttttgtccatatttaatttttcagtgtccttaccagaaatatctctggcctatctctagagctgtattgtctgtggtggtggtcccttcaaagttttgtgcaatcggagcatagctatcttcttttacctctaggttgtgttttagcagctgaacaagtgctgtaatcctttctctacttctttctgccccccccccccaaaaaaaaaaaagagagagagagaaagaaaagggaatgtcctatcttgctatgtttctttaagttggttctgttttccttccttccaaatgaaattggttcttgtgaatcaatgtagcgtccctttacacagtattgttttctcccagttgtcttgtctttttatttgacttttcatatatgtaagggaaagaagaaggccttagagaaaaaaacagtagaaaaaggaaaagaagataggggtaagctcatcctagaaccctagttggcttgcagtcaccttcttcctcaccgcaatggctggtgccttatctgctcgtcatggaggctggtgcctggtggagtacgatgcctcttagggcacagaagtatagaacacgtgggtatgaagacctatgttgggctttggtgggctggctgcctggcttagtgggccttttaccaaataccccctttcttcttcctaatttctctaccatgttctccactaatcacgcctcaaccatctcatatggcaaagcaacgccttatgcctcagcgctatggcgctaaggcagtggtgggtcgcgttaaactgccttaacaacactggtttcatatatgtaaattgggttgtacttgcactgaccttttcttttgcaccctgttgccttgcataaatttgttggtacatggctgatgttttactcactgttttgttaagattttacagtttgtttggaattttgttaattggtgggatttttgttgggatgcaaccgggcttggtctaccaacccagataccaatcctttgcttgctttaccactaatattgagtattgttcagaaaggcgctgtgtgagctgggtttctgcctaggagctaggttacctgttaatacttgtgcagcaggcgggaggatgccgcctagcgcctaccattgccctagtatgctgggtggaaccttgtcactggttataggtccatgtgcagaaagtgcggtaggtgggtcagtctacttgcatacctactttgcctcgtatgtttgtaagagtttcttggatgttctatcttgcttatctgtactgcatatagtctgccccgaaaaagaagatttttctgttgatatttgttatcctccataattaacttctcagtgcccttatcatagaattatctccagggaatgccctacgttgtttgctcttgtagttggttttgtttgcctcccttcatatgaaaattggttgttgtgaaccaatgtaaccctttacatccagacgtcttttttg

SEQ ID NO: 19875 - DNA, 450 bp, Oryza sativa
atgttcccaaaatgaatctgcagatcctctccctcagtctgttggtcattcaatgacagcaaatggcatgaacagtgagtcgttgcagtctccatcttccatgcaagacagtcctgtaagataaaactatttcagtttcaaagagtgtatcttgtggcagcgaagtgataaagggagatacattgccatatgcaatgctgcggccaatagttgttccaatatcacgaagaccatcaagatctgaatttaaggggggtcatgatcacaggagcccatgtgtgccttcaaacaggagggatattcctcttgtacgaagacctccatcgccagtagtacttagtgttcctcgagtcctaggccgccgcctccttctcctgtgggagagtcacgaaaacgaggattccctattgttagatctggcagctcaagcccaagacattgggggatgag

SEQ ID NO: 19876 - DNA, 669 bp, Oryza sativa
tttccgcattcaccaatgtatcaaggttacttataattctccctttgctggttgattggacctttcttctgcagtatgtgttttttaagttgtttgtatctttattttctcaccttctggaattttgttcttactattttctgggttatcatactgtgtatggtaaacttcagaatttctaaagcaatattttagtcttcatactgtattaggactaactttgtttggccttcaagcatcaattgttggtaacaaattgcgcatatttactaactctactgtttgatcatttgtatggcaggcttttgctgatgcttttactgttctagaaaatgagctgctgcagttcagtgcagaatgttacacacctgtgtcatcattcaacctactgaagaaaataatgccaagtattgatttcgatgagctatagagatgagaagagcctagggattccacacagtacaagcgatgttgggctggaatgtcctgtactgcgtcctggacactcagaatggttatgtcaattattaaaaaaggtaactattaacaccacatgtcaatctgggtttcactctacatttgctaggttacaccctaatattagtcctatgagttgcaacataagtaatgtaagatagatatacaaagttgcaaactgcccatattcaa

SEQ ID NO: 19877 - DNA, 7158 bp, Oryza sativa
caacaggttgaagtggttggacgatgaccgtcatgaaataccaataacaacaaatggaaggacgtttatatcgtgagacactctggcagttaggctatataaactcgtggaagacgaaaagcatgttactaccttcatctcaaaatataagggatttcggcaatgcaaaaatcccttatattttcaggaaggaggtaatacctacgaagaaatctgctccaacgtgtagcatcagttgaactgtggaagtgtcactggcagtttgtcgccaggcataacattggaagcacgagtgcacgactggtgtgcggaagcaattgtacaaaattacgtcaactaagagacatggaacacaactgattccctggagcagtcaaaagggtaccctgagcagaacaactgattttcggcagagaacttcccaagttataggaagtatctgttccatgaactgtagtactaatttagaatttaagttaattcacccttaagttattatacttttcatggatttcggattgttgcagtctgaactatggaattcaagttatacaaacttgtaagaacggcaccgtagtgtatagtacatctggatgaaatgttgaatggcatatgaggccaaggcgtttggtggcagatttggcatttggatgaaatttacgtactgcatacagtatgcaccaagtagagtctgcacattgcagacacattttttctgcccgtctgcaggactgccggattgccggtgacatcaattttcattctcctcccaacagtcacagcctcacaggtcatcatgactgcatgtagtattatgcatgtagtattagggcacccacaatggttatctataggctctctataagagatccatgtcagcatattttcctacttggaagagattaaatgaagagagagagcaaagctatctactaacctggagatagtctatagagaaaaacgaggcaatgtattagagagctatagatacccatgtagacatactattgagatggtttactattaatctagtctattgctgagatgtacatgttttatagatagcaccttactttactattgcgggtgctcttagagcaaggttaatggtatagccaactactggctctaatttatctatagccaatttaatagctaatttatacaatagttgtttattatactattagtatatggtctcactgtcatacacacactgcgtcttggagttcgtgttgcagctggctacagatctgtagcccactgctcttctctctcatcttttatctcattaaaatatgtttatagctggctaatagtctgctattgtacctgctcttaggcgtgtgttaatcccttggaaagaacccgtcggtgagaataacgaaacgcctagctcgagagtgaccaaacgattcgcgttctacattcaacccgggcgtcgcatgcgctcctctcgttccgatattaatccagtctccacttgcctctacaaatctacatatagggtactcgtagaaggagttgcttgagccttgccatctcacgctcgcagtagccgtagtgcgaacccaccacaaacaaggcaatcgatcggcagcaatgtcattttcatcgtggaacctcaccgaggccacatcggctattcacgacatcacggtgaacggctactctgccaccaagtccggcggtgaaaacgacttcccgtccaggcgactcaccgtgggtggttacgagtgggagatccgctactacccaaaggtgttcatcacacatggcgattaccgtattgcgttcaggctcgtcttccttggacctgcaggggcgagaggcgtgaatgcgtcgttcagctgccgcctgatggatcaccgctccacttggacggaggcacgttggcgtgatgcaagcgggaaccagcacgactgcagggctgaaactgtgtcacgcaaatttcacctcgccagggagagctctgactgggttaagctcattaaacaggacgatctggagaggagcccggctattttagcttgtgattctgaatgaggtgcgtcatcacggtgctcaaagatcctcagtagtacgtaggcactaggcagcatacccatggtttgatgccgtttgtccgtatggattggatccagagtgccgtcacctccatcctagcagctggtgggtttctggtttgccaagagaagctttactttaacttatacatgcatttcgatatctacttaatcatgcttgcggttaattagccccgaaatggtcgtatgattataagattatatttaattgatgcctgatgctattagtatgttctcttttctcatggcgtttgcaacgttgtcatgattttttttttttttggtaaacgttcgaatgtagcatcggatcaaagaagcagaaggggttggcccattgttcacccagagcaagtttttaggctctcttcaaccctcggctctgctacctgtatattcggtccaccaaacggtgtttacctaatacctactgcctccgttccatattacttgtctttttaagtttttgtttgtcaatgtttgatcattcgtcttattcaaaaaattttggaattattatttattttgtttatcatttgctttattatcaaaagtactttacatatgacttatctttttttatatttgcactaattttttaaataaaacgaattgtcaaacgttataaataaaaaatcgaaaacgtcacctactatgagatggagggagtactcggctactcgtttcctctgaaaacgttgatgataggatcaattcccaattcttctgtcaaatgcttcacccaaggtcagcacgactgcacaggtccttgtgcccgctaatgcttcgaaaaagaaacatctcttaaaaggaaaaagtacagcgaaggtccctaaacttgtcgtcaagttacaaaatcatccatcaaccgcaaaatcagatatcgaccgtcccttaactaatcaaaactggtcataatagctccttcgatagtgttgaccccggttttatcctacgtagcggctgagtcaacgtaggacccatgtggaccccacatgtcaggatgccacgccatctctttcccttcctcctcatactctctctcttctcttcttctttctcctcttctctgggcaaactgttcggcggctggggaggaggccgccggggcgacgcggcaaaggaggagagcggcgctgcgacggctgccggcggcggccgcagtggggaggcggccgttccatggaggccacatcccgcgccagcaacaccaacaaccacccggcagcgacggcgaatgaggggatgctctcctcctcatcggcgtcgacgacgcggctgtccacggggagacagccgttgctcgcccccggccgccgccagcttctcctccgcctcccgcgccgagacggcgacagccgcagcgcacgcatcaggcggtcgcggccatcaccatcccgaggttagtactggtttccttttaggcgaatggctgctgcgcctcgaggagagcggggtggttggggtacaggcagaaaggaaggaacaccagcaataaaatcaaagccagcacctcatcttcttgttgaacttttcagacgagtatgcagcaacaaaccagccgtccagatcaaccccaactcaacctggcgagcagaacacgatcgagagaaaaggacaaacttgtgtgcatatgtactatgtttaccatgtcaacattcacagataattccatgaagcaattctatataaatcctgccattttgagcaaaatgctcaagtgtatcgtctctgctctgagttctgaactttgaacatgcaatcgaaagcagaacaagatggagcgctcttcttccaagccggtcattgcgctcgtgctgctcgtcgtatgcatcgtcagctgtttcgaggttgtcactgcctagtacgacggttcttccagcaacggcgcagcggtgacgggccccatggccgccggtgggaactgctcacttgttgttgctgccgttgtgctcgccattgcaacgtttgtctggaactgaaacagtgagatggaaacgctgcgaccgcctgatgcgtgcgctgcggctgtcgccgttccgggcgcgggaggcggaggagaagctggcggcagcaggggcgagcaatggctgtctccccgtggacggccgcgtcgtcgccgccaacgagaaggttcgccgtcgccgccgggtggttgttggtgttgctgacgcgagatgtggcctccatggaacagccgcagccagccgccgtcgcggcgccgctctcctcctctcccgcctcacccggtgacctcctttccagccgccggccggcttgcccagagaagaggagagtgagagagagagagagagaggaggaatgagatagatgatgtggcatcctgactcgtgggtgccacgtcggtccacactgactcagccgccacgtaagacaaaaccagggttaaaaccaccgaaggatctattgtgaccggttttgattaattaagggacgaccgaaatctggttttgcggttggaggatgattttgtaactcgatgacaagttgagggaccttcggtgtacttttcccctcttaaaacatgcgtgattttttaacggaataagttcatctgaggttccttaacttgtcaacgaatctgattttcgtccctcaaccgaaaaaccagacataacgggtccctcaactatcaaaacaggtacagataaggtcccttggcggtattgagggtggttttggcggacgtggcgcctacgtggctaatttgactcggtctttatctgatataggcactgatgtggcgcttacgtggcaatttaatccagaaaaaataataaaacccatgagacccacgtgtcagttccacacacaaaataataaaaaagtgggcccacctgtcattctcatccctcttcttcctcctctctctccccatctcccttagggtgtgtttgaggggaaggggattgaggagattgagaagatacgcaaaacgaggtgagccattagctcatgattaattaagtattaactattttaaatttcaaaaatggattaatatggttttttaaagcaactttcctatagaaattttttgcaaaaaacgcaccgtttagtagtttgaaaagcgtgcgcgcggaaaacgagactcaatctccccaaacaccctggaacgaacggtgccttaatctctctctcggattgggatcctctctccaggcgcaacggagaggcagtggcgcatggcggccggcgggagaggagggagcggcgcgacagcggaggcacggcccggcggctgtgggcggaagaggaaggggcggcggagcttcttttctccctctcggtctctcccctctccacgccatagatctctccctctcccacttacccgcagccatggcggaggacgcccccagagccgccgccgccgccgagggaagccagcatgcgtcggccgcggagggaggctccgccgtcggcccgccgctcccgcggcaccagtcgccaaggccgcggaggtgctgctcccgtcgctcagcatctggccgctgtcgcagcgcacgccagcgaggagcagacattgatttgattccaagattatttttttttagcaagggtcaagaaccccatttcttaattaaccctttcttttactaaaaatgatcgtaccagtacaggttcagccaaagcggcaagcaatttgattccaagatagtatcagcttagctagcagtggctagctagccatgagtaatagtggcaaggagcagcggcggatggaccggttcatcgtgatccccttctccacctgccgcaatggatccagcgtggacgtcgtcgatggcggcggcaagagcggcaagaagccccaaggttcgttgtttggagtcttggatgcttattcttcacttctgctctatcttgtcgattgttttttgcggggtgatttaggagtttggtattagtgatgttgtgtacgtgtctaggcggcggcggcgagggtggcggcgcggcggaccaccaccgccagcacgtggcgcacatcggctgggacggcagcacaaacaccaccaccagcctccgctcatggaaccgcgccgcgccgccgtcctcctcctcctccaccaccaccgcgtccacctcgtcagccttggcggcgccggtgacatcaataaggagtcggcgccggcggggcctcggttgtgcagctcatgtcctaccgtctgccgcagccagggccaactcccaccgccccttcctcttccgcccacagctgccggagccgtgcctccaccgccgcgccgctcccttctctcccgccggccgccgtgcgccgctgcctctccgtcgcacctggagagaggataggggagagagacgaagagagggagatggagggagaggaggaagaagaagaggggtgagaatgacatgtggggcgcacatgggccccaccattttttattaattatgtgtgaaactgacatgtgggtcccacgggttttattattttttcgggtcgaattgctacgtaagcgccacgtcagatgaagaccgagtcaaattagccacataggcaccacgtcatccaaaactggcctcaaaaccgccgagggacctcatctgcaccggttttgatacttgagggactcgttgtgtctggtttttcggttgagagagaaaaatcggattcgttgacaagttaagggacctcaggtaaacttattccgagagagaaagagggagaataatgggctttctattaatggggttttgttaatgggcagtatttcaggtccatgttgaattgggcttaactgtgtaggttaccagtttgccactgacagcttgaagagatattctcccccccccctctctctctcttttcgaaaatgctaatggcgatcgattgcccctagcgatcaccctcctcctccatgtggttttcttttttggcactgtattacttttctattttagtaaatttatacacctaaactttgtacacctcaagtttacatatctaaagtttatacacctaaagtttagagacccaaagtttataagtcaaaagtttatatatccgactcaaatttgaatttaaatt

SEQ ID NO: 19878 - DNA, 20341 bp, Oryza sativa
ctggtttttcggttgaaggatgattatgtgattcgatgacaagttaagggaccttagatgaacttattccttttttaaccatcaaaatggggccaaactgtggttggttcatgggcctcacgccggcttcaaattgggccacagcttcgtctcgcgtcaaagtaccttggaataagttcacttaaggtcccttaacttgtcaacgaatctgatttccatccttcaaccagaaaactagatacaacgggtccctcaactatcaaaaccaaagcgggtccctcagtggttttggtttatgtggcgtctacgtagcaggtttgactagctctccgtcccacgtggcattgacatggcaattatatcttggaaaataataaaaccgtgggcccacttgtcagctacacaaaatatcatttaaaaatagcagggcccacgtgggcccacatgtcagctacacaaaaaaatactggtggggcccacgtgggccctacaagtcattccctgccctctcggctctccctcttcttcctctctgctctccctcgtcctcgcagcggagcaacggcggcagcgggcagagcagaggcacaagcggagcggcgacgacctcgccaaggacgccacgcgtacctccgacgcgagaggagcggtgacgcatgccggccggcgggagggagggagaggagcggcaggggggagctgcacgcagctgccggcgggagagcatcggcggcgcacaccggccgacgggtgggagggagattagcggctgcgcgcgcagcgctgccggagagggcgtccgacgggagcgctgcgagggaggaggcaatgcgcgccggccgacgagagggagggacaggagcaacggtgcgagggggtcggcagccggcgagtgggcagaagaggagcggcagccccccggcctctctgcccttgtcggcattcccctcacagcgagcggcggccgtcgaccgtctccgcccccctcgtcggctgtcggctttttccctctccgtgcgcgcttgccggccgccgaggaaggatggccgggagggagagagagagaaggagacgcggtccggcggtccatcgtctcccgtcgtccatggcatggatagaggagggtgggacccactaacatgtagatcgtactatttttccttttgtcttactgacatgtgggcctcgcagtttttgtttttatttttttatatattttgcttccgttgccacatcatctacaccaaggacgaaggcagagttaaactagccatgtatgtgttacatcagccaaaaccatcatcaaaaccgctaaaggacccgttgtatctggtttttcggttgaaggacgaacatcaaatacattcacaagttaagggaccttaagtgaacttatttcaagtaccttccacagtcagtctcaagtctgcgttggtagaagggcgcgttgaaacggaaagatctctcaaaatctctggatttaacagagcgctgcctgggaaaacgcaagcacgattcgcgaaacactctcgagagcggtacaacggttcgcgttcacccaagccgtgcagacatctgtatataacgctccctttgctcaggctcgttcgcctccgctagcttgcctgggatccgcatcaatggcgccctcctcaaacctcacccaggccgcgcgcgccgtccacaagttcaacgtcaatggctactcggccacgaaagccatggccaaacacgagcatgtctcttccaagcgtctcaccgtggccgggtatgcgtgggagatccactacaccccaggccacgatgcgcactggcactactgggtcgccttcaagctcgtcttcctcggcatcggcgagcaggcgcagcgcgccggcggcgacgacgacgacaacgacgctggcgccatcaaggcgtagctcagctgctgcctggtgcacccgtcgaccacgcgctcccatgcttccgaggagaagagcgacagtcgcacgcgttcgggtccgcgaacgagagctcgccgtgggttctgctcgtgaagcggagggagctggaggcgtcgggtttcatcaccggcgactccttcgccgtgcgctgcaccatcacggtgctcagcaagaacaccatcaactcggccgagccgtcccccgaccttcacctgcagctcggtgagctgctgcggagcgggagattcgccgacgtcgagttcatcgtttccggcgtgtccatcgcggcgcacaggtgcgtgctcgccgcgaggtcgccgtccctcgccgccgccgtcctgaaaggtggcacgaggaagaaggatgggtcggtgcgcgttgaggtcaaggacgacatgagagccggcgtcttcagggcgctgctccatttcatctacaccgacacgttgatggagctcgactggagagaggatggttctgatcccctgctgccgaggacgatggtgatgagcttgaatgaagccgcgggtcggtatgggctggagaggctcaagcagatttgcgagaatatgcttggatttgacgatgcttgtagtgcagattgtgctgtcatgtaacgcatgctctgcatgctgccaaccgttgagaactcttttcttatcgttgtttgctacttcgtcacgagtcacgacgagcaacgaaccttagatctgtgactcgcgagttgtgaacttgtgatgggtgtgctaatgcagtgcacaatctgtgcttttatttacatccgacatgtactcgtgtatggagtactggatttgagataatgaaaatggattacatctccagcttctatcataagacacacagtcataagtttaataataaaaaagggtaaagataaaattaaaattaaaatgagaaataaggcgatgagacaaatctccaacttctctttattatggactagcgttaaaccacataatgttctttagctagcaattctaatggaactacgccacctatagtggaataagagactattggctaccgatttcaaaagtgtagcactgtcgacgggtgatacccgtagaccggatatagagggtattggggtacgctggtacaaagatctacgtagtacgacatcgagcaatcaaaagacaagaattatactggtttaggccccttgacaggtaatagccctaatccagttgatgtgggattatatggtggaaaacacaggttacaaaggaaaagatgaaacttgtcagatccggcgagattgtagtcgagttgattcgactagctctcggcgacttggctcctcgcaggctccggcttcttagactgtgtggattctgagattcgatgatctatgcccttctcggggggtcccttttatatgacaggtctggtactctccgagtaggactcgaagataccagacctagcacgatacgtaggtaacccagttcttgtccgagaaggactttttcccgtctattgatttcgtgaaaggtttccttagatcataaaggaaatatccgcgtgcgcgtgggtatgccatgtcgatacgtatcgtatatcgaagggtagggggtatgcctgacccgtaaccctgacagtagcctccgacttttgctcaaaaacgaactcatgcgaccattcgcgacttcgggcgtctagaacgttatcattccgggtgcgagaatcgcggagttgatgtgtagtcgagcatcccgtttgaagcccaacagtcacgagtgaattttgaactgaagtccaaaaactgccgcgcgtaatagacttagaaatttccagcggggatttctctcagttccttggaattcgcaccgttgggggtgcgcttatttaaagggattttgggtgcacgttttgaagtccgccaactccgtcaaacacaccacctgttagcactcctcaccttctccgctgccgtaaagaaccctagcttcgccagctctaggtccatctccggcgatctttcagcagcgatgaatctcggcaagtcggcttccaccagcgcgaccctaaagaagctccaggaggacggcgcccttcctggccgtgaaaaggcggagaggaaagcaggaggtactaatcctcagcccatcttaggtcgcatggttgcgatcgaagattatgttgttgttaacgaccaaatttggtaaattctatcactattggcatcggagatgaagatcagatcgaagtggaatccaagatgaagatcgttgcggagacagagtaaaaattggctgcagtctaaatcagctaaggtcaggatcggcagagttcgagttggacggggctagccgatacagctgattccgataatatgacccggtgaacgtcatcgggtttaagttgatgtgcttcaaggtgattgccatgcatggatagagtcctgggaaggcaattgtatctattaattaggatattctatgtaatttccttagagatatgtttgggcaaaaagtctgccgtaaagacttatggtatcttagagtttgctagagataatagtcgtgtccgttatggacgtatcttgtaattctcgtgtataaatagacccgagccctatataaaaaagagataacacatccaatacaatctcggcgcatcgccacccttttttgctttacttttatttcgacgagttcgtgctctcgggttgagctacatcggtttcgatcttcaacaaagaggtaaaacttgtcatgacgacttatgttctcaggattagtgcttccatctttatgacactctaatcttgtctatataattcgtcgagttatcatatatctcatatagtcttcgataatatctttatctaacctataatcggctaacatctgctaatggaaggcagccgattaggttatacaatgacgttaacttagattatgtgatatatctaccactctataaaacttccagcggcttgattatctagatattgttcttcttttcatacttaatgctgcatcagttgagtttgatctattaagtcgtgcttagaattgcaatctctagcctgctttctggttgccaattagggtaatatcggagtttcagccgatcttatctgatttaactaattttattttatatgcttgattgatacgttaaatctgccctttatgttaagattttattgcatctaagtatattaagcttatgtttggtatattctacttgctttaatatcttagtatagagtggtatcggagtattagccgatacatgctagatttacctgatcagctatgttatgaatgtatataatcctactattaatatatatttcaatctaagtgatttatactgtctcggcaaggcgaccgatctatcccaatcacttgatttaagtatatactgatataaggattatatatcattaatgtctacagttgatcgagtagatttagttctgaattgcttattgatatttgccgatcgatgtacgcatgacatcggcttgaaataaatgatatgtcatcagcacctagccgatcggctatcatttataggattaattgcggtttctttgttctatctcttgttgattgcaggatcaaatcaactggcacactcatacatccgaaggcgagctttggacctgcactggagttaagcagatctcccaggcctcgtgttttatatcaacagttgtctgcaggtttctccctccaccctccgaattccttctgctggttttgaatttctatgggctttctcttctgcatttgaaccccaattccattgctttccttagcgtctttgtgcatctttgcgaggcctacattggggtagagccctttcttgatctgttccgcttttactacgagttgcgctggatggaatccaatagggtatccggttgcgtcgggttccgacttcgtgatggcatgaagtcgcattatgtccccttccaatgtccctcttctcgcaacaaatggcggaacaggtggttttaccttgaaatcaaggattcaaatccggtcctcgttgttcccgaggaacaaccggacaagattccggtctggaccgccaaaccctccttgaccccctctctccaaccgtttatcgacatcatcgatgatctccgagaacagggcttattgggatatgaagtcgttgcagacttcatcggtaggcgaatccagccgctccaggctcgggcccatccggcttatgactattccgggccagacgacgcgacctgggtttctcctcggggtatctttctcgcattcatttagacatgcttgtactcgcgttactcttcaacttatcaaaaattgattcctttttgacaggtctgagcagcgaagccgtggagcagtgtgttggtcaggtgatgatcagcggcccgaccacggcgagcgacatccccgcacccctttgtgaaaagggtgcgacggagcgcgacgaagcaatcaatgtgagttcattcgatagcgtcccgccttctctgctcgaaatcagcttatgatatgatttagcgtaggcccttcctttgactgatgtcgtcggaccgctcgcggatcatcaggtggcggcatctctgaaggagaaggtcgtcaaggaggcgtctgacgctgctaccaccagtgatggcaaagctccgaccaaggcgaggaaattctcgtatgtgctcggacatcgccgcaaggcagcgactccctcggtaatttcacctcgtcgctatgttgtgtagcaaggaaggtttattctcactccacattggttgtcttgcaggcttccgacgcgtctcctccacctccgcgacgttagcgcattgtgacgatcggcgagaagttagtaaacagacttttggattctcgtgtcttctattcaaatggagttttgattcgtggttatttgtagggaggcgcgggcgaaggctgcgcgggccaaatccagaggaacgtccagcgcatcccctgccacggtgtcgacagatgtcgtgcccgtggtcgggagtcgggaggcgacgccaagcggccctgttagcgatcccgctgagggtcgtagtctggcagaggccgtcctcacctaggaagagctccaagtcgaaatggggcgccttctcgaagctggtgctcgcggcaccggccgcgagatctcagaggcgagggtggagacggcggtggcaaacgcgcgtgccgagcggttggtgcgggaactggctgaggcctgtgaggacctcacgaagatgagggagctggtggccgggaacgagcgccaacgcaaagggctcgaggaccgcatgtcggaacttggagacaatctctctgagatccgtggttcgctgcgggtcacctacaccggccttcaccagctcgccgaggagtgcggcgtcaagtccacgatcccggtgaaccccgacgagttcttgttgacttcttctcttgcggagctggcgacggtgataggggaaatcccctccaagcattcggccaggatcgcggaggagacgtccaacggtatctacaccggggcgtgtcacatcctcgcgtgtgtaaggttgtcgcgccctgaactcgatctgcgtgatatcttggatcagggggcggcaagcgacacgcgtaaggaggtgatggaagaagtcagtgacctgggggagtctgtcctccccctttttgaagagtaggacttcttgtattttttataatttgcaaatcttgaactctggttgctttcgggcgtatgattaccatccttgttcagtgttgatttcggaagtttttcttgtcgattgtagagatgctggtgacgaggatgttcagcagcgcgggtagcccgagtcactagcgataattccggtacttgagtttgaaccacgcgtctcacatgacgtcgaggaccaaactcttgatgtggaggtcgagatggggacaaccacctcaagtgagtagcctttttaacccgtgttgggttagtggtttccaggttgtcttagtggtcgttatgtttagcagatctcgaggatgcccttgcaacccaagatcgtcgtatccaatattagaagacaaaatttgaagtggcggaactctcgagaaccatgctagccgtgaagaaagagcaagccatggaaacgctccgaggacgcgaggtgtggtttgcgtcatatttaaagagttgctgtacctcaatggcccgggtatgcggggagcttcgagtagtccgcaacactcctgaggaatcggcgaccgggtacatctcgtggctcaacggggcctgtgcccaactcgatggcatcggcaggcgtatcgatgaggccttgaaacaagagtgtcgtcgagcgagtcgatatgccggaggacatgtgctagcttgcctgcgagatcaccgcccgcgcctggatctcgaattcctccatgaagggtttgctcgttctcggaggactccggcggagatagaccaccttgcgaggtcgatgacgccgttagccgagaaggtattccagtctatggactggcattggccctcttggtaatactcgtggcctgctatagatgtcttaggaaaaagtgtaatgtagtgggagatctatgtaaaaaacaagtaagaattattatgtgaataaagaaatattccttaaacaaatgcatcttactctggatgttatgtgttagagtgtgttcttagttaacgacctcggctgtttgagtcgtacactctccctagcccccagccttgtcgtcggagaaattttcttggatgataaggctcttggacacttgatctgcctaggttgaataagctctgatcctagcccccagccgtgaagttggaaagctcggtttccgattacacggcttggttaatacgcacggcgagaactcttacacgaccagatcttacatggtctttcgtctctgaaggatctgacaaggccttatcggttctgggcatccccagccgaagatcccttaggttcctcggaggccttgtcgagacggcgtaaagggtcataaggatatgtttcaacgttaggtgttatcagagtaagggatcgtcgagtgaaaacactttggtcgtggtatgaaacctagaaataggctttattgatactgtaagggtgcttacaggtacggtgttattgactcatacatagaatttacgtagttggtcaatgttccacgaatttgctaattcgcgaccgtcgccgtctgcgattttgaatgcgcctggccgcaagacttgtgtgatcgtgtagggtccttcccattttggtgagagtttgttttgccctgcttgggtttgaactcgtcagaggacatagtcgccgatcgaaagtatgcgtgctcggatacgcttctcgtgataacagcggagggcttgttgatagctagctgctcgaacagcaactcgctcacgatgctcctcgagaaggtttacatcaatgtctcgctgttcctcgtcggaatgcttctgtactcgtgtactttgatgtcgtaactcgccagagagcatggcttcagacccgtacacgaggaagaagggtgtttccttgttggatgttgtcggtgtggtgcgtacggccaatagtactgatgggagttcttcaacccattttttgtcatgtgacatgagtctgtcgtagacgcgggtttttatcccttgtagtactatgccgtttaccctttcgacttgtccattgctttgagggtgagagaccgaggcaaaacatattttgactcccaaaccgatgcagtaatcctggaagtcggcgctgatgaattgagagccgttgtcggttatgatgtggtgcggtagtccgtatctgcagtatatccctctgatgaacttaatggcgttgtcggccttgatttccccagtgggtagtgcttcgatccatttggtgaatttgtcgatcgccacaaataggaatctatagccgccctgtcctcgtgggaatggcccaagtatatctagcccccagcacgagaacggccaagtcagagggattgtctggagcgcttgtgcaggtagctttgtgtgcttgctgtggaattgacaggcttcacatcgctggaccatgtcgcatgcatctttaagggcggttggccagaaaaacccttgtcgaaaggccttgccgactaatgtccgaccggcggcgtgtgacccgcatatgccttcatgtatgtcgaagaggagttgtctgctgtcgtcggtagagacgcatttgagaagtatcccgtttggcgcttttttgtataaatcgttaccgaccatacagtagatctttgctttacgggttattttctcggcctctgtgtcgtcctcgggcaattcctcgctgctgatgaatttgattaatggggtacgccagtcgtctgtggtttcgatgtcagcaacgtcacgttctgcctcggtgacctccgagctaatgttgggggtgctcgggccagactcaccgttaacttctttcaccgatggcttcgtcaggacgttgagaaaggtgccggggtcgagcggttctcgtctggatgcgcgtcgtgctaggtcgtctggctcgacgttgtccttgcgatagacgtgtcggacctcgatcccgtcgaacctcttctctagcttcctgacctctgcaagatacttggataactcggggttggagcatttgtagtctttgtgcacctggtttgcgactagctcagagtctcctttgacgattagtcgcttggccccaagtgcggctgcagctcgtatcccggcgagtagtccttcgtattctgcagtattattggttgccctgaagttgaggtggattgcgtgcttgaattgatctccggagggagatgtcaagataaatcctgcccctgctccttggctgttgagtgcgccatcaaacgctattgtccatgtctcattgtcgccttggttgtctgacttgttatctggcatggtccaatcggccacgaagtcggcgagtacctgagatttgatggctgttcgcgacacaaagtggcatatcaaattggcttagctcgactacccatttcgcgatgcggccgacaacgtctttgtttctcacaacttcgctgaggggaaggaggagacaactgtgactctgtgggcttgaaagtagtggcgtagcttccttgatgtcatgatgactgcgtagagcagtttttgaatctgtgggtatcttgtctttgcatcatggagagcttcgctgacgtaataaactggtcgatgtactttctctctctcgactacaatgacagtgctaacggaatatggcgtagcggcaatataaaggaataattcttcattaggttggggagcaacgagtacaggtgggtttgataggtagcgcttgagtgcaataaatgcctcttcggcttcccgtgtccatacaaatttgtcttgtttcttcaacaaagcgaagaaaggctgtcctcgttctcccatcctagtgacgaatctgcttaatgctgccatgtatccggttagcttttgtacctccttgagtcttgtgggcgacttcatgttctcgattgctttgatcttctcgggatttgcctctattcctctaccagaaacaaggaatccgagtagcttgcccgacggtactccgaatgtgcacttctctgaattgagcatgaggcgatatcgtcggaggttgtcgaacgtttcccgcaggtcgtcaatcaatgagtcacttgtcttggtcttgacaacgatgtcgtcaacgtaagcctcgacattgttgccaagctggttgctaagtgcgccctggaccgtgcgctggaaagtgttcccggcggttattagtccgaaaggcatcttaacgtagcaaaataccccgaacggcgtgatgaacgctgtcttctcctcgtcctcttttgccatgctgatttggtggtagccagagtaagcgtcaaggaagcttaatagctcgcagccggctgttgaatccaccaactgatcaattcgagggagaggaaagtgatccttggggcacgccttgttgaggtctgtgaaatcgacacacattctccattttccgttggccttcctcaccatgactgggttggctagccacgctggatgaagtacttctttgatgaagccagctttgagaagtttgtcgagctcttctcgtatggcttgttttcggtctggtgcaaatctccgcagtctttgctttactagcttggcatcgggtcacaccataagtttgtgctcaatcacctccctggggacccccggcatgtcggacggctgccaagcaaacacgtcggcattatcgcggatgaaggtgatgagcgcgagttcctatttctcatctagtgtagccccgattttgacagtcttgtcggggttagcactggagagcggaacgatcttgatggtgccgtccggcttcggcgccttgtttggcttgctcactttctccggtggctcagacgtggcgggtggggtgggcgtttgttcgaccatgtcgaggctccgcctgtcgcactgcaccgccagctttgcgttcccctaaatagtgattgttcccttcggtcccggcatcttgagcacttgatatgcgtagtgggatgcggccatgaacttcgcaagtgcagttcttccgatgatggcgttgtaagctgtatcgaattcagcgacatcgaaggtgatctgctctgttcggaagttgttggcttggccgaaggtcatgggcaacgtaatcttgcccagaggtctggacgatgattggggagtaattccatggaagggttgatcggttggtgtcaacgcactttgcggaattgccattgcatctagagtgctggcgaagaggagattgatcgagctgccaccgtcgatgagaactcgcgctaccgtgacgttccgaatagtgggttcgaccacaatcggatatcgtcctgggataacagaggtcttggggtggtcttcatccgagaactctatcctctgctcagaccacttcatcttgggtgcagccccctgccatgtcgaacagacttcacgttccgctttcttgtattcccgcttggaggagtacgttgtggagccgccgaagatgtgtgagacgtggaggtcggagtctgggtacgcagaatccgattcgtgagaagatgtctcctcgttcttctcgataacacgtactcgcttgccttttttgaacgccatgtgcttctcgagcgactttttgaaaacaaggcaatcctccagagaatgtctgtccgttttgtgtatggggcatcatgatttctttgtatcgctgccttgtgggtctgggcgcttgggagggttcacgtattctgctgcgaggacttccgcttgagctttccttttcccgtttttgcgatttttcttcttatttgactcagaggcgtctgcggctggtttcttctctcccccagtcttcggcttgtcgttcttgcgtcttagcgcgtcatccacatgggcgcaccgctcaacaatctcgaataatcttcgagtagttgtgatgcgtcttgtcgccaactcctgggtagtgtagcgatctctaccaccggacttgaaggcgcgaattacagaagcgtcgataatttcgggaattgtgtttctgcactcgttaaagcgccaaacgtattccctcaatgattcccccgagttctgtgttagcgtgtgtaagtcgtcgttgatcgcgtggcgcttgtatgttccttggaaattggcgatgaactgttgccacaggtctgcccacgaagagattgagtagggaggaagatgcatcagccatgaacgtgcagaacccttcaacgcagttggtaaatagttcgccaatgcgttgtcatctgctccggcagcataaagcactatcgagtagacttgaaggaattcttcggggtcggtgctcccatcatacttttcaatggccccgggtcggaatctctcaggccatcggacatcacgtagggaacgaccgaaagccctacacccagcgctggggcggtgggttgtcggcggtcgcgtgaccttcgtggatgtctgtctgacgatgaagaggacgcggatgatgacgatgacgatgggtcgcttggctccggcgtacgattacgaggatgatgacctggatcccgagaatcttgttgttgtctctcgttgttatctcggcgccgatctccttcgtcgtcgtcgttgcggcgacggccatgactagtattgtctggcccccgccgttcgcgatcgttgcattctcggtcctcgtttgggcggtttcctcgatcatggcgccatgaagaaacatgacgccgagagcgatttgcgtcgtcccgtgtgcgccgtgcttctcggcgattgttaatttgatctcgaagatcgccagtgccacgaggtggaggggtagcctgtcgaggcaattccctccgctccggatcttcaccattggcgtcgccgattggtggctgatcttggtgtgctgcggtagcagcctctttgaacgcattgctgaggttagtcaccgactcccgtaatcattctgtccaacgctcgaggtcgtcgttcagaacgggatcgtaaggagtttccctcagtatagcttgaatagccctgatgtgctggactagagtagtcgattgattcgccgcttctgcgttggcttgcgctgacgtgccaacgtcatcgataactaatacctcccgcggcgcacttgttgtcgatgacccgtagtcttcgaggggatgtaagaccgatggttcgtgaggatcgagatcgattaccccaacgaatcgatctgaggctggagtcgctccctgttccttgccgttatccctagcggggacgtatgacttaggagacggggttttcatggcgccgaggagaactttgcagctcgagagatcgtgattctttgtcttgtggataggacaatagacatcccgagtcggagaaatacattgaattccacgttctttgcaggcgcgaatttcagcacggacgttgatgaatacccagcaatcttgaagggtatgtttcttggttttgtggataggacaccaagacctgatagcttcggaagtcatctttgtcggcccgtgatttatgtcggtgggacaagacttggccgcatcagaatccttcccgagtttggatgtagtcggtaatccgttctccgtttcaacgggtggatttttcgacatggagccgtcttggtttgtggccactgcgttctcgttttcagtcattggaggaccggttgagattggcatcgtggtgtaaaccgggaagacgattcaccgacttgagtccataccaacattgttgaagttgagaatgcttggctggagctggtgttgacattgttatcgacgaagcttgatggcatagtagtagaaccttgagtaccaagtccccctacctggcgcgccactgtcgacgggtgatacccgtagaccagatatagagggtattggggtacgctggtacaaggatctacgtagtacgacatcgagcaatcaaaagacaagaattatactggttcaggccccttgacaggtaatagccctaatccagttgatgtgggattatatggtggaaaacacaggttacaaaggaaaagatggaacttgtcagatccggcgagattgtagtcgagtcgattcgactagctctcgacgacttggctcctcataggctccggcttcgtaggctgtgtggattctgagattcgatgatctatgccctccccggggggtcccttttatatcgcaagtctggtactctccgagtaggactcgaacatatcagacctagcacgatacgtaggtaacccagttcttgtccgaaaaggactttttcccgtatattgatttcgtgaaaggtttccttagatcataaaggaaatatccgcatgcgcgtgggtatgccatgtcgatacgtatcgtatatcgaagggtaggggatatgcctgacccgtaaccctgacaagcaccattgtgcatagtatcatgctctttctgtggtaacatcgtaaatcaaaagtggagccagtaggaagacatgaagataagctgtatagggttagatagttatttaccattaaaactttatcattacaacaatgttaaattgaccaacatacaacactagctctaattataatcatctttttgatggacctagaaacccctctaagctaattacaaaaatatttttgtcgttacggtgtggagggatattaatatggagtattagattactagagcaacggcgaataattcgctcgtgtgttcgaaaagtcgtgggttgttcttgacttcttgccagtgctgttgtacatctcaatccatacatacatagctgtgttcgacactctttttcccgacccaaacagtgtacatggaaaatggaccgcacacgtgattaattaagtattaatttgattttttaagcaacttttatataaaaactttttttaaaaaaaagcactgcttagcagtttgaaaaacatacacgtgaaaaacgaggggaggggtttagagtgtaaacgctgcattggtcgatcatgccacaagtggggaatcaatttctatcctgcactgaagccatcggtcaaattatccaaattaattaaagagggaactcggtctgatgaattcgcctgttcatttccggaagcgctacccgaggagccatcgaacgatcgactagctcactttaatgaacgacaccgatatagtataagagtagatacaatagcagactataagtcagctgcaaatatattttaaagagataaataaatagaaagaaaagcagtgagctataaatttatagccagctatagcacggactccaagatgcagtgtgtgtatgacaggtaggactagatattaatagtgtagtatgtaaatattgtatgaataagctcttaaattggctatagatgaattggaggactatgctattaaacttgctctaatacaaaagcactcagctactgaagaaaaacaattccactcgcttcctcacctagccctctctccacgatacgtccagtccagccatacgattcgatcgatcgccatgggaaagctcaccgacgtgacacgctccaacgacatccagctcaagatcgtgggccactccttgacaatggccatggacgacggcgagttcttcagttccaggcggtattgcgtcggcggacacgactgggagatccgcctgcggccgaaggatccctgggttggcaggcgcgaccggccgctcacgctcaagctcgtcctgcgcggcgcgccccgcacaggcagcggcagtgtgaaggcccagctaagctgctgcttggtagatccgacgcagaagctgaggccgtcggagatgaagaccgtgtcgcataagttccacaagcccggtgactactcgccccgtgccgtgttcatggcaagggacgagctggaggcgtcgggctatctcacagacgattcctacgtcgttcagtgcgccatcaccgtgctccgagaacagccggagatagccgcggcggcggcagcggcgggcgacagcgcgaatgcagccgtggcgccgtcgtccgagttgcacgcgtaccttggcgccctcctggagagcaagaccggcgccgacgtcacgttcgtcgtgtccggcgagtcgttcgccgcgcacaaggctatactggcctcgaggtcgccggttttcatggccgagctgttcggggcgatgaaggtgaaggcctcggagcgcgtcgaggtcaaggacatggaggcgccggtcttcaaagccattcttcacttcgtctacactgacaccgttccagagctcgaccaccgtgatggcgaggagacggaggcagcgtcgacggcgacggcgatggcgcagcatctgctcgccggcgccgacaggtacgggctggagaggctcaagctcatctgcgagagcaagctcgccgagcgcatcgacgtcgacacggtgtcgaccacgttggcgttggcggagcagcacgactgctcgcatctgaaggccaagtgcgtcgagttcattgctgccggcacggctgaaaaccttgatgctgtgttggccactgatgggttcaaacatctggaggcgagctgtccctcggtgttgactgaccttgtcaaggttgcccgtggaagaaagaattaaaatgcaggtacgtgcgtatcagagatgtcatagctgaactgttctattgtgaaattttctctaggatttggcaatgcatcatctctgtttgtgctagaagttttgattgattcttcccagtcatggagtagtgcatactttgtacaagcccattatttgtcactactcactagtactagctagtattaccttggtcattcttgtatttttctcacgtgttagtacaatactactactgcactgcagaaatatgcttctgcgtttcaagcctttcaggctatgagaacatgcctgttgccactagtaatcagtacgtttatttttcagaaacatttctttaagcaggagaacctgttttttttttttcagaatcatcactagcttcgctctgttcttaatatttatttatgggccatttggcatctgagcaaaaattttcctattgtgcaggtaataagcagagaagatttcaagttgctcctggatgctggcgatgagctgctgcggacttgctgagagcaaacaaatcttcaatttgcttatatgtttgctctatccttttcttttgtgattttgccattggatctgttgtgtgatgcccatgatcatacggttctcttctgcagtgggcaattcgtagtaattagacgcaaccctgtctaatccctctgctactctgtctgtgtagggcctttcatttcagtttaatctgtaattgaaacgggtatatcccggttcagaaaaacatattggagtagttctcgccttcaaagaatcaaatccctctggggaaaatagattgacatttaggaatggagaggcacaatgcagtgatcagttttcaggctcattgccggtcagttttggcagggagatctgaaacaatgataaaccttggttctgaaaattttgtgctaaaacttgttttgttgcaaaacctgattttgcacagttgaactgctgactcaggatcaaatttattccatttctcatttctcataaagaaatttgctcttcaatgtacgatggagtttattttcctttgaacctgcataataatataccggtacgtgttaatgacagcagattggacacagcaggtcttgaactcttgatgaacgaaacatccccggcccaaccgaggatcacgcggcccacatcaaggattcggccgacgcgatgtccacgtcatcgctggctgccacgacagtatggattggacaagctcaaattttatttttcaatgttcaatggaggtttttttttcttttttcagaaaacctagacaacggtatcctgttggaacgggatactcttctataagacatacctgttgtggtaccagctacatagtacccgataactgtgatacctgttacccaacacctgtaatacctaggatctgatacctatgatactcgtgcaagagaataattaatatgtctatcctgttgcaacgggatcccgtagcagccctctccttttttgggctcagaacctccacagatacctgtccgtttgtagaatcccataagaattcgtcgacactgcggcggtgcaatatcattgcaaatctccggctcgtctaaaagttcagttcatcaaggggacaaattaaaaggagaaaaaacgaaaaattagttggatgttcattgaaatttttagggattgatggtttagcccttgttgtttaccttgtttccgaaacatttgtatatttctggtttgcttttgcgaactatacctgttattaattgtagatggtgggtactaaaacagactcctgtaacaagttatgtctctttgtaaatctagtgataaaacgtttcgatttgaaatccacgaagggatatatatatagccggtagttaacgctcgatcgacgcctgagcccagagacatggagaacgccgccatcaacctcacgcaggcggcgcggcgcgtgtagctgctcaggatcaacgggtactcggcgaccgcgaacaggcaaaatttggtcacgtcgtgtacgatcgccgtgggcggatacgactggctgatcgaggtcttcccggccgcttactaccacggcaccagctcccgcaactccggcccctacataaagctgcgcttcaccttgtcgagcgacggcgagcgcaccgtgtcggcgacgttcagatgccgccttgtcgatgatcatcagatcaatcaaaccgccgcgtccgcatccagctctttcaaggaggtgatagtgacatccatcttct

SEQ ID NO: 19879 - DNA, 2830 bp, Oryza sativa
agcaagaatggcccggacatcacgttcctggtcaccggcgagcgtgtcgcggcgcacaggtgcgtgctcgccgcgaggtcgccggtgttcatggccgagctgttcggcgacatgaaggagaaagactcgcagagcatcgagatcaaggacatggaggcagaggtcttcaggaccctgctccacttcatctacaccgacactttgccggagcaagatgacgacgacgtcgaggctgaaacaatggcgtatggtcttctcgaagccgcggatcggtacggcgtggagaggctgatgctgatctgcgcggagaaggtgcacgctggcattagcgtggacaccgccgcgatggcgttggctctggcggagcgccatggatgtaccaagctcaaggctaggtgcatcgagttcatcttggcttctcaggagaatttccacgcagtcgctgcaacggagggttacaagcttctcatggatagctgcccctctgctctgaatgaccttctagtggctgtttttctgaggtacaaattaactgttctgtaaccggaacatgtacgggatagaacaacgttcctagatagagttgagtattgcgagctcgagatttgaagaagaaaatagtgaattttcccaattacaatactccatcagttttaatttatttattgttctagcatttaactttttttaaaaaaaatatttatctttctcgcatttcaaatcatttttactttggcccgttctaactttataaagatacatatttttttctcgttttccgttggcacgcttttcaaaccgttaaacggtgtattttatgcgaaaaatttctatatatgtgacctttcctcatgttattgattagggtcgcagactcgtaatgcgtactccctttcatattgtttattagggtcgcagactcgcaatgcatactccgtttcatattgaaaaaacattttgactttttttaagtcatactgctatttatgtctcattagttttttctataaatttagtcaaactaaaagaagttgacttttagaaaaaacacgatataaaaaggagggagatagggaatagatcagacaaagcaaacaattgtaggataatttctcaggatatgaaaatcactaggatgcttgatgtagtgagagcatgtctaatgtataatttctcaagagtgtaaaggtgggatccacttgtgtcatagcaactatagatgaaaagtccatcaacgtataaaatccaccattgatcatatagttcacaacatataagatagcttctttgttggtttagcggtaactggtctggtgttaggtttctcttaggttttatataggcactatcgggcttggtgtggtggtggtggtttttttctttcctggttaatgttttacagggtgctagccttgcaatttttgaacctaagaaatcaaccatatgccagcaatttttgacagaaaagtgaagtagagacttctagctaaatattgtggctaagtggcttactcaaagtactttaagttggcaagtcaaatattaaagtaatggagtatatgttagtcaaacttacttaactgaagtgctactacgaattaaacacgtactatatcttactctagtggctaaatcatctataatggttactagaaaggcatgcccaaagccatcaatctgttataaaaggagtataatttgttataaaaagagtatgttataggtagcttctttgttagtctagtgatgagttttgtgttagttttcttctaggttttgtatagacgctgctcgggtggttatttttcttttcttttctgattaatattttatatgatgttagtctagtaattttttttaactcaatcacttgctgccattattcaacagttttctattgagatctatcccgtaaataaatcatggcaccgtctcatattagttgttaatgaaaaaaattgttcaaaactccagtacaatctgagtcgtccactcgtccataccagaacaaatcctttcatccaaaacccacggcgccgaaagcgtaaaccccgaaaggtccaaaacctttgacgtgcagtgggacccacatttcgtctggctccacatgccactggcacacgtatcaaggagcctgacaggtggcacaactgcaggcaacgacgatataaagaaaagcccagcaccttcccgtgccttcctcgtatccaaactctcctttaccccaatctcgtgagcggcgacgaactttgccaccgatttcgatccttttttttggcaggtaaatcttacctcatctcccctgatcgctccgatttatggattgcaaggccgtcgtgcgaatttttgagattttcggggtcggatttggtgcagcgtgtagtgacgcgagagagaaatggcgagcaagaggagcgtgggcaccctgacggagtcggatctgaaggggaagaaggtgttcctccgcgccgatctgaacgtgccgctggatgacagccagaagatcaccgacgacacccgcatccgcgcgtcggttcccaccatcaagttcttgatggggaagggcgccaaggtcatcctggccagccatctggtgaggattactacgttgctataatgtgtttgagcatgaggttgtgtgatatgtgagattggtggtccgttttggatgatgtgacatgctatataaacagtatcgattttatgattcatcaaagggtgataggttcacagtgaattttaagtggtaactatgtgcagattcatggttacgataggaggttaaggtgtcaatataaatttaatactgtatttttagactgattacagt

SEQ ID NO: 19880 - DNA, 1617 bp, Oryza sativa
ccacctctgtaacatttgggttatagaaagagccacatgtttaaagtgcagtagtcctcaaaaatccccatgccatataattgggttatgttaaaatggcaaatgaaactgaaattgtatgttcaaaaaagggcagcagctaaccgtgtttctatgcttgggataatgttctttcgcccccctttttgttttctcttgtcctctgttgtaatgcaatcaattttgtcttttcagggtcgcccaaaaggtgtaaccccgaagtacagcttgaagcctcttgttccgcgcttgtctgagcttcttggtgttgatgtatgctataaaaggataaatcatatttattattctgcaattctgcttactacaaactggtagaccatcttatatttccatgttttgatgatgtccttgtcgtaggttgtgatggccaatgactgcatcggtgaggaagtccagaaattggctgccactttaccagatggtggtgttctgcttctagaaaatgttcggttctacaaggaggaagagaaaaatgaccctgaattcgccaataagctggcatctgttgctgacctttatgtaaatgatgcctttggcacagcacacagagctcatgcttcaacagagggagttacgaagtatttgagaccttctgttgctggtttcctcatgcagaaggtattgcacaagtttccttactttgtgcattgctcaagattttcaccatctgaactgttttgacataactgtttggtgaacataatttcgtttggtgtttacttactgatatactccatttagaacaatgaaactccttcaagttgcaagcagcagatggcttgcagcagtacttgagtgacaagttgcaagacatgttgaaatcaactacattctttttgccaaattgcatattgtcttttaaattgtatccgcaatgaattcaagctgtttttccttgagattttttgaaatatgtaatccttttaaaattttgtagtaactgtcctcaccaatctaggaacttgactatcttgttggagctgttgccaaccccaaaaaaccatttgctgccattgttggtggatccaaggtgtcaacaaagattggggtgattgagagtcttttggcaaaggttgacatcctcatactgggtggtggtatgatctatacattttacaaggctcagggatacgctgttggaaaatctcttgtggaggaagacaagctcgaattggctacctcgcttattgaaaaagccaagtcaaagggagtctccctattgcttccaactgatattgtagtagctgataagtttgctgcggatgcagagagcaaggtttgttcattacctcgtgaatggcactgcataagaatttcatttcactgcatcatacaatcatagttgaatatatgaaaatggtttttcagtagcacaacattgtaaatgtgaacttgctgccatggcaatgttcttttgaagtagtcattcataaatcatggcttaaattcactgcgtcatatgccaaatatctgcattcagcattcgccttctgtatggccagttgcctggtaaatggattcagcaaacaaacaatatcagagagtacttgcgactac

SEQ ID NO: 19881 - DNA, 743 bp, Oryza sativa
catatggccaatgctttctctaaaaaacaaaaaccatttcaagcggccaatggccaatgctttgcatttttttttcttttctgaaaatcacattctctgtagaatattgtcacagtgtcgaggacagcagttgcgctccctagatgtagctgaaaggatttatggctcctgtcgtgatgttgcctgaaacacttaacagtacagatgtagaactgcagaagcaagttcagatgaactaacaatgtccctggagcattgtttttttgtgaaaatgtatatatagcagtgtagtaaatgtgtccgaggaggaaatgggggacaaaattgctcagagttccaactgagaatgtatcaacagttgtgagattagatagcaatatatcgtactgtatcaaatcatcaagtgcacacaaagaagaaaaccatgttcaagagaaaatgagaagtatatggctaatagtttaatcgttacaggaacaaagaacactgacctcctttctccatagtccatagaagttcgggaaaaggttgcatcatatagcttgtcagcttatagtgatgacctgctgagaaatcacagtcaaaaaagaactacagatcaacagctcgatggatcagaaacaaattgcatgacaaaacaagataacatcgatcagcaacctaccttaagacaattacgaacctgtgatcgaagactggagccccgatgagatggttttgctggtagtgagagagtgaagctg

SEQ ID NO: 19882 - DNA, 8665 bp, Oryza sativa
tcttcgcaaacttcctttggcactcattgtactttgatcacaaaaatgtaaaccatataaaagtggtgggtggattcctacaacattgggcattatatttggtttgcattttatttggtagtattactctagaatggtcattaatgatcgcttcctgcaaaatgctttaggtatgaggtgcaaagttacgatgatagggtaaacacatggttcagtgaagctattggacgtccttgtaccttggtgagatgctcaagctccaagtaccgttcctgcacatatactggcttgagagatcgtccatgtagagatactcaaagcaaacttaattttgttaatgaaggacaactactactaatatcagaagaaagcatctctgacctcaatagtcggctaaattcaggtatccaacctccttcattttccgctcttttcatttttaccgcaaaaggtcctctactcaatcatagaactaattgaactttatcattccttgttggctatgatccaacatagtcagtatgcaatgtatagctgcacattcttttcttgggataaccttgttatgggaacttattctgtagttacatattttgcaggcaaaggggactgtaagcaaaagttgcctgttgatgcaatgagattccgtcccaaccttgttatctctgggtcgagtccatacagtgaggataactggaaaaaacttcgtatcggagaggcctgttttacggtatacattttataacccttaagatcccattgctacaagaccataatttggcttttttgcaattgctgagttactcatttcattcattctggatggcttatgtgcagtccatgggaggatgcaatcgctgtcagatgatcaatctacaccaggactccgggcaggtgctcaaatcaaaggaaccattggccactttagcgtcatacagacgaaaaaaggtaagttggcatgcaaaattttcatcagtggccaacctgcagttgttcttcagtcatgtgatccacattttatacgtgaccagggcaagattttgttcggcatcctattaaactatgaagacattatggaaggggaaaatgagaccattgcagggcacatggtctccaagtgggcgcaacaagtgtacccttccacagaatgacttgatgatgaagtagctgtggacatatcacttgagtacatatatggaattgcaagttgcatcagcagcgaccttggtgatgatgaagtgatgattgttacgtatacaaaacacgtcggcatacaaagcattttcgtaattttccaatacgcataagatgaaacaagtttagttaggtgaaaacagaatataccttcacatgtatcacatatatactatagttctcaaaatgcttttatataacacacaaggggctctaagcctaagccctagctcaaacaaaacgaaatgattgtgaagaaaaatgtacagacggaaatggttcatatttcagagttctcatgattacggtttctgtgcacaggttatcagtcatattagcaatcttggtacactattgaatactatttgaaaaccaggtgtggtatcaggacttaagaattacgcaaatgattacatattaagtggatatgacagtatctattaacaaggagaggtgagggcatgttgcatacacgatgaaatgccttaactagaaggtcagattgctctatgctatacgacgccatttgaatttgatcccttgtacctgaaggggaaatggctctagaaactagaggacagctaagtaaaaacacttacattgtcaacctaaaggtctagaagtagaagcagttaagaaatcatagcaggtatagcccataccatatgtacagagcatcacgtctcgtaacaacagggagcaagcaaaagcacagtggcaggtatatgatgatgatgcaagagaaaacgcagtactgtaagttgtgtttcagtccactttgtgcaatgacatgctggtccacatttgagagtgcacaacttcagagttcgatgatacgatttcatccacgtttgaactcaaatatcgccacaacactctttcttcaggctcaaactctttcctcaagatagagaagccttccagggacaagtttcctgtgttgaaacatatgatttcacaattagtaccatgtatgacaggttctgtaaaagatgggtagacaaatttcctactccatccgtttcacaatgtaagactttctaacattgcccacatacatatagatgttaatgaatctaaacacatacatatgtctagattcattaacatctaaatgaatatggacaatgctagaaagtcttatattgtaaaacggaggaagtataagttaccttgtagggggcacctcctcgtcagacaaaacctttatcaacctttcctcaaagggtgtggaatgccagctgacatgttgatcctaacaacagtaaaccatcagaagttcagaacaagtggtgaatttacatataagcccagcttaagaaaatcactagatgagtcagtgataatacctctccatattttctacttgtgtttggaatacagtggcaatcccgagccttggacaacctcggagtatgattgtccacatccacattatcctcagaagtcataaaggcatgtccctcttcgataagattgttctcatcgtacatttggttcgtgtttcctgcgggtgaagatttaagccagcgtgatagactgcacacctcaatattttcatctgaattggactttgatctctctccagcatccaatagcctttggcggtcgagctgatacttagacacctcaagagggaaatgtgaagaattgagtgattctcctttaaccactgaatctgaagagatctgctgtgtcatcttggcagaatctgaaagttgcatcttctgaagcttgttctctgttggtctaaagatgggatatgcgaattgtttgcgggtccgcacacgctttccagacgatcctttatgtgaagtataaacagttctgggggtctgcatatcatctctcaatactagaggagtatgaaagggtgaatcactggaaccatcgttgatgcttttgatgttctggaagggggagttgcctcggatagctgattgataaactgatttaactagtggaagatgttcagtatcttcagtgttaagttgaggcgtcaagatatgatcctccccatattcaaagctgcatagtatgaaaatgaagcatcaattaaatatctcaccatgataatatattaaaaaacttcagacactaatggaaattagggcagttcttaccctccagatgatttagattcaaatgctggagttgcttccactgccagtacatttgtgggaattttatcatgctacatatcagaagtgaaggtatcagagaatgaatattgataaacaaaatattcagaaatgctcttctcacctcaatgtaactttccatattgatttgataggatatgttatggagttcagctggtgtttcaaatagtgtgccacataacttgaggaaatttgcctgtgtagagttaaaaagtgcaatgaaaaattcaacttcacagtaaagtactagtagactatatgtataaagagtatatctcaacagctcagtactcaacaatttaccatcttaaacaaggtctaaacaaaaagggtactggataagagcgtgacttcgagagcaaaaggaaaaactgcagaagataaaaaaatatgtagataacacatgtacaccaatataatcaaaacaggagtagcatcactgagctttccaatcctatatatgatggaaattctggacaaaatcttatgcccaaagcatataacataaacatattatctgcaaatgcaatgctcataagcccataaaaacatttactgaactacagtacaaaaaataaaactcttttttacaggacagatcttactacagttcatttaaaaactgattcaaccatacaccgtaactccaagaaattccacaaccatccgattattgttataacataattgtgaggtgatgtggcctagttatagaacataaggtggtggctgtcaagaccatgaatccaaatctccattctccttccaaaaacagtagtccttgtgatttctctctattttctcaccaatataaaagatatatccagccagcaatactgagtgtttaagaacatgtctactaggacatatacaaggaacgggttcccaggtcatataattgccggttaggacatatatagctcctaattcactgatcactactaggtgcacgaccaaacaaatatggataaacgttctgcagaatcttgcaacaaactctctaggtgctcactctagtactttacaatagaaattagcttagcacttttcatggaacttatgcaatagttgttactgccagtaaatcgagtgaaggcacggtataaagctaattctatcagccaaacagtagaaaaacacaacaagggatcaaaaacacttgagatctagtttctggtaagctgaaggttgcacatacacaatcagactgtcaacctcaaactagaacgcgacactgacaatagccatccgaagaagtacataatcagacaatagattacatcgcacttgattacggggaaaagaaaaatcattcgagcatacctcggatcgaagctcctcatcgctgccacaatcatcagccaaatcctcatgagatcctcccctccctcccaatcctaaacaatgccacaaacacacagatggggacaacgtacgcgcttacccccacacgaaaccacacaacgaaatcgatcgaatcagacctagctcatcgtcgtccgagagcagctccccgagccgatccttgtgcgcgagcgaatcctgcatcggaaacgccagagaacaatcaccacctcaatccaaatcccctcccaaaaccaaacgatccaacacgaggtcccgcaacgaagcgggagggatatgtgtacgggaggctagggtttaggggggttcccttacgcggcggccggagccggggctgtcgtcgcggtcgcggtcgcgggggtgggggccgaagaaggagaggaagaagccgacgaggacggcgtcgaggaactccaccaccgccctcgcgatcgccgccgcgcaccggcacatcgtcgtcgcgtcgcggcccttcccgccgacgaggagagaggcggaggggaggaggcgaggagaggggatatggtttgaaatgggaagcgaagctgcgaagaggagggaagcattattattattattttattatttttttattattttggggaagcgagaaggatagttgatgggccaggccttcgcgacttcagcccaactattaatagtttgggcctcttctgttttagtcagatttgtcaacgcaccgggccgtagaaaaaaatatgtttgggcttcagccttgctgctctctctgcttctttctcttttttttttctgggaacatatatgctgtttggactttccagcagattgtaaaaaacaaaaaaaaaaagatttctgggttccttttctgtaaatagaagatcaatatctaaggaaactatttaaaaaatattttctcgatttatgtctctgtacacgtacttacctcctgaatattcctactaaaacatacctcataccacatatatatattgacgaacccaaaacataaattaccgaggatcctatatatactaattattcaattatcgactgatattactaattaatatggtataatttagttagaactgaacaatctactcgtgaattcgtgatcctatgacctcgcggaaagttgcatgtcactatatatgtacccatgtgtatataataattgtagacaaagggattcgaccattaagctcgctccatcggcgcagttagtgtcgggccctccacagagtcgcgatctccaacagtagcagcttggattattggagatcgatcgatcgatcagatcaccgcgtctatggacacaacacctgcatccatctctccgcggtcgagaaagtttccaagaaatgacttttcgcctcaatgattcccaacaaaatcgtctcgatcgtctccgcgacaaaagcatggccgccggcgactaaacgcgaggctctatgcacagtgcacacacatgctttgttgttggcaccgccacattgacatttgtggcgatcgatttgatgctgattcctcccttccgctgcatttacatgtgtagcacgcggttttcacccatggataatatcgacacgctatgacgtttgtacgtacgctaactgcctgcactgtttgatttccaaagtgattttgccgctgtgtggtaattaattcgtgtacggctttgcgctgattcattgaatctctcacacactgatcaatcactcaaggtctctacaactcaaccaaaattaacccgtgtcaaaatcatcgagctgtactagagaaaaaaatatatatatttcacattcctagcgcgttgcaaataatatgaaattttcatcgatatattttgtgctattattaattaggagggacacatgatagagttcaccaaccgacggaaacggcatgtttttcatgaaatatcaggttttgagttggctcaggctgataattccgctcggtaatttttttaaaaaaaatcatagtaaatcttttctaaatttcacaaattgttttcaacctttttcatgaaaatcgagaatctactaataaggtgtgattctcgatctagtaacgactctctacacaaccctacaaaggaaatatatttagggttagacgtgcatttaggtacaccatacatatagagagtcgttttagcttactttttaattgaattgaaaattataccatatggtcagatctagtgaggccaagagaatgaagatcagttccaatcgctatcacaaattaaaggtagaaaagaattggagcttggatgaattctacgcagctaattaagcagctagagcgccatgaatgcgcacacagttgacggagcttgcagagaactttccaaaccggagaaagaatttttccaacttcgaaaaggtacatgcaaattagacaaccaacaaagcatgcaatagtagccgcgatccctttcacatgccatggaactgatgaaaattggaggaagaattcgacagcaaagttaattagcttcggctgtacgtctggttgacttgctcatagcttgtccactcaatcaaatgttcaaattgggtttgacatttctgtacttgattgatcagtcgttttgaccaaggaatagcaaatggtgtagctgtaggtttgaagaaataactggcccagaggtgaatagtctctgaaaggattaattggactgttgctgttgttcagggaaactgtcttaacaggccgttgaaaatgtagcaagctgcttagctgcaggtaattaatttgccgtacgccctggttagcactgtgtacacacatttcacacatggttaattagcaaataagtttacataatgatattaggagataaacccagaaaatgaatggtactaattaatttgaatgccaactttaatttctggaaaaacatttaaaaaaaaggcatctatcgagtcacttaaacacttctggtcattctctatagcaaaacgtactaaaaatatctctgaattccagacaaaaaaattacatctagatctatcagggttcacataaattgatctatatctatcaacacgtaatcctctatactacatgggaaatgaagcttgttgttgttgctgttgctactaccactataggatctaataggtaatcctgggaccaccaaaaaaaaatcctatcccaatgtatatttacatatgtgaaatatatttttgcaaaaagaaaaaaacactgtcttattaatatattatgatgcaatcaatttatatttctaaccttattatatttagggtattttaaaaaatatataagttggatcacccatataaaaattctagatacgccaactactattatgggagtgaacattatttgtttgctcacctaaaatagttgatttctctccatgtctagaataaatataagtcaaagttgaaaagttacattttggtttagaattggaaaaatcttacagatatgaaagaatatcgaaattgaatatatactagaaaaaaaactccaaagaaaattaatccaatcgatataccaataattaatttaatattacttctagtcaatgtagtgtgcatttctaaaataaaaaatagccgcgcctagtttttgtaacaaaccaagtaccaaaatattacacgagtgcaaaagcaccttattcacacgtacggcatatgtacacgtgtatcacacgatcgattgaaaaccgaatgtgattaatcaagcatcattttaagtttttaacgcatgcacgcacacggaaaatatgcacactgcatgcgtaatacggcgccgaataagcttaaacttaattggagtttagctaagcttaattggagtagtcatcgttcgtgcaagatgccggtacggcactacgacctttttggcttagctatagactatagtctctaggtagctagctgccacttttgccttttagaccctgcaattgcacgcttgcacta

SEQ ID NO: 19883 - DNA, 4925 bp, Oryza sativa
aacacagaacgatattagattgcaggaggaaacatggttgatgatatacttatcagttgtcaatggtgtgtagaaaaactacatatccaagcagaacccttgcacatgagggttatgtgtaggatggatctagtccaatacccccttcaactgcctcaaggagcagtggttacacatgaattcaccaaagaacaccagatcacttgcatatagaagtatcaaaacagatggcaaggatgcactaacgaatcatgtatttgatcttatgcaatttgcagagaactttgtggtgaaagctgttatcgatctttaagaaccaggactccaggagccctttgccaaccactatatatatatgggaaaagtgtaatctgcatctcacaatgaaataatgtcactggtttcagtgtgtatagcaaaatccttttctgttaagaactcgagaaatgcaaaaattgatcctgatcaggcattgaaatattcagaaccaccggtcagttttgagaaatacaccagatgagaaaaaaaaaacaattccaaccttccaacagctgaactctccaaatatgtgtgatatatgggaatagccatccttctgacagtaacataaaacgacacgaaaacgaaaaaaacacaccagtgaatcaaccagtttgatacgcgtctggaaccgcgtctggaaccaaccaaaaacttatagaattaaacctcaagaagaatgatagagacctattgcactaatttaactcccaggtttatacagctcaataattctgatattaactgaaattatttttttacttatccctagcaccaatgtagcatacactaatataattgatggaaatcatcaaacggactctcagaggccaatcttgtaaaggaatcacactaaatcagagagggtttcttcaaaatcaacctaaacagaaaattgctgctgatggaaagaaactttccatgaactgaacctatgaatttaacctaagcacttagtgtttaatttaaaccactgaaggttaacattatttatcaaatctacattcgatgtaccagcgcaccattatttacagaaaaacaaaacagaaaactactgtttgaatgagctacacgagccttagaagttagcaatttagcattacacgagtcaaaatttatgcggtgaacgttcgtaccagagtccagtgatagatatagatccatgtgtaacgaatttatgcataaagaatagcaccataacctgcccaactggacgaactcttatcccaggttaaattccgaagaaaggggcctaaacaagataccaagttgaaaaccctaatagacgtcaatagccctaatcgcaacttcgcaatgaactcacaacctaaccaccagcacagccgaaccagatcgcacaaaaacaaagaacaccatcaccatgtcacatatgcaatcgtgcaaccacgagcccgaacgcgattcgggtgtaattaaaggaatcgcaactaaattcaccttgggatcaccaaggggagagcgggggatcaacgaaatgggagaggatcaaggccgtagcggtcgcgatccctccgacccaaaccctaacccgtcccccaccaccaatcaatcaaacggtaaacgcaggaaccgccgcagcagcaccaccacgcctgaatcgcaaacaaaattcccccaccaacaaaattcaggaagaaccagacagacaaaaggctaggatttagggtttcgtcgagtcgccgaaggagcgtataccatacctcccacctcggaagaggcggcacggagaaaccggcggacgaggggggtggagacgccgctgcggggcgatcgcgatcgcgatcgcgatctggaggacgttccgcccaccgcgttggctctagggttagggaaagagaggaggcgaggaggccgccatggcgaaggcggcggcgcgcagagagggagagagagggggacaagtggttgggggaagcttccgcgagaaggaggcctcgcctggtggtagccaataagccaaggacggtgaaggcggttgcgggcccaagaaaaagagcctttctgtgccacgtggcaaccgagacgtgtccgttcacgtgtccgttctagcgagttggccaggtttgaaaattcagcgactgacaatgtggtcccacaggtaggaacacaaaggctgtgttaattcagcgcaaagtttggtttttggttgaaattgaagatgatatgactgaaaaattgtatgtgtatgacaggttgatgtgatagaaaagtactgaagtttggaaccaaactttagatctaaactcagccaaaagtttgaataatgctaaaaaaaatattacgaggttaatttatcacgtaatcatcaacactaaaatatattacgaggttaatttatcacgtaatcatcaacattaaaatacactccaagtggttaatacattgtacgatattacggtcctttgtttcagcttaaaattattataatctagattattaaatcagattactctaaactgaattataataagctagcataaaataagctacgagatgtttgtttatctaaattattgaaggcatctatagatagtgggtctttagccacctaataatctggaaaaagctcctctagaggagattattagattatagtaatctggcttacagattataataatctatcctaataacctacttgtttgtttcagcttactcctaataatccagattataataattttaagctgaatcaaacgagtctaataatctacttgtttatttcagcttactcctaataatctagattataataatcctaacctgaatcgaacgagtagtgccattcttttatccctatcactaattcgctatgttccattgttttatctaaacataacgacgactatctcatctcgagctattgtaagttcactatgctaatgctgtcttagtgctagattactgcaaggacgtccatgaaatccacgtccaccagccaccatgtaggctgtttcaattgacaagtcagcgatcctcaatctgcaaggagaagaataatgtgcaacagattagataactgatcagggctaattgtgcttggtggaatattaaccaaagtactccttgattacctaccagagccgcaggtcaggctggtcgccgtcgtgcggctgcggccacagctgcagcaacgtgctcgacgccgccacccccttctcctcctccgggaagaagcaattgaacgcctccgccgccgtcgtcgccgccgccgccggcggcagcatcgtcagcgcctccattgccgacgcctccccggaaccagggctctgccagttctcgctgtgccagttctcactcatctaaagccgaacaaattgagtattataatactcctaaattcaacgtccacatgttaaaaaaagaataaattaaattggaaatagttaacccgcattcacggttatatttgtcatttttgttgtaatttataaaagttgaatttaaacttgtatgtttatggagtgaaatattttcatattgatctatcttatcagttcttttaaaaaaatttgataactattttatactagttacatgcccgtgctaacgctacggcgaaacaacaaaaagatatacaatatattgtttgggctatcaagtatagattcaagacattaattaagacttacatatgagcgagtttagttaagaagcttattagaagttcctcagttattatatactcgaaagggataaacaagccaaataaactacatccaggacaaggttcaaaatttgcaaaacaagccataaggtcgacccattcagtcgacgatgtattatgtcttcaacgtcttttctccatgtcacagaaaaaccagtaagcaaagaacaaaagtctgattgatatattaagttctaaaccgattccaggacacattcagtcaattcagttcaaatacataatcatgcgtttcaacattaattaaagtatcacattcatatatcagtacatggcttggcaaaccacaaagctgaggctgccttaatctaagctacaacaaaatttcttttttttttgcattttagaataaacagtaaaagagaatggataaatcacatgtcctgaagctgtaaatttctacgaagtcctgagcagctcaattttggagagggtagtagtgttgttccctttatggttcatctgatgcatgaagaaggcaagttcaatttctggttcagtaactcttgttgttcctactgcttccaggaagtcatataaaccagaatcgccaagaattttcttgcttgatgactgtaaagagatgaaagttcaaactggtcattaaaaaaattgtgtgcagataagagtggtgttgagaagtcaagttatcaaagtagcattttgtcttcgttccaaaggagctaactctgtttttaaatatttgatctttttttcataaactcactaatgcatatcactaatacgagggaaattgtaagtgaatagtgaatgaagataaataatggtttgagagagagatagagggtgaactaaccaatatatcccaactgcatacaatcatcaagggcaatgcgtgcatgagtgatagaaatcatggcagcaagtatcattattgtgatcacattctgcatggagaaatgtattttttccaagaatataagcccattcctctgctagtaaagttcccatgtcaacctattttactttaaaaccaaagaaactgtaaataaaaaaacgagatagagatttgcaattcactgggtacaaaagttagatgcacttctttaacattttagcagattgcttccaacatatgacatcaacttcccagtcagttggttattttacaatcttgaaaagcaatatttttctatcagtccaactaatttgagaaaaa

SEQ ID NO: 19884 - DNA, 925 bp, Oryza sativa
ttgtgttgcctgtgtaatctagcaagatgtaatttgcagtctagtaccaatttttggaagccctacactgtaattccataaatcatctgcacatttcatcatctcaaattctcaataaccaaaagggtaattcacatttcagtcatccaatcggtgcagagtcttgcctatgaactaatgaacaccccaagaaggaactagcaactagaaagtctagaatggtgcatcaagccatcaaaaacaaataaccctaacattagacctaatcctcctccctgatataaacgatcgacatgcctcacaatgaactatcgggtcaccgctatactttacatacgaaagtctcctgcaaacgaactgcgcaaatctgtgacgcgcgcacacaagcagtgaagcaaaaacatcacaaaatttcagatttaacagcatacttcctcccgaaacccgataattagggtagaaacagccgagtcaccccgtcccaacgcgcagagcctttgatccccaattccccataccacaaacagtacacaactacacatataatacaggcaaaatactaagcaggagggaggacaaaatggcaaagcaggagagggggcagatgccataccggtggagaaagccctggggaaggaggagatccgaaggtaggaggcggtgcggcaagcccagagcgcccttgaggcggcggcggcggcggccatgatcgagcgagctgttccaccgccgagctcttcgagtggaccaaccccgccgccaccttggagagagaaagagaaaataatgggctttctcttaatgggcttttgttagtgggctgtagtttaggcccatgttgaattgggctaaactgggttggttaccagtttgcctctgacagcttgaagagatattggaaaaagtacaccgaaggtccctcaac

SEQ ID NO: 19885 - DNA, 1307 bp, Oryza sativa
gaggaagaaaacaaatcatagcacacatatgtgaaaaaaaattgttcccacgacctccattttaccgaaataacatgttacagacagatttttgaaagttagatataagttacaccatagttacagtgtaattacatgcaagttacagtataattacactacgattgtactgtaattacatctgtcaaatttttggggaaaaatttatcgacaaatatatagcaaaatcagaaaccgtttactctaggtccttcggtggttttgaccctggttttatccgacatggcggctgagtcagcgtgggacccgtgtgagcccccacatgtcatactgtccacgtcagctttctctttccctcttctctcccttcctcctcctcctcctcctctctctctcttctctcttggcatggcgtgcatcgggtggggaggagaccgcgccgctcgcccacgccgcccgcgccgctcgcactcgccggccgagtcccggccgtgccgctcgccctcgccagcgccatgtcaactttcagctgtcggcgagtctgccgagatgagcggcggctggccctctgcagcacggggccatctctctaccgccggatgcactcaaggacaacgcccccgctgcccctaccgtcgacaagctcggccgcgcgcccgtcggcggccggcgcggttgggctccatgccacgggaagctcgaccaccaccatggccccggcacatcgccacacggcttgctgcgctctgcggtcgacaccggccgccatgttatggggcatctcgtacgtcttggtgaagcagttgcccggcggtgaggacaagtctccatctagcaccacggtgattccattaatgctcattcgcacacgttgcatccccagctccatcccctgcagtctctgcatggcctatgacaaggcagcaaggctgttgccgacaagctcctttgccgctgaagaaacccaccacaaccgtgatgccgctcccgcagctcgacggccacgacctcgcgccgacgtcgtggtcggaggtcagcaaggccctggaggtcatcaagcctacgctcaactccaacacgacggagaacgccaagagcccgcatggcaggcggtggagacgtggcgccgaggtcgtgtcggcggcaggaggatcccccgtcgtcgtggacggcggagaggaggccgacgcgatggcggtgggagcacgcggataggaggccggcgcaacgggcagcctttggcggccggctgctggtaggggggagcacagtggagaggaggccggtgcgacgggcggcgggcggtg

SEQ ID NO: 19886 - DNA, 9743 bp, Oryza sativa
tcctcctctcccgcctcgccccgcccagcggccgccctgcatagagagagagagagagagaggaggaaccgaggaagaccgaccggcctgcacagaagagaagagagggagagatatgccctcatcgtttggcttttcttttaataagccaaaacggcttattagagaataaaaataaatttgtaggtaaaacttttatatatgtgttctcggtgacttaaaagccaatgctgaaaaagaaactacgttgaaaatatctcaaaatcaatgtcaaaattaagtttgaaaattcaaaatttggctttttctttggctgaataggccatccgatgggagccatagatgactcagcctaacatgtagggtccacatgggtccatgctgactcagccgccacgtaggataaaaccggggtcaaaaccaccgaagaatctactgtgaccagttttaattagttgagggatgttcggtatctagttttaccggtatctggttttgcggttgagggacgattttgtaactcgatgacaagttgagggaccttcggtgtactttttccaagagatattctccaatagaatattcttctcctctgatcccacgaggaacgttctctagattgcttaaaaaccatccaaactgttatgaaaaattctaaagaaatttgaaaacgcttatacaatatatttatacaactccacaaaatcctaggtctaaactcaactcgcacgtcaagataaaaaaaagataaaaaagacaaatttaacgtatgaatagcaatgtactattcacatctaaatttatctttttttctcaacgtgtaggttgaatttggacatgatttttggtaaagcgatagatattattataccctatattgctaaaaaaatcataattgtttactactatttgtataaaatttaaaagaaaaggtacacgagaggatataatcccgaaggattagaatccactcccctctcattttcgctttttttttagaattggtccagaaattaagggtcatttctgtacgaaaacgtaaaaataacttaaagttacattaagtggttaggtcgtcattatcgtcctaatgaaattattgcgtactccctccgtcaaaaaaaaaacaaactctggtttccgtgtccaacgtttgaccgttcgtcttatttgaaaaaaatataaaaaaaattaagaagataagtcacgcataaaatattaatcatgttttatcatctaacaaatatgaaaatactaattataaaaaaaattcatataagacgaatagtcaaacgtcagtacggaaactcagggtttgcctttttttaggacggagggagtactggttaggtcatcataacagctcattcccactatatatatgtagtacatttttcgatctattccgggtacacgatcaacagttcgcaccttgattgacgctaattttagcccaaaatactcccaacaagaaaacaaaaagaaaaaatgaaattactacagcaatcagcctcgggaagcagcaaatttctcataggaatttcactgtaaacaacacgttgaaaccaacggcgccgaatgtgcaaaattatcagcagctggagatcgatcgatcgaactcatcgaagacgctgtgcaagcaaggacagtccacagagccggatacgagtgcgtacatcacactgcagctaagctgagtagggcatcgagcacgcgctgaacggcagcatcacgaggggcgggtgggcgcgagcgcgagagaccatacctagctgcaagccttgacgagtagtatcggagttggggacgacgaaccataacagtagggatgaagagggtcccagacgaaagcctagcccagtgttcactagaccagcaatgggcacggtcatactttcgagcgtggtaacctttctggcgacgctgtcgaggtgcccctttgcccttaggcaaggatctctataggaaaactttgtccagttttttagacaggcagcaatgttatgctatcacgtcgcaccttaatgaagacgttgtttttagagtttccgtcctatggtgttgttgtaagtctagcagtgtccggtctcaaatagcattagtcgtttcgatgcttgggtccctttttttgtagcttgtgttcgtgtggttgagatgtagtgtggtttcagggcgtgcgtttttagtgcacgtcctttctcgacaaccagctgtcaattcaaactcttttgatcatccctaccaaaataagattcttcgtccgcttttggccattggcatcaggtgccgcgtcctttatgcaccggaagatagcttaatcattctttaggccccttcaaagaaaatttataggaattttagaggatttcatttctatagaaatgtttcctacaaagtcctttgaatcaaaggaatgaaccctatggaatcctatgaaattcctatggaatgcctcttcccgtacaagttttggaggaattttaataagatgtagaacctcatagaagaaatcctttgagtttttatctctccttaaattcctgtgtttttcctgtggtccaatcaaatggtcattcctatatttttcctgtgttttgcaatcctctgtttcacacttacattcctgtcagaatcctatgtttttcctattcctccgttttcttcattcctgtgattcaaaggggcccttaagcaccaataatactacttcagaataacaatcagtagtgtactggtgtgtttgttttgttgctccctttcttcaaagattacgacagattaccagtattatattgcgaagaaagaggaaatgccttcatttagtggaatcaagatcaaaccggacccaattaattaattaattactccctccattacagaatataaaaattttaaagttggacacagttattaagaaaatagttagaagtgaatgatgtagggttgtgatcggataagtagtggagataggtgagaaaaatgaatgacggagggttgtaattagttagaagaaaatattggtagagaagttatattttagaataaattctaagagataaaatttgttatattttggaacggagggagtaaatcggactaataaaactacaaaatgtaacaaacacactacctcacctaaagctaaccaccgcaaactgaactagcaagctggaagaactctgcaaaatttgctacctatcgacctcgtcacctccgctgtttgtttgcagtcattcgcagcggcagcgatggatgttgcggccgccgcgggcgtcgttggtgggttcttgcaggtcgtcttcgacaagtactacggctccaagctcgagcagtgggctgctcgctcgggcctgcacggcgacttcctcagcctcaagaaccagctccacatggtccgtgccatgctcgaggcaggcggcggcggcaacgccccccacaacgactccctgcgcagcctcatcgtggagctcaaatccgctgcctacgccgccgacaacgtgctcgacgagatggagtactaccgcctcaaggagctcgtcgaggacaccagtggccgcgacggcggcgcaccgtcgtcgtcggctcgccaggtggtcggccgcatactggtgcctgcgcctctcctgtccaatccattcaagcgagccaggacgggcgccgacgaagccttgcaagggcagggcgctgacacggacacccccaacttcgatcaggatgcaatgtcctccaagatcaaatcgatatcctgctgcctcgagcagattgctggcatggtgcggaggatcatcgagctcgacaagttggtgtcgatggcgagcttagggcatgtacaaccagaggtggtggtaagtctgcggcagacaagctcctttcccactgaaactaagttgtttgggagagatgagtctaccaacaacatcataaaccttatgcttagaacagatatggagtctaggtacaataacttcaatgttcttcccattgttggcattggtggagttggtaagactgctcttgcccagtctgtctacaatcatcaaagagtagttgattcatttcaagtgagagcctgggcatgcgtttctgatactcttgatgtgcgcagagttatagcagatttgatagattcgatcgatggtggccaagaaactcccaagtttcatagagtgcctagtcttgatgcaactcagagaactctactgaggaaaattgaagggaagaggttcttgattgtccttgatgatgtgtgggtcagcagccactgggagaagctttgtggtcccttctccgcggggatgtctggaagcatggttttagttacaacgcgacagagaaaaatcgccaaggccatgggcacatttgacagtttgacactgcacggtttacatgataatgaattttgggctttcttcctacagtgcacaaacatcacagaggaccacagcttggctcgaataggcaggaaaatagctctcaagttgtatggcaaccccttggctgccaagaccatggggagattcctttcggaaaaccacgaggaggagcattggtgcaagtttctgaatagaaacatatgggaactaaaacaagagcctgacgacgttatgccggttttgttgttgagttatcagcatctccctctaagcttgcagcgatgtttcacctattgtgccatatttccaagaggctataagttcactgagcaagagcttatatttgcttggatggcacaaggccttgttccaacacctggagaggatcagacattggaagatgtaggaaaggagtaccttaacgagttactcagttgctcattcttccatataatcgagagtggccactacatgatacctgggttgttacatgatcttgctcaacttgttgcagaaggggaattccaggcaactaatggtaaattccctatctcagttgaggcttgtcacttgtatatctctcattctgatcatgctcgtgatatgggcttatgtcatccactcgattgttctggtattcagatgaaacgccgcatccaaaagaactcatgggctggcttgctgcatctaaaaaatttgcggactataatgttctctgcctcttcatcaatttggtctccaggttctgaggtagtctttgtccagagcaattggcctagtactatcagactgttgtctctgccctgcactttccgaaaagagcaacttgcagcagttagtaacttcatacatttgcgttacctagacctcagatggtcacgccttgaagaattacctgaagccgtatgcaagctttacctactacaagttttgaacataaagcactgtccgtgccttcttcatttacctccaaggatagccaacttattaaactttgagcatctgattgctgatgaaggaaaacatttactcacaggagttccatgtgttggcaatatgacttccttgcttctgttggataagttctgtgttaggaaaaccaggggctttgacattggacaactgaaaaggttgaggaacctaagaggtttgttgaaagttcagaatctcgagaatgttgatggcaatgaagaagcagcaaaggctagattgagtgacaaaaggcacctaactgagctgtggctgtcatggagtgccggttcttgtgtacaagagccttcagaacaataccacgtcctggaaggtcttgcaccacattcaaatgtaagttgtctccatattacaggctataggggcagtactaccccatcatggcttgctagtaatctcagccttagctcactagaatatctttatctagattattgttctgaattggaaattcttcctccactgggactcctccctcaccttaggaagctgcatatagtcaatatgcacgcgctaagaagaattggctctgagttctatagcagtggtcaggtggtggggtttccatgtttggaagggctatttatcaaaacaatgccagaattggaagactggaatgtagatgactccaatgttttccctagcctgaccagtttgactgtagaagattgtcccaagctgagtagaattcctagttttctatggagtagagaaaacaagtgttggttcccaaagcttggtaaaatcaacatcaaatactgtcctgaattggtgctgtcagaagccctccttattccacgcttgccttggctccttgatatagacattcaaatttggggacaaacagtgataaatttgcgtggtggctgtcttgaggtttctgaaatcaatgctaatactagctcaggcccaataaatgctgttctacaattgcattggctaaaacatgtgtctagttttcatatttgggcacaggacagtctttctgtacacccctgcaagcaaaagacagaaccatcagcatgtaattctgaacacatggtaaattctctacaaacatcagcagagaaagttgaagtcacagggtatggtattactgatgaattattgtcagcaattttggagaatgaaatctgtccttcaagtttatctatatcagattgtccacaaataacatctcttgatcttagtcccctaagatcattaaaatctctggtaatacacaattgtgtatcactaagaaaactctttgaccgacaatatttcactgctcttagggatttggaagtgaccaatgcatcaagttttgctgaagcatggagtgaactgttaggatccagatatgcagagtggggtcaagttactacctcactggaatctcttacagttgacagcaccttattcctcaactcccctttgtgtgcagtgctcacttctctgaagaagctaacaattcattcggatttcagggtcacttccctctcaagacaatcaggctgcaggcatcttctacttcttaactctctcttgcacagatctctgggatttactacacatgtctagcaatctacattctcttcccagtgaactgcacaaaatatacactctcaagcagctcgagattgattcatgcccatgtgttgagtcattgccaaataatgggctgccggaaaagcttgaaaaattgatcatcagaggctgcaacagaagattgtatacaggtgcatcaatgatgggttcaactagcaccaaagtgcacctagtagatagatgatataatagatttaggttcatattagtcggcgaccacgaatataaatagctcgtgcaagtgcacagtaatcaagtagtctacgtagtcgcttttggatgtcaggctatgcaacggtattaatcaaaagatttattcacctatttttatttctgaaaactgttatagatacaaccgtttcgtatggaacaaaaaggcaacccacacagatgttttcatctgacttgataattcctcttaacaatctaattaccatgacatgcatcctccatacattcttagatctcgataccagaatcctccaaataatagctttactttttgttctgatttgcacacaaaagtctcctccaaacgaactgcacaaatcttgacgcgcacacaagcaatgcagcaaactcatcacaagaaattcagatttgacagcatgcttccttccgaaacccgatacttagagcagaaacagccgagtcaccccgttccaacgcgcagaacctttgatccgcaattccccataggccataccacaactacccaactcggcaactacacgagatacaggaagggataaaatggcgagacgggagagggggcggatgccataccggtggagaaagccctggggaaggaggaaatccgggaggtaggaggcggcgcggcaagcccggcggcggcggccatgatcgagcttcgagctaattccaccgctgagctctgcgaatggaccaaccccgcggctccgagtccttgaagagcgagaaggaataagttcacttgaggtccctttaacttgtcaacgaatccaattttcatccttcaaccagaaaatcaaatacaacgggtccctcaactatcaaaatcagtgcaaagcaaatccctcaacggttttgatggtggttttggctgatgtggcgcctacgcggccggtttgacttagtacttgtcataagtggcggtaatgtggcacgggaagcaaaatataggaataagagataaagacagaaatgtggggcccacatatcaatcagataaaaggaaaaaaacagtgggacccaccatcctctctgtacacggacgacgggagaggagcagccgacgcgtccttctctctccctcccggccatccttcctcaccggcgagcgcgcacggagagggaaaaaggcggcggatccgttggtagctgcccgccgttggtgttcggtttggatccatcaataaccagcccgattcctcgcacccacgcaagatccaaaacggaaacttagacggcacgcggatccaaaccgaataccaacggcggaggaagaggcgcgcagtgaaagagagagaccagcggatctaccacgctcgccatgcgagaaaaagacggcgcgcaacggcgaactctgatcaaatcccaatcaatagccggcccgattccttgcacccacgcaagatccaaaatgaaaactcagacggcgcgcggatccaaaccgaacactgttagatttaattgggtaattgatccatttaaatcaaataaattccaaggctcattatgctaggaattatgctaggaattcatgtgtattcattttcttatgggatatcaatgggatgaagagtttatgagaattaatccatttgactagggaattggtaacttatatcaattactcctaattgatggatggttgatggttgtgtagtggaggatggttcatggctagttgatgacaattagttgctctattcctcttcctattccattggtaacctacatcaattactcctcattaatggttggttgatggttgtgtagtggaggatggttgatggctaattgatgagaattaattattccatgactcttacccttcatcttccattccttctataaaatgagaatggatttgatctccctaagaagaagtgagacacactttcatccatttccaaggctgttgctgctacaataatcccatcccgacgagtgtgtgcacacgcgttgggagagtaggcctccgaaaccatgcaaaccatgcactgctacgacgtttgcacggacgggcgggtgatcaggtttttggggagcgcaaggcgcgactactcattgttcgtcaatgtctacttcatcttcaccaacatgtcgaacactggagacaacggcaacactggagacaaggagaaggaggctcccgacaacaccaacggaggcaacactgcctcaaactctagcggaggaccattcttgggtataaccttcttacattatttcaattagaagttttactgttaatgttcatcgcaatgtcaacattgcgttattatgtgattgttgatgcttattctacgttaagcatgctcatgttgattacattcacctctatcactggatcaaatcccattgtaaatatcatgtttaacaccaacggcgggaaacgaccagtggatccgctgccttttcccctctccgtgcgcgcttgccgacgaggaaggatggccgggagggagagagaaggacgcgccggtcgctcctcttccgtcgccgtggattgagaggatggtgggtcccactgttttttccttttgtctgactgacatgtgagccccacattgttgtttttat

SEQ ID NO: 19887 - DNA, 722 bp, Oryza sativa
aacatgaaaacttatttaatatctagaacaattatgacgaattcactcttctaatagtagcatgttgacccccacacatgcattcttctaaagaatgtaaactaagacagataactccgatataattcatgcatttcctcctaatatccagtttcattgcattaataacttggcatccagaccttaagaggataataaagcgccattgtgcacaatacaatcaatcattaacaacccaaattcatcacaacaaagtaatttgctaaaattcgataatatgccatcgaccagtttagaatgcagagtaaacagcatactgatactagagaatgcgtcagtctgttagtcaaggcatcttacctggagacacgtttccttgatgccattcctgccttccaaaatcccagcttcttttataggttcctggaagcagccacaacttagaattgcacactatggcatgtaggcaggtacatttgaactaccagttacatgcataccgatagtaatgcaactcaccaaattacgaactggtggaagagaaattacaagatctacatcgcttgttggaagagccaaaccagtggcatttgagccaaatagatttgtacgggaacgaggccagagaacttgcaaacaccgtgtgacccttttgacagcccaataatatagggcttcctcaccagattctcggcagaaacctaagttcacatttggaatca

SEQ ID NO: 19888 - DNA, 647 bp, Oryza sativa
acacgacgaacgtgacgtcggcgccggtcttgctctccaggagggcgccaaggtacgcgtgcaactcggacgacggcgccacggctgcattcgcgctgtcgcccgccgctgccgccgccgcggctatctccggctgttctcggagcacggtgatggcgcactgaacgacgtaggaatcgtctgtgagatagcccgacgcctccagctcgtcccttgccatgaacacggcacggggcgagtagtcaccgggcttgtggaacttatgcgacacggtcttcatctccgacggcctcagcttctgcgtcggatctaccaagcagcagcttagctgggccttcacactgccgctgcctgtgcggggcgcgccgcgcaggacgagcttgagcgtgagcggccggtcgcgcctgccaacccagggatccttcggccgcaggcggatctcccagtcgtgtccgccgacgcaataccgcctggaactgaagaactcgccgtcgtccatggccattgtcaaggagtggcccacgatcttgagctggatgtcgttggagcgtgtcacgtcggtgagctttcccatggcgatcgatcgaatcgtatggctggactggacgtatcgtggagagagggctaggtgaggaagcgagtggaat

SEQ ID NO: 19889 - DNA, 6206 bp, Oryza sativa
agattgttccatcctctagaacctgttcgatattctttcttttttgaacaaagtcgatgtcagcaattgaagcagctacggttcctggaatttaataacaattccggaggtaagttaaaaaccaggatataggaaaatagattactcaaaaccaagtataacgagctgtgaccacaaacctccactaaaatatgtcttgttcaacagattagcagcctctgccataaaatggaaaatatacaaaaggtcattagaaaggttatcattcccttgcaaagaataatgatggcaacgatttacagattgctgttgttagttaatttatcttatcctatccaatgtagcttagattataatatgtgtaaaaagaaaaaaaaaactatcatgctaagttaagtgataattgctagttgcataccattttttacaattagagcaccaaggccagttggatagccaaatatctgcaggtttgccaaagatatcgatatcaattggtgacttctgtaggaccaagcatttcaaaacacaacaggtgcatgtggattaccttgtagaaggaacatacaacaaaatcagcaggatacacagttaaattcggtggttcagtggcacatccttttgcagcatctatcagaaccatccatttacccctatattaatgcatttaataagcatgctaaagacactagagtccaaggaaaacaaggcaatgatcctgcaagacaaattcaatgcatcttactgctgctgcaatgggatttttccttccttgatgagcttaaccaagctcagactgaacttttgtcctgaaaaattgcattctgacgggaatgcaaatatattccaattgttccctacagaagaaatgaatggggagtgagcataaatattaagcatcgcactggaattaatcttccaaatgagagcaaaccaaaagttttgctatcaatatttctagttatccatgttcattccacattgcatggtcatacaatatgaccatgtcaaaccaataaaccaaataaacaaacttcttaaggaaaaatccaggaatgataaatgtgttcccagttaactccctcataaagaataaaagaaagctagagaaaactgaaaacatcattaacagattggaaataagacaatcaaattctctgtgtaaattctacaatattgatcaataattgaacctgatcaagaatatgttattcagcaattgtaaaggacaaaaataaaaatcataagggactgacctgaaatatctgaaagacttccgttctgacaattgtgtgaaagcacatctttgcttcttctttggtttgtgcgtcttgaaatcttatacaaactataacttccattgtcttttgccagatcagcaccctcctcaacatcaacggccaacacagtagctcctttactcagagcatatctagaaatttgctaagggaagacaaaatttacaagatactatgtgccaatgtgaatttcatgatcctacacatagactgacaggaataaatggaattttgagaaactgcccaggagaaattcattgcctcatgtttgaatgcagaacacattaccgagcatactgatgaaggtatcaagatatcaagctatgtacataaaccagctgtatatcccactagttttgcatgtatgtgcatagttctgtatgctttgactagtcagataatagagttataatgatctgagaaacgttttgtggtaggatactctcttatcccaagcacactattgtgattctccatcgtgtacatgtaacagctttctctactccatggaaaacattcaccaacaagtttcagagctgctgttgccccagaggtaaatatgcacttgtattctctgggagatgcattgaagtattttaaaacctgtgaaaaacaggtcaacatcactacaaagaaattagcagatggcaaaacttgtaccatgcgcataactggatatagtaaagatgtagctgtgcaggcaccctgttgtagtaccttggaatcaaaacaattcatgcaacttcctggggcacaaatcattgtacgtagtagtagataagaaagtagcaataactagggcgtaaaatggaaaaaaaatggatgcaggatgactcatcatgcaatgtgccaatgctgagcattggcatagactgatagagcttaaatactattgccatgaggcagcctaaattcactattctcccgaagtaactgttctggaaaactagcacacaatacctgatggcgtgcagcagtaacgaggtcactcgcagccatgcttgaatcactctgactatctaataagcatgtcaaagaacacatccccaagaatctgcagtgcaatgttctaccaaggtaacaacaatgaagtgtccagaacactgtctcaaagtctaaggatacgtgggttcccatatacattggatgcaaggtctttcaagacatccgccatctgcgcctctgaatacagcgtcgcaccggcatggtccaggtaagccatccctgctcctcaagatcaagaaagaaagaaaattaaaaatctagaaacctgctacaaatacaagcacatttgtttttttatatataatggaaatcaacccggatttgcttcatagaagctatagccaattcttattacatagtttgcagctcacactactgcagttccaaacatcaaaacaagcacaattgttgaagcttatgtagcaaaattcggtaggatgctagattcttcactctccgcaacaacaaacctaatagatttatcgatacaacagtgagttacagcaagaaacgcggtcatctgaccgaacgccacaagttcctatccatccttttgttctcacaaaacactaatagaattccatttttcctcccagaatttggcaaaaagggaatcgacaaggtcgagattaggcgcaccttcaagccgcttgaactcggcggcgcgcatctcgtcgacgcccttgggcgcgcccgggtagccatagtcgccaccgaactgcctcaagaactcctccttgctcacctccatccctccccccctcgactgcaagaatctcctcagctcaaaccgcgaccggcaatccaatcatcccagctgagcccaatccaagaaggggaggcggggaatccagcggagcgggagggtctcggattgtccagaattgtgggattcccctcgattgcgactgattgatttgatttgattcttctcctcccctcgtgctgggagacgtggagtggagctggagaagtcagcgccgtggatgtgggatcgatggggatgggtctcgtgctctcgtctcaccgaggattaaaagaaattgtggcgcgcgtgtggcttcgacgacggcgagaggtgagcggcgcgaggtagacgacgtaatggctcacgcactcttcggttcggtttggttttcttcggttcttcgagattctggttttttttttattcacaggagaaaaatataagccggattaatttctgttggaaaaaacaaagaaaaaccacgcaggcgttgctgcagtgcagagggaaggggatggaagtaaaagatggaagttgggaacggccaaggtgaagtacgacaagtctacaacctgagtttatctagtttttttttcccttgagtactctctcctccatttcataggctgtgtttgcatccctatgttcccagcccatctccctcgttttccacacgcacgcttttcaaactactaaacgatacgttttttgcaaaaagtttctatacgaaagttgcttaaaaaatcaaattaatctatttttttaaaatagctaatcaaatttgcttaaaaaatcaaattgcttaaaaaaatagctaatacttaattaatcacgcgctcccatcactagactccgaacacagcgtggagtactatacactttaattttttttctttaattaaattttaggcttgactaaaatttaggtcatcatcatcgattgctcatattctgtaataaatcaaaacggtttactagaaaataaaaataatttattaaaaattattaaaagtcaatacttaaaaagaaactacgttaaaaatatttaacatcttattcgttaaaaaaagttaagtgttttatagtattaattataaacgaagggagcacttaagaaagaaaactaaataaacgaaaaaaaatgttcaattattattccttatagtttttcggtttatttctgaccacctacaggacgcttccgtagattaatgacgttgaaactgtttcttaaacatgtaaaaggacatgcaaacacgtatgccacatgcgccacctacggcgtgctgcgtgcacgtctcacacatatgcttatcaagtgcgtcaaaattgatttgcaaattgcaacattcaaggacacgcacgccccatttgtcccgttggcagtgacgtgatttcgcagcgttctatcgtaaatgccagaaaactagtaatttaattttgatctgattaatgtcaacgaaaaaaaatgtgtcttatgataaaaattttcttagcatatgtttggtttcgggactaagtgggatgggatgaaaccatccctgattttggagttgggatgattccactcacatgtttggtttgtaggatgggataattccaattttttgtttggttgaaaggatgaggaagagatgggatggacgccgtttgccatcaccgtcaacgaccgtcgcctgcgccacctgcatccacgcgtggaacaaccggatcaagcacagcggcagcagcaggacggccaccaccgccggagcacccaacccgctggcccaccgtcgtcgccgcggctggatcgggagatcccctgcgccggatccgccgccgccgctctccctacctccaagtttcgccgccgccgagtcccccttctctggatccgccgccgccgccctccctacctccaagcttcgccgccactcgagcccgccgcgtcgacatcaccgcagctgccgcaaccgctctcgtcgagcatcacgatgagcggcgggatggcgccgagcatctcgctcgcggcggcgaccggtgttaaggcagggggtcgtggaggagcgccggcggtcgcagaggtggtggcaggcagtcgtggcggagcgccggcggtcacggaggaggcggcgggcacgggcgcggacgagcgccggcggtcaccgaggagacgccgtgtgctccatccaagtgggacgagctcgtccggccgattttgccggatggatttgtcccggatctgggaggaatattcctctctagggaccaacccatcccactcgcccctcaaccaaacacctctaaaagtgggtttgtcccatcccatcccatcccatcccaccaaccaaacactaccttagagatcccacaaaacgcttgccaatggtgttgaatctgtgcttgtttttaccactgagaaattcagacttcagtttagcaaaacgatctttggaattcgagaattcaactgaagcttatatatggtaaaaaatctagccagctcacatgatgattttacaaagcaagcacctggatagatcacaatatactatgcaaaaacaaaactacatctcgccgggtagaacatgggactcatggatctgaaagttgcacagttctaggtttgtaccttgcgaaacatactactgaaagttaaactgtacataagctcttctttcaggttagggaattgcagtgccggctgggttgccatggtagtaaaactagtaagcaccacagatgctgctaacttgaagggaaaagaactgcagcagcagaagctcaaggaagctcgaggtgagacgccctagaacaaccaatgcttcttcttggttttgcgggttaggagatctgcattgtacataacaggagcacattcagaactaacaatgcaaaatatcatggtagggaatgttagaatttaatgatgtaagaatcataagcgaaaattcgatgttcatatagtctaagaaagacactcaccgtcagttgcgtacaaggaattgtagtgcacttcacaccagaagcttagccacaactctacaaaatgcgggtcatgaaagaatcagataccatcggtgagataaaaagcgtcgcatggaactaagtatgtgatgatcggagcaacacagcatcccagttctcaccccttgtgggagtcacatccctgg

SEQ ID NO: 19890 - DNA, 18470 bp, Oryza sativa
ttatatggttcaaccaaacagtatgaaccaatgacatgttatcatacaggtaaactgcaggtgtcttcctaaggacattataatggatgttagccagcaataagccaataatgaatatatgcatttatcagtttcatttgatgtcctgaagtaggatttaaggtataaacgatggacaagttcaacaatcagaaagatcagtcgttcaaaaacaatcagaaatatctgcataaaaaaaagtctaaagggggacctgcagttaaaaaaagatgtattcccacaaactattcaaccatcataacaccacaacagctaacattaccctgtctgcagctgcttgtaaagtcagatgatccccccattccccagatctgcaaggtgatggttatgaagtatgagtaagtaggccaaaagtaatggaaaaactctctggatggtggattataaccttttcattttcttcaagtagactttatattccataggtacatagctttcatactgttttctgaattcctttagctgaaaaacagggatagtgtttcagcacagttgcatattcatgacagtgcatgattgaggcaagaaatccacctgtttcatgactaactttctcacatgtttgtgataatcggggttgcgaaatatctggtctgccaaagctcggaactgtaacaatatggcatcaagtgaaaagggaacaggtttaagtacagactggtgaaggtgtagttctactaaacacctcatagtatcagctataaagatcaaacaacacaggccacttaatcttcaaaagaatgtaggccaatctattattcactattcagtataagataatggcagcagccttaaaacagtaaatacaaaaaaaaaacagctgcttcaaaatgttactctgaaatagtgtagatgatgcggcaccgtatctataaatgaaatgatgatttaggttcaatggtaaaaacaaacctgacaatttccatcaccctctatttgaaactcggccaaaccataatttcccaacctgtcaagaaggatcaggacaaatgagaaatataagaaagcgcaatggccatactgttctagagagagagagagaggtctgttttttttttacctttccgacaatctttcatgatccaaagttgcattatcaagattagggatttttccattaactcgaggagtgtgctgccatacatgagggcattagtaacttgtcataaaacatagccgaaggcacactattgtaaattaagaactttatttttttatttaacaatctgcagttaaaaactgtaataattatcgtattagttattatattgagtactgtattggaatatttatgtacaattgagagagaattcctatatttaatcatggtacagctcaagatgagttcaagggaacaaatgccaaggggggaacaaagaaaaatatggatgactgtatattaccgggattgaacccaattgagagaggcgccttccaagactatgcccactgttgttctttgcttgggcgaggaggctacctattgttatagatacctcctcctcgctctcctgtgtactgctgctgatgcttgagctagagcttttactagtactatcctgctgttccgacatcctatctccaaatggacattggcagggtcttagactgataaaaggcttcaaagaaaacaagtagcagaaaattattgtaggagtccagcaacatgcattcgcatgataagaaaaaattcaaaacaacttgtagcaaccaacaagatgataaaaacattgcacttcttgcctgattgatattaagagctgcaacacatgttctaagatggaaacatgccgttatgttttaaaatttttggacagcaaatgtatacagatcttaacaacccctgtaaggatatatttcgatcacgtttgaattccttacatctcatcacaattaatgcctaaaaactaggatcttctggacacggattccaattccaatcagcaaatggcttatgaaagtgactaccgataatggactggataagaagcaagcagcagtgtgttttcacaactgcaaaccaaaggagggtccctccaacacaatcatcagtgtgtatctttcagtgtaattgatctgcctctaaaaagttccaactcctataacctcttttactccatattagaatccgaaaaatataaactgcttttaatcgaatcgaggtgatccgttggtacttggtagaacggtactcagaatgagtgctttccaaggaatcgaactgatcgaccagacaataaagaaacaaaggaacacaccacatagcagattagtcgcagataagctaaacttttacatgccctaccatttggggaccaaagtaaccgtctttttttttgccaataacctcacctgggtaaccaactgattccaaaaacagatttagccaatcaactaatcggatcttggatgaatccatctaaggggctttttttttcctacccagtcctaactcagaacacgaccacctggggatctttactcatcagtgaaaattgaacccaagagatatctatcagattgagatatcaatctagaaagaaaaaatcaatccaatcaaaacaatcaaaagcaagaagccacccaagacccaggaaaacaagcaaagcctcatcactcaggtcggccaaaccctgatgctcatggagcccaactacgatcaatcagcaacccagctcacagatcggacgagatgatcggatgagcgagggaacttactagcttcgtcggatcaaaaggccactctcgccgcgccgcgccgcgcgacaggagggtctcgagttcagtagctcacacttgctgtcggggctcgagctgatgagagcgaaggagagagaaaggccatctttcattccctttcctcttcccttttcttttggtttttaaattgggagaagaaattgtaaccaaacccctcaaaaagatgcctttttgctgtttttctatgacctatttccgtgggtcgaccaccaaactgatgaatatatttaaaaaatccaaaaatatcactgcctccttggagttgagttatcgtcaggcaggcacagtatttttcttcccagtgcttatctcactcaccgcacaagcaccatcacctttttctctcttttttttaaaaaaaatctgcttagtactgtactaattagattcttttttttttgcggttaaaaaattcagaaataagataatttgagtttgggcggcgattttggtgtattttgtcctttcactgttctgaagatcttcaatgctcatcacccacttgcatctaccggtctgtctccatgccccttcccttctactactgtcgtactcggtacatcagcaatttcagcagtgagctcacagcaaaatgttgctacgtgcagtctgaccataaggtatattcaggatttcaggtgattcagaaatcgctgagtcatcagtggacatgaacgctttcagaccgatcgagctgtgctatcaaccgcattgattttgtgtggggagaagaagcttcaggcttaattttgcctgaaactttctggcactgtctagcaacaacaggagtgccactgaaactttctgccattccgctgtgttcaaagtagtactgttcatgcaacaaccaagaaaagtttctgatggtgcacatgcctgaggccctgtgtagtttctagaaagtttttcccaaaaaaatcacattgaatctttaaacaaatgcatgaagcattatatatatagataaaaacaaaaactaattgcacagttaggggaaaaattgcgagacgaatcttttgagcctaattattccatgattagccataagtgctatagtaacccacatgtgctaatgacggattaattaggctcaaaagattcttctcacggtttccatgtgagttatgaaattagtttttttattcatgtccgaaaatccctttcgatatccggtcaaacatccgatgtgacacccaaaaattttcatttcgcgaagtaaacggggcctaatcttagtatctgacgttgagaggagtagaggacggtgcgggtgaccgacagcaactttctactatatgccaaacttctggaaataggaaaaagttactactcgcaggcaatcgagacccagttttgtaccagcttatacggagtagttctgaattgaacagaggctgcgtgttttgttgacagtttgaagagaaaataatggtgaattacagattactaacttgtaagctatctgtactagtgctactccacacagagatagcgtgttttgtttgacataactttaactcgcttatttttagttggattttcttatggccttttttttaggcttttaagtctttttttcaatgatctataagtcggtggataaagttttaagtttaagggtgaagttatacatctactttacattaaaaaaaacttctccaatttagtttgtggcttaatagtgtaagagtgacttataagttataactttgaaaagccaaacgaaaaacctatttttttgctttggattataagtttaaacaaagagaacgttaacgctagaaatccttaaaagttgagccgatggtagatcaaagtaattgagacatttgttttgttagagacgagacattttgtttatatcatagataaaaataacttttatttcatatataaattcattcatagtaagaatctcacaaacttgaagcaatacaaaagagggtcacgtagaaaaatcatcggcattatcttttcgcttatgcttatacttattagccaaaaataaaattttcaacttaaatttggagttgttttgtcgaagtttattttccagcctttgcttttagatcactaagaatacacatataaaaaaatattcacaaattattttccgtttacaaatatgccatttggcttattcccatgataagcaaaaacgatggcgccgcatttctcacaaacttctcagacttcaaccaatcttgcatgttgtttagttttgggcccaaaatttaggcccaattatggccttgttttggccggcccatgaacaacccaggcctgcctccgagggaagagaaaaaacgctacacagagtagtcaaccaacctgcactgtaccacacaggacacgttccaccgcagcagcacaaacaaatcattccgtgtgacactacgtgggacgtgccagacctgcacaaaacccaacccaaacccaaccaactccacccctctctctactgacacgtgggccctccacgtcagcctcacccccctcttgtggccagcaacgaagcgccccgaagtataaagaaacatccacatcgcgcacagcacagcgtcgcgtttcgcattcttattttctcttcgcttcgtcccccgcatcgacacgcacgcacaccagcagcacaagcacccaaaccctagctcgcggccgcggcgaatcctgcgcgcgcgagagagaccccggctgatggtttcgatgagcgcgacgcccaatccgatcgatgcctccgtcgtctccgccgccgccgccgtcgcgggcggcgggggaggtggggatgggggagggggaggaggagggaaggagaaggagaagcaggtggtggctgcgccgctgcagccgccgatggccgtgcctgcaccggcggcggcggtgggggaggaggcgaggaaggtgaggaagccgtacaccatcaccaagtcgagggagagctggacggagcccgagcacgacaagttcctcgaggcgctgcagctgtgagtgcccccaattctgcccccgtctctcgctctccctcttatctctgcgcgcgcgcggcgcgccccccgtggttggggatagtttggcggctttcgtgctgctttttttttttaatcttgtatggtggcgtctgtgtcgttgtggagtttggatgcgattgtgcatctgctcctcctgcgaatgctaaccctgggtagtttgaaagacggctttttttggaggaggtattcaattgaggataggtttagcctgctgggtcgaattgggtggtcgaatctgttgagctgagcagtcgtggttgggaggcactaccttctaggtctcacattttgggtagactatgatgttttgattttcgattgatcttttaactgaattacggtgctagaatccatgcgttcagtaggggccagtagcttgacaggcgtgcttctttcatgtctactccctccgtccgaaaatgaaccaacttttgtatgtgaatatggacataggctatgtctatattcatttacaaaagttggtttatttttggacggaggaagtacaatctcgttgtagctgtaggagtagggaggtttatgatattctgatccttggatttgtgaaccaagttgctgggtttaatgttgggaagagtgctgttggtattatctaaatgtaccagtggttatagaatttcctgcatgttagggttacaatatttatttttcctgaactcaattagcatctgatggtagtttaaaacaagcatttcattgcttccttttttatgtgggatgatagaggtcgctctacctgataaacattgtattaatggaagttaaaatgtgctacaaaatgccatgtagggctaaaccaaaaaagaaataaagggatataggtggtacaacctgtacagaaattgaaaaggttataaataagggaaagagcaatatgcaatgatatcaaatgttagaatacccacctgttaataagcatatagtgtggttgttttgctcgatagatccaaatgcaagggatcacttgatgatttttgttagcaggcgacagataacagttttcatcctgaaacagtcctttatgtgaagcagattggccagagttgttgcaagctttgaacttccaatatcatacttgtcaggaattctaataggttacctgaactgttagctttctcgagcataccaagtttgtgccataggcttccagcagtcttgcatcttagtattactattatgtaaccagttatttgaaacgctggacagtgtgggtattcattcagaccagttttcctttgcactaggctgatctctataggctaaccaaaggaaaacatgacagtagtggggataggttggatcgagatgttttcagtagaaaggtttctgttaatgtctcttgttggttgtttctgcatggtaggattggacacggtaaagggtgcatcttggaataattcagagaaaaaatagttctaaaatgtggatgtgctggtttgttatcactattaacctttgagatctaacattattattagaggattgacagatattgacagtgtgggaacatacaacagtagtggtaatcttattgaacttgtaatttgaattaacgtgggcctgtttattttataagacttatatctcttaatgttgctggttactgctaaacttttcgaacttaactagctacatatcatacacatggctgttagggtgacttttctgtataatttatttgatcgctaaaattttcttgttgattaattgtaattagggtggtcaatgttgtgtacacacctcttaaatgtgcttccttttcttttgtttgatttaggttcgatcgtgattggaaaaagattgaagcatacgttggctcaaaaactgtgatacaggtatggttcatagctacctttcaagttaacgttttcattcttctctgctagcctttggagtggcgtgttgatgtttgatttgaggcgttctatatgtatctggttggcagtgtcacacatcatttgaaatttatgcacgccacatattatttgaaacacaccattgtattctgtctgttaattgttgtcattttattgacttatagaatcttatgcctgatatgaaaattgaagcgctatgcttgaagccttggaatttcactttccttctttttttaaaaagaaacaggcatttctgtgcaactgtaatctatgcacctagttcaaatatagtttcaagtcaaatcaacttggattacacttctcgagcgcgaagttaaattacatttgcaaacttgaaatatagtaagtgctcattagcaggcacaactaccctatgctgaacggttgggagtatgaccatattctggaagttcaaaatgcatattagtatcctacaagtttaaaagatgttttttttgtgccaattaaaatgaaatgctcctacaccattttggtttctctctgcaaaatctaaaaagctgttcttttgacagataaggagccatgcacaaaaatactttttgaaggttcagaaaaatggtacaggtgaacatctgcctccacccaggccaaagcggaaggcagctcatccatatccacagaaggcctctaaaaatggtttgtactgctcagcagcctcagtcttgtaatattttttgccatcaactatttctagttgggaagtagtaatcggaattatttagcttgtgcagtttcgccagctgctatatcacaaccccctcctctgggggagcaaggttgtgttatgtccatggatacatctcctgtcatcagaaatacaaatgccagtgctgtagtaccctcctgggacaattctattgctcaacctttaagtgcaagtcgcacgcaaggtatgtttacctactatgctcataaacctctgtccaaaattaatgagaaaaatccaacaaatgccattgacgaactaaatttggcaggtacaggtgctgttgctacaaataactgctctagtagcatagagagtccttctactacttggccaacttctgaagcagttgaacaagaaaatatgcttcgaccactacgtggtgagtttcctttatttagtatacggtttgcagacctatcttggcaaatgcatgttgatcaacagcttagtttgtatgttggaccaacggtgttggaacttagttaatgatttggttccacaaaggcatcacatttcataattgatgatccctgatgggggggtttagactagtcttctatagtcaatggaaactaagtttctcatgttgtttgcatggttgcaagtaatcatctacctttgaggcctgactattcacatacgtatagtttcacgtgtattgaaatttgaaaatgttattttgtcatgcaacaagtccttgacttacttattgtgaaatattatatcatatttaaattgttaaatattccttgaggtaggcttcagtgctttattccactatattcttataattttgttcctctctggttacacatgcagctatgccagattttgcacaagtatacagctttctgggaagcatatttgatccagatactagtgggcatttgcagactttaaaggcgatggatccaattgatgttgaaacggtatgtttcttgagatttgagatatagtttctgaatgttctatgattatatcgtatccttttcccaacacagatattcttaattttgaagtagcggaaatgttagacagatgtgcatttatggggccccagttgtagaacagctgtaaaagtttcagtgatactaacatttcacttcactattgttgttcttagaagcctttctttgttcagtaaggccaaaataagactttgcattctcttccattcatagctcttacccttaactaaaaaatcatctgctgcaactttccacatttgaaagaagttattcgtatattttatgctaaacacagtaggaattcattgtatcaatatatatataggttgtctcaccattctactgcattggtttcgatcaattcatgttcttctattttatggacaaccgtaccattgttacttctagtttttcttcacataactattttatttcacttgcaatgaacactggttgatctgacaaattgacaggtactactgctgatgagaaatctgtccatgaacttaactagccccaactttgcggcacatgtaagttgttctgtttttgtatttgttctccactgatattatgcatcttgtagctatctaaacatgttatgagtaatttagagtttgaactgtactagcgttaaggtttgccattttggctagttattgtggttagggttcttgttagctgaatttgtgttcgaagtttggggtagctaataatgttttaaataacaaacaattgactggctactttcatgattactgtgatcagattgcattagttgcctaccacatgcttactctcatccacctgtgttcttctggatatctagtgtcaagttgaccgcatccatgtcctctcaaacttactttgcaggatttgatcctgattgggctggctacaacagccatagaaactttatacggaacttttctttttcctgaataactaaataggatattattatcatggtttcgtggtatatagtttctacagatatgaaatgcattagctatgtcaataagggcatattttatgttctacacaacacttgcatttgacttcgatttgttatagtgcaatgtcctgacattttgactctacctgattgcagctgagcttgctgtcatcatgtaattctggtggggacccaattaagtctgaaggcatggaaaatcttggatctccacagagttgccatctcccgttcatgtaatacttcagttactctcgttttctaggtgcttgtaatctgattttatcccatcttgctgaagcaacttttcgtactccagggtaacaagtgagtgagggagaactgcttgtatgcggacgaagcttcagttgtttccacaagacgttcttgtgttctctttgtactggagttgtggacggctgatccggcagtttaccaacgctagcacgtgttgtggccgtggcatctgtatagcttccaataatgctctaaccctaggctagttttgctcatcaatcatgttcatgtagatagccagttttgtgtgctcagcaattctttttccctcggggtggggcatggctcgaaatgtttttgtatgtgtacatctttgtatacatgtatgtaaatatgtgtgatcatgtaatgcttaaagatactgttgactgatttgaggtaataatacaataaaccagtggggcactcgggtgtagtctctagggcgccccactgttgtgaaatgtgagctctgaagttgtggactatcttcaaagctatgacctagtcgagatatgtgttcatctaagttcgtttgagtttgcagctggtattgattgcgctatggttctatagctgctgttgtacaacccatccccaatgtacattttcgaccttcttggcacctgtttgtatccgaatactgaattgatatgcattttcattttatctgaaactgaagtgcatcttcatttctaccctcatcatttgctctttggtttacaggttgcagttaaaaattgaaatttttaaacttcattttaaattattctaggtgtcattttcatcattttctttaagctgataaaagtagaaatgtaaaactctaccctaaaatcatattccatcacatttattttctacggaatattaaccacttccaagattgtttttttttttcccgaattcagcatgttcctattcggaattcatggctgttagcggcgtacccctccatcccataaaaaacaacctagtaccggatgcgacacatcttaagactatgaatttggacataaaatatcatatcctattctagattcgttttttcatggaatggagggagtacctagtaagggtcaacagaggtcattgaatactggtgattttttttttacagttataagttatgtatttataccatgtgggacacccttactaagttaaatcgaacacatgagaaggttgcttcataagttagatgagcataaggaccatcggtaattttcttagcgggttcactgctaatggctatggttgtattaacttatatttttttgttgttaagggtgtaatgccgctgcttgcagccataactaaggctatagggagcgttcttctggccggctacaatggttgcagttgtagctacgcacagtgagtgcggcactattcgtgtcgatcatggtgcagtcacaaaagcaacagccgaaaatgctcattaaatagagccgcttatttttaagttaattagaactgatctaaaagttttacatataaattatattttggttgatactaataaaaacatgatggctggaaacaacaagacataaattttggaggaaaaaccgctgtaaaatacactccgtctcccacaagagaacacgccattttggcaggcgtttccccctccgaactccaccgaggtgatccctcccatggcggccgttagctacgagtagccgcggagacggaagactctcccacctagcaaaaggactagtagcaatccagcgaactcaaagccacccctcctcgtctccctcgcccaagtccacggcgagccgcggcggcggcggcggcggaggaggaggcgcagcgagtgggaggggaggcggaaaatggtggtggtggacgcgtcggagttcggggcggaggggttcgacccgaagcggtggatcaacgcggcgctggacgcgcgccacccgtcggagccgctcgaccgcttcctcgccgacgccgaggagcgcctccgctcggccgccgacgacgccgcggccgcgctcgagcgggacagcgccgacgcgctccgccgcgtcccgctcgcctgccgcgacgcgctccgcctccgcgacgacgccgtctcgctccggtcccatctcgcctccgtcctccagtcgctctcccaggtgcgcccccgctcgcctgctagttggatctggatctcacagttcactcgtgcacaattgtacgtgtatcacgcgaaacccagatcattttggaggattacgaacttgcgataatagttggtgcgaatgagcaaatgttgaaccaatttggcacaataggttttagtttgattcatttatgcgtatgattcagcctctggccgcttttagtaccccccgttttttcacttggatctggatctcacgtactgtatttggtcatgtcaattttatccttgtacgctttgcattgaacagtgcgtacaactagaactgtatttagtcatgtcaattttatcgctgtacgcttttatcaaatgatatgttaatttgatcatctctgttaactgaaactgaagtcagaatttgcgtgggcttggcaaaaccaagctggagctctgttggcaaaatccttgcatgtgtcgggatgttataatgctgtgtacttatgcaatgcagttatgtgcatgtaaactttgagtatgctgtagaggacattcaaatccagcagttcagtgatgcccataaaactatgcctatagtctattataatgggataccgtcacttatatcatttagttcatataggtgataggtcaggatgctacatcaaatcacaagcaaaacattttctcctgtagcatgtacttcttgttacgtgtagcgttatcttctcataacatttagcttgacattttgtagaatacactggaatgaatttgctagcactagaacttttttttttgggtactgagtgattccttctttgtaacggccaatgctgaatactgggtgttaatgaatgaaatatgacatacatatgcatgtatgatcaactaactaggtattcagtcccatctacatttcataaattctgtattactgatgatgatgatttcttcaatcaggctgagggttcatctgcagagtcaataactgcactagcacgaattgatactgtgaaacaacgaatggaagcggcgtatgcaacattacaggtaagttgtatgtggactatggtgcatgttactgaagtaaatgcttcactcacagtggtaggttatcttttaatagatttaacagcttgttggtcggaatgccaggatgcggctggactagctcagttgagccaaagtgttgaggatgtattttctagtggtgatcttccaaaagctgcagaaaccctggcaaccatgagacattgcttgtcggcagttggtgaggtattgtactctctcacacaaacatgcacagtacactgagtttatatgcagaagctatttgttttgcttatataaaagttgctttcaggttgcggagttcgctaatgtgagaaagcagcttgaagtattggaagaacggctagatgacatggttcaacctcgtttggtggatgcactttctaaccgcaaggtttttcttactaatctcatttatatttgttaaacagtagtacaggcatctctatttcatctaaagcctacaaattttggttggaaggtcgatgctgtgcaagatcttcgtggaatactgatacgtattggcagattcaagtcactggaggtgcaatatactaagatccatgtcaagcctctaaagaaactttgggaagattttgatctaaaacagagagctaagcgggtagagatggagaagtatggtggagaaagcataaacagtctctcatttgctagctggcttccaaatttctatgatgagacactactttaccttgaacaagaatggaagtggtatgttcattgtaccctgttgtcttttgttctgaatcagcaatgtttgcccttgtaaacagaagccagtttttggcagcatcttttagctgcattcggacaatatttttgctccaccaaaaattaatggatgttctacaatgctaatgctgaaggtgcctgactgctttccctgaagaatacaaatcactagtcccaaaagtacttgttgaaaccatgagtgagttgaattcaagttttgtctctcgtgtcaacctagcaactggagatgctgttcctgaaactagatctgttgcaaaaggtaatgcataaacttctcgtattatttcatttttgtatgtctatactaatttcatgattgaattacatgttttatttttctctgttcaattaaaaaaggatattacttgtttgccacatatgcgtacttctttcgtaacaataaattgattttatgtcctctgtacccaggtatactagatgttttatcaggtgacttgccaaaaagtaccaaattgcagaataagcatcttggagcactgatcgacctgcacaacatgacgggcacttttgctcggaacatccaacatttattttcagagtcagatcttttagttctgctgaatacattgaaagctatttattccccatatgagacttttaaagcaaggtaaaaaaaaaacttgtgaaaaattctgttgcatgcagttaactgcattggtgagattttttttgttgctattgctgtagtactcagccagtggtgtttcatgctatgtaggtatgggcaaatggagcgtgctttactttctgctgagatggctggtatagatatccgtggggccattgctcgtggtgtgggtgcacagggtatagagctgagtgaaactgttcgtagaatggaggaatccatcccacaaattatagtgcttcttgaagcagctgtcgagagatgcattagtcttactggtggttcagaggcagatgaactggtattggctctagatgacattatgctgcagtacatatcaaacctacaagaaactttaaaatcccttaggattgtatgtggggtggataatactgcacatagtgattcctctaaaaaggaagcaggactagagaaaaaagaagcacaacgattggtcgatgtctctgaagaggaagaatggtctattgtccagggtgctttgcagattcttacagttgctgattgcctaactagcagaacctcagtttttgaagcttctttaagggctactcttgccaggattggaaccaacttttctatttctggttttggttctagcctagataaatcaactgcagcaaatggtgatgagaatgcagaagtgcctatcacagggagggcagcacttgatattgcagctattcgcctcaccgatctaccagacaagtctaagaagctcttcactgtactagaacaggcaagttatatatttttaaattatcttgctagtgtcacaacactagagttatcacatgtttctctgatttgtttgaacagcctgattgcaaacttaggtggtagtattaagctagattatctggttttataggaaattcggagatcttttttagctttccttttctattatgcatttttttaagctactcatatgtggcatagaacctattttttgacctataatttcccaagtatcacaagtaactctttgtttgtcttcatggctaatttaaagataacatttctgttatacagtcaaaagatccaaggttccatgctctacctctgacatcacaaagagttgcggccttctcagacacagtaaatgaactcgtctatgacgtgctcatatctaaagtccgacagcgtctcaatgaggttgctcgcctcccaatttggtcatcggtggaggaaccaggtggccttccccttccaagcttcagtgcctacccgcagggcattatgtcgcaccagctgtctgcgggcagatattctgcctatacttttatccgccagacagctctggtagaccatctttgcagcaaggtatctcaggcggtgaggctggcaacgaggaggctcagttctttgctactgaatggatatttaaggtaatatattcaaagcattttttttcatcatgctgtgtacattcgcaacataccatcgacaaaaccattcatacttcacactgcgactttcgcaaattccgtacagaagagttgaccatttagaactacatgcattgcaactgaatacaacattacatacaaaccccaataatctggaccacatactatacacacacgcgcaaactccctaaaattcctgtctctgccattgcacatctcaactcccttagcaaccctggttcctcctgcatccctctgctcttcccatgcatgcaactcatggtctccggcaaggcgccaccgcgctgttcatggagcagctgcgagggatccattacatcaccgaccgaggcgcgcagcagctggcggcggacatagagtacctgagcaacgtcctctcggcgctgtccatgccgatcccacccttcctcgccaccttccacacctgcatctccaccccgagagaccaggtccgcgacctcatcaagtctgacggcggcagccagctcgacctccccaccgcccatctggtctgcaagatccggcgcatctcgtcatcagattagtgaaacacaaaggttgccttggtttgttcacgccctgtaacatcgtgtgcatccatccctccaccgttttcccacatcctgagcaaactgatcctgccgacgagtggttgacagtttgacatgtgcttgtaattctttaccattctgcatcttggctacagagttttgcctgtgtaatcgtattccttacagatagagaataatcattagtatatcatcatagaagaaaattctacactatgtgtaaattcgacgaggaaaaaaattcagtcggcaggtcgtgcaagggaaatggacggctctggctttgtttacccaataactaatgttggcagcaacttagtatgtcatattgccatgctctgaccagtgtgtcgccttcacatctccaggattccaagcagtccaatcttgcgtgagccgtgagtccagcagccacgacactacaagccatcggaggaaaaccccactggctacgaaaatggcacgcaaaaaatacgagccatttgccaatttcaccaggacggagagatatttcacttcgtctccatgggctttggcttccgtctaagtgggctcatctcttccttatcgacgctgtgggcacggaggcggccacgtcgcccccatccccctctcctcctcttcctccccaaatccccacgcaactgcgcaccggagagagagagagagaggccaagcgagcggaggaggaaaaatcaatctgccgctaccctcctcgtcggtgtcgggctatttatacactccactccctcctccctccccttcctagttcggcccaccccccccccctctcccctccacgccccgctccgatccactcaggtgcgtgctcgtttgctttggattcagtgcttccctttacgatttcgcttgcgtgcgtgggtgcgtgcgtctggttctgtttctagcttgaatccagtgtgtaagtgtgtggcgtttggtctctgatgcgatgcggatgttctgtttgttagccagtatgcttttcggaatttggagtactggtctagctttttactggtaaagatggtgggactgagatcgttagcgtgttcgttccaatcgataggttaatcagcaagtagaagctacggtgagctactgaattcggatttcatactggtt

SEQ ID NO: 19891 - DNA, 1040 bp, Oryza sativa
tccttcgagtggcgttgcacagaggccagtttctgtgactgcctccctcgagcacaagactaatgatgccagaaggaagttcctaaagctcgcgcttgggaacctcggggtcgggcttcccaccttgttgggtgctaagagagctcttgctgaagagcaaggtgtctcgtcgtcgagaatgtcttactcgaggttccttgagtatctagacaaggacagagtgaagaaggttgatttgtttgagaatggcacgattgccattgtagaggctatttctcctgagctcggcaaccgtgtgcagagagttcgtgtgcagcttcctggtctaagccaggagcttctccagaagttgagggaaaagaatatcgattttgctgcacacagcaaccaggaggactctggttctcttctgttcaacctgatcggaaacttggctttcccacttatccttattggtggtctatttttgctgtcaagaagagcacaaggtggccttggtggacctaacggtcctggctttccccttggttttggtcaatctagggccaagtttcagatggaacccaacactggtgttacatttgatgatgttgctggtgtcgatgaagcaaagcaagacttcatggaagtggttgagttcttgaagaaaccagaaaggttcaccgctgttggtgctcgcatccctaagggtgttctgcttgttggtcctcctggaactggtaagactttgcttgccaaggctattgcaggggaagctggtgtgccgtttttctcgatatcaggatctgagtttgtggagatgtttgtcggagttggtgcctcccgggttcgtgatctcttcaagaaggcaaaggagaatgctccttgcatagtatttgttgatgaaattgatgctgttgggaggcaaagagggacaggtattggtggtggaaatgatgaaagggagcacactctgaatcatttgctgactgaccacggatggttttgaggggaacactggaatcattgttattgctgccaccaacagggctgatatcctg

SEQ ID NO: 19892 - DNA, 10521 bp, Oryza sativa
agggctgatatcctggattctgctttactcagacctggacgttttgacagacaggttagtttttatccactgaacattcttttggatgtgaacatctgttgtattctagtttttaactcattcaattgtgacacaattaagtaaaaatgtttcagctatagcgtttacctttgttctgtattattgaagttctcacgtggttttaggctagaagtccaataaatactcgttcttggttgtagcttactcacgcaatcagtttggatgcttttggtttcgagcttgagttatctttgagtgttctcaaagttagaattttgttatcctcatatgtccaaaaccttgctaacattatggatataccttttaacttgttgcacaggtaagtgttgatgttcctgatgtacgcggaaggacagagattcttaaggtgcacggtagcaacaagaagttcgatactgatgtctctcttgaagtcatagcaatgagaacacctggctttagtggagcagacttggcaaatcttctaaatgaagcagccatattagcgggccgacgtggtcggacagcaatttcctcaaaggagattgatgattcaattgacagaatagtggctggtatggaaggaactgtgatgacagatgggaagagcaaaagtcttgttgcttaccatgaagttgggcatgcaatttgtgggtaagagataatctgcatatttgctaactgtgcttttgtttattacttgcatatcaaaattccgtgcaactattcatatctggaaatgtattctttgtagaactttgacgcctggccacgaccctgtccaaaaggttactttgatcccgaggggtcaagctcgtggtctcacatggttcattccaatggacgacccaacgctcatctccaggcaacaactgttcgccagaattgttggtggccttggcggtcgtgctgctgaggagatcatttttggggagcctgaggtgaccacaggagctgctggtgacttgcagcaaattactggcctagccaagcaggtacgctatatttctattctagaactttgctaattgatctacagaaactttgaagcagtagactatgtaatctgttctgcttctgcaccttttatgacttacaaaccagtctggaggataaatttgctgcaaaataacatgctagaaaaactgacagcatttacatatatattaaacatctgttcttagtccttcccctttctttcttttgctaattacacctggggtcacaatgcttctgcagatggtggttacattcggtatgtcggacattggtccgtggtcgctaatggactcaggagctcagagcggcgatgtcatcatgaggatgatggcaaggaactccatgtcggagaagctcgcggaggacatcgataccgctgtgaagcggttgtccgatgaggcctacgagatcgctttgagccagatcaggagcaaccgggaggccatggacaagatcgtggaggtgctccttgagaaggagacattgagtggtgacgagttcagggcgattctctccgagttcacggagatccctgtcgagaaccgggttcccccagccacgccggcagctctccctgcctaaagccactagttttgtaggaactggaaccatgctgtacagatgttcatacttttcgattctttggtgtacacgtaactttactttgcgcggccggatctttttggcatactacatgtaacttactcttggttaattataaaatgtaattagctgaaaaaggtttcttgcaatcacttcttaaccgggaaaattcatggtgatggactcgtacaatggtagaatacaaagggtgtgcctttcacaggcaatcctgtgcgtgctttttaatggcttggatggaattactacttttttgatgttccaatctgaccttagtaaattcgacaatttatcacatttatagtactcctacatcatcagcaattattgtcaatgcaacttcatttaatatatcaactatgcagggacaaaatgatagcgctgtcatgtttggtttcctgtgcttgtgtccctgatatattttgcatgcaacgacaaattttgcctgatatattttgcatgcaacgacaaattttgtccaacggatcatatctgagctgtgatcacagttttgatgtgattaatgttggcgttaaatttatattggttagttgatcgtgcattcgtgctaccaaaaatgtaccaaaacctgtcaacactatcaaacctgcaacttcgttggttttgatcgctcttcaagcctgaaccacaaacaatgaaaatcgtggcctgagccacaaattactcaagtctggcatctaataattagttgatcacccatcttaatataagagagaagttcacaaggactaggttaccagattagtggacggtcacggtgccaattctagatttggaatttggaaccaccaatcttctagaaaaggaacaaaaaaacaaaaagcaaaagcgaagtgagcgtaactcaactagttaggtttcttttgacgaacccaggccacttggattcaaattctagatttgatatggatgctcgcacttacgcgtggtgacttcgtcaatctcaagatatatcgctccagtcttccggaggtgctcataagggtaaggtaagtgtgtgtgcgctataataagcgtctatgtttgtaccgtgtttctaatcctatcttactataaagttatctcccactaattccttaagcttaacatgtaaagatgacacatcatctttcactaacaagatgccgcatcatcatccactaattaacaaaatgccacatcatcatccactaacaatcatcacatttaaacatcatgcaaacatgctatatttttatagtttttataatttaagagcttttcaaatacaaacatgttaaattatcgtccaacataattaacataatgtttcaatgtatatatttattatgttttatgatatcctatatacttatatagtttatccttatttagttagtgcttaaatgattaatctacggtccaaattatctttctcctttttttcctctaattaagccatatcacatcaattgtttgtagcctttagatgattaatctacggtccaaactatcttcctattttttttcttccataaaatcataccaccttaccttttacgtttgaatcaccattccacatactatttgaatttaaattatcataaatcacattaatttacttaatctgatattatctagctatcttacacgttatttttttttgttatcatacgaaattcccgcagcaatgcgcggggtttcacctagtaaaaaaacaaaataagtgcaaaatatttggaaccatcaatccaagtctagaaaaaggaataacgaacaacaggtgaaaaatgcaaaagaattttgcctcacgtccccactggccccacctgccagctacacagcttcacatgtctctcccccgtctacggacgcaggctagaggtggccaaacgggcggcccggcccggcacggcacgggcacgggtccggcacggcccgtttcggcacggcccgttaggcacggctgatgaaacgggccgtgccgtgtcggcccacgtgccgagccgccggcccaagcacggcccgtggatggccgggccgtgcccgtgccggcacggcacgcccgcggcccacgggccgttcggggcacggcggcccgtgaaggcaggccgccagcccacagtgcatgcacagtgtttttttttttaaaaaaaggaaaggaaatgtataaggaaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaagaaaagaaaaaatggtatttttgttgttgtcgttgaaaaatttagacaatatagattgtgattcattattttgaaataatttaaggtaaatccacacttgcgaaaatattgcaaaagaatctgttaaaaatagtaatgacctttattaatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaagtgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctccgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacatgtgacaatgttagagtagaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagcttccacaccggccgcaatgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacacaaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgcgtaccgtaccgtctgggtttagcataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtcgcctcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaaccgcgagctcttcaaacctctgcgatcaaactgttgaactacgaaactaattttgatttttgacaaaatttgagcaaattttgtcaaaatcaaaaaaaaatgcacacttgagaacaaagagagcacttaaaacacttgagagcacaagatgaggagtgtgggatgaggagaaatggctggggttcatgccctatttatagggcgaaatttgagattttttgaaatttttatgaattttttagcctcccaacggttattttcaaatttcaacggtcaaatagccgttagtgccacgtgtcgccgtcccattggaccgccgcccgcctgccgcgcctgacgggccgccgccgtgccgtgccgggccgtgccccgggccgtgccgtgccggcccgctacagtagccgggccgtgccgtgccggcccgcgtgctcggccagcggcccaagcacggcacggctaaacgggccgtgccggcacggcccgttactgtagcaggccgtgccgggccgtgcctgctacaggtccggccgtgccgcgcgcggcccgtttggcccggcccatttggccacctctaacgcaggcccagcccacactggccatactcctccctcctcccccaattcccaggtcccgaccaaccccaccggaggcgaagccgcacacctccccacttccgaccacgcgaccaccatggcctccgcctccgtctccgcctcgccgcgcaccgcgcggcagctcgccgacgccctcaccgcgcacctctccctctaccacgccgcgacccctccccctccctcctcctcctccccgcgcgccgcgatcctccggtggctcgcctccctctccccgccctgccgcgccgcggccgcgacctccctcctcacccccgccgcggccgccgcgctcctctccatgctccgccgcctccgcgctcgcggccactcctccttcttcgtgctgcatcctccttccccttcttccgcggcggtggccgaggagggggcggcggcgcccaccgtcctctcgcggctctcccgcggcctcctcgcccgcgccgcggaggcatcccgcgggcaggggctcgtcttcgaccacctcctcctcttcccttcctcccccacgtcgtcgtcgcgcctcgacgcgatcacggtcgcggaggaactcctcggcgacctcgacggtttcgtcgcggccatggacgagatctcgggtgggaggttcctatgcggtgacggggaggtggacctggtggcaatggtgggggaggagttccccgagctgccctggctgaaggccaaggggtactacgtgatcgaggagttcgtggcaaattgggtggagatcgcgctgcggatgtcgtgggcggcggcggggggaggtggtggaggtggaggtggggggaggaaggcggtgagggttgggaagggtgtcaaggagaaagctggattggcagcaaatgcgttctggagggagaaagggtatgtggattggtggatgaggctggagccgagggtgagagcaaggatcatgggagcattctttgggaagggcactacagcactggtaatatgcttacttgtactgcattttgaaataatttgcattcatggatttaggatactgcagtgcttccatttctcagttgtatcttctatggaagtcgaaagcatcgatgcttgtattttgggtagttagctttgccattttttgtgtgtaaaaggaacgattgtgagaaaggtggtgcggaaataaagcaaatatgtgatcaaagtaacatttgcaaagatactgatgcatagttatgctattctaaaatcagttgttggaaaacaagctgaatatgcgctccacaactctgtagaaacgtgtgctccctagttttcatggaatcatgggaaagaaagaagtgatgatttggtttgtgttaaactgttaatgctaacttttacaatgtaggtttgattttaagtcagtaagaagatttaatgggctattgaatagaagggaaaatctgtgaatctttccatggaaagatttcaaggttttgctatcatctaaagaatgggtgatcaaactaagcattagttatgctttactggcgttggaaatgatatacggaattcttgttgttatgtactgtacgtacatagaagaaaagaataactcttttgctcaactctatcattttttccccaaaaaggttggtctctaaaaatcatatcaaataatgacgtcttattggtgtttgtttctgataaagatgattttgaagttttgttgagtcagatattttgtttgtctttataggattgcttttatgttatagttactaccaagctaacacaagtaggttacttttggcctgtatgacttgatgtacccacaattctcacctagatatagcataacaagttgaaaccttttggacttattctgttccattatacacgtggattgataattaatcttcctttttgcaacaaatgtgcccttactagacttgttataactaatgaatcaaacaattgttattgttactatatgaactttgttgctgacctagccatttgatgtggtgtattggtgttcaggcttgttttacatactgattataatttggcaagaaaatcacataagttggtagtagttaagttggttaagttgctatggcttaggcacacctaatatgctaatagcttaagtttgcaggctaatgagatcattgaaggaacatatattgcttctagcgagaaattcagtttctgcttaggtgaaccagagtcatttgttgcagagacttattatgaaagcacacggcagtcttttttcagaaggaatcgaccttgttgtcttgatgttccaagcacactgtcttgtaagaagaatcccattttcgtgaaagaattgcaaaggctgatgctggttcaggagatagtgtacttgaagagcaatatttctaaccgtagtggtgatgcaatctttttcactaaattaatgtcagctggtactgttgctgaccatatactcatgaaattacgaggaattctcatggtggtgtcaacggaaagtataaatcttgaactcattggggatgaagcaccaaaggctgccaaaaagaaagatgttgaaaagatcagcggtggttctcgaaaaggaaagaagaagtccagtagcttgaaaaagctaataacatcttctaagcaaatgaaggtattgatgctttgcttgctcttcaattgatatagacacagatctatgtgattcactgacaaagttacctagctgacttaaggacatctttccaggacatcggatgcagtagctcagatagtcatgatcctaaggttttgccagatcaacagggtccatctgttgtgtgcactactattgaacatgcatctgaagataatctttgcaaggaaattgcaccaacgccaaaggtggtaagcattattatccgaattcccccccccctttttgtgtgcgttagtttaatcatgaatatgagtgataacctccatatgtttaggagcaaactgttgggttgggtgactgcaagaaccaatgtaacagcaaaaagagaaataagcgtaaaggaaaaactaagctccataatctgatgaaaactgagaaccctggatctggcacattgaagacagatgctcctcatattgctacagaagctccaaataaacctgttgaagcaacacatgtctcacctcatctcccatcatatgtccatcagtccaagagttgcattcccaaagcagtgaattgctgtgactcttccattgcacttaatggaacagatgtaaaaggcattggaaacacaaaactggaagataccttgcattctcccagagtcagctcgttgttgactacagaatgttctcagagtgtgaaaacatctgatggctttagtatgaatgagcaggtcatatcgcagaatggccagaatgaatctacactccaaccatcttcttgtttgccttccagaa

SEQ ID NO: 19893 - DNA, 1388 bp, Oryza sativa
acgaacgagtccctaccagacttcagcctcaacgggagcatgaccgccaccgtcgactacaacagcagttcgagcatcctgtcagtaaagctgtggataaatgacacaacgaatccgccttacaacctaagcgacaaggttgatctcaagagcgccttgccagagaaggtcaccatcggcttctcggcggcaacgggcgcatcagttgagctacaccagctgacttcttggtacttcaactcgagcccgtcgttcgagcataagcatgtacgtgccgtagttgaagcgggagcaaccgtcggggcgacgttgttcgttgtgctgctcttcactgttgcagctatcctcatacggcgacgtcgaatcaaaaacaggaaagaggcagaggatgagcaggacataagctcggacagcttagacgacgacggcgagcccatcgtggagatcgagatggggactgggccaagacggttcccatactatgagctcgttgaggccaccaagagcttcgcggcggaagagaagctcgggcaaggcggctttggcgcggtgtaccgaggctacctgagagaacagggcctcgccgtcgccattaaacgcttcgccaaagattcctccaagcaagggaggaaggagtataagtcggagatcaaggtgataagccgactacgccaccgcaatctcgtgcagctcataggctggtgccatggccgcgatgaactcctgcttatttacgagcttgtccccaaccgtagtcttgacatccatctccacggcaatggcaccttcctcacatggccaatgaggttatcaaccctcgctagttctatctcaatctttgtgaccgtattaattaacatatattgttaaattaaacttaatagattagctaacttattttttacagggtcaagattgttcttgggattggatcagccctcttctaccttcatgaggagtgggggcaatgtgttgtgcaccgtgatatcaagccgagcaatgtcatgcttgacgagttcttcaatgccaagctaggcgactttgggctcgcaaggttcattgaccacactgtggggatgcggacaatgactgcagtgtccgggacaccaggctatgttgaccctgaatgcttgatcaccggcagagcaagcgtaaagtctgacgtttatagctttggcatcgtcctgctagaggtggcatgcgggaggaaaccgatgagcctactagacagccaaacggatggcgtctttcggctggtcgagtgggcttgggatctgtatggcaagggagatgttctcaaggttgtcaacgtgcgtgtcaacgatgatcacgatgtcacagagatggagcgtgtcatcgttctcgggctatggtgcgcgcaccctgat

SEQ ID NO: 19894 - DNA, 1337 bp, Oryza sativa
aaccgccattacagtgttgcttaacgacttgcccgtagttcctcttcttaatcatcgttgggattctaaaaatcgaacctaatcatcttttcggttttgttaatagttttcatcagatgtcccattaaccgtcaccacactattgctttataggtctgttgttcctcttctctttattatcatttgctattattgtatttttttaatggactattgttttacaattttgtattttttcattccttttttatttgaaaattttatttctacgtgaactcttatttttatttttctattttttggagcttattttattttttctgaattttagttaacctcgtattctattctacatgtatgttcttgcaataatcatttttattttaaaggaaaaggatataattggagagaaaagtgaaaagaacagtagaggataaccagcaaaatatcaggttaggaaaggagaaggataaaattggagagaaaagggaaaagaacagtagaggataacatgtatgttcttgcaataatcatttttattttaaaggaaaaggataaaattagagagaaaagggaaaagaacagtagaggataaccagcaaaatatcaggttaggaaaggaattggataaaatggaaaaaacgaagagatcgatggaatcgaactcatgaactattggtcaaatgtttcagtctaaccaattgagaatcatcgacattgtgctacattgtgtagctacattttaaaaatatgggtaacgttagtgtgtccgcccctgcaccctatacatgttggagcgcggtaaagaaaaaaaattggtatggacccgcccacctatcgaaccttatctccttctctgaaatcctccacctccgcttctcagttctctctggtcgctttctccgtctcccgaatccccgtctctcctcctttgccaacagccgagagttagagagagcgccgcgccgccgcccccgtctcttctcccaccggtccctctctctccctctcgtctctcccttgccggtagcagaggaggtggcagcgatggcttcagctgctcccgcgggccggatccgggagtggcggtggagtcggcggctactattggcggatccggtgacggtggcggtggcggtgtttccggcaggcggatccggcgggcgattctctaccacctcctcctcaccctccacgcccaagcttgtcctgcggcagcggcggtgacatcggtgctcccgtgggcagatccagcagaagtggcggcggcgttctttttggtgggcggatctagtgtcacgcaatttctaatccaaaattccaaacgcttacatgtg

SEQ ID NO: 19895 - DNA, 770 bp, Oryza sativa
ctctttttctttttttcattgatttttattttgctaattgccgacattcccaaatccccacatcaaattgacgtcacagatcgaatgaacatactaaacaacaaaatcatccacaaattcacaaatcatctaaaaaaccacaaaatcacaaatcgtccgccgtcaatggcggcaacatctcctctggcgccgcccgctgttgacggtcgttatcgatcaatttcgcccgtcaatattaccggaataaaaggagaactagtcatgcttacaatgcatatagtgttagaataaaataaaatccactattacttggtttactaacctcttgtagagaataagcaataaatggagaagaatatgcatcaaaacactcgatcgatcaatcagacgatgccgagaatcacacttaaaggaatgatgggctgaaaatatcaatttcagaagacccaaaatgcccaaaattcataagtctgcggagagatgaagtcagggaggccgcatgataaaaagtgggctggttgtgcctgcctgaggtaacactactcatcgccgttggatgcagcgctttgggggaacaacttatattagcccccaatgatggttggagggtatatccgaccatttcaaccatcacaatcgtcattgggaggctatataaaccccttacactctcacttttctcacacacttgaagcaacaaagctctcatattctctcaagttaggttactgctctcaagctaatggaatcggaataaaaatggaagcaaa

SEQ ID NO: 19896 - DNA, 17136 bp, Oryza sativa
  unsure (1)..(17136): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctctaccggtgatcacgcattcaggatcaacatagcctggtgtcccagagacggcggtcatcgtctgcatccccacggcatggtcgatgaaccttgcaagcccgaagtcgcctagcttggcattgaattactcatccagcatgacattgctcggcttgatgtcacggtgcacgacacactgttcccactcctcatggagatagaatagtgctgatccaagcccaagaacaatcttaaccctgtgacaagttaagaccaagttagctgagtttaacacgccaattaatttaacatcacaaaggaagtttagatgaagttaaagagaacaggtactaacctcatcggccatgttaggaaggtgccattgccatggaggtgaatgtcgaggctgcggttggggacgagttcatagatgagtaggagctcgtcgcggccatggcaccagccaatgagctgcaccagattgcggtggcgcaaccggcttatcaccttgatctccgacctatactctttcttcccttgcttggaggaatccttagcaaacctcttaatggcgacggcgaggccctgctctctcaggtatcccctgtacacggcaccgaagccgccttgcccaagcttctcctccgccgcaaagctgttcgtcgcctcgatgaggtcttggtatgggatttgccttggccccatgcccatctcgatctccacgatgggctcaccgtcatcgtcatcatcgtcatctctggccaaccctacgtgtctcgcctcctctgcctcttctacctcccttctcttcttgctccgacgtcgccgcacaaggacaactaccatggcaaagaggagcacgacgaacagtgctgcaccaacggtggctccagctataactccggcaagtccggaacctgaggtggtcggggaatgttgcaccgccggtggtggattctgctggaacgaggagttgaagtaccaagaatgcagctgatggagctcaagggataagcccgtcgccgccaagatgccgacggagaccttctccggcaaggcgctcttgagatcgacggtggtgctaaggttgtaaagtgtagtcgagccattcgtccatgtcttcaccagctgggccgacaggatgctcgagctgctgttgtagtcgacaatggcggtcatgttcccggtgaggctgaagctgggcagcgactcggtctgcaccgatctgatggagttgacgtcgatgccgatgtggtcgtaggttgcgttggggtcgaagtcgcggtttagataagtgtcgaattcgacggcgacgaaccggttctcgccgggctggacggtgtcaaagtaccggctggtgaggccgagggcgccaccgtcgcccttgtccggcatccttgacgggtagccgacgaggaagaaggccatcccgtcgcccttgttgtccaaattcgtcggagtgatgttgaaggagaagcgcgtggtgaagctggcaacctcgccggtggcggcgtcccagagctgcaccggcggcgtgtacgccacgcgtcccatggtgccgctgctcggcaggttgcttccggtggtgatctcgatgcaccccccgccggcgaacgccgcgctgccctggagggtgatgttcttcgcgttgctgaaggtggagtagttgaaagataccgtggtagcgacgacgctaggcaagcagcgcagcatgacgagcaagcaggctagagcagaagcggcagccatgaacggttttgtcatgaggacgccggcggccatggccggtctttgagcagaatcagcggccggacaatactgccaatacgaaaactactactcgaagaatcagcaggtcgccactcggagagaccagtcaagatcttaaggacatagcgagttagcgtagtgagaagaactctactaatttaacaagttggtgccttggtggttggcaaatcaattaggctccatgagaccatgactctgacaactctggttcctcggaaagtgctgtatcatattttgtatattttcctaataattttaaatgaagttaagagtaagtttcgtttcttgttggtatcttcaattttcttctgatacattttcaagaatgataaaacatcaagctggtttataaaaaaaaaggtgaagctttggacattggcataggccctgcagattgagtgcaaatttttcgtcttttttcaccaaattttataaaaaaaattataaaatttagctgctcctcttacttgatcaaatatccaaagatagatgatctgaaatcttgatggtatgttaactagggctacgttcgggaggttgaattccacggaaaatggggttgtccattagcacgtgattaattaagtattagtcttaaaaacttgaaaaataaattaatatgatttttttaatgtaacttttctatagaaaacttttataaaacacacaccgtttagcagtttggaaaacatgtgcataaaaaacgagagagtagaagttagagaaagttggtagcgtgggtaccagacttgctgtggtagtgtggtggcatcagttttttattattattattttcatgcaggtagtgtgggtaccagactactcccctcagtactaaaatttaagtattcttaaatacttttaaattggaaggttttgattggttaaaaatagaaaataggtgtataaattttagaagtttatgatttgttaaaaatagaaagtaggtatagaaattcaatgagagattgttattattcactgtaatgagaagataaagaagaaataactatattttttaagataaatttaaactctaaaagtaattatactactcatccggacaaataatactggtcgttttgaacacaaatgagaatataagatcaaactttaaaatctttatctataataatttctaaaatatttatcttagaaatatggagattatatgtatagagtagtcttaaaaagtattttaataatatcatttatttgttattgttttcatatatattataataaaaaataatgtttaaagttgttttctagatgttgtagtattgtctcgaattggagggacgagccaatatgttgatttgatatatgcgagtggcactggcacacattcgagttggaaatgcataaatgcatgtgcgtgaacagaagaagataccgccgtgcttctttggttctttgacgtaacttgtttttggcttacgcttacccccacttgccttactttctggatgtcagttttatcgaaagagatgcgggcaacttaactaaacccactggttagtactatacactgttgggtataccctctttgctcccggtttacaacctctttagtcccgggttacaaactgggactctgaaagcaggactaaagatatctatcttttgtctcggttgaaataactgggactaaagattcaccaaccaggactaaaggtcttctctttttctttttttcattgttttttattttgctaattgccgacattcccaaatccccacatcaaattgacgtcacagatcgaatgaacatactaaacaacaaaatcatccacaaattcacaaatcatctaaaaaaccacaaaatcacaaatcgtccgccgtcaatggcggcaacatctcctctggcgccgcccgctgttgacggtcgttatcgatcaatttcgcccgtcaatattaccggaataaaaggagaactagtcatgcttacaatgcatatagtgttagaataaaataaaatccactattacttggtttactaacctcttgtagagaataagcaataaatggagaagaataggcatcaaaacactcgatcgatcaatcagacgatgccgagaatcagacttaaaggaagatgggctgaaaatatcaatttcagaagacccaaaatgcccaaaattcataagtctgcggagagatgaagtcagggaggccgcaggataaaaggtgggctggttgggccggcctgaggtaaccctcctcatcgccgttggatgcagcgctttgggggaacaacttagattagcccccaatgatggttggagggtatttccgaccattccaaccatcacaatcgtcattgggaggctatataaacccctcaccctctcactttctccacacacttcaagcaacaaagctctcatattctctcaagttagtttagtgctctcaagctagtggagtcggaataaaattgtagtcaaagtccggaagtcttcggaagagttcgggtatggctctagtagctttactttcttcttttgtaagactagtatttaatttagaatatacttttgtatacgactctggtattgtaatactctccaattatatgaatacaagctttacaatgtctgagatattatgattatactgctagcttatctgggagatgcattggtacgggtataatgtttgcatatgaaattactctatgtcatgacgatgatactagagtagtatctggtagtttaggcatggtatctagattactcggtatcattatttggggttatatgctgcggatgagaggtgggccgctgatggcgacagctcagtatgggtattcctccgcgcgtgtatatagtcctaagttaattccctggggagggtactcctccgtatttagccctggttgaatggttatgacgggctgtcgtaaggaactcagctgtcaggggtggcttctcaaagtaccaggagggcatcggaaagggggtattagctagttaatcatatacctaggatgtatgtataatatgtatactagaagtatagaaatagattcttttctatactctttccacttagcttaggagatttaatataagaatgagtagcttatgcttgtgtgtcattctaccctgcaattatatttacccctgcttagacatgattaatacaagtaacatataaatattagtttggttctctctattataatcttcccatgggataaacaaatatgatacccttggaatactctcgggtgaaatgctacaatggtatatccatgcgcttgtggataaactctgtaaccataatataccatgactatttttggcgccattgctgggaattatatttctagtaatgtcgttaagaaataccaacaagcatttctagcgccgttcccggggaagatttgtaaaaagagattactaaaactaatatcttatatttacctctatataatcactgtgctttgcaggctaaccatgttgttttcaccttttgttgtgaaaacagggtagtgcatgacaggtttcgacttgccggaaaattttcaagaaaatccagaagtcttcttccgaagcgtaaagccgcgggttgttcccccgcagaagactcttccgacaaagaagccagccgtaccagcgccaccaactttcaagactatggctgacaagaccctccgcgagttcgctgctccctcctctgagaacgtggccactgggccgcaactcaacatgggagacgtggactttgacctgaaatccagcctcattacgatggcgcaggctagcccattctgcggcaagcctaacgaggatgctaatgcacatatgcaatggttcctggagatctgcagcacgtacaccgtaaagggcgtcagtcctgacgtcgtcaggctgcggctgtttccgttttccctcctcgggaaagcgaagcagtggttttatgccaatcgtgccgtgatcaatacctgggacaaatgctcgatagtattcttgtcgaagttctttccgatgggcaagacaaatgcccttcgtgggagaatttcgagcttccagcagacacgtgatgagtccattccagaggcatgggaacgtctgcaggagtacgtggccgcctgtcctcatcatgagatggacgactggctgatcctgtagaacttttataatggactcactcccacgtcccgtgaccacctagacgcggcagctggaggagcctttttctctaagacggtcagaggggccgtcgatctgatagagaaaatggtctctaatatggggtggagcgaggtacgactctagtcccatcagcaaggaatgcacaccgtcaaggagacggaaatgttcactgcaaaactcgacctcctcatgaagagattggacgaacacgagaagaagccccaaggcaccgtcaaggccttggactcacacgttacgtgtgaagtctgtggcaacacgggtcactctgggaacgactgcccgaaaacccatgaggaggtgatgtacatgggtaacaacaacaataacaacaatgggtatcacccacaaggaggtcaggggtgaaaccatccccgtccgtatttccaaggaggcaataaccaaggtagcttttctaatctgtcttccttaaaggatcttgtctttgcgcaagccaaaactaccgacgcactcaacaaaaagatggctgccaatgacaagatcttagaaaatataaatgtgaaactagatggctttgcttccgcatttcaaaaccagttgagtttcaataagatgattgaaacccagttggcgcaacttgccgctctagtacttgcaaatgaaactggaaggatcccggggcaacccaaaccctccattgaaaatgttaaggtgatcacgacgaggggaggtaagtccactcgcgatccgccatatcctaacactgcaggtacaagcaacacgcgggaagcaccatccaacacaacggctgaagaagaaattcagccagagaagaccgtgccgcaagactactgcaacgcgaggttgctgccattcccatagaggatcaggaaaccgtcagttgacgaatagttcgctcgattcgttgaggtgatctagaaaatccacatcaacatgccgttgttggatgctatgcaagtgccaacgtacgcacgttatctcaaggacatcctcaacaacaagcgaccactaccaacaaccgaggtggtcaagctgacggaggaatgcagcaacgtgatcctccacaaactcccggagaagaagaaggatccgaaggatccgaggtgtcccacaattacttgctcaattgggacatagaaattcgacctggcgctctgcgatcttggggcaagtgtaagtgtcatgcccaaggatgtctttgacaagctcaacttcacggtgttgacaccaacaccgatgcgccttcaattggctgactcatcggttcactacctagctgggatagcggaagacgtaccggtcaagatacgagattgctttatcccggtcgacttcgtggtgctagacatagacactggcaaggagacaccgctcatcctggggcgtccgttcctgagcactgcggaagcaaacattgatgtcggaacgggaagtatccgtttccgcatcaacgggaaggaggagaagttcgagttccagccaaggacggaacaatgctccatgttccgaataaagtacgggccagccccgtagaacattcagacggtcgaagtggagccacccaaaatggatagcctcatcgtgtttatgaagaaatctctagaaattcaaccatccaggatgaggtcccgttattggaaaacgccggtaaaacccaagacaccggccaagaaggaagaaaagctggctcagaagaagccgccgcccataccaagaacaaagaaggtatggcgtgcgaagcagaaaacgcccactccatcacctccggagacgggtgaaaaatccgtgaaatgaacgtcggaggtacggtcttgcacgtcggacttgaagcgacgccgccctcgccaataggtaaattggtatgtatcctcatatttgttttcatcaatttgatttctgcaacaaagcatgtttgaatttttttaaagaaattgcatttaggtttgaattttgtggcaattattcaaattgaatttttcagagcaaaatggaatcaaattttaaatcaaaattttcagtgtcacgaccacactgatcgatcttgtagattgttgaactctggagcaccatcatcctcccgtttgagtccttcagctttgacttccttaagtttatcatcattagcagagcttgactcaggcttctcatcaaccggtggcaaatccaccttgtgtctttgaattactgtacccgaacgagtcagaacaaatgaatgtaagtaccgattttgcagttgatttatcatcccttcaaacccttgcttctgttctgatgttagcatgtccatggttattggaatcacattgtctggatccacctcggtagacttgatgtccaccatgatggaagcttgtcacactcgtgtcccaccgggcgtgccaaaagcatgttgatgcgaaaaacacacactggcctgagagatctgcttaactctagtgcaggtccaaatcttggtttcgagttcaaaggcatgctagttggtttgatcctgcaaccaacaagaaacaaagaaagaaacacagttaaattcataaacgatagccgatcggccatgtgccgatgacgtatcgtttgtaatctagccgatgtaacgtgaattagatcggtaatgatatgtaaagaaaaaaggacggttagatctagtcgatcggctgtagatattaacaacatataatcagtatatcaaaatatgttgaaaccatgtgactgggatagatcggacaacttgtcgagacagtataaatcacttatgtctaaaagtacttcaatataaagattatatatgtttatagcatagccgatgttgcagatctgacatgtatcggctaatactccgataccactttatactgagatatcaatatagacaaaatatattaaacagagatcaatcaagtattaagatgacttaacagattaataacgtgcttaatatatttaattagagtgagatcttaatataaagggcagacttagcatattaagtaaacataaagtagacaaaataaccaaatcaggtaagatcggttgaaactccgatgaaaccctaatcggcaatcaataaacaggctagagattactattctaatcacaacttataagctcaaacttaactaatgcagcaatgagtatgaaaagaagaacaatatctagataatcaagtcattgattgattcctaggatggtggatatactatataatctaagtcaacgttggtatttaaccctatcggttgccttccaacaagagatgtttgccaattctaggttagatagcaatattgatctagattatataggaaatatgataaattgacaacttacataaacaagattaaagtatcattgagatgaaagcactaatcccgagaacacaagccgccataacaagttttaccttatcatcggagatcgaaccgatgcagcccaactcgaaagcaagaactcgtcgaaagtaaacgaaagtgaaaggttggcgaagcagcccaacacgggttgggctacttttatacccaacccaaagtacataatatgcccttgtcagacacgactcctaactctattacaacttaggatacgaacaagtccctaaggcagactcttaccaactcaaactgtaagtaaattacataaaatatctaattaatagatacaattgcttttttcagactcaatacgcacgtggcaatcctcatgaagcatatcaacccgatccgacaatgattgcaatgccatcttgtcggaatcgacttcatcggctaccttgtccgactcgaactctgccgatgcataccttagccgattcgatctccagccgatgcgcactctgtttccgaaaccatcaacctccttcgattccgcttcggttttaatctctatctccgatccatgatttaccaaatttggtccttaacaccgacaccgacctcgacattgttggtgatcgggagctacaagcctaccacatgctgaaggaccgggagttcggccacaccagggcgtatgatccagaacttctaagaaaaacaggtatggatgttgattttcacgctgttagcagagatttgtagtagtagatgagccaggttctcgtttgcttactatacaatttctgtgcactttgaaagaaacagaagatagcatatccttttgttttttccataaggagtatacactttcatggaaaggattaagcacacttcttggttttcacgataactgtaaaatcgatcttcggaaaggaatttccgggttcgagaaaaacagattttgggaagacatttctggtgctccaacttgcagaaaacctaggacaaatgacatccataatcctacacttaggcttatgcacaaatggattgctatgactttgtttccttgaggtgatcttagacccattcggggagatgagttgattatcatgtttgccaaggttaggaagactaaagttgctcctgttaaatatatgattaggcaatggttagaaagtattaagtataatgcccctgttgagtgcacttccttgatcacccgcatagcgaacggacatggagttatcaccactgatcaaatcgagtatatcttcactgtccatccctatgtggatgaaacatatttaatgcaagggcatatacttaagcatggagccgatggctctttgatatactttttcccctgtacaaatgaaatcccgttacccaatgcggggtatcatttgtacaactgtcaggaactaaccattcccctgcagaccatagaagaatctcgtgcaggtacatcctacagggaaacacgcaacaaaccaaggcaaaaacacgaggagtcatcatcatcaacacccatgcagatgtacgaggcggactgggaaccaacgggggatgcacccggttggacccaagcaccacgacacaacacaggaggttcgtcctagcacagtgccagtgagaaccgctggcaagcaccgcgtgaagtacactgggggaacgcgcacacctgttcctctggatcaagcgggatgcctcccgcctccaactgttggcgctcaagttcctcccaggacttgggtgaaatcacgaggaggctagacacccttgatatgcagacaggagagatccagtactacctcgatggacacatcgttcagacgcaagaatggtaggaaaatgctaatgctcagttcgttaacatcaacaatctgatgcaacaacagcaggctgatcttcaagcgtaccttcgcttccaagggttcaatccctaccagggaccctgagcgaaagataagcttggggggagacatctccccccactgaggtaacttgtatcacattgcatattttccttttccattgcatatttacatttccacattgcatcctataaaccaaaaaaaatgacataaaaatttgcaaaatagaaaataccaaaaatataggttagattttattatgctaggtaagacaagtagttctcttgattgaaatgatgaatagttgcactgttttatatctcttatatatggattcacggttaagtaatatctcaaagattaaataaaagtggccacatattatccgggaacctgaggtaagtgggctgcacttgctgaactaagtctaggttgttgtgagatatgagatagtgataagagctgctatgatcctgttctaagtttgacttaaattttggatgttttattttctaaaatgataaacttagaagttcatcatttgatataaattcctaccagagccaaaaatattcatattgacaaaccatatatatttttggcacttgtacttccattgaactttgtcaaatttttgagacttgtgtagatacttttcatgctctatgatcaagatcatacacccacatatatgcacatgcgaacttttgcactagaagttagcatccatccattccatttatatctatcatgttaccacccaaataaagctctctaattatatgctttctcctcccaaaataatatcctttccaaaaagaaagaaaagagggaaagacatggttatgaaaataaattcttgctcctcaaaatattgagcatgataaaaaaaatatagccatgccccctcctaaaaagaaatgaaggattttttagagaagaaagaaagcacaaagtagaagtattttctttattttttcacattccatttccaccatatatcacacactttatgtacgatcttgatcttgagtatgtctagtcatatgctctagtctaagtttttgacttaataataaatgtgaatacaggtatgccatgtttgatccctaccaagctccacatactaaaccttagagtaggaatcaacaaggttactttggtgaggaattcatatttatacactttgagtgatcgagaggatcatttgaggaacttagatttcttttgaaaaatcatttgaaaactttcggaataaaaagttgaataaagattgggtgactagtgctcatcattgctgttctgtctttcaaccgctcagggcaaggtaaagcaatgtctcgcgggaatcaggtgtaagggtaagccacgtgataaaattatttgatttgagagagagtacatataccttgcacttgtacatttgagaatatacagcatagtagcaactcctgatcaataaccaagttttgtttcctttcgtcctttactcgggacgagcaaaggttcaagcttggggtgttttgttgatggtcgttatcgatcagtttcgcccgtcaatattaccggaataaaaggagagctagtcatgcttgcaatgcatatagtgttagaataaaataaaatccactagtacttggtttactaacctcttgcagagaataagcaataaatggagaagaatcggcatcaaaacactcgatcgatcaatcagacgatgccgagaatcagacttaaaggaagatgggctgaaaatatcaatttcagaagacccaaaaagcccaaaattcacaaatctgcagagagaagaagtcagggaagccgccaggcaaaaagtgggctggttgggctagcccgaggttcggccgaaccctcctcatcgtcgttggatgcagagcttttggggaacgggcttagattagcccccaatgacgggttggagggtatttccgacccaattccaaccgtcacaaccggtcattggttggctatataaactcctcaccctctcacacacttcaagcaacaaagatctcatattctctcaagttagtttagtgctctcaagctagtggagtaggaatagaatagtagtcggaatccaaaagtcttcggaagagttcgggtatggctctagcagctttactttctcttttgtaagactagtatttaatttagaatatacttttgtatacgactctagtattgtaatactctcctattatatgactaccagctttacaatatgtccgagatattatgattatactgctagcttatctgggagatgcattggtacgggtataatgtttgcatatgcaattattctatgtcatgacgatgatattagagtagtatctggaagtttaggcgtggtgtctagattactgggtatcattatttggggttatatgctgcggatgagaggtgggccgctgatggcgacagctcagtatgggtattcgtccgcacgtgtatatagtcctaagttaattccttggggagggtactcctccgtatttagccccagttgtatagtcatgacgagctgtcgtaaggaactcggcagtcaagggtggcttctcaaagtaccacgagggcatcggaaaggaggtattagctagttaatcatatacctaggatgtatactagaagtataggaatatattcttttctatattctttccacttagcttaggaggtttaatataaaaatgagtagcttatgcttgtgtgtcattctaccctgcaattatatttatccctgcttagacatcattaatacaagtaacatataaatattagtttggttctctctattataatcttcccacgggataaacaaatacgatacccttggaatactctcgggtgaaaatgctacaatggtatatccgtgcgcttgcggataaactctgtaatcataatataccatgactatttctggcaccattgctgggaattatatttctagtaatgtcgttaagaaataccaacacgtactgtcggccggcgacggcggcgacacgaggagaatctccacgctcggcttggcgatgaggtgggaaggagggggaacttgatctacgccggcagcgatgaccagtcgaggcagagagccaagacgcagcagctgaggtccgcggatgaagctgctcggtgggaaatcccgaggtgcgggaggaagaagcagcggctggcgacagggtcgcagacacagaggtcggagggcgccgcctgccgccggccaccgctgtcgtcgtcgctcacccgcgcgtgacggaggacgatgaggccaccgcgcaacgtcacgggctcatagccatctccgtcttcaccacctccgactccatgctccgatctccacgcctcgcctaggtgagaggggaggaggggggtggaggagaggataggaggatgcgacggagataagacgcgacacggggtaggagaagaagaagataaggacgagggagagaaagagagacatcagagataattaagacgcgatgcggctctctccctccccgtgcgcttttttcaattttagtctcggttgtaccaactaggattaaagtgctgtgttactaaccaggattaaagatcctgggcggcctgacaaaagacaaaccgggaataaaaataatctttagtcccggttggtgttacctaccgggaataaagataaaaaagtttcgctgggcttctgatatgtatgttctgcataagtgtgtgtattttgcttttaagtgctcaataatgaaaccgatagtttcgaatttttgaaattggtaattacaatatcataggtatatagaataaaatataatactttttatcccttactttctatttccttatgttaatacacacttcgaaattacggaatataaatgttttttattaaataatatgaagctttaaattaataatactgagttgtacttgttatggtgtcttacttttagtatttttcttgataaaggatttctgaatttaggattgataaaaataaaatattgtacatggatcggggtccagattttaagttttcatggtgttgtctaagaagacaacagtgcatttataagtgtacacaaagaaagtaaatatatttattaatccttaaaaactctcacttacatatattttctcttggaggtgtctatttatagccttagattagctttgaacattttatatttgtcagttaaaccagccatctatgctgccaaaaaacctaatttaacccggctttgcacgttggatgtccatatttattggaaagatgagaacatcaagtggacttatttccattgggggtaggcatgtagatcaggcttttcctagcggttgtggcccagcccaacttcattctgtaggccatggcccatgaagaggatggcggccacctcttcaattgtaatgggccgatcgtttaattcgcttccagtaatcctcttggccgaacgttcagggtctgtttggttgcctgcaccaaggttggcccgcaccggtccatgcaaattcgtggtgttttggttgcctgctcgggcctcccagcctgtccatgcggatgcaaaaataccccctcagccaggcacggcagaaacggtcaattcccacttcgctgcttggcctggctcgaccgatgtgcaccgcttcacccgcgcctgcacccacgcgtgcaactcgcgggatggggtcaccactgcttccccagaatcgctccctccctgcctcacttctccctctcgtgaaaaaaaactagggttcaacctaggctttggcagcggcgcggcgctgctcttctcgtcactccggccataagcggcagccctctcccccgattctggctctccttcatctgttccgaggtcgtctcacttcctgcccccgcgtcggtccttcccctcgtttgccagttctctccgtcgtgcctgttgttccactgtcactctctgtcgagcagcagggtaagtgcattgatggctatccatcgcccattgcaaggttgggcatcctcttccctgtccctccttccccagttttttcttctctatttggttgatttgctgttatttgagtggatgagagtatggggccttcataaatctgctagatctagtaaaagcttatacattttcctagttgactttggtagatttaaatattgaaaccgtgtcaatggctagatgaatattagttcaatgtcaacgtgtattgttggtatcctttttagctgttcattttctttcagatctactgttttttcagtttcatacagattaatattagttcaatgtcagagcaaactttgggtgcttatttgttttttatggtgtgctgttgtgttacacttttggctgtgcaccttattttgccgattgtgttttgtctgagtaaatatccatggtcgatgatggtatgccactggatgtatacatacatactcaggttgtgctccttaggatgttgtgtttatgtttcttggtccaattatcttttatatgaattacggagtacaaggtccatggattggctatgctgttaagcatatacttctaaatctctgcataagttacatttcagtctttgtaatataatcagatgttgacatccactgactaatttagtcaagcttggaagaacaaaggtaagtacatggaactgaaaatggccacttggagatgacagctccatactcagtcgttgtggctgccatttgatttcccagttccatgtggaag

SEQ ID NO: 19897 - DNA, 2332 bp, Oryza sativa
gtaatttagctcacaaataatagtagccaaagaccaaataaaattttaacacaacctcacggagtaacctcactacacagatgtaaactttatgagggtaacctcaccactcacaagagagggtatttacacctaagatgtatccatccaaccaaacaacatctcctgcatgcaaccattccaccaatcctttgctgcaaccaaccaaacatcatctcagcatatccaggttcatcggatgcgggtaatcaaacagctgcatatgtatccttttagccagaccaaactcagcctggatagaagagatgagccagactaagagaatacgagcaaccaaacgcacccttaatgctgctgcagccactatctctgcccgtctccctcactcgacttccgctgctgctggaacagaaaatggctggacaattctttgtagacaaattataacggcagtaaagttcaaatccctgccgtatcaatcagtatatataaggcaatcttcttgccttcattatctatctattatattattaagacagctcaaaaaaaagacaccacgttcgctgtggaggctagaaattatcacattaatcgaagaaaaagaaaaaatctacaccgctagatcatgatagatttatattttaaccgttgagattgatcagaatagtataagtaagaaaggatacatgacaaatcctactcaaactatgtaaaaaaaaaatactatacagcaaaacaaaaattctattcggactgtaatggcccaaccggacagagggctgagtcaacgtttcttttgtttccagaaacttataaaaaaaaaggaaaatcaatatgtttccttggcacttaccgcatagacgtgtcagctaacaatcaaactcactctgccaaccaatgcaccctttccttgcacagcagcagcgggtgatttagtcagccacgcgcacgcacacgatgtcatttaaaggcaagtttagtatgatcaaaattttgttaagtaagaagtttaattgttttgttggtcgtagattgaaagacaaaaatatattcccaatttttctttttttgagataattttgtggttaaagaatactataaatttcaaatattacataatgaggtatagaaattatcaagacatcaagatcaaggtcagtatttggcagcctgccaatgttcgatcatcaattcttgaccatattctatctaagaattaattcacattgcaaggactaaaaatgccacatttaatcgaaagaaagcaacattatggccaagggtcggcaaataagcaggcatgcaacgtcggtttacaggcattctaataatattataaagaatgaaatcatatcaataatatggattgattttttagtcttaccggtgtagtgagagatgacaaagaagagaagcaatgggcaggcgagcgtacgcaaataaatgagataggaggcaattgccataggagggcatgccgagggtggtaaagtaaataaaaataataattataagagttcaagtaggaatacaatttataaatgaaagaaatatcacaatgagaaatattgatttttgaaaaaatagtccacacagaacacaacaatgacaaattataataaagatgagagaattaatagacccacaaaaaaatagagtggtgtaggtagatgggatatctaaaaactataaacaaaacctcacatagaatttcaatgataattaagaggagggacgatgagcaggtcgttaagcagcactgtctcgacgattggcgggatttctagaaagtaaaaaaaacttcaatcataatcatgttcgatttttaaatctcaacgataataaaaatgggaagcagcgggcgaaccatagaggagtacagtggcggcgtttggcgagacttctaaaaattataaaaacgaaacccaacgatacaatgaactctaaaaccacaaggtcaaatttgtaaaggttccaaaaagaatgaatgaaaacagtggtagattgagcaagcaaataaagcgatgacaaagaaataaggcgtagtgattggcgtgactattaaaaacaccggcatgataaagtcagtctttcaaagttctaacataacgagatagttatttaacaaatttaagtaaaaccatacgtaaaaaatagataattttatatgggtgctagccgcgcaattgcgcgggccaccagctagtttttttgaaaaaggaagttcaaaccatcgcgtaaatacacatacattactcacatcggcaattaggcaacactaaagaccaaatcaacggaccattcaaccgtaaactctaaactaagaacaaac

SEQ ID NO: 19898 - DNA, 2643 bp, Oryza sativa
gcgaagctcttggtggcctcaacgagctcatagtatgggacccgtcttggcccagtccccatctcgatctccacgatgggctcgccgtcgtcgtctaagctgtccgagcttatgtcctgctcatcctctgcctctttcctgtttttgattcgacgtcgccgtatgaggatagctgcaacagtgaagagcagcacaacgaacaacgtcgccccgacggttgctcccgcttcaactccggcatgtccatgcttatgctcgaacgacgggctcgagttgaagtaccaagaagtcagctggtgtagctcaactgatgcgcccgttgccgccgagaagccgatggtgaccttctctggcaaggcgctcttgagatcaaccttgtcgcttaggttgtaaggcggcttcgttgtgtcatttatccacagctttactgacaggatgctcgaactgctgttgtagtcgacggtggcggtcatgctcccgttgaggctgaagtctggtagggactcgttcgtcacagatacgatggagttgacgtcgatgccgatgtggtcgtaggttgcgttggggtcgaagtcgcggtttagataagtgtcgaattcgacggcgacgaaccggtcctcgccggtggagacgttggtgtaggacttgttggtgaggccgagtccactactggaggcattctttggcaacctcgatgggtagctgccgaggaagaaggccatcccgtcgcccctgttgttcctatcgctcggggtgacgatgttgaaggagaaggttgtggtgaagctggccacctcgccggtggcggcgtcccagagctgcaccggtgtcttgtaggatacccgtcccgcgctggtgaaaatgtcccgagcgtcgttcgcgctgatgtcaatatacccgacgcggatggaggctttgccttcaatttcgatgttctggttgtttgagctgaagttggagtagttgaaggacaaggcggcgacaggagccggaggctgcaggtagcagacggagaagaagatgacgaggccggtagcacaagtggtcaacgaaaagccggccatcgccgtcggcgatccagcgtcgatagatcgtgtgcaaggtgatactgatacagtactgtgatactagtactgtgtactgatcggcttctccagctggaggagcaacgacacaacttcctatactgccagtctgagtctgtatttgaggtatcctccattggacccgttctcggcctggcgcgtgacgacgaaacaagagtaagtcaaaccagtattcgtttcgtccttagggtacaatgtcactgaactcttcaaatgattgatactccctccctcccaaaatataaatatttttagagtaatgtgatgtcaaaccttttaaattttgactattaatagcaaaagaaaaaagattgatcatgtcaatttgatgttactagactgatcattaaacaaattatcataatatacaactctttttagttaaaacatagatattatttgtcaaagtagtatctcaaagaccgtgtcgaagtttaaaaatatttatattttgggacggagggagtagcatatattaggctgtatttagttccacgttaaaattagaagtttaaagaaattagaacgatgtgacggaaaagttgaaagtttatgtgtgtaggaaagttgaatgtgacaaaaaagttaaaagtttgaagtaaaaaagttagaatctaaacagggccttactatatgtgtcttctctagcactaaaataaatatagagactgtaacttttgtgctccccgccggccgtggcccgtgttaacaccgtaccgtacacgctcaccctctagttactgattttaaaattagattttttttctccactgtccatctagaaactacaaacaacataatctttagctgaccttaggcgcattttgtttggtgttactgattttaaaattagaatttttttctccactgtccatctagaaactacaaaccacatattctttagctgtcctttggcgcattttgtttggtgtttctgtggagatgtacataatttttagctgccctttggcgcattttgtttggtgtttctgtagagatgtacataatctttagctgccctttggcgtattttgttcggtgtttatgtagagatgtgctgaactggttgtttggtgtttatgtagagatgtgctcaactgggattatgttcctcttaactttgatgacttctttatccgtgctgacattagagcttttgatgacttctttatccttgctgacattagagctgaatttaaccatttgctggactctatatatgaacaacgagaaacaacatcgtatctacctttccaaattgtctctttcttattgccgtggagttctttgcgtaggatcgtaaatagtctttcccatcacaaaagctagccttgaggtgaggggctcttccacttatatcttatgtcatttgtccttccacaatcaatataaagactattcaacactttgcatcggctggagatgaataagagtgatctagagaagctggccggtaaagaggttgaaggagggaggacctgctctaagacaaaatagaataggagttggttgatcttgctagccccatgcaatgttt

SEQ ID NO: 19899 - DNA, 835 bp, Oryza sativa
cagactgtagtatagtcgctgattaacatgtaaatcataaagcacattctctgaattataacagtgtagactctattagaggtcccatagtttagagtgggattcaattgaagcagatgagcaagagaacagaagcttcgctctgatatgctgattaaaaaacagtagcagtttagcacgtcaagttcagacttttatctttatctcttgtagtaaattttataatgtttagtcctaattctttccgcaggcaggagacggccaaccaaagaaataaactactcgcatctatcgctgctgatcagctgccggcagcacaccagccacctccactcctcgctctgtaacgctaccccgcatgctcagcccagcaagacccaaaaatccgagcgtttccaactaacatgcaaatttacaaaattatcctcccatgcacgtttctactaccattaaatatggtggtagtacgaataggtctgatcccttgaatagaaaagaatctacggtttagctagatttatttttactaccattagaaagcaccgttgtgagattcaaaaataattcgtcaagtactttgttttgagatagatagatggtcaagaactgtcgtaaagtaaaaaggagaaaataggtaacaatccaatgattttagagaaactcttacctttttatcattgacaaggagccagttctatagattaccattgacgatctcaaatctatctatctatcgattatattattaaaacaactttaaaaggcgacgccacgttcgctgtggggggctataaattcccacattaatcgaaaaaaataaaagaagagtctaagt

SEQ ID NO: 19900 - DNA, 688 bp, Oryza sativa
ttgtgtgtacatgaatttgactatagatgtataaatgaaacctaatatgcgattccagattcatagcattcccaaaaaataaagagcgatgctcggtactctctactcgtagtattatacaactagtagaattgatttgaaccgttgattcataaggacattttagtactttactaacttagtgattagaggtaaggttggtatttaggatattatccactcttcattaaaaaaagtttttgtacatttagatctatcgcttggctactcgacggcacatcgccttccgttgctggtcggcaaatcgtcctgccgggcgctggcggctccggtggccgcgttcacaaggccgttctgttcccttttcttttcaattcattgcccggtttcaaatataaacagagaagtactccctccgtttcacaatgtaagtcattttagcatttcccacattcatattgatgttaatgaatatagacatatatatctatctagattcattaacatcaaatccgattacaccattgtgttcgttgcaattaaatctttataacaatatcttacatgactatattttgataaaagaaatatctatgttgtaaattacttttatatatatgtaagttacttttatcatatatataaattacttttcgatttgattaaattacttattatacaaccataa

SEQ ID NO: 19901 - DNA, 2511 bp, Oryza sativa
tcctgcagcccgaaaaaaaactttagtcccggttggtaacaccaaccgggactaaagatggtagtgctacaatttttagtcccgggttatttcaagcgggactaatgatgggcatctttagtcccgggttgtaacctgtgattaaaggggttgtaaaccaggactaaagatgagttccccagcagacacatgaagaaacaaaattaacaaattttattatttttatttttttacttgtagattagatagaaacttgcatgtttgtgtatagacttatatcatcataattgatgttactaaatttttttaattttttctataataactatttaagtcacatgtaaatgttgggtgtcatgacacctactaggtgtagagaacctagtcgctttcttgtacctttccttttttgctttgaactacactttaagactttgttcttccacggggtaatgaagattggagaaggggaccagttcgaaactgcactgaaagttcaaattcacctatctttgttacgctggttgcttgacaaaacgagagcatagcagcaatgtatccaaagtattctgcaaattgagatctattggtctgaattttagtatacttatatgattattgggatcatgttatacacatttagatcttctagactgaactaaccattctagatctcagccagagatggggatgaattaggacaaaacaatgtttcggtagtaatctatgcagtcattggacagcattagctgaatatcatatgagatctatcaacaatgaacacatgtcttgcaagaggtctcttctgttggtgccttcgatcatttctgttttgttaatatttctgagtttcttacaactccaacatttccaggccctctgtaaggactaggatatcgactgaaaacaagaaaagtatgtaacaaatatcagttagatatatggactgtttgattggattgttggacagaggaaattgtaggaaaagttttctggacaaaataaataaatgcttggaaaatagacagcatcatgtaaactaaacacattgctcacattgccaattaggcagctctctaaagagcaaaccaattgcctcacgagctgtacatatcccttgtaaatgtagaacaagtaaaatgaactaaacatgactaatactcctgtatggagcaattaacgaagatgagtcctccaaaccaacttgtgggtatggataaaaatctaaatatgacaaaaattatctcgctatacaaatcctatgagtgagaaaacttgcaaacctagcgaggtgtgatggacgttagtgtcaaacttgaggacgacaacggctgcccctccgctgaggccatcggcggtgcatatgttggcacgggcatcttagctggtaacacgggtagtggtccattggattggagaactgccatggcagctctgatagatggacgtgcacatcggtccggatgtgcacaccagagtccaacagccatgacacactccatgctagttgtgtcgtattcattgttgagccgctcgtctgctgcattgagaacggctccttggccgtacaggtcccacacccattccaccagtcggaagaggcaattgttctgggtgtcctgcaggctaattggtctcctcccacatgccacttccaatagaacaatgccaaaactataaacatcggactcagcgcttgctttgcccgtgattacgcattcgggatcaagatagcctggtgtccctgaggggtgagtcattgtttgtatcccaacggcatggtcaataagccttgcaaggccgaaatcgcctagcttcgcattgaaggattcatccagcatgacgttgctcggcttgatgtcacggtgaactacacattgatcccactcctcatgtaggtagagtagtgcagatccgagtccatgaacaatgttgatcctgtggcaacatccaagttagcagatgaattgaatttcaaaggtgtcgattgcacataacgaaaattactaaatcaatgagttaattaataaacctcattggccatgtgaggaaggtgccattgccgtggagatggacgtcgaggctacggttggggaatagctcgtagacgaggagcagctcggtgcggccatggcaccagccaatgagctgcaccagattgcggtggcgtagccggcttattaccttgatctctgacttgtactccttcctcccttgcttagaggaatttttggcaaacctctttatggcgacggcgaggccaagctctctgaggtagccccgatacactgcaccgaaaccgccttgcccaagcttctcctccggcgcaaagctcttcgtagcgtcgacgagcttgtggtacgggaaccgccttggtcccatccccatctcaatctccacgatgggctcgccgtcgtcgtcatcgtcactgccgtgccagcctccatctctgcctccctccttttcttgtctgacgtcgtcgtacaaggactgctaccatggcgaagagga

SEQ ID NO: 19902 - DNA, 1224 bp, Oryza sativa
aaggtgtcgaactcgacggcaacgaaccggttctggccggtcgagacgttgccgactgtctggttcgttaggccgaggttttcgccaccttcgtggcccactggtaacctcgatggatagctggtgaggaagaaggccataccgtcgccctttttgcttctatcgctcggagcgataatgttgaaggagaagcgcgtggtgaagctggccacctcgccggtggcggcgtcccagagctgcaccggcggcgcgtacaccacccgtccggcgctgttgcccatgcccgacacactgttcgcgcttatgtcgacatacccgacgctgacagaggcttggccttgaatgtcgatgttctgattgtctgaggaggcgaaggtggggtagttgaaggacaaggcggcgacaggagccggaggctgcatgtagcagacggagaagaaggtgacgaggccggcagcgcaagtgatcaacgaaaagccggccatcgccgccggccagagccagcgtcggcgcgcaagccgcaaggtgggttgatcggctggcttgacttggagcaacgagtcgatgcacaatgcgtacactgcttgtagtgcactggcagtgaatggtgccccttctccctggaaaaaaaacccttctttttgatggagctatgtgaatgtggaactatggaagctggactacaataattgtctttgtcgagctgaaaagaacaataccccaaaaatcaacgatgctgctacaatctccatgatccatcggagagacggagaaacatgcataattgtaagtaaatcgtaatgttcagacttgagagatattcagggttgcctcatgcagtcgtttgacgcagaacaagagcccagcggtcagtcaatggcccagcttatctgaaactatattgtgccaactccactgatcgatcgatggagagtgatgcggatcgcagaaagactttaaagactcccctttggccgtggagtttagtctccgcaaatttgagctttgttgtcatctagtacaaccgatcgaagaccgaattaagtgctgagttccagcttgcagcatacacgcacacgaccgtcaccgtgttgaaaaagacagtgaactctctactgacagtatgagctttcaattacttttcgagaccttttacggcaattgcgaggtatttaaaggtatctggaggtggaacaacgtgtacccttaatcaagagaggggca

SEQ ID NO: 19903 - DNA, 1157 bp, Oryza sativa
cattcccccctccttgagttccagcttgcccccaagctggtgccgcaggaaaacggcgacggagctcgcgcggattctcccaggtggttgctgctggtgcatcgccggtccaacgaatctgtacttgctccaccatcttggaacccttgcggatgaagcgatgatccaaaatctgcgctggacaaacgtgagtaacatttgtcggatccagcacaggaagtggagaatgaacttgttccgttggagccaaggccttttttagttgggaaacatgaacaattgggtggatcaaactggaagttggcagatccaagcgatatgccaccgctccaaccttgtcaagcacctgaaatggtccatagaatcgaaacgaaagtttacgattagccctggtaaccaccgactgctgaacgaagggctgaagcttcaaataaacccaatcgcccactgcaaaagagcgttctgaacggtgctgatcagcctgttgcttcatgcgagtctgagcacgcaaaagatgatctctgatcaaagcttgcatcttctcacgttcatgcagccactcaacaagatcgtctgatcgacaagcagcagaagctgaaagaccaaagtagcgaggcttatgtccatacagtacttcaaagggagtggtgcccagagcagagtgaaaggacgtgttgtaccaatattctgccaacgcaagccagcgactccactgtgaaggacaggcatggacaaaacaacggaggaatgtctctaggcatttattcacacgttcagtctggccgtcagtctgaggatggtaagaggaactcattcggagttgagtgccggctaacttgaatagagtagtccacaatgtactagtgaaaatgcgatcacggtcagaaatcaaagactgaggcaagccgtgaagtcgatggatatgttgcatatatgcttcggccacatccaaggcagagaaaggatgagtcaatggaacaaaatgactgtatttagagaatttgtcgaccaccacaagaatgcaattgaaagaagccgacttaggaaggccttccacgaaatccagagagacaatttgccacgcatggtcaggtacaggagaggttgaagcattccaggatacttcacatgctccgattttgcttgttggcaaacag

SEQ ID NO: 19904 - DNA, 1779 bp, Oryza sativa
tacagagaatcctaatctctttattgtacccttccgttttgtgctttgaaactacactttaagactttgttcttccacggggtaatgaagattggagaagatgaccagttcgaaactgcactaaaagttccagttcacctatctttgttacgctggttgcttgacgaaacgagagcatagcagcagtgtatccaaagtattctgcaaattgagatctattgttctgaattttagtatacttatatgattattgtgatcatgttatacacatttagatcttttagactgaactaagtaactaaccattctcaggggcggatccaacgtggggactcgagtcccccctacacccacaagacccatggatacccccagagcaccttctttaatttttttcaccataaataataaactaaaggtctttagatggctaaaggttagagaaacaacgtacttgaggccccccaattttctgttgctggatccgcccctgaccattctagatctcagccagagatggggatgaattaggacaaaacaatgtttcggtagtaatctatgcagtcattggacagcattagctgaatatcatatgagatctatcaacaatgaacacatgtcatgcaagaggtctcttctgttggtgccttcgatcatttctgttttgttaatatttctgagtttcttacaactccaacaattccaggccctctataaggactaggatatcgactgaaaacaagaaaagtatgtaacaaatatcagttagagatatggactgtttgattggattgttggagaggtgtaggaaaagttttctggacaaaataaataaatgcttggaaaactgaaagcgtcatgtaaactaaacacattgctcacattgccaattaggcagctctctaaagagcaaaccaattgcctcacgagctgtacatatcccattcaagcgtcaatttgtaaatgtagaacaagtaaaatgaactaaacatgactaatactcctgtatggagcaattaacgaagatgagtccttcaaaccaacttgtgggtatggataaaaatctatatatgacaataattgtctcgctatataaatcctatgagtgagaaaacttgcaaacctagcgaggtgtgatggatgttagtgtcaaacttgaggacgacattcgtgtcgatgatgagggctgcccctccgctgaggccatcggcggtgcatatgttggcacgggcatcttagctggtaacacgggtagtggtccattggattggagaactgccatgacagctctgatagacggacgtgcacatcggtctggatgtgcacaccaaagtccaacggccatgacacactccatgctagttgtgtcgtattcattgttgagccgctcgtcggctgccttgagaacggctccttggccgtacagatcccacacccattccaccagtcggaagaggcaattgttttgggtgtcctgtaagctaattggtcttctcccgcatgccacttccaatagaacaatgccaaaactataaacatcggactcggcgcttgctttgccggtgatcacgcattcaggatcaagatagcctggcgtccctgagggatgggtcattgtttgtatcccaacagcatggtcaataagccttgcaaggccgaaatcgcctagcttcgcgttgaaggattcatctagcatgacgttgctcggcttgatgtcacggtgcactacacattgatcccactcctcatgtaggtagagtagtgcagatccgagtccat

SEQ ID NO: 19905 - DNA, 22524 bp, Oryza sativa
ttcctgcagcccagaaaaacacgtaaaagagaacatcaaagaacggtgtaactctagataaaatgatgcaacttaagaacctgtaatgctagtgccgactaaacgacttaactcaaacacaacgtaaatcaaatctagagaaaaccacataaaagagaaaatacgcaaataataacatgtaaagctggtaccggggaaattaatgttaacttcgtacgggagtacctacgcggtaccgattctaattttggagacaattctaccctttttgctctaatagtaaaattatatttttatccttagtacttaagtacctataccaatagttaaataccttttacatgatacctatgattgaggagtgttggatcttataccttttttggaatgcaaacaccgtaaaaaagcctatcagattttgttgaggaaattgcagcagtaaagccactgctgaccctatcagaaccaactcttctctttcaaattttggcttgatcactctgtgaagtagcagagatgtcaatcttggacaatatgcttgctgcatgaatctcttatggcttaaatctggcaattggctgctgtatttttgtgtgttaacaattttggttcgatgttctggattccgcgttcaatcaacaccggagtactgaacataaatatccaccatttgagacgattgcataagaactgcttcagtagaaaatgattggaggctctttggctcttgttttcagtagctagagccatatattactatgttatttatattaaatgttagcttattaattatatctaggttcctgttgttgatcgacgaaaagcctgtgatggtagtgttacctatcttggttcctcttgttaacgcccattgtgttgcatgttgtttttcctctttcttgtgcctttacttttcggattgagctttctcattttgtcttgaaagttgaaacaatactttagactttgttcttccacggtaatgaagatttggagaaagggaccagttcgaaactgcactgaaaattccaattcacctatttctattacgctggttgcttgacgaaatgagagccaacgatagaagcaacatgaatgaaacataatgtatcaaaagtattctgcaaattgagatatattgttctgaattttagtagtgtgatacctatatgatttttgtgatcatgttatatacatttagatcttctagactgaaaccattctaggtgttagccagagaagggaatgcattaggacaaaacaaaagtttaagtgataatcaatgcggtcgttggccagcattagctgaatatcatatgagatctatcaacaatgaacaaatgtcctgcaagaggtctcttctattggtgtcttcaatcattttttttttgtttatgtttctgaatttcatgcaactccaacaattccagaccctctaaggactaggatatccacttaaaacaagaaaagtatgtagtgaataacagtcagagatatggacggtttggttggattgttggagaggaaattgaaggaaaagttttctggacaaaataactaaatggttggaaaactgaaagcatgatgtaaactgaacacaattactcatgttgccaattaggcagctctctaaagagcaaaccaattgcctcatgagctgtacatcctattcaagcggcaacttgtaaatatagaacatgtaaaatgaactaaacatggctactgtacggagcaattaacgaagatgagcccttcaaaccggctaaagtatgcgaaaggaacttgaggtgtagggatgcaagtagttcgacttgttggtatggataaaaatctaggagtaaatttcacaaaactacaggtattttgaccaaattatcacaaaactacagatttaaagagctgtatcacaaaactacacatttaacaccaaatttatcacaaaactacagattttaggttaactatcacaaaaatgcataattaatattgaacttatcacataactacaacttttagagtttagattcctagcactattgttatggtggagctataaacattattactttgtgattaaattgattctaaacctgtagttttattataatttagttactaaacgtgtagttttgtgacacttcatcttaaatgtgtagttttgtgataaatttggagctaaatgtgtagttttatgatacaactccttaaatctgtagttttgtgatagtttggtcatagtatctgtagttttgtgaaatttactcaaaatctagatatgacaaaagttgtcttgctatacttatcctatgagtgcgaaaacttgccaccctagcgaggtgtgattgatgttagtgtcaaacttgaggatgacattcctgtcgatgatgaaagttgcccctccgacgaggccataggcggtgcatatgttggcacgggcatcttggatggtaacactggtagtggtccattggattggaggaccgtcatggcagctctgatagatggacgcgcgtatcggtccggatgcacacaccagagcccaacggccatgacacactccatgctggttgcgtcatagtcattgttgagccgctcgtctgcagccttgagaacgactccctggccatataggtcccagacccattccaccagtcggaagaggctattgttctggttgtccagtaggctcattggtctcctcccacatgccacttccaataaaacaacgccaaaactatagacatcagactcagcgcttgctttacctgtgatcacacattcaggatcaagatagcctggcgtccctgaggggtgggtcattgtttgtaccccaacggcatggtcaataagccttgcaagaccgaagtcgcctagctttgcattgaaggattcatccagcatgacgttgcttggcttgatgtcacggtgcacgacacattgatcccactcctcatggaggtagagtagtgcagaaccgagtccatgaacaatgttgatcctgtggcaacatccaagctagctgatcagttgaatttcaaaggtgttgattgcacataatggaaattatgacaaattaatgagagttaattaaaaacctcattggccatgtgaggaaggtgccattgccgtggagatggacgtcgaggctacggttggggactagctcgtagacgaggagcagctcggtacggccatggcaccagccgatgagctgcacaagattgcggtgacgcaaccggcttatcaccttgatctccgacttatactccttcctcccttgcttggaggaatctttggcaaacctctttatggcaaccgcgaggccaagctctctcaggtagccacggtacacagccccgaagccgccttgtccaagtttctcctccgtcgcgaagctcttcgtagcgtcgacgagctcgtggtacgggaaccgccttggtcccatccccatctcaatctccacgatgggctcgccgtcgtcgtcatcgtcactgccgtgccagcctccatcctctgcctccctccttttcttgctctgacgtcgtcgtacaaggactgctaccatggcgaagaggagaatgacaaacattaccgcaccaactgtggctcccgctacaactccgccacgtctggaatgcgacgttatcggggtcagggaaggcggtggtggtgacggtgacgacggcggcggcggagatgctacttttgctgccagcttctgctcgaacgacgaactcgacttgaagtaccaagaagtcagctgatgctgctcataggctgagccaattgatgccgagaagccgacggtgatgttctccggcaaggctctcttgagatcaaccatggagctaagggtgtaaggcgtcgtcgagccatttatccatagcttaactgacagtattctcgaattgttgttgtagtcgacggtggcggtcatgttcccgatgaggctgaagtttggtagggactcgttcgtcacagatacgacggagttgacgtcgatgccgatgtggtcgttggttgtgttagggtcgaaggggttgacgaaggtgtcgaactcgacggcaacgaaccggttctcgccggtcgagacgtccgaccgtctggttcgttaggccgaggttttggccaccggcgtcgcccactggtaacctcgatgggtagctggtgaggaagaaggtcatcccatcgccctttttgcttctatttcccgggatgatgttgaaggagaagcgcgtggtgaagctggccacctcgccggtggcggcgtcccagagctgcactggcggtttgtggaacacccgtccgacgttgttgcccacactgttcgcactgatgtcgatatacccgacgctgacagaggcattgccttcaatttcgatgtactggttgtgtgaggaggcgaaggtggggtagttgaaggacaaggcggcgaaatgagccggaggctgaatgtagcagacggagaagaagatgacgaggtcggcagcacaagtgatcaacgaaaagatggccatcgccgccggcgagccagcgtcgatagatcgtgtgcaaggtgatactgatacagtactgtgatactagtactgtgtactgatcggcttctccagctggaggagcaacgacacaacttcctatactgccagtctgagtctgtatttgaggtatcctccattggacccgttctcggcctggcgcgtgacgacgaaacaagagtaagtcaaaccacatgccactaaagtggagtattcgtttcgtacttatggtacaatgtcactgaactcttcaaataattgatactagcatatattactgtctgtgtctcctctagcactaaaataaatatagactgtagccgttgtgctccccaccggccgtggcccgcggtcgaccccgtaccgtacacgctcaccctctagttactgattggactaactgtatttatggcgtcatatttttcattaaaaaatagtcgatatgtatttatattgtaagtctctaaattacatatgtaattttaatgtatttacaatttaagttctaaaattgcatatgtaagtcttaaaattacatatgtaaatcttaaaattacatattaaccatatgtaaatgatgcgtaagtggggtgtaactagtatgtaaatttgtataaatatataattacaacaataaagtcaattgactgctacaaacccatagcaactccggatcaacaaataaagtaaaaaaaatgcaaagggataaacaggtggagaaacggatgtgcatcgtgcacacgatgtccagcgcagcgcataccagccgttaaaatccgactgtactcagccacataatgtggcgtcactttttcagcaaatccgttttaaaattagttttttttctccactatccatctagaaactacaaaccacataatctttagctgccctttggcgcattttgtttggtgtttctgtagagatgtgctgaactgggatcatgttcctcttaaccttggtgacttctttatccttgctgacattagagctgaattaaacatatagctgtgaaaattgccctgcttgctgccatttgctggactctatatatggacaacgagaaacaacatcgtgttcagggataaacttgtttactcacccctaatactacctttccaaattgtctctttcttattgcagtggagtcctttgcatcggctggagatgaagagtgatctagagaagctggtaaagaggtttaaggagagaggagctgctctaagacaaaacagaatacgagttgattgatcttgctagccccatgcaatgttttggcgtttggtttgttttagattgctgccgctttttttttaacgagacggtgcgaagttctattgatagagcaggaaaaaattacaagattacaaccttggaaggtcgtaaccaggaaaaaggaaaaaaaatatactaccacccacacaccgacagcgccaacacacagatccgggagaaggctagcaccggaccggccaccgctaagcgtgaccgaccaccgctaggccaacaacgggacatagacgagatcgcccaaaaacgcccttacaaccaacacaaagcccgactctattcacgtcttccggatttaaggagagggggtgagagaaaagaaggaacacctctccccctagggcctccgacgtgaccaacttgtaggaactaggatgctgccgcaagaggatgagaatctagagcgtgcttgcaccaattgctcgagtgatttcggcaaggggatacctaaacgacgtctccaaggagagaagcgatggaaaaccaacgccaccatccgtcaaggtctcaaaagagccaatactgggcttttgcccggcaaccacccttgaggggtgagacggcacgacaacgccctcaggagggagaatgacactcgagcactgatgctgggttttcacccaccgctcaccacctgcgagtccacggctgacgcaccgatgctccaccgaccgcccaacctctccgacatgtgggaccactgcatcagcgccccctgcacagaaaaatcgattttcgtgtgcaggcctcttaactggaacgcatgcgaaaatttcaattttcgtgtgcggctctttaagaggaccgtacggaaaaatcgattttcgcatgcggtccacaaatcgattttcgcgtgcggtcatattaagtgaaccgcacgcgaaaatacctctccctcgcactcacttcaaatttttcacacctcctctcccttcctttactttttattttcactcctctctctctgtctctcactttccttctctatctctttctccatctctttctcttctccactccactcctctccgtggctggcgacgaggcgcgtcgaccgggtgggcgcgccggcgagcggcgaggggcgacggcaaccggctcctaccaggatccggccgcggcggccgtcccccgcccggatccggtagcggtggcagtcggcgcgacggtggcggcggcaggcgagctcgacggtgacgacggtttcgacggtggcaggctcgatagcgatgacggttgcggcagcggcggctgggtgcggcggcggcgcgacgacagcgacaacgccgggagtggcggcgggtgattccagggttagggttaggattttttatttttttattttttttttgtgcgtgcgggcggtataatttgaccgcacgggataatcgattatcccgtgcgggccacttaacccgaccgcacgggaaaatgattatcccgtgcggttgggccgcccgcacgtgaaaatattgattttccaagacccctgagtgcagatgggcaaaacctctgtacggaaaaaacccatttttaccgcacggaaaaatgcttttcatagtacggctccgcgtgaccgcaaggacggcggcagcggggcttcgcgcaccacgcgcttgtggcggccgggggagcctccggaggtggcggcggcggtagctttcccatccagatccgggccggcactggccagatctagcggggcgccgggagctagcggttggcggtgggggaggggttggcgccggggctagtgacggcgcggagactggcggcaggcacgggtggcgtcgtggtgggtgggcagaggccactcgcgccgaagttgcagcgtcggcgtcggcgttcgtctgcgcgggtccacagaggtggcgctgcgcaggcaggggctacggcggcgtggtggttgcggcgacgatggacggctgtggcgcgcggacgtcgaagccggcttgctccaccctggatggatctgagcgttcgtggccgaatccgtcgcctccgcgcttgatctggccagggcagccagccagcggggcggttgcgtgtggtggcgttgcatggctcgggtgagctccgatgagctcgatggctgcactgcgtcgcctaggcaggttccagtggggttgctcgctggcgacgagcctcttgctcgcgatgtgcggatgtggagttggcgggacgttggcttgcgttggcatgaagcaggaatggggcttgacatccacggcggtgtcttcctcgttgccggccgagtgttctccctccttttggtttccaccttctttggccagaccctgttctggttgtggggaatgctagggggagggcggaggctccaacttgctgtaggaatttgcagcggattgatggcgtttcgagggtggccaagggcacatccttgccgttggttacggtcaaagtatgacttcttgtgagacgccatggacttttctgtggccgtcgatgtgggggtgcttgtgtgggtgatatgaagacactagtgaaagccttgtcgtgcctttggccagttcgacgatgacgacgcccgtgggtgccgtttcccttcttggaggcgtcgtcatggcgttctttcatatccctcacaaatcttcaggtgaaaaaattgttccggatttcggacgagcggcggcggaattacgcgtcgtgtcctccttggaggcatcgtttcggagaagttcctatgcatcgacgattgttgatggcctttttcggttcaaaagctttgatactttaatgttcggcgaggccttcgccttcttaggtccgcttcgttcttgtggtgggtgacactctcttcggttgtttctactgatgaagtcggagctgctcgctgatgaggtgcggtgacgcttggcaacggtgacatgttacagtctcttccaaggagttggtgctagtcgtgtgaaggaagtggctctttgatggcttggctgatgtccattgttggataacggagctgcttttcgatcgctttggcgactttcgtggtttcagtgtcgctgcggttgtgaagtcggcgctgctgggtcgcttgggcggctagctcggcaacgataacacctcttctgcaatgtcggagctgtggtatcgcttttgtgtttagcttggcagcgatgtcctgtgtttgggctctgccgtcattgttagttgtgtagctaggtctcttgcttttttctctacggtgggtttcagccgatttcccataattaaccatgtagttgtatggtttttgggcccggtttcccttataaattaggtcaattctcttcttctaaatatacaagctgggacaaagttccacctcagttttgaaaaaaaaaacaatgccgcgagctgatcgcgaccgtaatttgtccatgcatttgtaatgctcggactcgaactcgagagatattagggtgttaaactaatgaatgtccatttttcttcagggatgtaaaatggatatttctcttaaattaatgatgtctatgtagagagcagaccaagaaaacatagggttttgattacgccacaagtgaaaattaaactgattactgtatcaccaagacacgtactcgtaagaattagccatacaaacaacaatagtactagttgtatgcttgcaactccctacagttccacgaagataccacaaatcaagaataaaggggttctttggatgccactctgtttattctatcagcaaatttgacaatgccacacttgtggaaaattttgactaaaaaatgatcaatttaggtgtgggtgtcgatggattatatctaatacaagaggtatacctgatccgtaatattgacagtcctgattgtcaaaaaaatatatgacatattattaatgtagtagaaccaacaaacgctaggttaagttagttaaatgtgtataccacaagtgtaacaaattaaagttttgcactcaatcaaacaacgcctaaggacactattggatcaagagtgatgtgggaatgcgccccacctgggtgtgaagaaaatagtcttccgctaatttgcgcgttgtttgcaatctggaaactgaagaccgggagtgggtccagcttaagtcaagggtatttagataaatactcaagattttgtatttaaaaataataggtagatagatataatatgtgatgcatgtgtaccaaaacaaaggttgtattcaatccaagaggttatattaaactcataaaacgtatgtgatatatatatatatatatatatatagagacactcatatggggctccatggtgcccaggcaccatggtatgaaatacacaaattcgcccaaatttttcaaaattttcaaattgtgagtatatatctagttataagtattcgattcatacctatacctagcaataaaacaactcaaatttatctttatttcataatccaatattacatacctaactaattatatgtttggatgttatatacctagaatcaaaatctaacatattacatgtttaaattcagttcaaacttgtttgaactagttagtaaagtagttaatgttaatacctaaacatttaaaaaaaattcatgctcatttgaattgagtatatactcaatttgaatcatggagcccgggcaccatggagcaccaaacaaatttaatatatatatatatatatatatatatgtatatgtatacatgttatattttttttgcagggatatatacatgttatattaggcttctgcctacaagtttattttaattaccccctcatattttgaataaacaattaaccttagaatcctaacccggtcctgctaaagaccgaaacgcttagatctatactatagctttggagacttggacagcgttcgtttgggtgagtttgagggagaaaacgtatcgttttccgcacgatggtacgtttttttaaaaaaaaatctataggaatgttgctttaaaaaatcatattaatctatttttaaaatttaaaattgttaatactcaattaatcatgagctaatagcttacctcgttttgcgtatcttcccaatctcctcgatttccttctcctcgaacacacctttggaagagatgagtcaaaatacatgtatacagtaagtccgtccgtacgtgttgaaaaacaagaaatggcctgttgggccatatgcctgaacgaaatactccaaacgtggcctgttccgctttttgcgcctgtcactgcgggcgaaatgcaaatatgtaccttcaaactgctggccacttgaattttactttccagttttatcactgctggccatagctgcatgttgctatagtggaggagtataatatcgttcacttgttgtggcgattggatcagcaaatcaaggagtaccaaccatccaaattaatcacgcgctcactcggggtcgtagctgttgctgtttcgtgttgagcaagagaatatccagactttaatattctcttgtttgtgaattgtgatatcacctgccagctgggtcttgtcaggtcttgagcaagctcggcatcatgcaacgccttgttgtttaaatgatgatcgaacactgtctttgctaatgtacaattgtgtgtataggaaactcggcgagttcacatgcgagtgccaggatcactgcatcgctataactgaacacctgaaaatgcatagatccattgcatccgttgcctctactctactgagcggatgaaagttaaattggcgcacgtaaaaaaaaaagctattagcacataattaattaaattttaattattacaaacttgataaatgtatttatttgatattttaaagcaactttttatatagaaagttttcgcacaaaacgtaccgtttagcagtttgaaaaacgtgctaacgaaaatcgaggtaaaatctgtatgtgtgaaaaatgctagtggttgattggttagaattaatggtactgctgtttgtttgcatatttttttcttgtctaatgatgaaatcgtttgctttgttcgtgagagaatttatatgtgctacatacccaatttggtgccgaatgctcattaacttgcctctacggctctacctgtgatgttccggtggccaaattatattttttaacgaatcgatatttagatggtgccaatttcatttaatagagtagaaaaaatatataagaaaaggaaaagaaagcccgaaaccaggtagcaatgctgcgaggtgttttgctaccccggacccaagtcttagcgaaccatattttgtcgcgtttgaacttaattacgtgtacacaatctcccacggcatttctctcaactttttcaccaggccgaccaaaagttgacagccagcgttttgcgccgatcatcgtatgagatctatcaacgcgatgaatatgtagtcctgcgagaggcttcttctcttgataccttcaatcatttttgttcttttgtttttgagtttcagttattgcaacttaaacaataaatgagttaacccacagaattgctaatttgccatgtagatctctgcctgagggcgaggaagagaagaatatattcttaccttatcattgactctagacaaacgatgaaggactctaggtacaatatatgcaatgaattttttttaagcgaacgattgcaggagctctgctggaatttttagtaagtgagaaagttcaggttaaaaaaaggttacagggatccggagtaaaaaacaccccttttagaacaactggagaataccgcaaggtaagctaagaaaaactatcgacgaactaggcggttcaaaaatgaaatgttgctctgccacgatgaaggactctagatacaatatacgatgaaaaaatatatatgatgaaaagatggtacaccgaagtaaatttggaaatgatggctatatttgtggaatggttccttgtgtaatgtggatgacttaggaatcgagtcaagctcaatatagttgaacatgccctaaggaataggacatccactaaaaacaaaaaaagtatgttgagaatgacagcatccactgaaagaatgaataaagcgtagagagaaaatgacaggaaactaaatggttggaaaattgaaaagcatgacgtaaatgcatgtacgtacattactcacgtcagcactaggcagctctaaagaacagattaacggggtcacgtgctgtacataccattcaacgatcaactctaaaataagagcaaatcaaatgaactaaaaaaacatttagcaccatcttttcacttatgattatgtatgtaaaccaaaatttaaattttaaaacttagtttttttaaaaaacaagtgtgttttggttttatttgtgatggaaaattggtgagaaaattggaaaccatgtaatggtttttggttgaaaatttggtttggaatattggcgattatcggcgtgagtgctgcaatttaaatctctaagggtttgtttagattggtggattatcacgggatttttggaggaatactattcataggattgtttttcccttttaataccattcggatcacaaaaaccaatcataagaaggtcgcaggaaaaatttcctttacttttgcttccatgggagaaacatttgaaaatatccatccactctaatctcttttttcattttcttcgtgttggaacgaggcaatcaagcattaacaaatgcaaagaacagagaaagaagaatcagcgaagaacagagaaagaaaaggcagatctcacatgattggaaacatatcctatgcacacaagcttccgtatacactccatgcacaccaactagcagatgtcacagaaaattttagaaaaaattggacacatactcataatagtattacacatatctgcaaagtctcatattcaaattcattatattttagtcgtaacaataaagtgaaaaatctgacagtttttagggtaaaaatctgtcagaattttgtttttttgttacggctaaaatataataaatttgaagataagatttcacacgttggtgtaatactattggaagtatgcgtccaattttatctagaattttatgtgacatttgctagttggtttgcacggagtgtgcacggaaagcttttgtgcataggatatgtttcccatatgatttctttaaataagttccgtacaggaagcaaagcccatacgacaaagaatcccaagagcaaacaagagcaaagaggtcacgcgcagaggtcaccggcaacggtatcgaggtcagcttccagtgtggagctaatgcggcgcgtggcgtgcggaggtcgccggtgacggattgaggttggcttcggtcatggataccgcgcgtgaaagttgccggcgacggatcgaggctggcttctggtgtgtagtggatgccgtgcgcggaggttgacagcgacagatcgaggccggcttctagcatggagactggagtggatgccacgtgcggaggtcgatgatgacggggatcgagagcagcaggccaacatccagcgtggagcagcaggctagcatgaggtaccggtatctcgaggtactttttgttggactggagcaaaatctttttctcctatcttacgtttttcctatgctataatccgaacaagccctaaactagatttcaccacgatagcaagatctcaggccctcctgagaaaggatccctgcccatagctaggtatccacaattttctatctaatctgaaataagaacacgaagtagaaaaaaagtgcacttataattaaatgatgtggatcaatgtgtaccatgagtgggcaagcgtacatccctaacgaggtgtgattgatgtttgtgtcaaacttgaggatgatattcctgtcgacgacgagtgctggccctctgatgaggccaccggcggcccatatgttggcacgggcatcttggttggtagcatcggtagtggtccattggattggagaactgccatggcaactctaatagatggacgagcgcatcggtctgggtgagcacaccagagcccaacaaccaagacacactccatgtctgtcgcgtcgtagtcaccgttgaggcgctcgtcggccgctttgagaacggctccctggccgtaaaggtcccatacccattcgactagtcggaagaggccattattctggtcatccagtaggttcattggtctccttccacatgccacttccagaagaacaatgccaaaactgtacacatcagattcagcacttgctttgcctgtgatcacacattcagggtcgacatagcccggtgtacctgaggggtgggtcatcgtttgtgctccaatagcatggtcaatgagccttgcgaggccaaagtcacctagctttgtattgaaggattcatccaacatgacgttgcttggcttgatgtcacggtgcacaacgcattgctcccactcctcatggaggtagagcagtgcattcccaagcccaagaacaatgttgatcctatgacaatatccaaggtagttgatcagttgaatttcaattgacatttgttgattgcacattgcaagaaataaaaaaaataaaatctgaaatattaatgagagttaattaattacctcattggccatgtgaggaaggtaccattgccatggagatggacatcaaggctgcggttgggaacgagctcgtacacgaggaggagctcattgcgaccgtggcaccaaccgatgagctgcacgagattgcggtggcgcagccgacttatcaccttgatctccgacttgtactccttcctcccttgcttggaggagtctttggcgaacctttttatggcaacgtctatgccgagctctctcagattgccacggtacaccgcgccaaaaccgccttgcccaagcttctcctccgccgcaaagctctttgtcgcgttgacaagtatgtggtatgggaaccgcctcggccccgtccccatctcgatctccacgatgggatcgccttccgagtcgtcctcctcttcctccctcatcttctttctctgacgtcgtcgtacgaggattgctaccatggtgaagaggagcacgatgaacagaattgcaccgacggtggctcccgctacaactccgccacgcgaatgttgtcctgtcggctgcttctgctccaacgtcaagttgaagtaccaagaacgcagctgatgctgctcaaaggatgaacccgtcgccgccgagaagccaacggcgaccttctccggcaaggcgctcttgagatcaatcttggagctgaggttgtaaggcgtcgttgagccatttgcccatagcttcaccgacatgatgctcgaattgctgttgtagtcgacgatggcggtcatgttgccgatgaggatgaagctaggcagggattcggtcttcactgaccggagggcgttgacgtcgatgccgatgtggtcgtaggtggcgtcggggtctaggaaggagttgttgtaggtgtcgaactcgacggcgacgaaccggtcgccggcggtggcgttgtcgaaggtctggctagtgaggccgagggcgccgccgtagcccatgtacggcatcctcgacgggtagctgacgaggaagaaggtctgttgcagttattcctggtgtggcccgagctgatccggacgacgcgggaatgcaacggtgtgtaacggtgtggcgagatgcccgggcaaaggagatcggtggcgactagttcgtgcagcgcaggaagcgcgatgaagcagagtgcatgacggggagtaacctcgtcgtttccacatttgtaggatcaaagttgttagcctataaatagttggtggtaacagaatttgtacgcgcgcattcagttttcatttcagttcgaaataaacaccgaaagttgcccaaatactctcccaagttattttgttcttgttctctgcattctctgaattctctgtctccctgaaagtttcttcagtctgctgtgccggatagctacaggacgcccacaaggtgttcgattggtgttcttcgccaacaagtggtatcagagcactcaggttgagggctgatctgacaccatggcgttggttccggcgggagccgcagcggatccggcgagggggagctcagggagtgcgttctcctacccacaactcacggcgacgaattacaccagctggtgcattcgcgttcaggcaatgatggaggaccagggcgtgtgggacgccatcgagccggcggccggggtggccgtcgacccaagaagggacaagaagtcgaagtcccatctgctgcagtccctcccggaggacttgctgatgcaggtggcaaagaagagatcggcaaaggaagtgtgggattgcttgaagacaaggttcgtgggcgcggaccgcgttcgcgaagcgcgcctgcagacgttgaagggtgaatttggtgccatggtgatggagccgggggaaactctggatcagtacgcgggccgcatcaccgcgatgagcgtgcgtcactcggtgttgggctcgacactgagtgattccgcgatagtgaagaagctgttcgacacggtgccagagaaattcatcagcctcgtcgcaggtattgagcagttttatgagattgataatatgccatttgaggaggcggtgggtcgtctcaaggcctacgaagaacgagttcgcaagaagaaggcggccgctggtggtgtcaccgccgacggtcaagtacttctcactcaggcggagtgggaggcgcgtttcaggaaggacggcagcgagtcgtcttcgccgcagaaaaacaaacctcccagcgacaggggaaaccgtgcccagggcggacgcggtcgcggcagagggcacggtggaggtggtggacgcggcagcgcgccgcggaacagtggcgctggtggctctggcggcggtggccgtgacaagagccacatcaagtgctacaactgcgaagaattcggccactactccacccagtgccctcatcccaagaagaagaaggtggaggcccatctcgcgcaaaccgacgacgcaaaccctgcattgttactggcggtgaccgaagacgagccggcgagcgggctggtcgtacacgaggagcgtgtgtggccgcagctgctgttggctgacagcggagcagccaccggggacatctggttcctggacaatggggcaagcaaccacatgacgggtgatcgtgctaagttcagagatctagacgtatcaatcaccgggagcgtcaagttcggggacgcctcaactgtgaaaattcaggggaaagggtctatcctgttctcctgcaagaatggggatcaatggctgctgcaggatgttttttatatccctagtctgtgttgcaacatggtgagcttgggccagctcacagaaacggggcacagagtggtgatggatgaagatgtgctcgaggtgttcgacaaaagtcccctgcggctggttatgcgggtgaggcgcacccctaatcggctgtaccggatcgagctgaagctagccactccggtgtgcctgctgacaaggatggatgagccagcatggctctggcatgcacggcttgggcatgtcaatttccaggcgatgaagctgttggctgacaagggcatggctggtggcatcccggcgatcacacatccaaaccagctctgtcaggcatgtctggttgcaaagcagataaggcagccgtttcccgcaacggcgaacttcagggcggaggagccgctcgagttgctccacattgatttatgtggaccgatcaccccgacaactatggccggtaatcgttactttatgctaattgttgatgatttctcacggtggatgtggatgttcgtgatcaaaacgaaggaccaggcactagaggctttcaccaagttcaagccgctggccgagaacacggccgggcggcgcatcaagacgctgagatcggatcgcggtggcgaattcctgtcgggcgaattcgcgcagttgtgcgagcaggcgggcatccagcggcatctgacggcgccatactcaccccagcaaaacggggtggtggaacgccgaaatcgttcggtaatggcgatggcacgatctctgatgaaagggatgtcagtgccgggcaggttttggggggaggcggtgcgccatgcggtgtatctcctcaaccggctaccgacgaaggcgatgggcgatcggaccccgttcgaggcatggacggggcgcaagccgcagctgggacacctgcgggtgtttgggtgcatagcacacgccaagatcacgacgcccaaccagaagaaacttgatgaccggagcgcgccgtatgtgtatctcggcgtgtaagaaggcagcaaggcgcaccgcctgttcgacccgcgttgtgggcgtatccatgtaagtcgtgatgtcatttttgaagaaaatgtaccttggcaatggagtgtagtcgcaggggagcaaaactctaccgagttcacggtggaggaggatggagttgatgcaccgccggcaggagcgccggcctacccagtaccgcggtaccgggcgccatccccggcagtcccgcaatcgcctccggcaagcccggtaggggcgtcatcgtcattgccgacttcgccccagtcatcaccgagctctacaccgccttcaacacctgctaccggctctgccgggccggtggcgtcaccaggttccggcggcgaccttagaagcgatgagggtcccgtccggttcaggagtcttgaagatatcatgcgggaggcaccccgcgtggacctggtggaggatgaacacgatggggacgcgctgcttgcagagatggaggagccatcgagctaccgcgaggcagctggccagccggcatgggagaacgccatggcacaggagctgcaggcgattgagaagaattcaacatgggctctcactgcattgccggcaggacacaaacccattggcctcaagtgggtgtacaagctgaaaaagaacactgccggcgaagtaatcaagcacaaggctcgtttggttgcaaagggctatgttcagcgtcaaggggtggattttgaagaggtgttcgcgccagtggcgcggcttgacacagttcgtgtcatcctggctatcgcagctgatcggcggtgggaagtgcaccacctcgacgtcaaatcggcgttcttgaatggcgatcttgaagaagaagtgtacgtagcccagccagagggttttgtgaaacgaggagaagaacacttggtgctcaggctgagcaaggcgctctatggattgcgccaggccccgcgggcgtggaacacgcgtctcgacaagtgcttgaaagaactcggttttgcacggtgcacgcaggagcaggccgtgtatactagaggaaaggggcaagctggtgtaatcgttggtgtgtatgttgatgacttgattgtcacaggagaaaatccacatgagatagccatgttcaagcagcagatgatgggggaatttgagatgagtgatctcggtcttctctcttactatctggggatagaagtaattcagggggagaatgggattgctatcaagcaagctgcgtatgcgaagaagattctgtctcagtttggtatgcagggatgtaatcccacctcaatccccatggagccacggtcgctgctgcacaaggatgctgatggaaatccaattgatgcgaccgagtaccggcgtgtcatcgggtgcctgcgatacttgttacacaccaggccggatctgtcctacgccgttggcgtggcgagcaggttcatggagcggccgacaacgatgcatctcaaggcggtcaagatgatactcagatatctaaaggggacgctggactctggtctggtgtttgcaagcggcagtggctcgttggacatcacgggtttcactgacagtgacttggcaggtgacatggatgaccgtcggagcaccggcggcatggcgttctatgtgaacagcagcttggtgtcttggtgttctcaaaagcagaagacagtggcgctctcgtcttgcgaggcagagttcatggcggccactgcagcagcatgtcacgcgctctggcttagggcgttgctgagcgagatgatgggtactgaagcaaagcgggtgaaactttttgttgacaacaagtcggcgatcgccttgatgaagaatcctgtgttccacgggaggagcaagcatattgatacccgctaccatttcattcgtgaatgtgttgagagtgggcagattctgattgagttcgttcgttctgaggagcagcgagcagatgcaatgacaaagggactgccggcggcgaagctggcgactgcacggcacctgttgggtgtgcgtgatctcaggccacgccaagactaagggggagtatgttgcagttattcctggtgtggcccgagctgatccggacgacgcgggaatgcaacggtgtgtaacggtgtggcgagatgcccgggcaaaggagatcggtggcgactagttcttgcagcgcaggaagcgcgatgaagcagagtgcatgacggggagtaacctcgtcgtttccacatttgtaggatcaaagttgttagcctataaatagttggtggtaacagaatttgtacgcgcgcattcagttttcatttcagttcgaaataaacaccgaaagttgcccaaatactctcccaagttattttgttcttgttctctgcattctctgaattctctgtctccctgaaagtttcttcagtctgctgtgccggatagctacaggacgcccacaaggtgttcgattggtgttcttcgccaacaaggtcatcccgtcgcccttgttgctcttgtttttcggggtgatgttgaaggagaagcgcgtggtgaagctggcaacctcgccggtggcggcgtcccagagctgcaccggcggcgtgtacaccatccggcccatggtgccgccgctcgacaggttgttccctttgcctttggtgagctcgatccattcggcggcggcgccggcgagcgccgcgctgccctggagggtgatgttcttgctcgcgttgctgaagctggagtagttgaaagatacagtagtggtagcgacgacgctaggcatgacgagcaagcaggctagagcagccatgaacggttttgtcatgaggacgccggcggccatggccggtctttgagcggaatcagcggccggacaatactgccaatgccaaaaacggaaaactactagtagtactcaaatcagcaggtggccagtcgccagtcgccactcagagagaccagtcgagatcttaaggactctgctaatttaacaagttggtggttggcaaatcaacactaggctccatgagaccatgaccctgacagctctggctcctcggaaggtgctgaaatgtatcatattttgtctattttgctaatagatgacgaagttaagcgtaagttccgtttcttgttggtatcttccctttttcttcaaatacattttcaagaatgataaaatcctttttatatatatacatcaagctggtttatatatatatatatatataaaaggtgaagctttggacgtcattggcctaggcctgcggattgtttgcaattttttcgtcttttttcaccaaattttataaaaaaatgtactccctctgtttcataatgtaagtcattctagcatttcccacattcatattgatgctaatgaatctagacatatatatctaattatctatttagattcattagtataactatgaatgtggaaaatgctagaatgacttacattgtgaagggctgcagg

SEQ ID NO: 19906 - DNA, 1291 bp, Oryza sativa
aagatctaaaatcttgatggtattttgcatagttgactagggctaggttcgggaggtggagttccacggaaaatggggttgtattccattaacacgtgattaattaaatattagtcttaaaaacttgaaaaatgaattaatataattttttaatgcaacttttctatagaaaacttttacaaaacgcacaccatttagcagtttagaaagcgtgagcataaaaaacgagagagtagaagttgagaaagttggaaaaagaacagcctaagaggactaactaaacaatgtataaaaaaagggacttttagggtacaatatacgggtagtatatgttgctagtatgaataagattgtgttgggaatttctcacaaaataggaaatgatctttagttatttcgtgttagatcttaactcggatagtaatcctaattgatcatgtgttagatcggattactgaccggatacatttgatttgattgtgccatctattcaacatatgggttaaatacatggaaaaataatgttcctcctttaatttatcgataccaggtttggagatattagtaaattacgttgttccttaatttaatgataccaaattctccttgctttccacgtttttcaatttgagggtcaaaaccgggggctatgttggtagtggtggtatcagtttttttttattattattttcaggcaggtagtatgagtaccagagtactccctcggtactaaaatataagtattcttaaatacttttaaataaattattggaagtttttttttggttaaaaatagaaaataggtgtacaatttttggaagtttatgatttgttaaaaatagaaagtaggtgcacaaattcaatgagagactgttattattcgttgagatgagaagataaagaagaaataactatattttttaagataaatttaaactctaaaagtaattatactactcaccggactaataatacttgtcgttttttacaggaataagatcaaactttaaaatcttcaactataataatttttaaaatatttatcttaaaaatatggggactatatgtatagagttgttttaaaatatactttaataatatcatttatttgttatattgtttttatatatattataatataaaatagtgtttaaagttgttttctatcggttggagtacaatgattgtctcgaattcgagggacgagccaatatgttgatttgatactagtgccactggcagtcggtcagtggcacacattcgagttggaaatgcataaatgcagggctgc

SEQ ID NO: 19907 - DNA, 2971 bp, Oryza sativa
aaaatgaacggttaaacatgtttaaaaaagtcaacaacgtcaaacatttagggatggagggagtatttgcaacagtattatatgtatgttctgcataagtgtactccccctatcctctgatataagggattttaacatttttcttgcactgtttgatcactcgtcttattaaaaaaatttgtgtaaatataaaaaacgaaaagttatgcttaaagtactttgaataataaagtaaatcacaaataaaataaataataattctaaatttttttgaataagatgaatggtcaaacagtgcaagcgaaatgccaaaattccttatattagagaatggagggagtagtattttgtttttaagtgcttaagaatgaaaccgatagttttgaatttttgaaattggtaattacaatatcataggtatatagaataaaatctaatacttttaatcccttattttctgctacttccttaagttagggcatgtttagttcgcaaaaagaaaatttttgagtgtcacatcggatgtttgaccgaatgccggaaggggctttcggacacgaatgaaaaaactaatttcataactcgtctggaaaccacgagacgaatcttttgagcctaattaatccgtcattagcacatgtaggttactgtagcacttatggctaatcatgaactaattaggctcaaaagattcgtctcgcgatttcccccctaactgtgcaattagttttttactttatttatatttaatattttatgcatgtgtccaaagattcgatgtgatgtttttgggaaaaagtttttggaactaaacaaggccttaatacacacttcgaaattactgaaaataatttttttattaacaatatgaagctttaaattaataatactgagttgtacttgttatgatgtcttacttttttagtatttttcttgataaaggattttctgaatttaggattgataaaaatacaatattgtacattttctgagttttcatggtgttgtctaagaggacaaacagtggtttctaagtgtacacaaagaagtaaatatatttattgatccttaaaaactcacttacaatatatgttctcttggaggggtctatttataaccttagagttaggtatgcattttttatatttgtcagcgaaatcagctatctatatcgctgaagaacctaatttaagttagttttacaagttggtggtctagactccttgtattgcggttcagagatgcgatttaaactcggtggaaacataagggatgtaaaggttgatttaatccattggggataggcacgtagatcaggcttttcctagcggctgtcccccaacccaattcgttctgtaggcaatggcccatgaggaggatggcggccaccccttcaattgtaatgggccgatcgtttaattcgcttcaattgtagtgctgctgcagtacgtagcacctatcgttgcccatctccctcactcgacttattctaatgctggaacagaaaatggccggacagatctttctagagaaactacagtgccataagattcatggcataagtacacatacattactcaaatcggcaattaggcaacaccaaagaccaaatcaactctaaactaagaacaagcaaattaaaaaacaaacactaaacactagcactgatgcttgagcaatgaagacgagtccttcgaactggttgaatcggagggaaccgaggaccacgaggtgtgagtagcatggccactcgtcgtcgatatggacgacgactgcgtcacacctgatgacgacgacatccctgtagatgacgcaaagagcccatgaaacgaggccatcggcggcgcgtacgttggcacgggcatcttggccggtagcaccggcagctggcctccactcgattggagtatggtcatggcatctctgatagacggtcgcacgcttggatcagggtgcgcgcaccagagcccaagagtgatgacacgctccatctccgcagaatcgtagtcgccattgagacgctcgtcggcggccatgagaacatctcccttgccatacaaaacctaggcccactcaaccagtcggaagacgccattattatggctatctagtaggctcatcagtctcctcccgcatgccacctccagtaggacaatgccaaaactgtaaacgtcggactcggcactcgctctaccggtgatcacacattcagggtcaaggtagcccagcgttcctgacatggcggtcatcgtctttataccgatggtgtggtcgatgagcctcgcgagcccgaagtcatctagcttggcattgaaggattcatccaacatgacgttgcttggcttgatgtcacggtgcacgacacattgttcccactcttggtggaggtagagtagtgctgatccaagcccgagaacaatcttgatcctgtggaaacaaccaattaagcaagataaaaatagaattagatttgacactatcgaaacagttgagatgagaaagttaacgccgagaattaataacctcattggccaagtaaggaaggtgccattgccatggagatggacgtcaagactgcggttggggacgagctcatagacaaggaggagctcgttgcgtccatggcaccagccgacgagctgcacgagattgcggtggcgcaaccggcttatcaccttgatctctgacttgtactccttcccttgcttggaggaatctttggcgaagcgtttaatggcgacgacgaggccctgctctcttaggtagcctcggtacaccgagccgaagccgccttgcccaagcttctcctccgccgcgaagttcttggtcgcctcgacgagctcatagtatggcaatcgccttggccccgtccccacctcgatctccgtgatgggctcgccattgtcactatccgtgctcgcattctcctcatcctcggcctccctcctcttcttgatccgacgtcgtcgta

SEQ ID NO: 19908 - DNA, 14099 bp, Oryza sativa
ttgcgaagcaaatttgtaagaggtttactgagaatgccataattgcgcacaaatttcctgtagtatcctgagagacctaaaaagctacgtaattcttttacagaagtgggtgctggccaatgttgaataacttgaatcttctcagggtctgtggaaacaccattaggttgaattatatgtccaagatatgctaattcttgttgtgcaaaagaacacttagtcctcttaaccttcaattggtgtttaagcaaaatctgaaacactgttttcaaatgctgcacatgctcttctaaagatttgctgtatatcaaaatgtcatccacgaatacaagcacacacctcctaagtaaggtagcaagcacactgttcatgactccttgaaaagttgccggtgcactagtcaaaccaaaaggaagcactctgaactcaaagtcaccgtgatgggtttgaaaagcagttttatgcacatcatctggatgcattctgatttggtgatattcggagcgcaagtccaacttagaaaaccattgagctcccgcaagttcatccaatagttcatctatcacaggcaaaggatacttattcttcactgttatggcattaagatgtctataatccacacaaaacctccatgaaccgtccttctttttaacaagtaatacgggtgatgaaaaaggacttgaacatggttgaattatccctttactcaacatctcttgcacttgactttcaatctcattcttttggacatgagtatatcgatagggtctcacattgactggcccagctcctggcagcaaaggaatagtatggtcaaattgtctgattggtggtaaccccttgggttcatcaaaaactgaagaaaactctgtcagtactgtctgcaccacattaggaatctgctcttggtgctccaacgcgaaaactgaacaaaattggactaagacactgttgttctgtcattaagttccctaagttgcctggaacttatgtgggcacattgctcagtatcagaccttacaccatgtaactgaatctgagttcctgcacaagcaattatcagagattttgtggtccaatccactgtcattagactgtgctgcatcaaccaatccatgcccaaaatcatgtcgtagttgttcaattccagaaccttcagattagtaaagaacacatgtccttgagtggtccattcacaattcagaatctcagaacaacaatgtaacattgctcccccagccaccttaacttgcacatgcacaggctgctctagaacccctataaaactgcttgccacccttttactgatgaaactggcagagctgcctgagtcgactaaaatcaagatttctttgctttggatttgccccagcattctcatacaaccaccagtttcagatccctgcacagcctgtagtgaaactgccattaacgtttgctcaacaacatgatctgttgtgctcaacccgtcctctgctgattcatgcaacactgtgaataactcttggacagcatgcagttgcacagtattagaacacttatgtgtaggcgaccatttctctgcacagatgtaacagagaccttgagcacgacgttgagccttaagagaagataatctctcattcattcctgatgaacgttttacttcagactccttcctttcttcagatttaatgcccatgttgatgcccccagacctcattggaggagttggcaaaggatatgcccctttaagatttgcaactgaacgtcctagagaatttccttcactcttcctaacttcttttccaggcacttcatcagctgtctccagcacttcctcctgtaacaaagcaacagccaaagcagactcgaggtctcggggtctctgaagtaaacagcattacgaattttcctatataatccctcagtgaaacggtgtgtcagataacgcatattcactactggatcatacacaagcaacttattcatgagttcatcaaactgttcgtaatactcccacactgttcccgactgtttaattccatccatctgccgaatcaacagttcatgttgatccctatcaaacttatcagatagcgcagcacagaaatcctcccagttaggaaaccgaacatgagctctagtggatctcaaccaagatgcagccctcccagaaaagtagatgatagccactcgcacccacaaccccgggtacgtgttattcacatcgaaataatgctcacacttcatcctccaatcctgtgagtcggtaccatcgaatttgggaaaatctaacttaggcactctatggctatactgacgttcctcaacctctccatcaaattccccaaatcccgaatcaaaattttcacaggaatgcaaaggcacaggagaaacattgaacgtacccttgcccggagttgggatcagagtggtaaccactccagatgccctcctccagtgatgttgtggaacgccgtggccaccggccagtttgcccccgccttccgccgcgcccaactgatatgatggtggaggagtcggcaacaatggcaccttcctttcctcgcccgtcaacgggacccgaggggaaagtgccgctgatggagcttgctttcccttgttggcggcatcatgctgctgctgaagttcgtcgacctcagcacgcaagtccttgatcgcggcttcaacttggggtcgccatccactaaccccttcgtccaacttcgccaccgccacctgcatctccgcctgcttgttgttcaacgccaccagcgactcctggatgtcgccgagcaacttgccgaaatcgagattctgcttctccattgcctcaacctgcgattgcaaacgagaagtgtaccttggtttctccaggatcgctgctctgataccaaatgtcacggcacttgtggaattcacgccaagacgatgacgaaaccatgggaattcgaagaggaattcgtgaattgagaagagaaacagaggaagaacagaggaagcaatagaacagagagagagagagagatttgaattgaattgggaatttagttgtttctacaatgttcgattccttctctctctactttgccgatcttatatagcgatgtgccaaaagatctcgctccctctctgacagtggcccggtcgacagctaccgggtccactcactcgacacatacttgctcgtgggccgccgatctcgcatggatcgtctgggctgggcttcctcttgtcttcctcttgtcaccggtcgagacgttgccgattgtttggttggttaggccgaggttgtggccaccggcgcggtctggtaacttcgatgggtagctgccgaggaataaggccatcccgtcgcccctgttgttcctatcgctcggcgtgatgttgaaggagaaggttgtggtgaagctggccacctcgccggtggcggcgtcccactcccagagctgcaccggctgcttgtaggacacccgtccggcgctgttgcccatgccgttggcttcgttcaagctgatgtcgatatacccgacgctgaaagaggcgttgccttcatattcgatgctcgggttgtttgaattgaagttggtgtagttgaaggacaaggcggcgacaggagccgtaggcaggtagcaaacggcggagaagaagatgatgccgacagcgcaactgatcaaagaaacatcggccatcgccgccggcgtcgatcgatcggcgcgcaagggtgacaacgatactaccagtactgatcgatcggcttgaccagctggagagaaacgagagacaatgcttacagccttcctacgtgacaatgcagtcgggagtcccgcagatttaaggtaaccggtcagccctcatcagcggtgtaaaattttggtgtgccacgttgggtattatatagggtgtcgcatgggttgtttggacactgataaaaacactaactacaacatccgtcactaaaccgcgagacgaatttattaagcctaattaatcctaattaatccatcattagcaagtaccacattgtcaaatcatgtagtaattaggcttaaaagattcgtctcgtaaattagtcgcaatctgtgcaattagttattttttaattctatatttaatattttatacagggatacttaaacgttcgatataataagacgtaaattttttatgtggtaactaaagagggccttacctctggacggatttggaccgcgcttgcgccagcctgtaaataagtgacgaaagaagagtacgacaaaacacaggtaagcagatgatgtggatactaaacgctactagctagtacgtatactcgtttcgtccttattatgatacaacgtctcgtaagcaaactaaggccttgtttagttcttttttttttctaaaaacatcacatcaattctttacatacaatagagcactaaatatagattaaaaaaaattaattgcacagttaggaggagaaatcacgagacggatcttttgagcctaattagtccatcattagccataagtgctatagtaacccgtatgtgctaatgacagattaattaggctcaaaagattcgtcttgcggtttccagacgatttatgaaattaattttttcattcgtgtccaaaaaccacttccaacatccagttaaacatttgatatgacacctaaaaattttcttttcgcgaactaaacaaacaggccctaagtccacccaaaaatagtattagacctaatgtatataaataagcaagctatttcattgtccatgcttttcttatccacaatctttatctcacttatatatttaattaatgcatgtatccaagctatttttttttatctcgtttctacatttgtttatagttagcctataacctaagataaaatattctatggtaaattggaaccatgccattataattttgcaaaatttgagatatgccatcggtatctcaatgacatgtaggacccacatgagtcaatgacatgtgagtcaggatggtacatctcaaattttgcaaattataatgacatggttccaattttctcaatattctaaggcactctagttttacggttttatcacaggattgcggtcttttgccaaaagacacttgacctattactttacatacttgctattttactactgtagaaaagtggaggaaaaacttttggatttttatcgttggattggctaggagattcgtgcgcatgatcaagaataaaaagttgatagcgtgcgctgtgggtaggtgtcgtcgtgtcgaaatcgtgatgcgaagctagtgtgggaacgtgctgatctcccactgtgttacaaagcaaattctaatttacatagcagttgcatctaatatacactatagttaaaatataagtacactatatttatattatagttatggtgacatttataagtacgctaaaaattattcgtcaggagttatataggtagtcccttatttttccctatcctcttcaattggaaagagagaacttttgaaaagacaaaattgccctcaggctcacttggtaggttgaagggcaatttcttcttttagaaaatctctcatttgaagaggatatgtcaaagcaatggccaaaatgtattttggcaaagagaagcaaaactgtaccatcatacggcaaaccgcaaaactatatcttagagtgaatgtcataattatagagttacctagagcaaattttgtcaggttataaaactctttaaagtgattgataacgtaacttactatttcctatagcgaaaaaatagatcaagttatttttttttgtctagatagagaaacaaaggtactcccaacaaatctaaacgtatgataacctagctgctaacgatgaaatccccataattcttgacaatcctgtttgtcgcggagaacatatcttaggaccaagacttctagttgtcgctaggatcggttgaaggtgaactttacaacgatatttgtttttgcgaatttatcacaaatcaagacggattccctgtttgtcaaagggaatccgttagggaagtctagatctgttgtagtgcgtgaatccaaatccaattgtactttttatggtctacctttttttttttttttgttattgatagaaacctaatctacgttgtcagcttttgtttttctcaactatttcgatcacattcaagaaacgttgccacatgcctctaagagttaagagaccgagatgtatcacaaaacaactatatggtggtagcaaaagacgatagtaaaaaaaaacttaaataaattggcaatatcattctcattcccccggtaaggtgatgtccagaaataggtctccaaccatgtgacatcaaaactagtttgaagaaatggtaacaagaattgccactcactaaacaatgagacagacagcaacactacaagtgatgccacataattaatctctttttcttaaataatgttcgtcatggacttcgttttggcataaatggtcaagaacattctcattaagtaaaggataaaatgttaaatgtgtaacaatccaatggttttaataattaatactccctccatctcataatacaaggcatagtcaaacttggcacagtcttcaaaactaatctttgacctataatttctcatatattataaagtttattgcaacaaaattataatcatcttaaagtaaatttaaatgtcaatccaatgatattaattttagcaaataaaataaaatttatattataataattattggtcaaatgtttttaaagtaaaatcttaaaatatgtgcacatcttatattatgggatagagggagtattacacaggtggatggatcacctctactacccattagcctattcaactcatgtccacgatatcactcgagcagctggtgtgccagccaccactagcaaacagagactcgagaagccggctcggtctaacaaggaattgtaacacaagcttgccgttgatttattggtaatattagttcttccacttgtattaattgtgccaaaatggcacttctttctgtgctccggccatagttttcgaccgtcggggtcagaaaagattgggctgaatcaacgatcgattgtttgatggtcatatgggactgaagaccgaaatgctgagctctagcttggagcaccaagtcaatggctctgtttaaagagctggaggtttaagaagcagctttagctagtgagaatctgaaagctactgcttcatttttctgaattctgtcggagtggttctagagtccttcctctcagaaggtcatatgtagtctttagctagcattgccgtttttggagatttctcgggagtgtagcgttagcgtggctctacccctttccgctgtttagagttgtgtttagccgtcgtagtagtcttttccagcttgagcttttgttttgctttttctcccttcccttggcataggccggtctagctaattgcgttatgtaacaaattctttttcttctaatatattgatgtacaatccttttgcgcattcgtgattttttttcatgaattctgtaatttatgtgcctttgaatctacatcataatcaggattatttaggaagctgaagggaaaatcacctgaagacggagaggttcactactaggaagcaccccactttagttataggtgggcaaaaaaaacatctgcatgtgaaaagattgggatgttatttggttgagacccacatgaaaaaaatcgattttcgaatacgagcctgtcgaaacaagattttggcaataataaaagggggtggctatcaagttaggaaagtggatgggtttagagacaagggattttatacaggttcaggccttcttattcaagaagtaataccctactcctgtccggggatgattccgccgagtgtgttattgattgtatgattgggagaaaaaagaatcgtcccgagaggaacccggacccctccttatataggggaagggatccgtattacaaagtacagcccatatcctaacggaacatgggattacagatagaatacaatcgtaaccgactaggatcccgggtattttcttgatatacaagtttagaatccaacccgaatcctcataaagatgttctatctatatttagtaccgtatatccgactaaagtataaccgtcatgcagatatggggtaaccataatctccacattagcccccgagaccttcgcagttgaccaaaataatcttctcgaaacaaaaaacaataatccgagtgcttcaattcaacttgctccggcttgccgagtactaaaaaactgtgaagggcgaaaacatggtgcatcgagtagatgcacctaattaggtgtagccccccgactatgtgattagttgaaaaactaaacagatagtcaagaaccaagtggttttatagcgaagcacgcatggtacttagtaagatacccagccaactgcttctcaatctgaatatatcaaggacaaaaaatacgagaagggccgagtgataaacactcaaaaggtccaaaaatagatatatttggtaggaatccgagtaagaaactcttataatgatccaccaaatatgataaagatcatggtaattaagaagttcattagcctaggctataactcttaccataattaaaataagcatataacatgctaaaagaatgaccattaataaaccagtcatctcaaatgaacccaacagcttttgtagcctaaaaagcttacaaaaatggtataacacctttctgtcgggcaccttttcatgtgcatcataataattctaaagaattattgaatcacgttaaaaaggattttaacagcatcgggctgcgccattgtgagcacatattgccaaagcaaaaagcacctaagtccgtagggatcacaacgggccacgctgaaaacataattgggctgaaatactgtacaggcctaggcccattagtactcccgataccctaaaaataccgaagtccaaacgtcgcttcgtcttccccgccgagactctcgccattccccactccgtgctacagtacagaaccgcgccaacaaagctagggttcatcaatccgctccaatccatcctcaaaaacttcctgaaatttctccccgcatccaccgctccgattccccatccctttccagccgtatctcgaactaaatcaaatcatctagttcacattcatggcggaagaaagagaaagcttcgagagtcagtgggcgccctccgatgtgacagaagataatctgaaggagatggtggcgcacggcgttctcccgacaaaggagattatcgggtggcgaccggcgttcggcgaggcattcccgacccccgacacacacgaaatcgtggtatttgcgcatttcttctatggcggattttctcttccaacctcaaggttcttccgggggatcctaaacttctacgggattagcttgcatcatttgaacccaaactccatagtgcatattgccaattttatccatgcctgcgaagcttttctaggcattaggcctcatttcgccttgttccgccgcatcttcttcctcaagccccagccaaataagagcaaaccatacgtcgttgggggtgttggtttccaactcaggggaacactaagccaaaaatacttctccatgcccttcaagacctcaaataaaggctggcacgcaaactagttttatgttcagaatcctgagcccgcactccccgagtactgctgtcttcctccggtttaccaggatacatggaactcattgcctatgggagatgaagctgctcaagcagtagaactgatggagaggatgataaagctgaaagaacagggccttcaaggagaacagatcacccggcactttatcaagtgtcggttagctccaatcaaagaaagatctcgcacagccttcgaatttgacggcaagcatgacccaaaccgtgaagatccggattctcttgacttcaaggtcatgaaggaaaggatgtataacatcttctcaaacgccatcgttgtcagctactcacacttgctgccagtcgtaccgttcaacgcattcaatcctcctccaccggtgcgtattcatatacttcaaccttcctcaaaatatgatcttgtcttcctgttgaatcaattaacaatgaaagatattacacccaggaatttgctctgatgaagtcgaatccaccaatcgctccacgccgatctccccgccaccaaactgggcaagggagcggaggaccaagaattcggtctgaaactcaaccaagtgcttctgatccagtcggccagtcagattctcgaaagaggaagctggttctaagagacgacgaagccgacgataccaccaggaggcctgaagactgagagacgaccaagaaactaccaaaacaggctactccaaggaagaaaacatccagtcgccctgcgccaaagatcaggaagtcttccaggtgcaactcatgtaacgattcctcttgtattgatgcacacccattgcggcgataatactgataatcaaatttgcaggaaaccatctgatatagacccgtctgggaaagactctgacccgactaacatggacacaagctcttccaaagaaaccggaccaactgctgaggatcatccgagtgaaaatcagccggcaacctataatgtagaacccagcaacgagcccccgactgggaaccagtcagtcgaagctgaagtcggtgctaaccaggagcccccgactggaaaccagtcggatgcagggccaagccaaaagattcccgaggttgaagctcaaacgaacagtcctctcgggaaggatgctgacaatgaatcagaaaccagatctcctatgaaggcaccaagatccattcgtccccgaccgggaatcatctcagttagacatgccatctgaaatcattttgatccaccaaactctatgtggctgcttcatcatcgttcatggatacactagggccaataattggtgatgaagaagagatcctccggatacaagcagctgaggattcacgccctccgattctggtcaagtggtgggatgacaacatgcagcctcaagggatcgtgataaataagcaaaaagaggacgaagagttatgcctactgaagaaggcacttggtcaggcaacccgcattgtaaatgtaagttctctggtacctgatctcaaccatcttgtttgccatttaattcatgcgctaattaaactgtcttgcagaggattcatcttaggaacgaagccaaaacagtaaccttagagaggttagttcctcatctcgggaccctcaaagccaccaggaatcaattgcacgaagcgaaagaacttgccaggaagaatgaacatgatctgagggatcggatcgctgatctccaggaatcaaattttgaactgagtggctcatcaaaaggtacgcacaaactctgctcaactgactcatactgttatctttgccatcttgattaaccgtaatcaatgtagtacaagctgccaagatatctcagttggagaagcagattcaaattctggaaaatgacaaggcagaactggcaaaacaaagagacctggctttaaaggaagttgaaggtatcaacaatcaatacctcaaaagccattatcctccatatactgacttattaatgtgaacctgttgatgcagaccgcaagatcaaatctcaagctcaattcgacgtcctggttggcaagatcaaaaaacttgaaggagcccgggatgaggttgctaacgctgccgccccaatcgttcaagcgatgttcttcaataacaatggcccgagtgcacttgatgcttctaaaattttcgacaagctgagagttgctccggatacatatttcaagaacatcaaagaagctggaagtatgggagcaagtctggcgttggcgaagactaaatccctttatcctagagttgatattgacaccattgatggctttgcagacgggacgagcgaagaagctgctcttgacctcatcagtgatgcgcagaaagtggctgacaaaattgctgctgatgtagttgagagattccaagataccgatcttcgaccgactggtcctgataattctgatgatgaaaagactaatactgattaatgtaccgataattttgatgattaatgatgatggaggcacaatttgtacaatactgatgaatttatgttgtgcttgatatcttaacttagctcctgatttcataaaagtttttgtcaaaccttgttgagcctaaaacccgcaaaagttgttaaaaaactttcagtcctcattgactaagccaagaaatcaaacagggcaatgatacatcaagtaagcaaattgaattgatataaatcacactccattattattatagtagccccctgactgaaaacttcgaggaaaaaacttgaacttagcagtcaaagaggaaagatacaaacgaaatgcctaagcgtaaaatcgacgaaggtgttcaatattccaagaattgttgatgatagtaccatcttcgctcttgagtcgataagaacccggccgagtgacttcagcaattatgaacagtccttcccataagggagataatttatgccgatcctgtgttgtttgaattttcctcagaaccaggtcgccgactaaaaaggctcgcgatcgaacattccaattatgataacggcgcaacccttgcaaatatcgagtcgactgaattaaagctgcttctcgggcttcttctagtcggttgatgtcgtctactcggccctcttcatagccctcctcgttgaagttccgaaatcgtagtgattcaaattccacttcactcggcaacattgcttctgctccataaaccaaaaagaacggcgactggccagtagcccgactaggagtagtgcgtaaagaccaaagtacggacggcagctgatctacccacttgccagcatagggacgtagtcggtcaaaaactcgtgatttgatcccttgcagtatcatgccattagcgcgctcgacttgtccgttactcatacggtgtgccacggaggcgtaacaaattttaatgccgaagtcttcacaaaagtctttaaatgcttcgccagtgaattgagtgccattgtcagtgatgatccgattaggtaccccaaactgatgcacaatgttgatgaaaaaatatctagctttatctgctgtgatcgtgatgaccgatttagcctcaatccacttggagaatttgtcgatggccataaagagatgcgtgtaaccgccgactgcccttttaaagggaccgaccatgtcaagcccccagaccgcaaatggccaggacaacgggatggtttgcaactcttgggctggcaaatgagtttggttggcaaaaaattgacaaccttcgcatgtccgcacaatcttgtcggcatcggacacagctgtaggccagaaaaaaccttgccggtaagccttgccgacaatggtccgtgcagcagcatgattaccacaaataccagaatgtatatctttcaacaactgtctcccttcttccaaagacacacagcgctgcagtattcctgatgggcttttcttgtacagctcagtctcatgaataatgtaaagtctgctgcgcctggaaatccgctcggcttcatttttgtcttgagggagttattgtttggtcaaaaattttatgagaggttctctccagtcggcttcaatcatgcctatgcctcgagtatccatggcttcatttgcttcttttctgggcatggttggttcataaagatgctcaacgaacacatcagaaggagctgcttcctgttttgaaccaaaattggccagtctgtcggctgcctcattgttatgtcggaggacatgggtgagctcgagtccatcgaatttattttccaacttgcgcacctcttgtcgataagcggtcatattatcatctagacatgaccactctttcatgacttgattaacaaccaactgtgagtctccacggacgattagtcggcgaatacctagagatattgcaatccttagtccatgaagtagcgcttcgtattccgccacgttatgggacacagaaaaatatatccacaatacgtagctcaatctttctccagtcggggagattaa

SEQ ID NO: 19909 - DNA, 1330 bp, Oryza sativa
tatcggctactctctagtaatagatgttagccgactgaaggttagattatgatagtaataaagattacaaggcatatatgataactcgacgatttacataaacaagattagagtgttataaagatggaagcactaatcccgagaacgcaagccgtcatgacaaattttacctcttgttgaagatcgaaatcgatgcagttcaacccgaaagcaagaacttgtcgaaacaatgaaagtagaaaaagggcggcgatacaccgaaagtgttattgaactatcgttgtaaattacatgggatcgggttatatttatacctgggatacatggctagtccttgccggacaagactcttatctctaacaaactctaagatacgaacaagtctttacagcagactcttaccgaaatatatctctaaagaaactatttaaaatatcctaattaatagatataattgcctatcggtgagcttatctccatcatggcaatccttgtgtagcacgttgatcgatcccaaagacggttatacaaccatctcaacgaaatcggctacatcggctaaatcggctatcttctatccgatccatctcatccgatgcagtctttagccgacacccttagctaatgcgcactgttcttggaatatgattccctgccaaatccgctttgattccaatgttgaacgtagttcatggcttaccaaatttggtcattaacccaaatatatcatccaaaccaaagcaatccaagaggtcgaatgtactgatgcagccttgaacaacgccaacgtagatgatacaattgcctaagccggcggaacattggacttacctcttcgccggagatcgagaaccaatgcagccccgtatcaggtgccaagttccgccgtgataaataaaaaggtagaaaaggtaaaaggtggcgatgcgccgaattgtactgatcgtggagataatttacaatgacctcgggtgtacatatttatacccatgggtagacactagtccttgtcggacaagaaagaaactttcctaaagataaaagaaaaacataaagttcttattggacactaaacacactttcttaaagataaaagaaaactaataaactcttcctaattactagataaattgccatgccgcatcctcctcgaacttggtctcttctggataagtttccttaaatagattaatttccttaactgaatgctacaagaatccgactattggcgacatgataattctcggcaaaatctagatcaagaggcctctcgttttagtgctaacgagagatcctatctagatgccttaactgtgggactaagtcccat

SEQ ID NO: 19910 - DNA, 1812 bp, Oryza sativa
  unsure (1)..(1812): unsure at all n locations
ggttaccagctttacaaaatggagcacagagagcactcggagatgattaagtaccaacagacaaggggtatattaagggggtgtttaggtgagagaaggactaaactttantccggacttattttttttgtgagagggaccctctcacccaaacaccctctaaacctctaaagactagacggcagcaatctaaaacagaccgaacgccaaagcattgcacggggctagcaagatcaaccaactcctattctattttgtcttagagcagctcctccctccttaaacctctttaccagcttctctagatcactcttattcatctccagccgatgcagaggactacactgcaataagaaagagacaatttggaaaggtagtattaggggtgagtaaacaagtttatccctgaacatgatgttgtttctcgttgtccatatatagagtccggcaaatggcagcaagcagggcatttttcacaactatatgtttaattcagctctaatgtcagcaaggataaagtcatcaaggttaagaggaacatgatcccagttcagcacatctctacagaaacaccaaacaaaatgcgccaaaggggcagctaaagattatgtggtttgtagtttctagatggatagtggagaaaaaaaactaattttaaaatcagtaactagagggtgagcgtgcatacggtacggggtcgaccaccggccacggacggcggggagcacaacggctacagtttatacttattttactgctaaaggagacacagacagtaatacacactacttccttcgtttcataatgtaagtcattctaatattttccatattcatattgatgctaatgaatctagatagttatatatgtctagatttattaacataaatatgaatgtggaaaatgctataatgacctacatcgtgaaacggagggagtagtctcaattatctgaagagttcattgacattgcaccataaggacgaaacgaatactacaatttagtggcatgtggttagacttactcttgtttcgtcgtcacgcgccagcccgagaacgggtccaatggaggatacctcaaatacagactcagactggcagtataggaagttgtgtcgttgctcctccagcaggagaagccgatcagtacacagtactgatatcacagtactgtatcagtatcaccttgcacacgatcgatcgacgctggctcgccggcggcgatggccatcttttcgttgatcacttgtgctgccgacctcgtcatcttcttctccgtctgctacatgcagcctccggctcctgtcgccgccttgtccttcaactaccccaccttcgcctcctcacacaaccagtacatcgaaattgaaggcaatgcctctgtcagcgtcgggtatatcgacatcagtgcgaacagtgtgggcaacaacgtcggacgggtgttctacaaaccgccagtgcagctctgggacgccgccaccggcgaggtggccagcttcaccacgcgcttctccttcaacataatcgctccgagcgatagaagcaaaaagggcgacggtatggccttcttcctcaccagctatccatcgaggttaccagtgggccacgaaggtggcgaaaacctcggcctaacgaaccagacagtcggcaacgtctcgaccggccagaaccggttcgttgccgtcgagttcgacaccttcgtcaaccccttcgaccctaacacaaccaacgaccacatcggcatcgacgtcaactccgtcgtatctgtgacgaacgagtccctaccaaacttcaacctcatcgggaacatga

SEQ ID NO: 19911 - DNA, 1659 bp, Oryza sativa
tatttctaaaaattccaattaaacaacaatttatatattttgaattttcagggtgtgacaaacctaccccccttaaacagaatctcgtcctcgagattcggaagaactggcaaacaggtgcggatgagctgacttcaattcatcttctcgttcccaagttgattcttcttccgagtgattactccattgaactttgcagaaacggataactcgattcctggttcttctctcatttgtttccagtatacggattggtttctcaacataagtcaaatcctcttggacttctatccgctcaatattagcttcttcggtaggtacccttaaacactttttcaattgcgacacatggaacacattatggactcctgccaaagattgaggtaactccaactgataagcaacctctcctcttctactgacaatcttataaggtcccacaaaacgcggtgccaattttcccttggtatgaaaacgatgaactcctcgtaaaggcgtgacacgaagatacacataatctccctcttcaaaactcaaatctctgcggcgattgtcggcataactcttatgacgagactgagccacacgcaatctttcttgaatgatctttaccttttcttctgcttcccttaggatatccgttccgaaaacctgacgttctcccgtttgatcccacaaaagcggagtgcggcacttccgaccatacagtgcttcgtaaggagccatctgaagactagcttgataactgttgttgtatgaaaattctgcataaggtagattcttatcccaacttccaccgaaatctagagcacaagctctcaacatgtcttccaaaatttgattcaccctttcggtttgtccgtctgtctgcggatgataagcagtactaaagttcagcttagaacccatctcttcctgaagtttcttccaaaaatttgaagtaaactgactgcctcgatcagacactatcttcttagggacgccatgcaaacacacaatccttgccatatacaattccgctaagcgacttccggaataagttgtctttaccggaatgaaatgagccactttggtaagtctgtcaactattacccaaatagagtcatggcctgatgacgttctgggtaaaccagtaataaaatccataccaatttcttcccatttccattcaggaatcttcaaaggttgcaacaatccggcgggtttctgatgttctgccttgactcgctgacaaacatcacatactgctacgtattctgcgatttcacgcttcatacttgcccaccaaaatctttccttaagatcctggtacatcttactactaccagggtgaattgtcacgaccggaaatcacccaacaggcgttcctgacgtgcgtgtattattccttgtcccaggaggcaaggtacaccaaaagttgatacaattcaaagtttaacaagcggaagcgtaaatataattattacacgggcaacaactgcccagcacacatagacaacgaaaaacagcggaagactaaggcgactgaccacaggcgcttgacggcaggcacgagctagacaccaaagccttcatcttcaaggaactcctcatctgggcttggggaaaattgagcaagactgagtacaaccaccgtactcaacaagacacacccacaaa

SEQ ID NO: 19912 - DNA, 8988 bp, Oryza sativa
ggaatctcgaccccgagattcggaagaactggcgaagagatcgggatgggctgccttcagttcgtcttcgcgctcccaagtagcttcttcttcggcgtggttgctccactggaccttgcaaaaacggattactcggttcctggtcctgcgctccatggtgtccaggattttcactggcctctccacataggtcaagtcttcgcgaacttcaatttgctctgagtcggcctgctcggatggcactcgaagacatttcttgagttgcgacacatggaacacatcatgcacgttgcccaaggaggcgggcaactccagctggtaagcaacttctccgcgtcgagcgatgatacggaagggacccacataccgaggtgcgagcttcccttttgtctgaaacctgtgcacacctcgcaatggcgtgacccgaagatacacaaagtcatccactgcgaattccagatcacggcgacggttatctgcataacttttctgccgagactgtgccacctttaggttatcccgaatgattctgactttagcttcagcttctctcaggatatcagtcccgaacacttggctttctccaacttggtcccacaatagcggtgtccggcatttgcgcccgtacaacgcttcatagggtgccatttgtatgctggcttggtagctgttattgtaggagaactcggcataggggagactcttatcccaagtcttcccgaagtccaggacacatgcgcgaagcatatcttctaagatctgatttagacgctcggtctgtccatctgtctgcgggtgatacgcggtgctgaaattcaatcgagtacccagctcttcctggagcttcttccaaaagtgagaggtgaattggcttcccctatcagatacgattttcttgggaataccatggagactcacgatcctagcgaagtagagctccgctagtttattccctccataggtggtcttcacaggaatgaatcgagctaccttggttaatcgatccacaattactcatatagaatcatatccaccttgggtttttggaagtccggtgatgaaatccatcccaatttcatcccacttccattctggcacttagagaggctggagaagtccggccggtcgttggtgttctgccttgacacgctggcacacatcacatagagccacaaactctgcaatttcccgcttcatgctaacccaccagtatttctccttcaagtctaagtacatctttgtactgccagggtgaatggaataaggactttcgtgagcttcctgaagtatcagctgtttaagttctctgttatcgggaacgcatacccgctttccgttccataaggttccgtgttcatcctctgtgaaaccagcggctttaccctgtttcatattcttgaggagtccatgcatgtccggatcattcttctgagcctcgcggatttgatcgagcaaggtgggcttggcttctaacgcagccaagaatccgcgaccaactatgcttaggttcagggcttccatctgttgattaagctcgggtggaatgcctcggacgttgagagtgttgcagtggctctttcgacttagagcgtcggcaaccacgttggccttaccaggatgatagtgtattcccacatcataatccttgatgagttctaaccatctcctttgccgaagattcagatccgactgggtgaagatgtatttcaagctcttgtgatcagtatatatttcacagcggttcccaatgagatagtgccgccagatttttagagcatgaaccaccgctgctaactccaagtcatgtgtagggtagttgccttcatgaggtcgtagctggcgtgaggcataggctaccacatgaccgtcctgcatgagcacgcaccccaatccttggcgcgaagcatcacagtacaccatgaaatccttgcgagtatccggcaagattaacactggtgaggaaaccagcttttctttgagagtttggaacgccttctcgcattgcgggctccacacaaatttctcttctttcttcaacaactgtgtcatgggtcgagcgattttggagaagttctcgatgaatctccggtaatatcctgccaaacccaagaaactgcgaatctgagtgactgtcttgggttgcttccaatcggtgacggcggtcactgtttcggggtccacagcaactcctttagcagatattacgtgccccaagaatttgacttcggacaaccagaactcacacttgctgagcttggcatacaattgatgttcccgcaactttcccaacaccagacggagatggtgctgatggtcttcctctgattgtgagtatatcagaatgtcatcgatgaaaaccacaacaaacttgtccaagtattccatgaacactttgttcattaagttcatgaagaaggcaggagcattggtcaagccgaacgacatcaccgtgaattcatacagcccgtatcgcgtggtgaatgcggtcttcggaatatcttcttcccgaatacgtaattggtgatatccggaacgaagatcaatcttggagaatacagtggcacctttaagctggtcgaacagatcatcgatccggggaagagggtacttgtttttgatggtgacttcattgagagctctgtagtcgacgcacatcctcttcgtcttgtctttcttctctacaaaaatcacaggagcaccccaaggggaagtactcggacgtatataccccttttctttcaactcttccaactgtttcttaacttcggccagttcatttgctgccatacggtagggtcgcttgtgcagaggagtggttcctggagcaagatctattcggaactcaatctctcgcttgggcggcataccaggtagttcttccggaaacacgtctccgaactctctgactatggggatttctgacagacctatctgatgcagttctgaacttctgacagaggttgggggtgcaaagaaaacaaccggttgttctggccctcggtacagagtgacagtgcgcctcgcgcaatccactactccttggaattgagccaaccaattcatcccaaggataacatccaaattcttggtgtctagcagaatcagatccgagggaaaaggaatcccctgaatttctataggaacggcagggctataatactttgctgtcataacccctccaggggtggtgatgagcagagggtttctaagcctttctacccccaactgatttttccccacgaatggcacagatataaacgagtgggaagctccagagtcgaacaaaattgtagcagggatggaatggacgaggaacgtaccgacgatgacgtctggagttgtcagcacgtcctcggccgtcacgtgattcacgtgaccccgaatgacatccttcccgccgttgttggagcggggaggcgcttggccttgctgacgccttggctttggacatttatccgcaaagtgtccgggctcgaagcagttgaagcacagacgctgctgaccttgagcgtccctgcggccttgaacgggctgcacagttggcgtaggaggacggggcgcacgagtcccttgctgattctgctgctgctgcggcggtgggacgcgcaccacgaattgaggtcgaggcgcggagcgaggttgctgctgctgctgctgctgctgcgaggaggatccccctgggtagggattggtgtagcggaccctctggttagcaccctgctgattgcggaagttcgccaagcggcgcttgtgcgattccagctccttgtgcttggcctccaagcggatgctcttgtccaccagacgttggaagtccgggtagtccccagagactagacgaacggacagctcagggtccattcctgccaagaacttctcttgcttctcctcatcttcccgcacatcctccggggcataacgggctagattgttgaactcatgcaaatactccatcacggagcggttgccttgcttcaactcccggaattcccttttcttaagagccacgactccagcgggcacatgggttctccggaaagcggcggtgaagcgggcccaagtaatcggctgcccctctggctgcgcagcctggaagtggtcccaccagagagatgcgggtccctgcagctgatgggcggcgaagacgactttctcctcatcactgcactgcaccgtgtctagcttcttccccacggcatgcaaccaatccaacgcatctacgggattgttggagctggagaaggtaggtgggcggatgcggaggaactcggcgagtttagagtgttggggaggtggtggtggagcattctgttgtggcggattttagaggtggtggaggaaagcattcatcatgttggcttgctgggcgaggatttgggtgagaatggcgttggtgtctggtggtggtggtggaggtggattgccttggtggttggggttgctgccctcgggttggttgccttcaccggtgttaacatttctcctggtcgtcaccatctgaaaaccccacacagaaccagcaaacagagaaggagagctgacgattaaaactaaccacccacgactactataattcttgaatttattactgctattaaattggttcattaatgttcaagttgcttaggcaaataaaataagacaggctccgacatagttacaccacacaccggtgtaaccatgccccacacaactcaaaaagacaaacgaggaaaaacacacgcgcaagcctactaactgctcgtctaccgctgcgacgggccagggcggaaggtgagcaacagcgcaccctccgagctaccaacgccggaggcttccccctcctggggaaccacgggcgcaggctcggcacgaggggtctcgacgaagcaagtccacgccagggactgacgaacaagctcgggcctggaggtgctcttgcgggcggtgatcttctggctgcggcagacgcggcgacgcttgaggcggctgtcctctccctgggcgatcttgagctgatgcagctgcgcctccactgcgtcgaggtccttcttgagctgcaggttctcctgacgcagctccaggatcttcaggttgttctccaccatgccacggcgcaccatctgatggaagtcgatacgagccgcgtcgtacgcctccaccatgcgtgccagatgcacgacggtggcgtcatcctccgagctggcgtctcggaaggtggcgtagtcgcgggctcctccgcgacgagggtgatagcggtagggcgagtgctgcaactcgtccgggtagcgctggtgaagggtgccgatggcgaggagagcggcgttctggcaagcggcggggaaggaatccccacccgcggtgactgccagcgaagtccgctcgggagagccggagaggatcactgcagtgacctcccaaccagcgtgaggctctgcatcctcaccctcctgctccgggagcggcctggcctggtaatccactccatgcggataccccaagaccacgcacatgccccgcagctccaagacgaagccagtcatgtccaaaccacgacgggtaacgctgccggccatctacaaacaaaaacaaaaagagaaacaccattttaaaggacagattttgatgataagtgaagcagcaagacaaagagagaatagcgggttttcacaaataataaaggatttttatttttgaaaatattgctaaggcttgggatctacggctcgtcctagggtcaagggaggctctgataccaacttgtcacgaccggaaatcacccaacaggcgttcctgacgtgcgtgtattattccttgtcccaggaggcaaggtacaccaaaagttgatacaattcagagtttaacaagcggaagcgtaaatataattattacacgggcaacaacggcccagcacacaaagacaacgaaaaacagcggaagactagggcgacgaccacaggcgcttgacggcaggcacgagctagacaccaaagccttcatcttcaaggaactcctcatctgggcttggggaaaattgagcaagactgagtacaaccaccgtactcaacaagacacacccacaaatgcagaataaatgcaagggagtacaagggaattataccataaaggggttagggttgcagtaaacagcatttaaagacatttagttgctcaaggctattttgtaaacacgaatctagaactatacaatattattaatcaaggccgtgaacccacacgaacctgccttaacccaaggcctatgatgattcagaccgaactggcaacccgaccctgggtcccagctcgtcccaagccaacccaggccaaccattccatattttagttgttaagcaagttttaagaattaaaacactaacttgggtacattgctcggcttgcccataaccgagggctcggctattcgaatagattatactctgatcagaggtgtacatctttacccacaagacacatcttcctcacgtgtaaccacgtgccacataccaccacggtatacagacgaaagacgtgacatagtttccaacccatcctagccttagacaagagtaccgacccaatcccgcctacggccggaacccccgggacaggcagacggaactgagcccctcgcagcagggcaccaaccctgtgctttttgacatctcgactaccgggccgcagctcgtgtagccttcatttgccctggagaatgtccatcgacccccgacttcatccatctccaatccgtgtacttttgtttatgactagactgagccacaaactaagccttacccactagacatgtggaagtacggtagtgctttgcaacagaggcccgaagaccggtccttatatggccgaggtgctaccatcaaaaccatgcaccccgagcccagcctaaaagcaatttaggggattttgaatagagggggcggtgtgaagccaattccacaataaaccaacaattccagagtatccaggtgatatgaatatttcccaaagtctatagttgtaaaacctcctaaggttacctaattaaattgcgaagcatctacctagaattaaactagtggtgtcatgagtagagagtccactagttgaggttttctttgcctagggtgaacaaggtaataataataacaataacaataataatatggtcataacaaaggtaagtaggcatggctaaataaaacagtgataacgcgggaatttaaataaagcgataatgcaataatttaaatcaacataattttataaactgggattcaatatgatcaagatgatgtgtcttgccttgctcgttttcccaatcgacggcttcgacttccacgaagagcggatcttccgaagctgcagcgtctacacgaccaacggaaaagaaaaggcttaaacactaaataactccacataacagcagaaacaaagcacaaaaatgggttctttacatcttaaggaaaaattagagacttgaacggtccaattccgagttcaaatggccaagatatggccatttgaagtttatatgctctttaaatggatatttacgaatttcttcatttaaattttaattaaaaatcggattattgcgtcagccgagggggcgggcgtgcggaccgggtccacgggaggtggggcccacgcgtcagccgctcggtccacggtggaccgggcgcacgcggctggcggcggtcggcgccgtgggtcccgcgcgtcagccgcacccgcgggcgcgggcggctgacggccgggcccacttggcagccacgagggcgcgcccgagggcggcctcgccggcacggccgacgggagcggcgcgcccgcgccccgatggtcaccgccggcgaccatcggcgcggcggagcggcgcccgagagagcggagagaagggggaaagcgaacggcggtcttcggctcaccccgggacaacgacgccgacgagaacggcggccggagcggaggaaagcggcggcgcggttcgggatgacgatgacgacggtgctccggcggtcggcgggcaaagcggagcggcggacggggtcggcaaccactcggcgaagccgatggaggtggcgccgagtcgggaggaggaccggagcgacgacggcggcgaaacggaggtcggcggcgacggcggagagagaggagcacggcgcgagcacggatccgacggcgagagcgagcggcgagcggcggaaacggaagagcggagctcggggagcaattatatagcaccgagagggggagaacgcggccggagaggaaggaaacgggcgcggggatctcgggctccatagatgtcgccggcgatgaatgcgggaaggaaatcggacgaatccgagggagagagaggggggaaaacgggggaaacgggagagggaatcgcggggaatgattcccccctcattaaggcgcgcggggaaggcgggatgcggcggaatccgcggcggcggcggcgctagggcacgggcgcggcggcgggcgcggcgggaggaaggcgatgacaggtgggccccacccgtcagcgagagtggcgggcgggcccgcctgtcagcggtgcgcgcgcgcggggaggccgatgggccgcgggggaggagagagagagagggagggagaagtgggccgagccggcccaagagggaaggggggggaaaaagaacttcttttagggttttctttttataaaacctttttaactttgtttattccttttcaattattatttgtgctctgaaaattccactaaaatttatttaagcattttaggcttttaggaaatatacaaaaatcctccaagcctcatttgacttttatctttgcccattttaattgttggaggctttcacatgaattttaattattctttgcacaatttcgaggatgaattttagagtcgatttgggacgcgacaaacctaccccccttaaacggaatctcgaccccgagattcggaagaactggcgaagagatcgggatgggctgctttcagttcgtctgggctgcagg

SEQ ID NO: 19913 - DNA, 10800 bp, Oryza sativa
acgcgagacacggacgatgtatacaggttcgggccgctgggaagcgtaataccctactcctgtgttttggtggatttgtgtgtggaggagctacaaagtgtgagccgatctatcccttgctctaggctctaaatctggaaaaaatccatcctcctctccctatgggcaaggtcctccttttatactttaaggggataccacatgcactcttccctttccaaactggacttttcttctttacataaatggacggagatttgcacggttgccctccgaacgtccttctgatgggacggcccatacctacctccacttctgccgggggcaggcgcgtcgtgggaacgtggctatgcgctgacgacatgagcagtgtcagaccggtcacaaatcggtcattcttgtccaccgcgtgtcagcttagcaacgtgcatgtttgcccttcttcacacaacatcttgcctgtaatggttaggatgaagcctggtattcatctaaccagggctaacgtgtcatctctaagaggtaacacgctagctccggctggagacgcgtgcctagaggctctcgtcttgacgggacggggcgaggcgtgcgccaggccgccagtcgccacctaaccgttgatctgaccggtctgtgactggtcacagaccggataaaagagtgcgctgcattgcgctgcatgctgcatgacacgcttgaccagatcgcaataaatgcggttaggtgagccctaccgtgttcacccaacctatgtacataatgcaaaccccacaaggggtcggggcacctcggccctcggagctggggcaggagcaacccgacccccccccctcggggaaatcaggaggagggcggacacctcaccctcgggcccgacgtccccgaaggtgccaggccacgtgggcgattccatctgcctcaagcctccgggcgcaatactcccggtcccatatcaccgacagcaacgaaacctctaccgacaattcccaaatttaatctttcaaattccttgcataattccaatggcaactgtcgtccttctgtagcattgcaatagccttttctgctaagagcgtctgctacaacattagccttccccggatgataatgaattcccatgtcataatccttaattaattccaaccatctccgttgtctcatgttcagatccggctgagtaaagatatactttaaactcttgtgatcggtgtacacttctgtacgagtaccgaaaagataatgacgccaaatcttcaatgcatgaacgactgcagctaactcaatatcatgagtagggtagttcttctcatgcggacgtaactgtcgagaggcataggcaaccaccttcccatcttgcatcagaacacaacctaacccaagtttggatgcatcacaatacacttggaaacccttctttggatcaggcaaaatcaaaataggagctgatattaagcgacttttcaattcttgaaaactctgttcacattcttccgaccacttgtacttcacatctttctgaagcagtcgtgtcatgggcttagcaatcttggaaaaattctatataaacctccgataatatcctgcaaggcctaggaaactgcgaatctctgaaactgtctttggttgcttccaattggttacggattccacgttactaggatcgacggcaactcctccggctgagatgacgtgaccaagaaatttcacttcggacaaccaaaattcacacttgctaaacttagcatacagttgatgttctcgtagcttctccaatgcaaggcgaagatgttcctcatgctcttctttggttcgagagtagataagaatatcatcaataaagaccaccacgaacttgtctaagtattccataaacaccttattcatcaagttcatgaagaaagcaggggcattggtaagtccaaaagacataacagtacattcgaacaacccatacctagtggtaaaagctgtcttaggtatatcttcctctttgattctcaactgatgataccctgatcgaagatctatcttggagaaaacagtggcacctttaagctgatcaaacaaatcatcaatcctgggtagtggatacttattcttgatagtcacatcgtttagtgcacgatagtccacacacattctctgagtatgatctttcttttccacaaaaataaccggagctccccatggtgatgaactcggtctgatgtatcctttctgtagcaaatcatctacttgcctcttaacttctgccaactcattggctgccattcgataaggtctcttatggatcggagttgttccaggtaccaaatctattctgaactctatatcccttttaggcggcataccaggtaaatcatctgggaacacatcaggatactcccggactataggaatctcttccaaagttatctggttcagtcttgaccttaaagactcagatgacaatgcatgaacagttacaactcgaccatcatagctgttgagagttacttttctgttggcacagtctatcacacctttatgtctggctaaccagtccatccctaggatgacatcaaggtctttggattttaacaagataagattggccagaaatggtactccttgaatttctattctgacagaggggctacgttgcaaagagagtgcttgattatttccttggttttgctgattctgaaattgctgcatcatcatgttcataagctgtgtctgttgagcaagaacttgggccagagtgggattctctccattgttgttgttattggggttgttgggaccattcccattgctacgagtgttcaccatctggcatggacagggcacaagaagagaaaccggggaaactacttaggacagagaattactttaacttttattgatcttaactgagtttcattattacaaactaaagactctcacaccactaaactcaccaacttcctaacactcaaaagcaaacaaacacatgcaattacatcccaccactgatgtaaatcacatgcgagccacacacaagcaaacttaaagcaaaccaactaacacaacgatctaagacaacgacttaacaagtcactctagttcttccaagcatcggaggtcgattgaaggctcgtttttatcatcttgagttgctacccactcaatcttggaattgttgtgcttagattcttcttcttcatcactacttatgatgatgaccgaaggatccgcttgagctggggcaacttccttctccaccacacgaacctttggcgccaattgatagcgagggacaaatagagctctcttccttgcggtaagacgaatcctggccttctgcggcggtgcttctcccttcaatgcggctaattccttctccaaacgatccaccttgtcttctaacttgcaaatcttaccacgattccggtcttcacgatcttgagctgctaatacagtctccgcacgactttcatccatagcccacaacatctcaaccaaatgtttcgtggtaacatcattctcaattccttcagtctcaaggtaactgccacggtcacttccctggggttggcgaggatggtagcgatactcaatgtcggccaactgatcactgtagcgatcacggagctctcctatggcgatccttgccacctcctgacatgcatggatgtagtttcttcctccagcttcaaacatcactgaggggacctcttcactattactgttcaaagtgactttgactcggcacttctcttcatgacgatcatgaggaatctgggcataaaaaggggcagtcccaaatccaatgacaaaggacatcgtgcgcaactcctggacaaaaccctcaacaccaaacaggtactcaggcttgtaacgcggcatctaaagacaagtgaaaggagggagttaagacctttatccaattaatagcacaagtttttggattaatttgaataaagttagaaaatcagagtaaaaaggtaagtaaataaagtaaaccaagctttgcgagataagttaaaatagttggaaacgaggtcacaaattttgtaattttgaataactggtttcaaaagaaatgaaagaaaatgataaaatcaacatgataaatttattttattgcagcaagattaaataaaacagtattataaaacttttgctggtaaaatgagccattagtacagtaatagatgtacagtactaataacactggaataaattttgaatgagaaccattaaaagagattatgaagtgcatgtgccattagtttggtttaattaaaagagaaagggaggagaacagttctacttttccaatatttttcagagggcttctatgggtaaccatttggcataacctagggtcaaagaggctctgataccaacttgtcacgcccggaatttctatccaaaattccaaacgcttacatgtgtgtgaaccctcgtccaggaatcagccgaggcacacaataacaaattgataatagagtacaaatattactctaattaataagcgaataaaatgtcattacagaggtagatagttcctctcaatcaataaagttctaagcagcggaaaataaataaacggcgcagacggctccactccacaggcagcttgaccaaggctacacctaatcctccacaccatcagcctcattgtagaactcttcctctgatgaatgattgcaaggtgagtatatgacatactcagcaagccacgcagcaaatatgcaagtgcacaggataacaaaggatggcataatagggtttcatttgcaaaagcagcatttagcaaacatttgagaatttaacaaaacagttaagtaataattaaacaatattaatccaacgctatacaacataccctgttgtataggcccaaccattctgaacaaccaccccggctgcacagttctatctccaaaccaggaatgtcccattccaaaccaggagctaatcaaattattaccagtttaagcatcttttacaatgatgagaggtgtgagactaatcacgaaagacattgttagacccgcccataaccgcgggcacggctattcgaatagttttactctggccagaggtgtaccactgtacccacaagacacaaccccacatcatgtcaccatgtgcctcaataccaccacggtatctcggaaaggagttgtgacaatacccctcgcataacacaatccactgcagcgcaccttcctggatcataatcacccccttataaacaaggcatggactccccagcgacccccgtgggcttatctccgccacttctcagtctggtgccccgcaatgaaccatgctatacaaaagataaagccgttgcccatgctggcttgtggttggcacgataaatgtttcacaactgaaactcgtgaaccggtccttaattgtcatgagcacgaccatcaaaaccatgtgcccacaacccaccattatcaggttttagttggcacattaattaattaactaatcacgattgaccatcgtgaactatcaataagccatcatgaaataatagtgagtcattagttatcccataaatgtactaatgtttctaagcagggctaagcaattatatctaatatctagttgaaccaatataaataaagctcaactagtcaaattaatataacccaaggtatcaaggaataaggtaatcaagtacgaaagggccataacaaagaataggtcaattccacccaatgacattcgaaaatagatgcaatagttgaatagaaacaatagctttaaataggatcaacatgctcaaagggttgtttgggatctgtgtgacttgccttgctggccttggaactcttcaaactcttcttccgcgaaaacggactctccagaaacgacggaatctaagcaaaaagaagcaaaatcaccaaaacagcacataaacaagcatgaacagtacatgtggatatttttaatgtgtaaatctcaattttagaaaaatttagagacttgaaccaactaaatcggagctaagatgaattagttatgaatttttaaagattaaatcggattaaaacacttaaatcggtttaaattgaattatgacgcaataatgaattatttttgaaaaggaaaagaaggattattgcgtcagcggctagggtttcggtggaccggcgcacgggcggcggttcacgcgaacggacggccgagatctaaccgatccaagatggacggccgagattgatcgagtccacggcggttcacggcggacgaccccgatggcgtcagcgatgacgtcaccgacggcggcggcggctcggcggagcggacggctcgggcggcgcacgctcaccggcgaacggcggcgctacggcacgaacggaggacaccaacgggaagcggacgacacggcgaacacaccgacgaccaaaacgacggcggagaagcaacggacggcgacggcgacgagaaggaagcggcggctaccttcgggttgtcgacggcgacgaagctccggcgggttccaacggctgcgaaggggcggacgaggacggcggcgacttggcgatgacgacggcggtcttcccgagcggcggcgacagctggagcgacggcggagcatggctgaagcggcggcggcgacggcgaagctagggcacatggcgctaaggctcttccggcgacgagaggcgaaggcgagggctgcgacgggtagaggagacaccgggggtccttttaaaggggctcggaggcggcggcgaaggcccacggcgacggcaacggcgaaggaaaccttcggcttggagagagggaaaaccgatccgaatcgaactcgattccaaagctttccaaagcgatttaaccaaagattccaaaggagaaaatgtagaggagatcccggagatcatttcccctctattgattcggccggagaaggaaagaggcggccggatttggaaaggaaacggcggcggcgcgaactagggtttcggcggcgacggccgaaggtagacgacgactccgacaggcgggacccacctgtcagcgacagcgaggccgcgcgcgcgcggctgactgggccggctgggccgaggagagagagaagagaggttttgggccgactttcggcccaaagccaaaagaagactttttaaaaccttttcaatttaaattatttcttaaatgcaattccatttattacaaatactttcttagctcaaataaatcccagaaaaatctaggaattatagaattaagcaaagtatttaatgaaattttatctggcccaattttatattggaatttattaattaaacttagattttcttttcaagacttttaaaattatttctaaaaattccaattaaacaacaatttatatattttgaattttcagggtgtgacatctagcgatcccctaccccctccccctccgccccaagcttctcccttggatccggcggtggcgacgtcggcggcacccgcggacggatctaactgagaggatctgcccgacatcgccgccgtcccctcgcggccggatctgccggtgttgttggttgtgtatgggttgtttctatttttttttatgtgatgatgatgtcgttgccgtgattgattttggggtttttatgagaggagacctctcattgattacgatttggatttggattgaaattgagattttgtttttgggtaggattgtgatgatgtgggatttgaagaggaggtgcgcgacggaagaaaaatcgcggtatggacgaaaaatcgttgtgacgtcgtcatcttattttggatttttttttatgattccgatttagatttggattggaattttgaaaagtttttatttggattgggatggtttgagattttagagagaaggtgtgctcaatgtgggtctatttgtgtgatacggaatttcgactgggatttgggggggggggctgacgggacgaaaaatcaccgcatgcacgaggtgacgaaaggaaaaatacgaatatttatattagttaagatacagtagataggtagtgtggagattatgggtaccccatacccacacggcatggttatccgactagtaataggggataacatatatctatggaatatgtaaccgatcatgacttgggtattacgtttccttttatattatggagcggcctaaagtcctgattcgataatattgtaaaatagatttaggaaaccgataccgtattggttaaggtttctatcttgtaatcctgccccccatcctatataaggtgggcaggaggccctctagggggcatgagacaacctgatcgtcagatcaatacacactcggcggattcaaatccccaaacaggagtagggtattacctctcattgagagggcctgaacctgtctaaatcctttgtctctgcatccatccactttaggtctcgtccgctacccccttttattattgccgaattcatgtttcgacagttggcgcgccaggtaggggttgcgtcgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcaccgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgagtggtgcccccgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgctgttgggcgtctacgacttcaccgccggcctgcctccgtcgccgccgagtggtgcctccgcctacacggctggcctattatgccgccgttgttggatgtctacatcctcaccgccggcttgcctccgtcgccgccgagtggtgcctccgcctacacggctggcctattatgccgccgctgttgggcgtctacgacttcaccgccggcctgcctccgtcgccgccgagtggagcctccgcctacacggctggtctattatgccgccgctgttgggcgtctacgacttcaccgccggcctgcctccgtcgccgccgactggtgtcttcattgttattgatggacgactttgttcccacattggccacttctgccatcaccaaggggaatattacaaagctaagtcatcatttattttattctttatatgatatttttccttttcctctgcctcactacaccaattggtcttccattgagtagtgagtcgggggctacagatgttatatcatattttttataatatttatcttgattgcttgcgacataatctgagtacaaaagtacctatcgagttatggagttctatcttcctatgctttccgtttggtttgccaatggatggttgcctttgggccgattcctagcacccgggggctcgttggatggaccgagtaacgcaaggtgctaagtattactcggaagaaatcaaaagcatagagataatataatttattttctgctcttaataattgcaaaagtacctgagtagtaaattctgatccgtgaaactttgttccattaatgacgaactcatgtcactcatatgcatgtttgggaagtgcttaggccgactcccagtgcttggtggctatgactagttgggcagagcgtttaaacgtaatgagtcatctgctcggggaaatcaaaattgacaagaggagaaatacatgtttataaatattttaaaatacttgattttttctcgagtattatatttatatcagatactactcatcctatatgtttgttctgcaggatccagatccagatatgcataaaagggattcatggctttaggcttatctcttacgctccaggaatggatcagtcagaacatcaccgactggcttgccttcgccgctgccgactggtgtttccgcctgcacggctggcctttatgccgccattgttgggcgtctacgtcttcaccgaccggcttgccttcgacgccgccgactggtgtttccgcctgcacggctggcctttatgccgccgttgttgggcgtctacgtcttcaccgaccggccgcctcgtccgccgccgactggtgcttccgcctgcacggctagcctattatgccgccgttgttgggcgtctacgtcttaaccgaccggtttgccttcgccgccgccgactggtgcttccgcctgcacggctggcctattacgctgc

SEQ ID NO: 19914 - DNA, 5278 bp, Oryza sativa
tggtgtttccgcctgcacggctggcctattaagccgccgttgttgggcgtatacgtcttcaccgaccggcttgcattaaccgccaccgactggtgtttccgcatgcacggctggcatattatgccgccgttgttgggcgtatacgtcttcaccgaccggcttgccttcgccgccgccgaatggtgcttccgcctgcacggctggcctattatgccgccgttgttgggcgtctacgtcttcaccgaccggcttgccttcgccgctgccgactggtgcttccgcctgcacggctggcctttatgccgccgttgttgggcgtctacgtcttcaccgaccggcttgccttcgccgctgccgactggtgcttccgcctgcacggctggcctttatgccgccgttgttgggcgtctacgtcttcaccgaccggcttgccttcgccgctgccgactggtgcttccgcctgcacggctggcctttatgccgccgttgttgggcgtctacgtcttcaccgaccggcttgccttcgccgctgccgactggtgcttccgcctgcacggctggcctttatgccgccgttgttgggcgtctacgtcttcaccgaccggcttgcctcagccgccgctgactggtgtcaccgcctgcacggctggcctgttataacgccaactgatgctatcttcttcacggctggctacatcgctgtcactactaataggcatcagtatcttcaacacaagctgcctacgtttgccatggctgccgactggtgtttccgcctgcacgctggcctattatgccaccgttgatgggcgtctacgtcttcaccgaccggcttgccttcgccgccgccgactggtgtctccgtctgcacggctggcctattatgctgtcgttgttgggcgtctacgactccaccaccggcctgcctccatcgccgccgactggtgtttccgtctgcacggctggcctattatgccgccgttgttgggcgtctacgtcttcatcggccggccgcctcgtccgtcaccgactgatgtttccgcctgcacggctggcctattatgccgccgttgttgggcatctacatcttaatcgccggtcgtctcgtctgttgctgactagtgcccttacctctacgtctggtttatacagctaccactactgatggacatcatcatcttccgtcgccgactgattatgccgccgccgactggtgcttttatcttcacaactgcgcgtcttcactaccagtttgcttctgttgccgacgactcgtgttcacttcatcacggcaatgcaactttgtcatcatggtagagcgacttcatctttattatcttcggcactggcaaactctattgctgctacttcgcaagttttgctacttcaccaaccacgacgtctttgtgagcctcgacatctcggcatgcgatgccatgttattttactacaacaagaggctctccaatattcaggatttctacttggacatcttcaacacatatcttcaatcaagcaatgactacttgacgacaagaagctataattctcgactctatgttcagttgtttcccaactaaccaaagagtcgggggctacacaaatacaaggctcaaaatttgacaaattttatgtcaagctgaagaaatcaattcatcaaccaacgagtcaacttcaggagtcattatcttcatctttgattcagagcagacattctacttcaacaacttcaaatatttcggtttagacggagttgggcaacaacatcaactctcctccaattatttgtcttcacggttggcctactacgcaaccgccgatagaggatctcatcgttatcatcggctgctacatcgctattgactggatcaccgacatcgccatcttcatcaacatcttgtcaagcctcatcaacatagcctactctgctgccgttgatgggaaacttcatcatcatagtcggctatctctattgccgctaatcatcattaccgtcggatgcgtttgtcgccgccgattattttcttcatcttcatgattggtggatttcgccatcaccgttgatgcgtgtctacgtcttcatcgtcggtttgcttttgtcactaccgactgttctttcgttgttgttgggcgcctacatcttcactgctagctgacctgactgttgccgactggtttcttcgcctccatggttatgcaacttcattacatttgattggtggcatctttactaccactgacatcatccgttacttctgatgagcaatttcgtcttcatgttggtcatttcatctccatgccgactgcgtcagctattgccaatagacaattttgactatgacagaaggacaagctatatgctcaggagctcatcaactcaagcgtgaggattatatctctaatttggacttgttccggatacatgcaacatgaatttatgatcatgggtctattttctatgctcaaagactggactatttattattccccgtaagggttatcaaccgaatacttgcgccagtcgggattcaatttttatatctattttggagtatcccataagggataatcactcagatcacatggtctatatcacccgggagcatgttacatgcgtcatcctttaaagggtatcgaaggcatattttttggcctaggcctaatatgtctgcagcccatattttcaggtgtggcctgtcacgttcttttagggacttaggcactttttgcttaggccaaagtgcgcgtgatcaagtgcccaataccttaaaatccttttataccgcagttactcaactttttaggagttggtacaatgcatcttaaaaggtgtcaaacagtaaagctttatatagctgccccgctgactttttaatatagtcatggtgctgtttgggtttttaagcaattgattggatacaatatcgttgctttttgccacgtaagtgtgcatttttattgaccaatattatggcttaggctgattatatattgtggtcatttttctaggcggttggtaaatcctttatgagtttatttactcggattttacaccacatatgccatatatttccaggtgtggtgaaaccatgtgtcttttagggactaaagcacgtctgttaaagcagtgtgcgcatggcgtatgcccaatactttggaaatttctttattcacaacatccaagcttctttatagctattttgctatgtgaattttcaatgatgtagccaactttaggttacactcatcatattttacaaagcagtcggtatatcacttggatcatattattcggggattcacaccgcatatgctatatattggtatcaagtcacttggttgactacgattatcaaaaccactcagttggtgcatctattagatacatctattcgatgcacctgactttatttttcagccctccacagtcttcatatttggtaaaagtactcgggagatcatggtgaggatgattgaagcactcggctttggagtaatctagttcgagaaaagattatctttccgactgtgaaggtctcaggggctactgtggagattatgggtaccccatacccacacggcatggttatccgactagtaataggggataacatatatctatggaatatgtaaccgatcatgacttgggtattacgtttccttttatattatggagcggcctaaagtcctgattcgataatattgtaaaatagatttaggaaaccgataccgtattggttaaggtttctatcttgtaatcctgccccccatcctatataaggtgggcaggaggccctctagggggcatgaaacaacctgatcgtcagatcaatacacactcggcggattcaaatccccaacaggagtagggtattacctctcattgagagggcctgaacctgtataaatcatttgtctcggcatccatccactttaggtctcgtccgctacccccttttattattgccgaattcatgtttcgacaggtagaccatagattcaagatttgatctaatactaacaaaaacttgatcaatatttaatgagataattttagttattatcttttctcatctatgtacgtgcatggctaccaaaaattaggagcattcggtctgtttgtttcctagtcctttccttgcatatggccgtatacgtaagttggacatgatttttttggggcatttgcaaatttgccactggttttttcaatattgcaaggatgccactcgactgacagatctagtggcatttttgtaattttctagtagcagtcttacaataacgattcaaattagtagtaaatttgcaattgcccctttttttcctattacccgacaataatcaggccatgcaatccggttcatagagcacttggagtcatgttgatgtaaaaagaaaatacacactggcctaggagatctgtttagctctagtgcaggtccaagatgttgatgagatgcgggtgtgtcagtcagtttgatcctgcaactgacaagatatgtaaacaatatatcagatagccgatcgcctgacaagccgatggagtaattccagccgatagccgatactaaccgatgccgattccagccgatgtcaatagggttttgagcaatcggctatatgttcaatgtagataataatgcaaagataatcggctgatgataataaaatatagttataatataaaccaacaaaaaccaatgggctaataataatatgataggataaatactgatccgatggttaaagcatacatcggctggaggtctgatgctataaaatccacaagagtagattaaacaatgaaacctttgttgtcatcagctaaatccaatttatatatgcaaaccttataagttgatgcaacgtctagataactcatcgattgaaaccccgataaaacccttattggtagtcaataagcaggctagagattatggttctaagcacgacttaatagattaaacttaactgatgcatacactaagtatgaaaagaaacataatatctagacgatcaagcccttgactgattttcagggtgataaatgccttagctaatctaatctagtaaaacaacttagccgatacaggcagaaacactaaagcgagaggcaaccgatagagctaaattgagatactaagactagattaactaaaacatatgataaattggcaaacaaattgttgatgcgaaaaacacacactggcctgggagatctgcttaactccagtgtaggtcgtaaatcttgctcttgggttcaaaggcatgccag

SEQ ID NO: 19915 - DNA, 1360 bp, Oryza sativa
atcccttatattgtgggacggagggagtagtacttactagtgctaggctgctagctagtactaggatttttgatgtgaaatagtagtggagattctctcggaacagtaattttggaacaatcacgagtaaagcacctgttaggatggaacttttcgtaatactaatacgttgtgaatcgagtgagcatgatctttttataatcctcgtcgagcgcgagatctgattgtccggtacagtattttattcaaccgaacatgacaaagtgttttaacgtcgaaaagtcactagtttacctcggggtgaggtgagcagccaatcgggtggggtgtcaaagacagaaaccaaaaggcagccagtcatcagagcggtcactgcggcacacgtcgtggggcgtggttggaggttcgctcaagtcgtggtcgtcctcgtcccggttggatggactagggggtgcaatgcaaatagcgtatggttacgggcgggtaattgcaaaaaatgcggcgcacccgtgttgtggcaccaataatgttgggcttctctccccgagaagagacagccaatggggggggggggggggggggaagcggaaccaactttttcgcgggatgggaaatttcggcctcgctttccttgtttgttcggcccggatgcattaccacttctgcccctgggtgcggtggccatgatgacgataaaaaacggaaatgcaaccgcacgcactcctcctgttgccgtttgcctctgtctccccctaccgcgcggtggggtggccactacgcgaacaaagggaaacggcaacacccgcagggaccaaaaaggaaagccgaggaggagagggaggggagagaagggagagggggtcggggagaaagaagagcgagcgagcagctttggctacggccaaaccctacagcgcctccaccaccactccttgccttttttggtgagtcgccctttgccgactctcagatccccttgcgttttaccacttttgccttgtccgccgcccctccaattgggataaaaaagaaaagagctgcatctctcgctgctcctcctcctcctcctccgccgtgcaggccgcagccgctcgtgtggttggttggttcatcggcgatcgaagatggtgcgggggaagacgcagatgaagcggatagagaaccccacgagccgccaggtcaccttctccaagcgccgcaacggcctgccaagaaggccttcgagctctccgtcctctgcgacgccgaggtcgcgctcatcgtcttctccccgcgcggcaagctttaggaattcgccagcgccaggtacgcaccccccctcccccctcctcctcctgcccaatctgctcttcttcttgtc

SEQ ID NO: 19916 - DNA, 1211 bp, Oryza sativa
tgaactcacgcttctggacaaatgcccacctcttcaccgcatcttgtaagtgacctttgtcatgaaacatctgtccaactttcatctgcttactatcataacaccagtgggcatctaaaccatcgtttaccttcatacgactcattgatatggtcgtccaattatcgggtatgtaagtttcgttgtcccacagtgttgtatcttctccttccactacaagcgcaatgtattcctcgttttccacttccatctgatccactaccgcctcattctcctccgctgcatcaacacgcataggcgaatccggttcttcatcgtccgagtcgttggcctcacgattagtaccacgaacaatgacctctccttgtgtattaccctctactacttcttcccctcgaccttgctcagtccgccaaacatttttagcttgtccaccttccaacggagtttcttccaccacggcatgacttgactcccccgatcgatcaacacattttgtcttctgcaccactattgccgggctatagcctttctcccttactttactaacaaactttctccaactcccagttgacgcaacctccactactctccactgccatccatgttgacccctcactggccacacggcatttatgacaaatttatcctgtactggatctaccccaaacatattatacaaccaccctaacacgtcgttcaaacccatatgctccggtgcattcagactagtatcatggaaggcatatacagtcaaatccaccccgctatcacatatttgtataggagcatcgccataatacagacgaatgggcatatcacctgacatcctgataaaacatgacaaatagtctcacgtttaatcatttaatcattcgataattaccctattacaacttatactacattgccgtgtactaatttacaactattagtaacaaacaactagtttaataatccaaataaaatataacacctttgtacatattttaacacacaacatatcaataatatgtactaactaagaactaatttaaccgtacaattacttaaatacctctaccaacatttagcaataacaaatatgtgctaaccatacatactaacatcgaacaatgcgaaacaattaacaactcttaaaccaattttttattaaactttcatatgcattggacttaaggattactaatgtataccttaacttcactgct

SEQ ID NO: 19917 - DNA, 10441 bp, Oryza sativa
  unsure (1)..(10441): unsure at all n locations
tcctcctttcgtcttcctcccgttccggccttgtgcagagaatctcaactgagatatgttcagcatatgtttgctccaacatcacatcaaataccaagccacaatcaagcaggagtacaagtatgcacttgagatctctcgatttagatttagatgggtagtggagtctgccgatcgaagggtttctgcctggtggtgctgaatgggtgggtgcatatgcgtctagcatttcgcatccatggacgacaatacgggtaagtaaaatatacagcgtggtctgtttttaggatggtttggtgtcattgcatgcctagcatcatctcctttctcaacgcagagatccagcttattcctggcctgttacttaagaatggggcatcgcttggctatcttctgcagcaccgccgctggagcgacttctgccaggcagccctatgaatagctcagtttcgacatccatgttgtcgttggtggtgttgatgttacggtccgggttctcatttcggcccggacagtcaaaggagcagacaagggaggctgattcttacactgcacaaagttcatgatcaagggaagcaaatcaggtaagatgatctttcagtgccccagaaaatttccggcatttatattggtgtgcacataagatatcgcacgaataagttcaaataatcatatgctaggctgggcgatcgacttaagctggctgctggtgtcttctcggcagtaaaagtttcactcgtcttaccttttcgcgtaactcttcattgtccttgcgcagcttcatctcctggtcgatgttaatgcaaaaaagagacaaacacgacattaggaacagatgattggtcctgcgtttcaggttatatatatatttatttatttatagtaagtacgaagttggtgaggtaccttctctctcagtttggcaacctgctcctcaagcagctttgtctagtatgcagagaattggttgtaagtttgtgcacatcatatatatagataaattaattgctgataacgtagactgaaatggaaaatttattagccaaccttccttcccctgatgctaatgaggcttctctccagcttgacctccaggctatgcagttcttcaatagaacattcatccaacttttcacccagcagttttctgcatatcaacaaattaaacacgatgataacagcctattttttgacagctacaaggacggcacttctgtaattcagctgaagggggtaccttttgtaagtttcaagagcttcaaagttttttttgcccaaaccatcaaggggtaagcttttacctttgttacaattcagacaaccaaacaatctattgaaaattgtccagctacaataaaacgactagaagcacattttatttcagaacacattttttcattgcttgtttagtgctcatgttctttatttatttctcaccaaaacattcctaccataatctcgaagactatgcacatccttggtgaattgaaaactgattcttaaaagtctagaatacatctgattttctttgtcttaaaaatagtactgtccctgcttcagtgcagggatcttatatatgcttatttatacataaccataatctactgtttttttattaaaaaaaatacaatctatcagatatagggcatcttcaaataaaatttgaaaacagagttccccaaaataactaacttaatatacatttcgttttacctcaatatacaacgaaatctattgatggagcagcattgacactgccaacggaaattatacgcacacatatgacataaattatactaaaatcagtctatcagcaataacactatggtacaaggatgaccaagtttgtcaacaagaattatatacctctatatcttgctgtactgtcttgttgccgatattttcctttgtatacgtcctatagcgttcaattgttttctgcgtactgaagtaaagagaaaagcagcaagattatgtcagaatagtgttagaattctgtttcaattacaaaagcacaaaacgttagatatatctcaattaaatatccaattagcttcataaattgttaattaagaaaaagaacgcggtcaaaggttgacttctttctgcaactagagaggtttttcgcctttcgatcttctgatgctacataaggagaaaagatcaatcttttagatcatgaaaagatcaatctaactatacatgtttgatctctgtcatattgatatcttaagccagaacaccccacatatgtatcaagaaaactcatgaagttggaagggcatttacactagtactatcaagaaaacataggagtgtttgttggattgttgcatacttttcgagtcactgtgtgacctatatccaatataaattgccggatgataaactacagacatatatagataggtagatattgttcaaaagaaaaaaaaatagatatactagctacagataaaggtagtcctccaacatcttcctgacttaaatgcagaataaaatttagggcttatctgctaaaaacaccagaagaatttataaaaggtataactgttccagaacttctagtagtttcattctgcggtctcaaactttgcccaagcttatcattgaatggtctttattatccacagcctaataatcaaattaatgtggtaactggtacaaatggaatcgtgcgaatgaaataatcatatatacagctgctgaacaaaacaatatcacattgttgctcatttttttgataaacctaggagaacattttgataaaatttgaggaaaaccatgaaataataactaaaattaacagacatatgatacaaaattcaagacagaaacttgcgtttatttgatttgaactaatcatcagacattttcaacagttgcctttttagaacttggtaatggagtcttgaaaatgaaaaggagttatggttaactaagtgtatttgctgctgctgttaaagtcatgtaaccagttaaaactggggtgcttttctggtggcnnaccgtattcttcccaggcgatgccaatataaagagttattaaataacaagtcaacttcgccataagatgtgctaattaatactccctccggactaataatattagttgttttgaataagggtaaaatcaaactttaaaatcttttactataaataaattataaaatatttatcttaaaaatatggaaatcatatgtatagattagtcttaaaaagtacttcaataaaatcatatgtttgctgatatttctatatatattataatagaaaatagttggtcnnaaagttacttttttgggagaaaccgtgctcttgtccaaaacaataagtattatcaatccggagggagtatactttatcaacaaaataaattgcagaaagaaattctccattcatctaaaacctgatgcacggtaacataagatcaattagccacatgcatatgcacttgtcgggacccatttaaaataaataatctatgaaatcctttggctggatggaagtagaatacaccaacacctaacaacttctttagtaagagtaaagaaataaatatagagtaaattatagtatatcaactgtgacccatgatggcagcctcccgctactaaaattctttatgaagccaaagaaggcttctcacaattctagtgtatcgaacttgctatttgtctaagtagcttcacttataagttgttttccaaagggctcgtgtgtattgatgaacgtcttatgaaaatttcttcagatggaaatggttgattttaccaaaaatgatgtggcttaagtatataaagaatctagaaaacatggtaaaaacgtcatttcagaaaagctttgtagaggcaagtcactcttggaggttagaatcattggtaaacataaataagttgtaggaattttctcccatgtatccatcctctatgagaaggtcaaggaaaacgtccatattcaaccactcaacttggccttgatctgaattttgaccttcgactataaaattgctcagttttgtacctcgtaataaagctatccctaagcccaaaccaggttttttttatgacacggtgaagtaattggtggtatgatttggatgccacaaagcatctactccatcctttccatattgtaagccattttagtttgtccaaaatcaaattttaaccaggtttatagaaggatgcaccaacatccataatatttcatggtggatttaatgaatgtgatttgatgttatagaagttgttacattttttatgaatttggtcaaagttaaaagaagtttaacataggacaaaactaaaatgactgataacatagaattaagtagtagctatcaaactaaaataaataagatacataagagagaaaggtggtgagcatgacaagtgggtcccaatattttctacatttctttgttgtttattgttgatttgtgtggtgaacaactcttttcacaagtaggtaggggtggcattttccccattggaaacagggcctcggtgggtccccacccctacagggccggggacagggccaaatcttcacccgtgggtgttactgagtagggccctgactttgagcggtgttagggccgaggtgacatcttcactcgtggagccctgaagtttaagaaatagtcacctcatgtatgtatttctagccatcaaaagcccataaggccaaaaatagaatataaaaggacaaaaaaacaataatccacctgcacaattcgatgctcccatcggctgcatgatttgtgcgatcgcttcaatgctctgcgcatgcaacgagtcacgcacgtcgcccatgcgtcgactttatcccgcccgccgctatcaccggagtcccacaccatcttgtccacaggtgccccacaccttcttcctcatcttgtggtcggccaccggcgcccactccattcctctccctcttcggtcgcctcccgacgttgtctcttctctccatacgattgctttatttggttgaaggtggcacttgtcgttcttccctccttccaaccgtcggcaacttccgcttgcttaggggatgttgggacttggctgaagtgcgaggccctataggggccggggtttcggccagggactaatttcaacctgttctttctttcggggtcgggaccgggtgaacctgcaagcgaacagggatgggagtttttgtccaacacgaaccgacccaaccccgttgccatgttggatccatctcaccacatcaatggaaccatgttgatgaaccatttttaaagttgcgggatcagtaattaattgctttatagttaaaaggacaaaaattagatcaacgcaatagttgaagggctaaatttggactttaattgtaggataaccaccatttatatacccattgtcattatgatatagtatttattctcgtctcgaagcatcatcttaacgagataaatggtatatttgacttgagtctaatgtatacacatttttcgaccactaaaataggcttattgcaaattacattttgaatatacacaagaagcatgctaagtcaaattacacctttttctcactttgagtcaaagggccaaccaaagaactacaacatatttgacacgtacttgggtttatatcttacattggtgggtctactctcacaatggttcaactgatgcacatgtatatcaactgtgagttcaattcatccttcttgggtcaagggtgaaaaatagatatacatacgagtggtaaaggctattattttatgacttgtacaatggtattgtagtagcggcaaagtcgtgtagtgtggggttgttagcttgtgaagacatttattgcatcttggaaaacattgaaacaaaacatttatcactaagcattccaagtggtatggaaaaatttaattacttgccacttttgcaattgttcctatatgtttgcttctaatgagaatagttcttaaccttgtgccacttttcccactatgggtattccaacatggaagattgacattaaaagttcattttgctccagccccttcccccaaggtctggtacccgtggaagtcactgccgcaaccaccagatgctatggagctgtcgctggggaccctatgtgagccatggttctttgcgacgacagtgaaggtggcgggagctcagtagaaccattgatgatgttggggccgatggtggacttggagggtcaattggatagagaagggcatgtggcgaaagcttccaccaagaaggtcgatggggatcatcgtccttgccagggacgtcagcaacagatggtgagagggccttgaagaagagtagactagttgtggcggcgggaggcaacaaccctccttctcttcctcttctttcgcctcctttgcttccacaactcgtagcatggtttcacgtgggaggatactgttgctagccattgagttcttaggcacgactatcttttgtaattcgatttgttgccgtgtggcgaggggctatgatagtgggcagtggttgtggggtgttgcatcaaaaggaaggaggaggccgcgcgtgcttgcccgatgttacgggggttgcgaggtggcataggtggatggtgaggtgcatagcgaccaataagcaaatggataacatggtggctcacccgagatagagttcatcgacaaggacttacatcaacagcatagtggtgagctcctctacatccaactacaagcatctaatttcatgagggtggagtttgtcgacgaggactacatcaacggccacggtggtcagctccgctacatgcaaatgcagatctaaggccaaggacagccatggacatccttaatcgtttcttccttttgatcggggcaaaattgggatctcacatcaacaatccatatgatgccaatgtgttacacatagtggcatagtatttagaaatcttctctccaacggcaaacacaggacgacgggttataagagcacaaatagttaaacttcctaatggtatgagcttaccacttccatgttataaatgtcttttgttgatacaaacattataaatacttggctttttatgaatcaatgtaaaatgcatcgtaacccattaaaccatgcattgaccatgttgtgtttttgtccttccccctttatctatgtgagatcaaaagaacggtgggggaatattctaaaaccaggtctatgaagctaacttctcgttataggatccaaatcctgtcacaaatataccaaaccgagtagataattagctagctaccaatttacatggtgatcacacaaggttagttcaactaaacttccgtcattcattgtggtccaaggctcaaagccacaattacaccatagcgtatgacgtctattattgattccttgcatagaaacttagtagttatggatatatgggttttttcatatccacaaatcttatgttttaagaaatccgcatcatgcactgattgatgttgtataatgaattaaggtatggttggaactttgatgtgatcaagttggaacaatatatactaattttacatctagatttccaatttataggtacatggtaaagatgaattagttttttttttgtgtgtttgaatccttctctttcaccaatttataagtatgttttttttacatacaaattacaattatatgacgaaatcagaacttaatttttctctaggttgattgttctactgtttaagcctatatacataaaaagaaatacatttgcttgtttttgtctgaatgatataagatatatgtatataaacctatattttaaacagaatagctagttacatgataattttgatgataggtgatttagcaaccaagttttataaccttcagtagagaactataacaagggattagtatgagaaatatatatttcaactaagtaggaattaacatcaatgatgaatctaagcataacctggctatatagttggccataaggcccgaggcctgaaggcccggcccacggcacgcctttttggcccggcccaagcacggcacggcccgacttgggtcgggcccatgccggcccggcccgaccgtcgggcccgtgccggcccggcccgaccgtcgggccgtgcctgggcctccccaccagcacgctgggctggcccggcacggttgggccggcccggcacgatgggctggcaggccagacccggtacacaaagtatagggactaaaaatagacatataaatgtcaatgtctaaagaatagggaccttaaatagacttattttagctatttatataccacatcacaaagaagagggaggtaaaataccctttttttagctatacaatgtcacagcccaataggagggagaaactttagacttattctgaagaaaagcacgatggcccatcgtgccttcgggccggcccggcaagacccgaggcgtgttgggccgtgcttgggctgtgagtgcggcacgtgggctggcacggcacggcccggtgcgtcggtcgggccgtgccggcccgacaagcctcggcccaggcacggccgggcttgggccgtgccgtgccgggcggcccacatggccatctatacctggctatgatgggagttgcaccaggcaactagtaacacagaaagaccatgaaacgcgcgagagtagagttgtagatagtggtgaagggagacaatatttaacatgcatgattttgggggaagagataagaaaggaaagatcaacacaaaaatttgtcggactttgggactagtgtagtttggattagaaaagatgagaagattatcttttgagattcaaattacatgcaaaagaacataacatattactagaaaaacaacaatttcaaactatttcttatgcatcaatgctaacacatctttcattctaatattaaattctttaatcaacctatgcacatattatgttatgcaaattctcaattttccttactcagaatcgctcaaatgattttaccataaattagcaacgatctatactaaccaatttaccttgatgatatatatgcttttgggtgtaacatatctgaagtaagaaactaaaggatttgttttttttaccttgatttctattttatccttgatcacattagtgttggagtaatagccattagaatattttttttgcacatctcttggtttatgggtattaaataacataatttttttgatcaataattagttatccttgagcaatatacgacataaagtaaggttctagcaagggtatggtgtgttggtattgagccaagcataaaaactcttgcattatagccaattgtgggttaattcatattcacaaagtcagacaatagccggactttggttgaaagacaatgcacctacaaatgggctagatagatcttggaagctaatgtgcacctttcctcttcctaaatggcagttaattatatataataattgtcatattttctatctaatactaggtaccatatataatctaatatgaatctcaaaggaggttgactgcataggttcaagtacaaataaataactcaacctagccaaggtctatgaaaaacaagagtacaactttactgtctttgggagggtatggcctcatatgggtgaagctaactcaaataactatggaaataaagcaaattttataattttaaattaataagcatgcaccacaatagcgaattttaacttttttaatgcaaatactgtgtaattaacataacaactaaaaataatgaggcaaatattttatagagaaaaaaaaaacaatttacatcgatagttacattttttttttgctaagtgcttaagacaaacatcacatgctacatatcaataaaatagcaaaaatgtggtagctattttgtgtatcgagcatgttctctcattgacccaagatctccattttgagctaagtagtgatgctgtcaaaataagtgcactccatatgagaaaatagagaagatagacataatagtataattaaagcatctaaaagtaccattgccaaaatacacccattttacaaagatatgtccacaaataaccacaacggcagccaaactggagacaaaataacaaagattttcaattctagatttatcttagcactaatatgttttttttttaaaaaaagaatgactattcttaattacactgtattcttttatgatgataaaacaactattgttggtatatcaaaaagaccaaggacaaatgccatagaaaacgataaatatgttatcaagcaatttatcttcaattaccatgcccaataaagatgagactacatcaagacatgcaaaagaacatgaattaagtagttttattacaattgtggtcacaattgttaacatatttagcatgctaagtagttttcttacatgaattaaatagttctcacaattgtggtcacaattctaaaaaaaaaggggcaacaa

SEQ ID NO: 19918 - DNA, 754 bp, Oryza sativa
atatatatatatatatatatatatatatatatatatatatatatatatatatatatatatatatatatatatatatatattgacccaaaaacagtgagggagacccccactgtaaatatatatattaaagaaaatatatacaagagaagcaacaaaaagagaatgaaatatattttgcaagcaaatgaccacaatcaattaatgcattttttcacaactacaaagatatgctcaaatgcaatgtgcctcattcaattcctttctaaggactaccaatctataattttcatgtggtagggttttgatttgggatctcttcactctaggctttgacactagtttcttttgagtacatctcagaatatcataaccattttgtcaaaattatcagtttgatgcaactttagctaactatttccaaggtccacatgcaagacactcataatagtgaaaattctagtaaaatcgtccactacgatgttgtttggtgaaatgtctgtctaaagttgtagcaaaattctaattttgactaaatagttgttgttttgtgaaactcttcttttgaagattgaacaatatatatacataaaacctactaaaataatactattataaaatacctttcgagacaatccacgtgtaggattttcatgtatttgaactacgtatttaagatgtcttatgagggcataatcgtcttagatatgaccatgcctatgtttacatattaattaactaaaggcacatgcgttct

SEQ ID NO: 19919 - DNA, 953 bp, Oryza sativa
cgcaccccaagaggcggcggtcggcaagaaagggggacgagaaaaaaaggaaggaaggagagatcctcaccggaagcggcggccgacgcggaggaagaggacggcgacgacgattgcccaatggcggcttgcgaggacggagggcggacggggtcgcccttgaccttccgaaggagaagagggagttcgggagaggaggaccgatgcggggtgactggaaacgaaggccgatggcgatgacaagaggtagagctcaccggcgaccgaggaaggaggagctccggcggatttccggcgaagaggggcggcggccgaggtcctcctcgtccttgcggagctgagggaggcaacggcgcggcaacccctagggcggcagtagcaggcggctggaggcggtgaatggcggtggtttcggcttgcacggtgggaatggtgctgcgggggtggaaggagaggacggagcggtggacgaggtgcgcacggcggctgcggtgctggggagggcgacggcgcagtgcggggtggacgggagcggcggcgcggcgctgctggagttcgccggagagcggcggtgcgtgggctcggcgcggggagagcgagggagggcgcggcggcttggggaaaatgggggaaatggaggaggggaggccggggattgtttttataggggaggggaggcgggatcgagccgggagaggcggagtccgggcggcaaccgccggtggcgtgggccgcatcgtggggtgtgggtggcggttttggaggggagagatgggggaaaaccgcggcgtcgtggggcggctcgggcggccatggcggcagttggagctggaggaaggggatgacaggtggggtccacggggtcccacctgtcggggagagagggagggagagctggatgggggacgtaaaccagacttcacgagggagagaagaaacgggccgacggccca

SEQ ID NO: 19920 - DNA, 3606 bp, Oryza sativa
  unsure (1)..(3606): unsure at all n locations
ctgttgaaaannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncatctgctcatatacttactatgttccttgctagaatgcttgttgagttctttgaccagatgaatgtttgtagagttatccctagtaatttaaatcatgcaggtgatgtctaggtttaaatgattttcatcagatgtagaggtcacagccttccacatgccatttttcattgatatacccgtgtatcaacacattaagcaatactcttagtctccaagtcatgatatttctggcatatctcttcttctcagttttttttaacataaagctttgtccatatatatattgtatagcatcaaatagatgaatcttttgtgcacttctcttcagaatgtcgatgccagacaaaattctccttttgtattgatgctcatagcatagctatgatattttgagaattgagaacctattagtccagtttgatctaagaattatgttttgttgtttttcatattggcatttctgtgtggatgcagctttttaaagggctggacttggaggcactatctgttgaacttataatattagctatttggaacgaggcccttaatgcatgtagtttatccacggatgctacacatgatggattttttttgacccaagctcatgtcaatttcctgcctaagaatgaccatcgtccatctcgaaatgtagtacaaggattggatttcaccaggctcgtttctgtctgttcctgggctgaaagtggctttatcaaggcatatgaccgtgcagagaagatatcacataggttgcgggacaacaatggttagaacattggtatcttcatgtcctagtatagttttgtttttgttttttgctataacccttgtttgtttccagataacaccgagatgccagatgcagtggagatcatattccagacagctttaatatatggaacaactggtgctgtaagtatcagtattctaggttcttgtatggtttctttacagctttcgtttttccttgcacttcatggatttggggggaaagtgggggagtggtgtatgcatttcacgattttgggtaacaagcaatgatgctacaacggaaaggaaacctgtagacttgtagttaatgtgtaccagcccaggatccaccgctgtgcactggttgtccaggcggttggttagttattatcactccatattctgttagaccacgaacaaggggcagaaatgaatactattgttttaggctgtgtttgagggagagggaattgagaagattgggaagatacgcaaaacgaggtgagccattagcacatgattaattgagtattaactattttaaacttcaaaaatggactaatatgattttttaaagcaacttttctatagaaaatttttgcaaaaaatacaccgtttagtagtttgaaaagcgtgcgcgcgaaaaacgagatacaatctcccctttctcatgtgaacaaacgcagccttagactgcagtgggaaaaaaaaacaactttttttacaaatgagcaaaaatgtttatagccagccagtctctgctctctacttctattaaagcgctattcatgggggaaagcggtattcatggggaaaaaacttttatgaaagcactccaatcatgagttcaagacccttgctactctttttcctccatctgttttattttctggccaatacttaatcctgcccttgtaaacagtttgtaacattttgatgatagtaatatattcatatgggctggccttaggccttagccctttgtgaatctttcaaaaaatagcccccgtcattccctagctggggaactctaccatctttcataaaccctacttctaaaagttctccaacatgtttcttcacttagagctgatgtttataattcgtttgtgtataccttttcaggcaaaggaagttttgggataccaaaatagatcggtggcgctatactcaaaagcaatcatcttgctcacatttgtattgcaagaagcaactaatttgccactgaatccgccgttttccctttcatcatctgatcagcaacgtatccataggtacatagctaatttgaggagccatctatgcagtgcccagctgaccggacaacaggagagatatgtccagaactaacttttacatgggaaatattggtgcacaaagaagtgaaagttaaattgattccgtggtaaacttcaagcaagctttgttttgttccccacgagtattagtctttgcctccaacttttttttgtctaggagatgcttacttgggggaacttttgtaatgttttgtttgcatgatcatagtccatgtgttctttttgtatataatatataataacacttctaagttgtacagttatttgccatagaactgaaatgacctcttggctctgtatataagtagcatgtaaaaagagcaaatagttttttatttttccaagtcttaaaactgctttgcctacttattatggactgtccaaattctgaagtgagcattattttgagctatggtgtttggtgtatggaagctgacatgtacaagaatagcaggtaatattatctttaccattttacaatatattgctgagacatggattatagtttcagttttttctaggtaaatttcctgcttctgcttctgcttctcacaattggttgcagcttcatctttctaacttcgtacaagtaggtctgatgctttttttgccaaccatatgtccatatcccagacaagatgaaatggattgcatttccatcgctacatctgaaggtatgcggtcataaaactcttgtccttttccaagaattctcgtgagttatgatagaaagagatacaactatgacaaaagtgatggttccacctgatgtcataatactagctttcagtattaaaaaaaaaacctcactataaaataactcagatttactgaagaaaatttgatcaaatcatttccgactaatgcttccactatatagcatttcatttgtgcacatattctccatgtaaggttggagtatttctaatatactccctcattcccaaaatataaggatttttagagttggacactgttattaaaaaagtatgtagaattaaataggtggaatgattgtgattgaatgagaagtggaggtaggtggaaaaattgaatggtggagagttgtgattggttgggaagagaatgttggtggagaagttgttatattctgggacaaattttgaaagctaaaagttattatattttgggaattgggacgaagggagtatatgcttatgggggaagaattcttttttggctgaattcctccacttaagggtctgcattcttctggatattgttgagtaatatctaaattactgaaggtttaaatcatatagttgatcccatcagtttcgtttgtagtaagtgggaat

SEQ ID NO: 19921 - DNA, 8034 bp, Oryza sativa
atcatttttttcccaaaaccttgcaaactttgcataacatatcaaacggctaactggtttatgatataagaggccttactatatgtaaggatatgctttatttaaatggtaccttggttgcagtacagaaaaatatacttttctaaatttgtcaaactccaattcttcacaggtatgcatgggcgcatggcatcagttggccattgacattgcaaggtaaacgtccatattggatctagtattattatttttttttgaacgaatcatatttgatctattatgaaatttaacaatgtggctcctaatcagaatttgatatcttgtaatgctacagtaactgtacagtcaaacaactattgccttggaatatccatctttctcagcttagcaaagattctaatctgttccatatttttcaaagatgtgttagaagatctaaacttgtggccgctaacttgtagtttgtaaactttttaccactcatcacttgtccgttgtgacagatgagaccagtctgcaataagacagtggattgaacaatggaatatggaggcccttactcatctgaggcctgtgacagatgagacccgaaatctccatgtacagtggatgccggaatatcaggtactaacaaaataatccctcttctgaaaccactgaaccatcatttaatatcatggtattgctgtgacacaagagcagtcactgctgtagtcctgtgccccctcactaaaccgctcttcactttgacgtgcaaattctggtgcagtcgtggatagataatgagaaccttatactactcttatcttgcacacaagaattatgctcaaatacctacaactgagttcttttgtgtagaacttttccaaactggattgggcatttaggcaaattatgtgctgctgaccttctctctagccatgtccttagtagatggaatactgcagctacaaaaaaatatgagttccattatatgtacgacccagttgtataactcatgtacaattagagacgtgcaactatatatcaattaaacaagagcatgtccatatgcactgcagccgtttaccgtcggttgatcaaattcagtcgtacatgagttggacagtcggaacgtatgctaccaaaaatatattgtgggaggctgggagcctaggaaatgaagtctaggacgatatcacatttgcatgaagtctccacctggttttgcattacggttcattgtatcagaaatgctagacgactttgatatctggatactcaagggcctcatcttttcgcttatgtttatgtttatcagccaaaatttgaatttttaaccttaatttgaagctgattttgagtcttttttattgaagtttatttttcagcctttggttttagatcgctaagaacacatatataaatgttttattcctaaattactttttgtttacaaatatgtcgttttgtttattccgctaataagcgaaacgatggctccaatagaagagaaaccgtaaaaacgtccacagaaatcctcactgtggcagtgcttgtggctcagttgctgcaatggagcggccatagcgccctgtcagtccacagaaatcctcactgtggcagtgcttgtggctcagttgctgcaatggagcggccatagcgccgtcagtgccaatgtatctttgacggtgagctcagagaaggaggacggttcacggtcgtgtttttggcgcgaaaaaataagtgggagggatggataaggctggtattggtaccacctactgttaaaatggggcaggtttttttgtttgtgcaggtatgcagttggaggctttcatgcgttaattgtttttagctcttgtgtttatcccatggtcctgccggcacaggatttggttaaaaattattgaactcagctgatgcttgctagtactggttgcatgcgccaggagatttcaccggagcaagcataccccagctcaattaaaaccggtgccagtacctttggtaccgtccatggttgcatgggtcatcaaatcctgggatccgaaacaaatctctacaataatttcccggccgttgcatctcatgctttgctgcccgatgcatccaaagccagcccaccctcttgcctagtagctcctgcaactctgtcgctcccagccttttttgactccatgtctgcctggctgagcctgaggtcaaagaattttccattggtactactagctcgatacacataaaatgagtaataaactgtggaacaaaaatggtatagtacgagtaggcagagaggagggtccgaatacgattttgtgtacaggtgtatactatgctgtgcggctacttctttcgatgtctcttttcccgtgcgtgtcgaagcatggcgaactggcacagtgcaggagcagcggctgcaatcccttttacccttgcttcccctgcggctcggttcagatctttctggcacatggcccatgttgcctctgccgctctgccacttcattggaaatgctaccccgaaaatacgctcgtccagtcgtcgtctctacgtgtatgtatgtctttttttctttttgcatgcccttctctactccactttgattaattacctgcacttgtcagctgaacctaaggtccttagactcctactgtacccagtggcgaacccagaacaaaagttaccgggggtccaatacatactaattatctaattattgactaatatattaattaatatagtgtaatttatataggatttgaataatctacccggtgtcctgtgacaccgggtagtataacctaggcacgcccctgactgtacccgttggctggttgcactagctgaaccagtcttgcatcaaagatcaaactagacaagtcacatgattaccgacatgattaggattgtgtacctacatttatgtgatggttaaggttggccaaggaacgaatgggggcggccttgtaccaccgaagtgccgagtccgtagaagaaagtagggaagctatcccgataaagtttgtttggaaaacatgcacatacctcgggcagaacgcgaccaatggtaaagctagacctgcattgcaatagaaacaccgggtaaaaaccacagcagttaatcgcagtcaccgaaatgacagcggtggaaagaggttacgacaagaggctgaggtagggggagagtaaaggaaacaaggggaaaaggttaaaagttggcgagagagaaaagggtttggttgtctcgaagaaattccagaaacggcccaaacttggctcatctcgtaatcaccaataatgcaatcgcttcgctgagcccactgccaagacatcttgtcctgtccacaacgacgccaatcgaggaggagagattgcatcacatcgctcgctgccttggcgtcccccttgtaccgccatctgtgtgggcgtggctgcgtccccgtctccctcctgtccggccctacccaccacctccggcgttctctgccttgttactgttaccgtgtctcctgtgtcatgcattgcaatttgcaatgcaacacgcccgtatcacctgcatcgtttggtggaggggcaagagcagcatgggcattgctgcgccttctgccgttctgcaccacaggtttctcgcgctccaggtactatctgaagctcacggtaaaaatttgaatccccttcctcacacttctaaggacttgtttagtttccatggaaaaaatttccgccatgtcatattgaacgtttagacacatatatggagtattaaatatagataaaaaaaattacacagattgtgtgtaaattgcgagatgaatactttaaatctaattgctccatgatttgacaatgtgatgctacagtaaacatttgctaatgaagaattaattaggcttaataaattcatctcgcagtttacaggcggaatctataatttgttttgttattagtctatgtttaatacttcaaatgtgtatccgtatatctgatgtgatatgccaaaactttcactcttggatctaaacacagcctaactttgtctcaagataagtgcatctgtttagttcaaaaatacattcattttagggcggagggagtgccggtagaatgcatttgtagactgtactaatattacccaaaaaaaaaagtagttgtatgttttttttcatggtgatcgatcgaagcacagtgtagctaaccaactatctccaaatctgtcgtagcgcaatttgttcgtatgtacaatcgtcgtcgatacgtacgtagctttcatggaatcagctagcatccgcccgtctccaggcctacatgcatacttgcagctttgatgatatgagcaccacactgacactgcaagagacgaggcgagctatgatgcatggaggattggaggcaagttgcgggagcgtgacgacacgtactcgcctctcctcgctggctaactgactagctcagccccagctcgatcgttcgttgtatccaccaaaaagtcttgggctttccactctcatgcatgccaccactccgtactacaccgtccgcttaaatcatgtgtttcttgcatttcttgtatgcacgattgcattgcacgcacgcccaatcgattccgctgaaaacggtgggaacctgctgctacgcccgcgcattcacggccgcggccaccatcgagacgatcgatcatcgaatgccccatgcttacgccactatagatcacttcatccccggcaatgtcgccggccggttgccatgatagcgcttatttgtgtgtctatggtggcgcatcgcgtgctgccttttggtctcgccggttttgtgcttcaattccatccctttcgatcgcgtgctatcttttagctaagctacatggatccgcctttgacgccgtccctcgtcgatcctgacaagggcttgtaccgtgtgtacggtttggatgcacgtactgtccaaattaacgatgcaatatgggaaggtgtattccgatacggtgcatgatggtgtacgtccagtattatagccttcttagtttttttttcccagaaaacgtcacatcgaaattttggatacatgcatgtagcaatatagataaaattaaaaactaattgcacagtttgtatgaaaatcacgagacaaatcttttgagcctaattagcccatgattagccataagtgctacagtaacttacatgtgctaatgatgatttaattaggcttaataaattcgtctcgcggtttccatgcgagttactacctccgtcccaaaataagtgcagtcgtggggaaccgtgtccgacgtttgaccattcgtcttatttgaaaaatttatgaaaaatttgaaaaaaaaattagtcacacataatgtactattcatgttttatcatctaataacaataaaaatactaatcataaaaaatttcaaataagacgaacggtcaaaagttgaacataaacagtgtaaaattgcacttattttgggacggagagagtatgaaattagttttttcattcgtgtccaaaaaccccttctaacatccggtcaaacattcgatgtgatacctaaaaattttcttttcacgaacaaaacaaatcctatatatatattcggttgcgatgatatatagagggagcaaatctgcacagtagctagcacgaggatggagtccaataaccgggcgggcgcggcatacgggtacaatgtgtgaagaagacagcggtgggcagtggccatccgatgcctccgacgaaaaatacgaaaccctgcatgcaggatgtggtccggtagccgatcgatgtggatcgttagttgtgtgtgtgtgtgtgtccgtggtacgcatgcacgtccatgtgctgacatgcatgcgtagagaccgttcagtccatggaccgaccacctagctacgatctacatactgtacggtacttcgattcgatcggcgccatgcatcatgcataatgcagccacaatacacatgcacatttcttatgatattttagtttctgattacatgattacatcgaacctgccagtatactacagtgcacaactgtgaatacacctccttaacatgaacttaatcggtatagtagttctaaatctcccaaagatatccgtactacagctcacaaaattacgtatgcaaagcgttcatggtccaatacgtcaagaaaattacatgggccgggtaggggtgaaaatgcgcccagccacattatttcgggacaaattcgggatccgggatatttcacggatattgggtccgaatacgggtattttatggcagatatgggatcggattcgaaaatgtagtatcctaaggatatggttatccggtaaaaaaatcgggtatatattacccggataaatatacagatattatctatattatgtttttgtgaggcactttttagtattatgtattggttctactatgatgtattgtaccctatttatttcctatgttcctaatgcctaatataatcgtattatgtatatatggaattgttaaatggttattgtctatgtgatatataagattgttccttcgacttgatatccgaataaatattcgtaatcgatagtgtacgtatctattttggtacgtattcattccgtatttttacccgacattatccgagtttatatccgtattcggcattatccgtgtccgacccgattcgtcacgcaatttacacgcaatctgtgtaattattatttttatatatttaatacttgacgcatatgttcaaatattcgatgtgatatggtgaaaattttttgcgtgagaactaaacagagcctaagataatcaacagtacgggtaaagacattaatgtaactgaactgaccttaattaatgcagcagatgcgctgacagcactgttacttatctgttcccggactactgctaaagggttgacacagcagtgatgatacgggattagtaattaaataatcaatcatgtgtcaacaggtatatataaaacgggaataatcaatcatgtgtcaacagcactgttactctactacttgctcgctaacaccgtcgctaatcagttgcaaggagtcgagctcgcaaggcggccgggaggaggaggaggtccaggccccacggtggctgccgctgtcgccgtgccggacaaatctgcaaatctgccgcgcgcgcgccaccaccctcctctacggcttcaataattcactctcacttgctcaaatcttcatcctcgttacctggcctaccaaaccttacaagagacagccatttcttctccatccaatcgtctcctctccctcattctacctcaacctctctgctagctcctcacctctacaacaacacattaattgacatagacagcagcagctcgtcgtctgcttcaattgggagcaggaggaggagaggagaggagcgagggggttgctgttgcagctgctgccccaggggctcattactcgccagcgcagttattgctaccactgtagtataccttgccactaccaccaccaccttcctcttgtaatggagaggatgcagctgcaagggcccatcggctcgctggtaagcttccctggccggggacggggacggccactgcactgctgctactagtagctagtagtaattgagcaaccatgtagcttccattcctagtctctgcactgcagcacatgtaatgcgatgcgatgcaattcggctgtattaattgcattctgctgcttcttcttcttcttcttgcagctgctaggttgcaacatctagccctgtccgcgctcgcacgcaccattcaatgcattctcgcatgcaacctgctgcagctgcttgcattgtgctgtcttcttcttcttgcatttgcatccatctcttttatggcgttgccgctgtttctgtttcttgctaacgtgctcaactctgccggttcatggcgatggcgcggcggtgcgggtgctaatggaacagtgggcggcggcggcggcggcggaccacgcggccgccagcgccggcgctggtcagatgccgtttctcgcgctgctccacggcgccatggaagcagacggcggc

SEQ ID NO: 19922 - DNA, 8470 bp, Oryza sativa
tgtccaccggtggccgacctcgacctgctcgagagctgcgtcacgcaggcggcggcgccccccgtcacggctccggcgaccagggcggagcggaggaggaagaggccgaggccgcgcccgcgcgccgcgccgccgccggagaagcgcaagaagcccgaggaggccgagaaccagcggatgacgcacatcgccgtggagcgcaaccgccgccgcctcatgaacgaccacctcgcctccctccgatcgctcatcccctccaactacatccctcgagtaaattccttcccgccatgacgccgcaataatatctcaattctcaagcaaaaagaaacatcaaaatctctcgcaagttcttagcgattactacaatgcaattgcggatatagggtgaccaggcgacggtggtgggcggggcgatcgactacgtgaagcagctggagcagcagctggtggcgctgcaggcggcggcggcggagcggagcggcgtcggcgtggtggcggcggcggccaccgcggcgtcggacggcgtgttcgtgtccccgcagtacacgagctactccgaagcgcgcggcggcagcggcgtcgacgtggaggcgacggccgcggtgggggggcacgtgcgggtgcgcgttgccggcaggcggtggaccgggcggctcgtgcgcgccgtcgccgccatggaggacctccgcctcaccgtgctgcacctcgccgtcacctccgtcggacatgacgccgtcgtctactgcttcaacctcaaggtcaaaacaacgacaactcttcatcaccttttactgcatgttccctcgtttttttaaacctacatttgatttgccacaaaaggtagccattttctaactatatttgattgcggtttccatcacaaggaaaaaggaatatttcgttgctgatttcaatattgaaaggtcactattactaaaaggcaattttcagcttaattcacctgtaagctactccctccgttttaccatgtaagtcatttagcatatcccacattcatattgatgctaatgaatctagaaacggaggaagtatttaaagcagattactctagtttctaatggttttctcttataacacgtttcaattagacattttttttaaaaaaaaacgtagatggcaataaagtataatgaaaatattttatagtatttttttcattatagattgcgtgcaatcttaaatataaactttgaaatcagtctttgtccttcttgcctatgcaaatagtgatcgatgtttttctctttttttttttaagaaaaagaggattgagaacagttatatccaacaaattaaaatacatttgtacaaagagggaaaaaaaggtgagctatttttaaatatattttttaacctactagacgcatgtgctcttttttacttgcatccgattgagcatttaggctgtgggccacacgctaaaccagatagcttattagctattgtaaacagaaaaaatgactgtttatttttctttaaaaaaattctatgttgaaagcatttgaaaaaaatacgccatttaaatagtttggtagctcaagaaaagcgatggagtggttaaaccaactaggtaaatcaaacggtgtcgtctaattaggattgttacaactcatggatataaacagtaccacataccaataaaataaacaaaatagatctcagaatcaaaatatgaggaatgcaaaatatgtgccattactttgctagtgccgtctatttttcttgcgagaaccatttaatgatttttagtttggatatatatatactactagtagaaagaagtgattatgtaatagtagtatttgtagagagatgtgtaatgtagcatgtcgtgctcggcgcaccagtgagaaagtgatgggtaagcgaatcgattaattgtccccagctcgttgcagagtgttgcgtgggatttccaacagatgaggaccgtggctttcgtacgtttctgttaaaggatttttggagtatgcagatggagtgttcgaatacgatgagcatcccagtacttgggtacagacagactgtgcttaatttccagacaattactaattacaagctcctgctttcttacgtgtccttttctctcttgtccatggggaaaacacaggatcggaacaaacggatacaaccacaagccagtcttacgtatcccgaaccatgcatttcagagatagtataacagcttttcagtactcctccgtactgtctaatcaaacaagtagtttactgtgcaatgtgaatattttacctccgtttcctaatatatgacggtatatcaaacaaaaagaaagaaatgaagagagtatatatatatgatgggtttattattatgtaggagtagctgagtataatggtgtgtgacatgtttgagtgcagatggaggaaggatgcgagatggcgacggcggacgaggtggcgacggtggtgcaccagatcttcgcgtacgccggagcatgctgctgacgccgatgtacgggccggaaccaagagaagaagcaaacggtggaggagggaggcaaatgcaagcaaaacacatgcaacacagccagggataagtcaaattcgccgaggtgggcagcaggacggacgtacggcgatgagctagagagggtgagagagatgagagagattgcttgcttgctatggtagctagaagccgggaagggaccatacatggcaggtgggcccaagaccacggcagcagtggtcactcctggcagtctcaggctcatgccggcctactgctcgaggaagacctctactgtagcaagagggagagtgtaaaagtgcagagtagtgtgtagctcggggtaatcaaaagcaagctaagctaagcaaaagcaaccacacggaccgacctgttgttcatttgcacctttctcgccttgagcttgcttgcattgcatgagcgacgcgacgagatgttctcgacaggcgatcctatccttgtacgctctgtaaatactcctacacatacagtaggaagtagagtactctactgttgtaatcctggattccttgcatgcaaaactttctgcctggctggtgccctggctgtagttgtgtttctctttaggagtggcaggctttgcctcatctggtgctgtagtcactaggagtactagctaggtggagtactgtacgtggcagcgcagggccagggcctgggtggtggtcaacggcgatgccatcattgcggaagcttttgccccgattcggtttctgctgctcgcgcccagtggtaaaaatgctcgcaccggactaccggaggatattctgccatggccgtctcgtctagctagctcccctcccctcccgaaatcatcatcattcttcggcgtgccgccttggtggcgcacgcgcgcgcggtacaatcacccaaacccaaccgaagtctccacgccgaacctacggacacggcccgagagagacgcatgcagtggcaatcgtagttcaggcgggccgtgtgcgcaagacgagggagcaaagtacaggagagcatcagagagagacagggcgtacgcaatagcagtagtatcccatggcatcgcgtcggctattagtgccaaccagggccggtgcaacagtcgatccgtcactcgctcgccgacgccggccggccaccaacttcttcaccaatatgcccgcctcccctccgccttcgtccttgctctccttctctctcgcatgcagtcgcagaccatgtcgatcgcagcgcatctcgctgccaccgctgggcacgctccagtcgctcgaccatgcatgcatcgactccccgctgcaagctgctgctgcggcattatactggaccagtatcgccgattttgtgccggctgctgaaaagcgaaaaggtgatcgatacatcgcccgcgctcgtcaggctctcgcttatagccaatctaatagctcattcatacaatagttatatactacactattaatatatggtcccacctgtcatacgcacactgtgtcttagagtccgtgctatagctggctacaaatctatagtccgttgctcttctctctccttatttatctccttaaaatatgtttatagctggcttaaagcctgctattgtacctgcccttagctggctggctggcgcgattagagcaagtctaatagtatagccaactactggctccaattcatctatagctaatctaatagctcattcatacaatagctacatactacaatattaatacatggtcccacctgtcatacacactctgtgtcacctagtctcacctgtcatacacactatgcgtcttggagtccgtgctttagctggctacaaatctgtagcctactgctctcctctcttcctatttatttttttaaaatatgtttgtagctagcttatagcctgctattgtacttgctcttaccatgcagccaccaacacaccaatgctgcgaccaagcatcatgtgagtaatttgtgcagttttgcctgcgttggccgctcgaatcagcggcaatcagggagcgtctgcgactgcgacgacgacgcaagacgcatgcagcatcatgtgagtaatttgtgcgcagtacgctgtctgctctcattgctattgccgtggtacggaattgtccacacgttgttgcatcctcttgtttttttgcttgcaatcttgcatggacatgcaccgctcctacctcctacgaagcagcagcacaactctaatccagttactacagtggtatcaagattttagaacaagcaactgggctgggccaggagcccatcttgtcactccgtctctgcatatctgcctcttcatgtactggtgaactgagccttttcagtttcagaacctccctgttcttttatgcttaaatggaatgatggtgaacgcgtatacttcttgatcttcttttttttttaaaaaaaatacaatatatgaattccaaatgatttaaattcatttttcaactttataatagttaattaattcatttgtaccaatgaataattatcacaattcagctattcaggcatttagcgcatccactacactgcgtacaagatacacatgaagttcacagttacaatttagaaatgttttccaatgatatgtatatcaaaacttaaaaagtctagcagtgaatagttaacgcagaatgttcagaaatggtttgcatctgaaacaaacaacaggcatgcaattgggcaacaacaacaggaacagtaagatcttactcaggtttgacaagctgagctatgtgcacatgtggtgtatcatagggacttcacaagaaaaaatgtggaaactccaccaaataggtgcagcatgaaaaccatctacagtttggatgtaaatgattacagcttgtgaaaagtagatggtctgtttgctctcaaactgaccacggagggaaaaagattcaagcactaggaacaacatattgacgaacaaaaaggaagtaaaatctacaggtggccatcagtaaggtgattcatgggtgccagagaaacagactacaagagcaccttttccttcttctcaagtattggagggtcaacctcgattcccatattagcagcagtgcccgctataattctcatggccgagtcaatgctcttgcagttcaaatctggcaacttctcttgagctattgtacgtacttgatctgctgttacttttccaaccttctctcgctgcggttcttttgaacctttctcgatacctaagaataaggattggaggtgagaaatcatttgcttaagtatccaaagctcacaaaagagctacatgaacaatagaaaggataatcatagatgtaacaaggtcggttgtttgtaagcgattgtacgcagtcgtgtgcaatgcgttcatccttgcttttagtctgcagacatgcttgaactcgcaaacagcacagatattttgtgactaacgagtccatacaacttattcatctctctgatgtattcatattacaaacttcctcaccatattcatgaaacaagggaaatgacaaaccagagtaaaaatacatataatcgtaagcagagcaagttgcataaatatgtgtgcttaataacatctaaaaacttattggttaacttattttaattgatcaacaatccaatagataccatctagcgctactgatcatataccaaacacaaactagaaatatgcaagagtgaaaagcagtagtcatttgctatttttttaccttgttctcgctgtcctatggaaatgaagaactaaaatatggaaaatgcacatcagaatcaaaatgggcgaagcccacatgttgcattatctttcaattggctgaacaaggaagtaaagtgaataaataatgtactagtgattagcttttcagagaaaacttttttacgtctcatatgcacttcatttcacataagtgcaacattggtactaatgttatagcaaacatctaagtctaatgtatatgtcatggcaaactggcaacctgtgcagttcaccctatagattagtcaaacttttcggataaccatatctaacttgtgacatggaactttcaatccattcttctgcataatactccagaagaacataatattcttatagcattgggccacatggaatacaaaagcaaaaacattgacctagcagaagtgttttcattttattttgtccaaccgtataaacatatcgcaaattcaatacatggacgaaacaaaattatagattcatgctagctaaaagggtgcacacctgctgccttgaggagaaggactgaggcaggaggggtcttcaagataaaggtgaaacttttatcctgcaaaaaaccaggcaaacacacatataattaggagtacccacattagagatgcatgttcacacacattcagtggaattgacgattttaagctcacatcgaacacggtgatctcgacagggatgatgtagccggccttctcggccgtcttggcattgtactccttgcagaaggacatgatgttcacacccttggcaccaagcgcggggccgaccggcggcgccggcgtggccttcccggcctccagcgccagctttatgaggcccaccactgcacaacaaacaaagaacgcacgccgcgattcagccaacgcgagcgcaagcaaatccatggatgctgcagagcgagacacgaacctttcttgggcttgcccccgggcttgggtggcgccatggccctgacggcgagcgccctccgcgagggggcagcgagcggcggcggcgtcggccggaggaaggaggcgggggcgccgagaaaggaggaggagagcttggtggcggtgggggatgggacgccatgcagggacaaggaggtggtggccatggcggcgcgcttggagcggggcgagatgaggagatgaacggcgggagctttgctctctctgctcttccttccctatctactaatcctttcctcccttgagctggtaacagaaaaccttaatacgttttcctttgacagtagcgtaaattacgaaaatacgctttcctcgtccgggtgtgcctgtttttcgggccggacacgtgaaagtcttcctgggcctacgttcaaaacggcctattcatatggcccatgcggcccggctgccgtgcgtctccgttcaaacattcaactgccggccgctcaactctccaccacgtcggaggcgtcgactcatgtcaatttgtttacgtgtatttgtccccttttccttatcctcccggttttatattgttacttaaaaaaatacccgtgcgttacaacgggtgaaagctattttaattttattattgttgtatggtttagttaaggtgaaattcactttgagaataaaatcatgatctgcaattgtgattccgatcatctcaagttaatatgtaagttttttttaaaaaaatatttcttatacaactcctcctgtatttccaaaagcgaacgaatttaaaaccgattgaaatacatttatgtattttcaaaaccgaacaaacttaataaccgactcatacacggatgacgtaccaaaatatcgataaaaacatcttcaatttttataataatagagacaagtcgattgagtggttatatacgaacttatatatgtaaacactggatggctccatctttttttttatgcttatctttatcaactaaaatttgaatttttaactttaaatttaaagttgattttgaggttttttttcatcgaagtttattttctagtctttgtttttagattgttaagaacatgtatatcaaaactttattcataaattgtttttgtttgaaaatatgtcatttggtttatatcccgaatatatgaaaatttattcataaattatttttcatttaaaaatataccgtttggtttattttccgaataagcaaaacgacggaactccagtagtacaattgcgttgcaccgattgatttgattgattactcattccaacggctcgtt

SEQ ID NO: 19923 - DNA, 3554 bp, Oryza sativa
caccccctctcccaaacaccacctacacctacaaccgagtactacaaaccagttctcgactagatcaagaattcaagatgtgtctgtaggtgttgttctgaagagctccaagcagtgttcttggtcgaggtttctgctccagaacttcttgtagtactcgtcgtaggtgtagttccggtagacggccggggagccatcggtgatgagcttctgagctgggccgatgagcacgtcgttgcaggggcacaggaacgatgcgacggacatcctcgctttgtcagagttgacgacagcacggtgccacacgctcttgtatcttccgttgcttagcgcctgcaatatatggaagttacagaggttacaaattctgctgcagagcagaaccaacacttggaaaatatttactgaataaaaaaaatacagttcagtgctttgcagttcagatttcctgcaaatatttaactactctttgcaaagtataaaccatggcaattggcatccgatagaagaatcttcatttatctactcctagagaaaaatctctgtgtgcgacgtatcacggtatcgatatcttttagtactatactcaatccattatatctggctgtttagggcctcttcgattcataaaaatgatagaatctggccaagtattttcatataatttaaattcctatgaattttttcctacatgtccctttgattatagaaaagaaaggaaactttctataagattgtattacttgtttcatatttcttaggaaaaatagcaatgaagtaattttcttttgtttttcccataacactatcaaaagactcatattgtttttcctgtgttttttatattcatgtaagatttgagaagtgttactaccctaattcttgcggtttttctattcttgtgtttttcctgtcctgcaaatcaaaaaggggtccttattggtctttttctattatcacagttattataatgttggtcaacagctcgtcttttttttttctgcaacaagaagtgtttgtcctaggtgacccaactatattctgccgcactagcattgtctgccacctagcctgatcgtttaccaacaagctatacctgaacacacaacagcttcaattgccatggttaaggctgtgtttagttccacgctaaaattagaaatttgactaaaattggaagtttgaagaaaaaaagttaaaagtttatgtgtgtatgaaagttttgatgtgatggaaaagttggaagtttgaagaaaaagttgagaactaaacaagcactaagattttcagcaatgttatctgaacacctaacctagtccattatatactctgataaaagaaactgatatatgcatcacctgtagctgatcaccaatgttgatcaccagcgcgttgggctgtggattcacggcgatccacctgccttccttgagaacttgcaggccggccacctgctggtccatgaggaggatggtgagggcgttcgggtcggtgtgcgccggcagtccgaacgtcagctctggctccgggcacttggggtagaagttcaccgccatatgctgctcctgctcaccaagaaccttcttgatgtagtcctgttccaagcccaggctctcggatatcgctccgtacagtctgaatccgagctcccgaacttctttgcagtatgtgcttatgatctccctgcaccatcgtcaaagtaaattcatcttatggttaataatataaggattaacttaggagataatgcgtgattaattcccttgatcttttgtcctactggtcctaagttcgaccttgtttttggataaacaaaggataactttcggcctgagcgaagaatgcgcacaagtgcacaaccatatttatgtatatcaggatttgaaataaagtcatccaccatcacaccaacgagctccaatgagctcccattgaaatccccatccaagcactgatgagaagggaggtcctacgaaaccgacactagtggattcttagcaggtgaaatgatcccagcactaggcatggatgcacgtgaccacttcatcgtttctgatgttgggatcttcatgtgattgtgtacatgactgatgcgatgcgactttttcagtaggggaaaaatgtggttctcattgcattgtcttactagtagctccaaccttctttctgtttcctcgatcgatgtctgtgctaaaattgcctcttacagtatatgagtgcagagacataaaaggcattgctagcatgacaggtcaacctcactagttcatgttgttacaatatataaaaatgatttgtaatactacttatcccatcaataatttattttaaatctcatcttacctctaagaggctctaactacctcctgcctcaagttgtttcttgttacacaaggggcaccaaagtgtttcctcctcaactttaatctttgctatacaatctagaaatccttatattttaaaatggagagaacaattgtctactgtctccaatatcaaacaacaagtgtaataatatagccaattattagtttcaaaaagtggcacatcatctacagctaatctaatactctatccatacaatacttacacacaaatatatactacacacaccgtcttatagcccgtgctactgttagctacacatatgtaacacacttttcttctctatctcctctcttctcatctctgcttaacctacccataaatcttatttgccatgaaaatcactttcatataattatatttttaatgccagagtctcttcttctcaactttaatctccactaagaaacctagagatgctcataatttaaaactgagaaagtagttgtttactacctccgatctcaaatagcaagtataatagtatagccatctattattagcttcaaaaattggcacatcatctacagctaatctaatagtctatctatataatagttacacataaatatttactacacacgatgtcttataactcatgctatagctggctacaaatctataacaccgctattattctcatcttctatcatctctccacctaatcacaaatttgatgtggcaatttttgaagcccgctacttcaattattgcactaactcaaataaatagcattatagaatgcgtgcagtcaaaccttgaatcttaaatgattaattcatgcaaaaatactaaaatttaacatgagaaaatggtgttggtagatttggcatggaaatctcttttatataattatatttttaatcctttttaccgatagtagaaccaatctaaatcgtatatcttattctaatccaatagatcatatctatttctactaccaaccaactactagtagttgtagcgcccgttccgtcgtggcgcctagcgggaaaactatctcttaaaaactctatttgcgaaatctgtttctttgcttgttgcctagtgtccgtgccatctcagatctcaaatccccgatctatcgtcgagttcaatcccgaatccaaaccttcccaaatcgatccctccgcaaaagtttatttttcctccctcgggttcgatgggcc

SEQ ID NO: 19924 - DNA, 11177 bp, Oryza sativa
tattttccgctctgcccgcgcgccgcgcgcgcgtgcgcatgagccgcgccgagccgagccctccctctccgctccctcgatgatgcttcccgcgcgccgttgttcgcatgcacgcgcccgtgcggtcgccgcccgtgccgcgcctgcgccgtctgcgccgcgagtcagcacgcgtgcccgagccgcgccgctcaaatcgccgcgccgcccgttgcttcccgcgcgcgcgtgccgtggtggccgaccgcctggtcgccgctgccgtcagcctctgccgcgcctgtccgcgcctgccgtccgtgtcgccgctccgctccaaaccgccccgccgtcatcgccgtcgtcatcaacccgaccccgccactccgcgcgctagcttccaagggacggaggcagagcccctcctccctctgccgcgtcgcccccgctccctcctccttttcccaaagaggcaaggggcaagccccctttctctccctccttttcccttttttcctcccgccggcgtcatcctccctccgccctgtcgccgatttggccgctagccggagcgccagctcgctggcttgaccgtccaaagtcggttcccctctcccaaaccgtcattgccatcctataaagcccaggcgccctccctctcttctcctctcgttgtcccatcgcctccactccattgtcgccgcctcccgtgctctgttcgccgtcgccgtttgtcgtcgcgcgtgtcggaggagccggcacgagcgaggacgcggaaggggactccgggcgcgccctcttcttcctcttccccggcccgaggccggagagatcactcccgtgccgtcggcccatcgtcactgcgccccgtcccgcacggtagcgcatctccctattctccctcctcgttccatccccttcccttagactcgggtagtagcacgagtagcctccccgtagctagctggcgccgccccgactgctgccgtcgctcgccgtgtgctcgccgccgtcgccgcccgagctcggaagcgcctctcgtcgccggcctccctcgatgcgttcctcctaatccggcgcaagggacggattcccgtagccgcgtagatgctctcgccgccgggaatcggcccctcgtgacctcgtcgccgtttccctcttccctccccgccggttgccgccgccgcaatccgccgccgacgcactccctccggcgaatccaagccgttggctcgtctcccctcgtctcgtgcaaccacccggtgtgctcgctttcgcctgtatcgccgtggttcgctccgccgcccgccgctgtcgtccgccgtccgttccggccggcgtcgtcgtctacctcccgccggcccgcgtggctgccacttaggcgccatgtcggcgccacctcggccgcgaccggatcggctgacccggccagccgctccctccgttccccccccgtgcgcatggtccgcggtgagccgtgaggctgcgcgtgggcccgccgcaccgcatcttccgcgaaccgcgcgcgtgcaccgcgtccctcccccaaaccctagcgcgcgccgcgtgcgcgttccgcacggtgaaccgtgtcaccgacaagcgggtcccacccgggaccacgcgggatggacccggcccaccggctctctctcccctccccgcccgcgcgcgcgctttgggccgccttcttgggccggccggcccatttagctcggccgagccgccccttttctctcgggccgcgccctagccgcccgagggaagtctacttcccctccctcttccttttctttttcaaaaaggatttaaataaatcctttttcctttagaccaaaaatccaataatcttagaaattcaatatcttcccaaccgtaaatccgtttgactccgttcaacttccaaaattcctcaaatctcgagatctatctaatggcacgcttagaggtcattaatagggctttattttcgccgtttgttgagttgtcccgttttgcgtgtagtttcggagcccgaagacccgcagtgcgaggatttcgaggatcaagctcaagatctcgagcaaggcaagccacctttgaacatcttgagcctatatctgaacttaattatgttgcttgaaaaaaatattatgcattgataggatcgcacttaatttgcttgtcccgtctgcaaggcagattggcgaacctacctaatttgttgcatctgatccttcctttgttaattgttataccatgttcccttgtaaccatctagttgcgcctcgatattcgtgcactctatgcgagtatcgacggtcgccttcaaacttaaaatctgagtaacttcttgggtaaaacttgggttttacaaaagacttggaaaacccgacacctgggtcggtgcttgcgaactaaatgaatttccaaaaccacggaccggggaacgtaccgggtgtacggtttcccgctcttgcacttaaggaccgtttccttggaatttcatccgaacataagacaagtacgaccacatgggtggaatgggacacccctggctgagtaactagtttatcaggggagccttgatgccgagagacatgtggattcgccggggtggtgtcggggaggacccctgggcttcctggcacagtatggtctgggacctaacctgttgttggtctgggacccctctcgtcggcatatggtaaacctgtgtcggctttggaaatgccttgtcatgaaagcttggagatctcccgacgtggctgatccccacgggttgggtgatccgggttagtaatgtcgtgtgggtaaagtgtaccccctctgcagaggttaacaaactgttcgaacagccgtgcccatggtcatgggcggatgtgaggtgattcctagcgtagttttgtttgactactgccttgtgaaattgctgttgtgaaaaggggaatcgatgtttggaaaatctgcagctgatgggatcagctaggcccgggtggccgtttgaaagttgttggcccgggtggccgtttgaaagttgatggccaggtgccaatcttgaacaattctaaagactgatacattgcacatactccgaccggacgagacgcactgtctcatccgtgtcgtttgagaagcactcacttagttgttttcagaaaagagttcaaataaaatcaattgcaaaaacaacagcctttccttgaagcctgcattaaacacttatttcccatggcttgctgagtactcccgtactcacccttgctctatataaataatcccccccagttgctgaagaagatgaagcggatcccgctgacgaggagttcttccaggagcaaaccggctacgatgagttttagggtttcggcctaattcccaagtcgcgcctgtgttgtttggtccaagtcttggcttccgtttccctttttgcaatgcagttgtgagcttgggatctgtccgcagcccaacatgactgtacctctactctataataaagagacctttgttgctgtgatattctgtcttcctgtgataccagcactgtttcctgggactggtatcgattaacaggttaatttggagcgtcacgggctagttccggtcgggactagttcggggcgtgacagtagtataataattgtttctactcataatagaactcataaatcaatggttaaaatcaattctaaggctgtgttctataatacaccttttcaacttccattccctcatttttcatgtgcaagctttctaaactgctaaaccatacgtttttttaaaaaaatctaatatagaaaagttcttttaaaaatcatattaatccacttatcaagtttttagctaatgctttattaattatgtgctaatccgttcctccattttacgtgccaggagaaaggttcccaacccccaaacaaacacagcctatggtgataatgccaatattagaatactaattagtaaggatcaccgtcatggtacttatttttaatagtttttatgaaaataaaattagaaaaggtagtgataaaatatgtacattaaagattatcgatgtctaacaataagtaaaagaaaacggagacaatattttgttcattctactgcaagctaatgagtaatgaaacatgataaacgtggagccgtggtttgttggagtattggataggagtacttcctccatcaaaaaaaactaaacattgaagaggagggtacaatgaatctgtgataactctttgttatctttcatgaaagcaaaaggtctgtttgtcccggaatttgtttagaatggagccctgtctctctggcacatggtagccacagcccacagctagagtcgttcaggttcagagtggttttttttccccaagaactgttcagagtggttagcctggcattttcaaaccacctcgaaacacatcgttcagtatcacgcaaggagcgaaaaagattggtcaagtactatagttcttttctgtccgtggggtatggaccaaacttgaaaatggcaacgttttactttggtttccaaggattaaacattttattttaagaaactccgtttccctaaggaaaaaaaaagcaacgctgaaacatgtggggacttggaattaacatctgtgtgcatgagttgtgagttgtgaatgggaaaggtaaccacttgtaattgtgggcgtgtttagatctctaatttttcttttgccaaaaatatcacatcaaatgtctggacacatgtatagagcattaaatgtggacgaaaaaaacaattgcacagtttgcatgtaaattacgagatgaatcttttgagcctaattgcgttatgatttgacgatgtgatgctacattaaatatttattaatgacagattaattaggcttaataaatttatctaacagtttacaggcggaatttgtaatttgttttgtatacttaaaaaaaattgtgtaaagaactagacacggcctgcatggagtaatttcaccagccgtccaagctagctattcgtctgtcctgttgtttctttcaataccaaagcgaagatggagcagtgatgactgacttgcagagtcttttgagatgagcaagaaatggtctttggagtacttggaataggagtagtagagaaggcaggaaaagtggagtaacctgaaggaaggggggttggatggccaatcagggaggtagcggtgaagcgggtagcagtggaggcggaggtagtcgcgccagttgtgcacggtctccttgcggacgttgaagctggtggagaggcggatcttcttggccgggtcgtcggagtagagcttggccttctcctccgccggcagccggaagaagtcgtgcgccaccgccagcaccgacagtgtcagctccactggcaccccatggttgagcacctgatcaactccatcgatcgattgcatgcaacagcaacatccaacatgtgtgagacctgcttatacgagatggacgatgtagtaacgtaggtagtagtgctagtgatttattatacctggaagaagccgtgggagcggcaggcggcgccgacctgggagacgagcttggcgcggtcggggttggcgaggtcgacgacggggatggaggcgtcggagagcacgtcggcgaggcgcgggcgctgcgcctcggggcgcacgtagttgcccggcagcgtgtcgtggtctgccgtggagatgagctggtccgccatgccgcggtacacacacacaacttggcacgcaccacaccacggggggattactactataaataggcgcgacgcggcgccagcggagaagcgtagtcaggcggggagaggaagtcgagtcaggtggcggggggagaggggccggatgggtcgtcagcgatggggctgggcgtaacgtcatcgcggtggtgtagtataaggccctgtttagatgagactaaaacttttaagtccctatcacatcggatgtttgaaaattaattataaatattaaacgtagactattaataaaacccatccataatcttggactaatttgcgagatgaatctaatgagcctaattaatccatgattagcctatgtgatgctacagtaagcattctctaattatagattaattaggcttaaaaaatttgtctcgtgaattagcttttatttatgtaattagttttgtaagtagtctatatttaatactctaaattagtgtctaaagacagttaagtccctgatctaaacaccaccttactccaacgctacggcgacagccaatgctagcacgagttgtgtactcgtgttgcggtgtttgttttttattttctttttgccgcgtgcgagagtgggagcgacgcagtgtgtggttcggaatccgtgtggttcgatctctgtcacccactcacatcagtctccctccacatcgagcctgcaaaagataaaaaataaaagtataacctgagctttggtaggcaccgtcagcctcttattgtctccttgttgttctattaaccacgattgaaatttaaaatttagatccagtttgaatggagaaatattgttaattctatcagcaacgtaaaatcggattagacacatcttattaacgattacgaatttgaataaccaatctattcctagattattatataggggttgtttagatcaaatggtgtaaagttttggcgtgtcacatcagatattatatactatataggatgtcgcatagagtgttcgggtactaattaaaaaactaattacagaatccgtcggtaaaccgcgagacgaatttattaagtctaattaatatgtcattagcaaatgtttactggagcaccacattgtcaaattatagagcaattaggcttaaaagattcgtctcgcaaattagtcacaatctgttagttggagtatttttttagcctatatttaatactttatgtaggagttcaaacgttcgatgtgacatagtgtaaaattttagggtggaaactaaacatgcctataatagactccataagaaagcatttcacttctctctctcttcttttgttctagaggagccagctagtctctcgaggcggcgtcaatgcatccagttgaggccctgtttagttcccacgtaaaaactttttacactgtcacattaaatgtttggacacatacatgtagtgttaaatgtagaaaaaaacaattacacaaattgtgtgcgagacgaatcttttaagcctaattgcgtcatgatttgacaatgtaatgctacagtaaacatttgctagtgacaaattaattaggtttaataaattcgtctcgcagttttcaaacgaaatttataatttgttttgttattaaataatgtttaatattttaagtgtgtgtccgtatattcgacgtgacacgtaagactaattttttttccaactaaacagggcctgagctcgcttggggcattgtacgttgtctactgatattaatggctgagcaatgaaccaagtcaaacatataagtagagtagcactgatactgattactgaaacaagtcaaatacgagtactatacagtacgtattgaacgactaatcttatcttcgctggatattgggcgtactgggcggcgcattagaagtgagttataagcctactttaagattatatggaggagagaggtaaacaaaagagaagggtattggctctcatgcaagagctagtttaacacaagctccaagacaaatacattaaatgcataagtgagagatagagatagaagaagaaaattatagctaatctattatagcacccgcaatggtaaagtaaggtgctatctataaaacatgtacatctcagcaatagactcgattaatagtaaaccaccttaatagtatgtctacattggtatctatagctctctcatgcattgtctcgtttttctctatagactatctctaagttagtagatagctttgctctctctcttcatttaatacattccaagtaggaaaatatgctgacatggatctcttgtagagagcctatagataatcattgtgggtgcccttatatgtattgattttaggatgggctaataggaggaagtgggctatattattatctttgctcttatttgtttgttttgtttggccccttcttttttctgtgggcgcagcattcaagcgtttctcgcgcagaaaacagagcgcggttcatggttcggttgcatttcccggtgagattgtgactgaatacaagccgtaggttcagcttaaagtcaggcggcagtgccgtgactgccgtcacgtagcggcgtgtgcagatgaaattaatccctgctcagcgtgtaccagttcctcctcttgacgccgtcgggagcgtttttttcttctgtacgtcaaagcggcggcgttcaaatttatagtcgactcaccttcgtcatctattttttgaacagtcgtcgatcggactaaaacgaattaattatagtggctgtgcttagaacttggatcaaaggccacatatatcttatccgcatagtcatttttgtgaatttagttgcactttaacactactaattaattatagcgtttaccagaatagtctggttcaattcaacttaagaaggttgttttttttgaacacacaacagacccgcgcatcgatatattaaacgaaaacaaacaagttacaactgaccatctactagaagcagggccaaaagttctactccagcttaaaagattacggtaaagcttaaaagacgctactaagcaaacgggctccagctcaaagggtcgggaagagaggctgaatcacgaagagacgagggtgaccaacaggaagccgagctgctgctgtccccttgctgcacccctacatctatctagaggcggccttctttgcaagacagactgcagtaatgtcagcacggaggtcaagacttcgtcgaacactctagtgttccagcacccgtaatagtaaagtaatgtgctttttataaaacatgtacatctcagcaatagattagattaatagtaaaccacctcaatagtatgtctatatgagtatctatagctctctaatgcattgcctcgtttttctctatagattatctccaggttagtaaatagctttgctctctctcttcatttaatcttttctaagtagaaaaatatgctgacatggatctcttgtatagaggctatagataaccattgtgggtgcccttatagagatgccacgccaccaggatgatgagcaagtcaaagacacgtctccgcaccttgggtagaatgttcttagaccatccgcaatgggtgtccctggggcgtagccctgggaacgaccgttcccctcccgttagctttttcagccggaccgtcttctctgccagacgcgcgcctcctcgctggggtcgcgttcctcacaagctttttttctgagacaccgagccggaagacgcattgcagagggcgtggctaggtgagtgtcccatgaacaccgctcccgccccacattttgtcgttccacccctcaccctcgtcattgggagtaggcaacgaccggcgacgaccccgcgacagcgacggcagaggaagaggggtggaggcgtggcacgcgacctccggcggcgacgatgggtccgcgacggcgactactagatctgcgcgccgtgcccaccaccgccggcgcgcagagacgggcggtagccgaagggcagcggagggagcagcgacgagagagatggagggaggcggcccttctcattgcctcgtggccgctggcgatgagagagagaggcgagcggcaacggggagagaggagggaggtggcggcggcaggctgggagtcggcagcgacaagatgggcgatgaggagggcgaaaagaagaagcgagaagagaggcggaagaaaagaggggtatttggggatttttcatctggggctactttaggctaaaacacctattgtgggctgtagtaccctcaccggattgctttagattttgaggaacctatcaaaggtttgatggtatctttcattgcgaactgagtttctctactagtgttctcagttaataagaacactttagtagtggctcacatcatagatgcccttatatttggccactactctacgagacttactggctagttgggactgcaacctgaagactggtggcaagcagcaatttccgccgctagagatgccacaaatatgcacaggaaagcaagatgtggtttgtcatctccgactcccgagtcacacaacggacacgttgagtggcatccatgtctctgtcagtaagctggtccgctgtccagcatcggccgcgcgtggaaggcaaatcagatgaaaaacttgcattttcaccgacgttcaaggtcaccaaagctgctttcaacatgagaaggtttgactgcaagaaagttgatttaattgcttgcttatgactcaaatctattggctgtgcttatgtcggctccatctagataaatggacagttttattcacttacatattaacacagggattttcttgtagtgtgtcgtgtacattctagtacatatttacaaatactacctccgttatataatataattttttttatataattatgtgacagatgtagtaaatagataggtatggatcaaggttgatcgtgatgtctttttcatgcatggctggcaagccaatttgactccgagatatataaccttatcccggaacaagtgatgtgcatctactcgtttgggatttcgtgaagacaacgcatcacagctagccgtgacaacttgataaactccctccatccatattccttttacgtaaaattatttttgagcttttgtagattcgacctacgtatttgactcccaagcaaagcctctctattcgattcttatgttttatatacgtgttcaatgagagaattggatgatcatttgcatgaacatgcacgcaaacccgatcgaggtcctgcactgcatgcgaaagtttgcaagttctcatgcccgataggacggtggcggatggtggtgggaacggctgagatttttgccggccggatgcggggacaacgacagcaactcctcctcatccacctgcgatgggatagcagcaaacgctgctgtgtgctgtgtggggacgagaaggaaatggctgcagcgcggtgaccaggtgcggtggtgttcgtagctgcccctttctcgatctcctcatgcttagccagggggggggggggggggggggg

SEQ ID NO: 19925 - DNA, 5526 bp, Oryza sativa
tggtgatcgcacgccatgaaactccaagctacaggtgtttataatattttcattatctcgattctcttgagctacgcacgcagacggagcaagttactaacactgatggggactgtggagtagtttgatcactgctgcactgtacgcaataccacgcatattgcaatcggctattctcaccacaaaataaactcaaccggtatacttatgcagaatactccggattatttttttcctttaaaaaaagatacgaacatgtaaaagaattacatatcaattatattagaagaaaacataatttttgatatactaacacaatcagcccaacagatctatgcctcgagacgagaagaaaatagaaaaaaatctgttaggagaaaagactactacaaaactctgctccaataaaacgggaaggtcgttacggagccgggctacaatcccaaaagaccacatttacgaaaattcatataatgattgtttttaacagcgggctataagtcgtatatatggttctcttcagttaaacctgaatatagaacctccgaaatcaacgtccgatgttgtgtcgatcggatgcctggagtataatcgcggtgttctattttttggacctgtaagctgattacaaaataatgttaatagtacgaaacaatgttatacttgtatatgattgtatatgattgcttcttgattaagatatgcatgatcatgctccatattaatattagtatggagtaagggcccgtttagtcccccaaaattttttcccagaaacagcacatcgaatctttagacatatgcatgaagcattaaatatagataaaaaagaaaaactaattgcacagttataggggaaatcgcgagacgaatcttttaagcctaattagtccgtgattaaccataaatgctatagtaacccacatgtgctaatgacggcttaattagtctcagaagattcgtctcgtggtttccagacgagttctgaaattagttttttcattcgtgtccgaaaactccttccgacatccggtcaaacgttcgatgtgacacccaaaacttttcttttccccaactaaacacacactaattgcttcctcgccgtctgtatagtactactcaaataatcaccgctacaatcgctgtcttgcatcattgatttgattaattagctgattccctgaagagagagaagctagatatacgtggtcttacgtaacaccgattgcgtcacccgtgccgtatactccctccgtcaaaaaaaaaaaacctgttttccgtgtccaacgtatgatcgtctgtcttatttaaaaaaattataaaaaatattaaaaagacaagtcacgtataaaatattaatcatgttttatcatctaacaacaatgaaaatacgaattataaaaaaaaattatataagacagacaatcaaagttgaacatagaaatccagagtttgcctttttttaattacagagggagtacatactacttcgtacttttttttagagagagaaactactctatgtactgtgtgtaccgtgtacgctactgtactgcggttgggatctgccgagtgatcgatctgctcatctgatccagtccagtcctacagctccttgattgttttctttgaaaggatgtgcaccttgattttttttttccccaaaacactacggacgacatagtgacatactagcacacttatctgcacgaaaacacattctcataactatgcacgttcgagaattagaccgggaatgctccatatttatttttcgaaccaacgtatttgtactaaacatccctatctttacgcatatgtgcacattcgaaaaaattgcaccagcatattttaagattagcaaaatcactacgctgcgtacttgcgtctcactgtcaaagttgttagtatcccgattcgtattctaatatcatatgtacgatactatgatcctaccaaaccgaaacaatattgatccacctagtatcttaatttttatagtaacccgatcttactattcattttcacacgatcatatgaaatcttagatagtattttgatactacgatccctacgatcacactatatgttatttaaaattaaatgaattgaaaataatataaataaatatgctcaagtttacataaaaatcaattaaatttatcaaaatcaatattacgcacgaaaaacaaaggagaaaattttgaaaaaaaagcttataatagatttgcggcttggaagtaaccctcgttgatctgtgtatgtgcgttaggcaggtcaaataaatgtagaaaaatgacttttctccttaattttaatctcaatactcatggtgatttttggcagccggcagctaaccattgatcataacaatagcaataaaaattccctccgttctaaagtagttttatttattttatttatcccaaacataccaataaaaactactccctccgtcccagaatataagaagttttagtgttggacatgcttattaagaaagtaagtagaagtgagtggtggagggttgtgattggatgagtagtggaggtaggtggaaaaatgaatggtggagggttgtgattggttgtgaagagaatgttagtggagaagttgttatattttgggacaaatcctgagagttaaaagttgttatattttaaaacagagggagtaataattaaaatactcaactttatgaaatttcgatacagttattcttttctttgtatacttccaatgcatttatatccaaatttcacaaacttcgatataataattgtttgagaaagaacttattttagaacaaatcgtaaaagggttaaaaacaaacttatttaagatgaaggtatttaggtggtgtttggatggagggactaaagtggggctaaactttagtccctctcacaaaaacataagtccctagttatatttttgtgagagggactaaatttagtctctagttatcaaacacccccttaagatggagctagtactctgcatgacggccatgtgctagtttatctctcgccacgggagtttgtgggccatatgctacgtagatgttgggccatcttcgtgggctcaggctccaccagcacgtccgctcacggcgcatgggatgcacgcggcgccgtttgttcccccacactcccgtgggccgcatactacccaggacggtggcgcgttgggccgtatcgtccccaagcccatcacggcttttgccctacatcgcctcgatcgcgtttgggcccgctagtccatgctagtatacgcgacagcgacgtgtacgtacgtctccaacgcgaatacaacacctccacgtggcgtacttgcatgtgaggcagtcttcaacgtatgtttccctgtcaaaattctaccgattcctgcggtttcctgcatcctttttgcctctaattgcgtgtgaccactagcttttcgcctatgttcccttccgtgcctccgcgtgacacgagctgtttgagcagcagtgtatatcaactgaacatcgaataaatactacttcatccgtttcataatataagttattctagcatttttcacattcatattgattatatatatatatatatatatatgtgtgtatgtgaaacggagggagtaatgatttattactaccatatatactgaatttttttgagaattaatattatttttatggaaaatcgcaaaagtagtggtcaaccggggaaaatcgcgaaaataggtccctgtcgaacgggtgcagttcgataggccgcctatcgaacggccagagcgcgactggcgacgagatcggaaggctgccgttcgacaggacctgtcgaacagcccccgttcgacaggcagggctgtcgaacagcccccgttcgacagggtcgcgttctccatttatttgtaataagttattttttttaataatatgtaatttattttagtgtgtaagaaaggaaaatatttttgtaatgttatatgtatgtgatttagggttttgataatgtttggtcagaaattgtagtatttatttgttggttaaaatatttgaattatttagtttcattatttgtatatttgaatgataatttgtcatgattcattcgaagggtatgctactgagtaattatccgaagaagtttatgaaatagtcctgatagtactaagttaatcgtaaagtgtttctcaaatagtacggacagaacataaatgactaaaagtttaatacaaatagataagtcaaggacgatcagtgcccttcgcacgcttgctaggtcctcccttcttcctacgcctaatctgctcagtgggatatgtcaaattatcaggggggtgcctatctctagctgcctgctgtggtgtcacgtctggcccctgaccggcctccgtctcctgcgtcggctgtgtgacctgaggtgctgcgtgccagtaatccatccctacttccccctggggaggatcagtgaaaaagaagtcctcaatgaatgctgtgcgaggggagtaagcaggcactccgtgatgcgtcgacgccgaaccgtactcatcgtctgtttgtacaagagggagaaaccaaaaaatatggcgtagttagtaacgatacatataattagaaactaaagcgtgttattgtttaaaatgacttacatgtatgctgtgtgtggccctgctctggcgcacgcggagtgatatgaagtccccatactggtgtgttcaacacgttgtcccccgttggcatgtaagggaagtgtgccgacccagaagctccctgcgaggggtgaacataaggcggagtttggaatacctgcggacgtggtggtgccgtgctcgacgtgggtacccctgatccggctgaccccctggtgtactccggtgctggggtgtgctgaaaggaaggacgaccgtgagatgtgtgggccgcttcgtacccgcgacgtgaagaggatggaccactccgatccacgctggaacgtcggggtagtggtggtgatggccgttgtaacgccccgattttcgttcgggaataaaaatcaattaataatacattttctagaaattaaataaaagttaaatcaatttaatcaagtgaaataatgggagaattaaaattttcccttaaaaatcattggccgggaatattttgcaatattctttgtgccctaaaatactctccggaattttccgtgaattttcggagctcaagaagtaattttaatggcacaaagttcatcgaatcaattaaataaaaaaagaaaacaaaataaaaactccccttcctccttgggccattttcggcccaagaatccttcccctcccgcggcccgcgccctctctctccctctcccggccggcctccctccccatctcttgggccgtcggcccgtttcctctctccctcgtgaagtctgttttacgtcccccatccagctctccctccctctctccccgacaggtgggacccgtggaccccacctgtcatccctttcctccagctccaactgccgccatggccgcccgagccgccccacaacgccg

SEQ ID NO: 19926 - DNA, 4990 bp, Oryza sativa
ccccttgccgctttccccttgcggccgcggcgtcatgtttcggcggagccgggttcatgcggtgcccgtgccccagccgccccgcctcgtggccgtccgatcggctttgggccgatccgggccgtcggttcccgtggaccggcggtggaccgcctcggtggtcccggtccacggtggaccggcgcccttgtgccgctgaccggtggggcccgcttgccggcgccgcccctcccccttgatgacgtcagcgaggtccatttcctttgtaaaaataaataataattgcgcaataaatcgagtttaattctagaaattcattaaaatggctcaaaacttctaaaattcatatctaattcattcgaactccgaattgagccattcaacttgcaaaattcatctaaaattgagctctacatgtttgtttagtttttatgtactgtttccttggtttttattagagtttttcctcgttttgcgtgccagcgtgtagtttccgtcgtttcggaagatcgcggtcgcgaggaaaagagttcggaaaatccaagtgaagaagcaaggcaagtcacacattccccttgagcatgttgatcccaatttataaatgttttaccgtttgcaaataaacatgcatgtcttgctaattacatgggaatagggtttacctatctgctcgcttgtgccatgtttacttgatatctgttctttgtcaaccttgggtaataaattgactagctcatgttacttatgtgacctagctagaactatatgcttagccatgcttaattaccactagctcagtcgatgggataattgcagtattagacattctagtatcttgttgagccgcgtgctcgagacatctggccatgttttatggtcgtaattatccaactaaaatgcgactgaatggtgggctgtgggtgcatggttttgtgagtcgcacccatggcaattaaggaccggttcacgggaaaccctggaagacttacagcgcttgccacaagcgggaatgggtaactgcttgatctgaagtatagctcgaccctttcctaggcaccggtggcgagggtgggcgtgatggagttgggtcggctggggtgtccggttgtccagctgccggattcaccgcggcgcaagaggggaccgcccactgccttttgaggggtgggggtgaaaccttagcgtggtgtggatggttaggggagggttatgcgaagggtctcgtcacaatcactcgacatggtgacgtgtgcatcatgggcacatgatgacgcggtgacatgtcggtgggttgtgtcttgtgggtacagttgtgcacctctggccagagtaaaactattcgaatagccgtgcccgcggttatgggcgatcgaccagattcaccgtgattagtctcacacttaataaatcgacccaatgcactgtagtacaggtgggttggttgggcctgttcaacgtggtgtagcgttgatcagtggagattttaatgttactttaattactcaacagttttactgttttgctcaataaaatgttttacaaccgcctttatgcaaatagccacaaaccgtccttgtgttccccttgcacgtctgcatcgttggtgtggcttgctgagtacggtggttgtactcagtcttgctattattcccccttttcagaagtgtagtgcttctgagctgaagatggagttagaggaccaaggctcagaccccagttgagttttgcctgtggagtggagctgaagccccgctaggatcgcctttttccgctgctgctgcttttgtttcggtgtgaggactaagtgcctcttctgtaagtattttacgctttatttacgtttggaactgtttattacttgtcgttttgtgtaccctggctggtcctggacagggatttaatacacaaaatagtctggaaatttgggctaaatttctgggcgcgacagccgtcggcccgacgtctgcaccacatctgccgcgctccgacaggagacacgacgtagtagtgcggcagcacgtgcacggaagttgcgaaggacactcgccacgtcgtcagacctgacgactggaggtctcgcctctagtctttgcagcagggtgtcggactccacgtgaacgtgctcaacaaattccgcctgttccacaaataatcaaggcaattaaaattatttaaccagttgcacatttattaagagtatttaacaagatgcacatttgttagaaataatgaaccagttgcacatcatttataaatactgaactagttccacatttatgtaagaaaaggaactaggtgaaccaattgcacatttattagacatactgaactacttgctaactttttaaaaatattgaactagttgctcaaattccacaaataaacacgtaccattgacttgtaagctgatctaggctgaggggcaaacgtgtcagtaatcgctgcctggtgggggacggtgctacttctcgtttgtaggatggtataaagcaccgtaccactcgtagatatacatctgcgggtacgcaatcgaagagtaatgctccataataactcccatcgtctggaggtgtctgaagtgccaagttatcagctgcgtgctcccactcttgtaccgtcggctgaaccgtggtcacaataactagctcgtaggaaagcccgagcccctttctgaagtacctgcacaacaacaaattcacacatcagaaaaaatgttgtgcagtgatttattttaaaaaatgtaggattaaacaactgtgatgtgaactaacctatgaagactatctgccaaaggacgaccatctctcggagggaagtcctgatacatgcccaactgtttgagaaccctgtggacattgtgtggctcgacgtgcacgtccagcacgaggtgacaagtcgtcctccagagttgcatatctcgcgtgcaaagatccgcgagaccgtgcggtgcacgatcattgacatcgtgctgagtgtagggagtccaccgaacacggtcaggcgtaagctgatcaaagtcagctacaaactgagtgtagacacgacgtgtcgtcccgctaacccactgcggctgtaacaagtagtagttttcattagtcatataaggaaagtttgtgaactagtattcataatgataacataaacgaatttaacaaaaattacctcacggtgtgtccacaaggatcccatagtgggacgatcgtcgatgtcatcaacaccagacctgtacatctctcgcaaaccgtagtttgcgtacgagtcaagctgaggcctcccaatgtcgaagcgctcgtgcgcccacaacataagtagcaacgggcatccagggagtgaactttgcttgctggttcctcacgcaagcatcacacagtccggcatatgtcgccgcaagtaccgccgacccccaactgtactgtggaatctccgcgataggtaactctgcaatctgctccgcaaagtggatgaagtgcttgtccacggagtcagcgtgagttcccgtgaacatcacccatccaaacaaccacaacaggtaagcgcttaagtgccgctgcacgatccactcctcctggtcatcagggaagacatcctgtcgaaactgattcaaccaacttttcgtaggcccgtgcccatctgtgagatcctccagtgcaacaggcagcacaccaccaaaactggccagaaggtcatccgcccatccagcattcaccattgttgggccaactgctggcccagctatcggcagccccaacaaataagacacatcctgcagagtgggcaccatctctccaactgtgaggtggaaagtgtgggtctcaggcctccatctatcgacaagagcactcataagcgccgcgtcaatgtggattcgttcggaccttgcacgtgaaggctcgaccaaccgtgcaaacgtcaacaacccagctgctctcagcctacaacatgacagagcgcaagttattaatacatgaaaatataaacaccttgtattagtaaaaacaatatattttcacacaccttggaacccaacgaggatcaatacgccaatattgatccggtcctcgcatctttagcacattgcagaaagttcctgtagtaagacgtcgcgatcgatggttcctatcgatctccttgtctatcagctgcccatcattttgatcagccatacctacagatcgaaaaccacattagtacattgcacgtatggtaacagtgcaataaatgtatgcaacataattcaattaacaaatttgcatgccatttcaatttaaaattacagtaccagcacacatagatacagataagaatagttcagtacatttcaatttaaaattacaagcccacgacacatatattacgatattacaagtgcagtgcagttcgaaatttaaattacaattccaatacaaatacatgacgatattaaaagtgcagtgcagttcaaaatgaaaattacaaggccattacaaatagattcgggtaataaaagtgcaagaaagttcaaattaaaattacagacgcactaaacataaattgaacgataacgatcttcaaagtagggagtccaccaaggatagtagcgaactaaggattatttttcttcttcgacttcccctttggaacgcgacgaacatcagcgcctgtggcatcatgccctacattgtacatgctgcaatctttacgggaatggttctccccgcaaagaatgcaagctttcttacgacgagaacgatctttcactttagcttcatccataaggttcttgatcctgcgtgactggcgacgacccttagtatcaactaataaatttgagtcaggaacccaattggcttgtcctggaggaggacgagtgaaatcacacacggcacgccaaccacgcaattcaccacgccaagttgcctcccacgattcctttctaaagtagggagaaacaaaaatgtttccatcaacacccccttttgcggaagcagcaagaacatgggaacatggccga

SEQ ID NO: 19927 - DNA, 21425 bp, Oryza sativa
  unsure (1)..(21425): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnngaggtctcccgacgtggctgatccccacgggctgggtgacccgggttagtaatgtcgtgtgggtaaaatgtaccccctctgcagaggtcattaaactgttcgaacagccgtgcccacggtcatgggcggatgtgaggtgattcctagcgtagttttgtttgactactgcttgtgaaattgctgttgtgaaactgggttcgatgtttggaaaacctacagctgatgggatcagctaggcccgggtggcagtttaaaagttgttggcccgggtggccgtttgaaaagagttggcccgggtggccgttcaaaaagcttttggccgggtgccaaccttgtttcaagatctaaagactgacacattgcacatactccgaccggacgagacgcactgtctcatccgtgtcgtttgagaagcactcacttagttgcttttagaaaagagttccaaataaaatcaattgcaaaaaaaaaaaacaacagcctttccttgaagcctgcattaaacacttatttcccctggcttgctgagtactcccgtactcacccttgctctatataaatatttccccccccccccagttgctgaagaagatgaagcggatcctgctgataaggagttcttccaggagcaagccggctacgatgagttttagggtttcagcctagttcccaagtcgcgcctgtgattgtttggtccaagtcctggcttccgctttccttttgtaatgcagttgtgagctcgggatctgtccgcagcccaacatgactgtacttctactctataatgaagagacttctgttgctgtgatattctgtctccctgtgataccagcactgtttcctgggactggtatcgattaacaggttaatttggagcgtcacgggttagttccggtcgggactaattcggggcgtgacacttctgctttctcttagattcataagccaggggtccgctgaagatgtgattgagttctttgcgatgatcttgaaaaccagtcggggcatcgtcttcatcatctttcttctttgatgtgccttgatctccgtccgagggcttacgcgcattcttgacatattgctccgcaaacgcacgcatatgcaaccatcgatctctaacactgtcgaaacaagatttcagcaatagtaaaagggggtggctatcaagttaggaaagcggatgggtttggagacgaagaattttatacaggttcaggccttcttattcaagaagtaataccctactcctgtccggggattattccgcgagtgtgttattgattgtataaactggaaaaaagaatcgtgccccgagaggcacacggaccctccttatataggggaaggaatccgctttacaaagtacagtccatatcctaacggaatatgggattatagataaaatacaatcgtaaccgactaagatcccggatatttccttgacatacaagtttagaatctaacccaagtcctcatagagatattctaccaagtcctcatagagatattctatttatatttggtaccatatatccgactaaattataactgtcatgtagatatagggtatccataatctccacaaacacgaacgtcttgacccaaaccctaaaaatcgatgcacaattgcacgaagtcttggcaagctagcttggtgcatgtaccgatcgagataagacgtcgccctcgtcggagaggccgcggcgaggagatgtatacaggggtgggccaattggattggaacgggggatggatctgtctcgcacgacgtatgtgccgcgccggggaacacgctccttttcgtgctacaatctcaccatctccttcgaccacttcttcagtcttttcatcttgtggacgatgcacacacgctgtccatgcatgcacccgtcttcctgcagcctcacaattaaccgtctgcttcggccacaagtagtgtatccatgtcggtaattgtcagctggatttcgtcgcgtttctgcaggtcgtcgatctcacacaatctatgcgtgtatagcttgctttctgccgacggctatatacagcatgcgtgcttttgttagactcgatcactttgtggatgcggagcattgtaattccaagccatcagcccatcattatcatcgttcgcgccggaaagaacttcagatgcctatgcttttttcaagctgcctctgtatatcctcactggtaatacggctgatactagctgctagtgctgtttttttcccctttctgcgagggttaacttaactacagggtagtcccctcttgtatttaactatgttacctttgattccgaattccccttttttcccccgaaagacacctttggttctgaaatctgataacatgttagtatttgacgttccatgaaagagcgtcttacactcttacgttaaattggttaatcctttttctccatccaatgatggactgcctacttcaatttagctcttttaaatttagacgatctttgttagtacgagtggaatttcatttttgagtttgcttgccctgtacctgtttctctatccaaccttgacatcttgttgggcctagtactatggtattgggccggtaaaccaagtccatttattcacaaggtgtgtacgctacccaagagtccagaaatccagcagatccttttcacattgtgcatcttccatttttcctaatacatttgacaattattagtagtagcccagacacaaacttgtggtttccgttcaaccggcccctctagtggaaaaggctgactgggacttctagaagctgtatgcaaatcaaagtcttctttacccctttggtcaagggtctagattgccaagcttattggccgtttagaagacttgctagcatcgattcaattgggcagtgctacttttaaattatcatcaggtgcgtcattgatcattggtctgaattttctacggttagcagaattttttttccatcagttaggtgaaacatggaagaaatcttcagcgtctttcatatggagctacctgataaatttcgatatatttgtgtttgatttgaccacggttaatgaccattcacatgatcatgtgaggaccttgcgaattcagagaattatacaaagcagttccttgtagtaacttttttttttgtcaccgtatattagtattgtatagttttataattttgatgagatccggtgctggtcaatttttatagatttatgaatagcaaaacgctggtctgaggactgaggtaggactgattgtattaggatatcttcatcttccaaacgaagatacgctgttactctgtttaagcaatagagtttggagatggctcaaaaatgcttcagataggagtacttttttaaaaaattaagataattagtacttattttaaacagaaaacagttaagattgagacgcgttcttctgaaacggactcaactcaaacgtgccactctcacaggggagagatatcgacctgatagccagatgattcgaattgatccaatcatgtgcatcgtcaccgatgcgcacctgtggaaattcacacgacgaaaccaccccctccgtctcacagctcacaaatgggaaacccaccaaaaatgacaagcatgcatctgccgaacggctcatcctatttttgcattgactgcaggaggccgaagcacaaatgtttcgtatttacatcttctttacactatttttcacttgaggtacagtgaacggtcgtgttgtacacatctacttgaaccaaaaattgagaccggaggaacgaaccctgcagggccctgccatgccgtggcattcagtttgtgtccgactgcaacggccaggcagcgagtgtcatacggcgaactgctgcttcagggacttgggcgtttggcctccctttagccttacctgcatgatccagcaaagagttcattagcaagatgctattggaaactgttttatttccggcaactaatacaattcaatgcagttcttttgtgggtaaataatcgttagaaacttcaagataatagttggggtttctccctgttcaatactgtgacagttaaaatttgacagggtcgtgtagattccctggccatgaatatcacgctagaaactgtcacggatgtgagggatagtgacagggtaaacaattgcagttgtgatgtcaattgagctcattgtacacggatggctgcattttccagatatttctagagaactgtcctgatcggtccactaggctgtgacatccaacgcatggaaaatatgctcaggccattatgttagactaatcttcttcatgcgggttttccttcaaattctaatcggtttggagtgatttgacagtctattttttaatgataaatgtgaaaaaaactgaaccagtactaaatcgctaattaacagcattccagagcaacagttaccagttaaaccgtgggaacaattcagctagtaaaccattactgcagtaattactcgtagctatctgaaatttcaggtggaggtaagaagtttggtggggctagtttgtgcgtgaggaatcaggaatctccaatgcagaaatcgcgaggacctccttcgcacagttgctcacaggtactccgtccaaaaaaaaaaagataaacgctggtttccgtatccaataattgatagtcagtcttatttgaaaaaattatgaaaaaaattaaaaaaataagtcacgcataaagtattaattatgttttatcatctaacaataataaaaatactaattataaaaaaaatttatataagacggacagtcaaacgttggcacggaaacccaaggtttgtctttttttttttcttttggacgaagggagtacacggcttggtcggcaagggctaaagcagattccatggcgctatttgactatgtcgacgcgttacctatatcacatttggccgaaagcgtttgcgcaaatgggcaatacaggatacacccggcaagcgtattgttctacagaatctctctaaaacacggattggaatctggaaagcttgcatattttgggtttaatatgtttccaatccacactacaagctacagctaggcggaatcgtttgtttctctgttttgtgcgggcgtgacatggactcggtaaaagaaacaattgatacgatacgagcaaagaaagggaatcgatcacttacagcttcgacgtcgattctgtagacgagcaggcggcgtcgctcgcggcagctggcgcggtaggccatggcgatgtgcgcggcggcgagcgcgagcgacatgaggaacatggcctccacggcgacgagctggcccttgccctgcagccccagcacggccctgtcgggcgccgcgccgaacaccacggccgccttggcgacgacgtagcacaccgagccgacgctgcacgccacggccacccacaggtaggccgcgcctcccccgcacgccgtgtacgcgcctgcacaacaacgcccaccaagtgctcgtcagccaaaccaccatgacgacatgagatcgatgaacacgcagaaaaaaagattaaggggatcgcatcgaatcgcacatacgcttgataccgattgcgtggtggggttactcacagaggatgaggagggagcgcgcggcggagacggcggggaggtcgacgagcgatgaccggaagtggaagcccctggcctggtcgatgagcgaggtggggtggttcgcggcgcggtggaagttggagaggagcgcgggcgggagtagcaggtcgaggacgacgatgagcagcggcggcgcgcagacgagcagcagcgaggcgagcatggagacgaggaagaacaccgtcttggcccaccgccacggccgcgcccacagccgctcgttgtgcaccagcggcagctgcagcttcgtcttctccaccatgatcaccaacgtcgagcgaccaattcacctactagcagatatagccgcactagcaagatcgatcgatcgaacccgctttcttccagtggtttaccggtttcggtagggttgcgggattgatggggggggagtggattcggtcggaggcggcgagctttttaagcggaggcgatcgaagaacgcgagacggaaacgggggttttggtgcgccgcagggtcagagatgaatagcgaataccaggaagaagaagatgacgacgacgacgggtagtaaagggaggaaggaacaagatttgaccggccaggtgggcccacgcgagtacccgaccccacggccacgggctcacctggtgggccccgtggctgcccttagtcgccacgcctgcgctgcgtcagcatctgcgtgggcttcgttgagaaccttcccccgcgcttgcggcttgcgtatttctcaacgagttttcatcgcggtttcaggtgtacgaaactagagaattatggcgattgtagcagtacatgaacacgtagataaattcaggggagaaaaagaaaccggtggatggaaattcctgggaacactttgtgctgccgtgtagtacgaattacggcggctatgcctttcaggactagttaacaaaatcttttattactaacaactgccatgcagggccggccctggccctatgcagccgaggcgaccgccggagcccatgatggtggaggggccaacacctaatactagtagtctagtacctcatccgatgttgagatcaatgtttttttattcagaattaaatgtgtgattcttcgatgtttgcgcctgagattcttaagttcgttatggatgcagattgctatccaaatgttttagttgcctatcgaaatctattaactgtacctatgacggtagcttcagctgaaagaagtttctcaaacttgaagttttgaagaactatttgagattaactatgtcaaaaaaaggttaaatggcttggctatgtgctcaattgagaaggatatcttgaacactattgattttaataccgttattgatgattttgcatcaagaaatgcccgaagaagtatcttttcatgggagcaacggatatgatggggttttgttcttcattaagttaatgaataatgatattagttccaagttacaaatatattgttatttttatttcttcataattaccagacatgttaaatttaatatatggtgtatttgttatcgttttgcaagtaaaattattatctctatatcataaaattttatatatatagtttagagggcccatcgcgatgagttcgcttagggccctcagaatcataggaccggctgccatgagttgttcattgcttattcatgagccaaatggagcgacgtactacttctagaaggaagtgcaatttgtcagcgcgatccctgttatccacctgtctctcgtttgcaacgtttatcagaaaaccgatcgtgtaatgaccaaacggaaaaaaacgacaggctgatagcagtacacacgactaaaaaaacccgtgcttttggacacaacacatggcagccatgtgactcaaaacgcgatcggggcagttcaaaacatcccaggttgaaaaccacatggccgcgatcgatttcgacgcacaccaccaccggtactccccctctccacatgccgtgatttccgctacaatttcgcagcggcgccaacgtcccgatcccttgtggtggagttgggaagccgcggggcggcgcgcgcatgcggtaaccgttaacggccgccctcgtgatagccacgagtccaaaggcctaaaaaaaaaactcggtcctccatggctagccgccctgcagatcgtcgtggattattaagcgaccggccgtcccgttcccccacattttttacgaggattctcacgggttttgagtgctgggacctgaccccttggagagtcttggacggcttgtctggctgagttgagtatagctgctgaccagatcaacacttccaaggcgagctttctgccaggtagcagcactgctgcctgcgtctgaaactctgaattgtttggcccgggagcatctcggttaattgcaatatcagggtattcttctcgaattaaccgtgggtttgtttgttgcgtgtgccctctgcgtgtttctggcattctggtttcagaaatcagaacgatggatttcgatcagttgacgactgaatatttaagagaatcttggtgacggaatcacgagcaactgttgcttgtttgacaaaacgccaagaagcttctgatggtgatctgatcatgtttcttgtttgacaaaccatggagaagtttccgctgatgatcacaacgggagtttttttcgttctctctccttcgttgttggtttgagtttgaccgggagctgtcgtttactcgtttagggcctttcagtaatcagaacctaccccactactagtattgctggtctttccttcacgcattacttttcctccggtcaaaatttggactctatgcaaatatattcacgtgcaagagctggagcttctaggttgagctaattgcaacactcgctgttaattgtacaacctgctgttgtttgtgagttcatcatatctttgagcacgggacaactgcaaataggtgtcaattgtggattgtatggatgccacgctgtctataataaatgctgcaaactctgaacccagctgttgtaaattcgtagagtaccactacatacaaaccggccgttccacgtgccaatgatgcactcaagtttgtttttatataagcaagttgaaaatacaggataggctagctaaatgctcaaaaaaaaaagaagagagggtttttatttttacagggtaggccagatatttgctttgtatgagtccaattggagggtgattagaggataagacaatcccacgtcaccccaacttaaattctaaaaccagtgcgccttgtgtcacatctttatctctttgccttttgacttctcctgatctcctcatcgtcacgggctaatccacttaccactcaaatctccggcatgagttaaccagaagactccttttccgtgtaaagcagggcctttaattgtagcccttgaaagattgtgattaggattaatccgaatctagcttcttatcgttaatcccctttctcctgacagcacctctgttgcttgcctacccccaaccaattctcacgtgtgccccaaaccgaattaacggccagcagctggtttgttcatcaccactgcaagctattgagcacatgatcctgtcaagccaaagatggcagcaacatatcaatttgtgttatgcatttgaattgtcgagtacacatctctccgatcacgtgtgattaattagatatgacaccagaaagacgtactgtatcctgcaagcaaatcataatatcatattgtacagatttgaatgacgggatcagccatgggaaaaaagttggcaacaattccaaattattgcggtgcgagcagcgacgtcactgctttgatatttcgcggcatgcagtgagtagaggcggagctcggccgtttcaggtgatgaggtcacatgccgatgccgccatggccgcccgtacgatttcctccctcgcgtgagctcagctcgatcatacgacagcgaccatggccgccatatggccgtgtatttccccatcgtttcttccatagttcgcacattccgttcgtatgactacagtactgttatgtaccgccttcgatcagagtcgatctccttacgaattgatctgccgtatcccctattcccctgcgaatcgtccatacaacgtgcttgactatccgttcgatctcttatgtacggtcgagatcgagaatccacctttgcatcggaggccccccttttttattgcaccatcaagtatatcctgggctggattaaactctacattgctagcactctggtggctagggtttcctatttagggggtgtttagatccagggtgtaaagttttggcgtgtcacatcaggtattatatatggtgttgcataaggtgttcggacactgtaaaaaaactaattacagaatccgtcggtaaaccgcgagacgaatttattaagcctaattaatccatcattaacacatgtttactgtagcaccatattattaaatcatggagcaattaggcttaaaagattcgtcttgcaaatcagtcgtaatatgtgcaattagttattttttaagcatatatttaatacttcttaaagtgttaaacgttcgatgtgacatggtgaaaaaaatttggggtgagagctaaacaggacctaatggaggaagcacaccatgatcaatttaaatatgtaaaataaaacatttttataaatattttaataaaaataaaataaaaaagttcctcgtctttccatcctgtaagataagcctggcccaggaaataaaggataatcaatttaaatcctcactggactggatcgtgccttgtgctcagtttaacaggaccatcaaatgttcagtccgatgtcaggagacgaagggaaagcggaggcacatttgtggagtataggaagaagttcactctgactcccttaactaatggctaaatctgattcgcattcttaaaccacaattcctgatacactctcggcggtttcactgacgtggctcctacgtgacagtgtcgatctgtcttagtcccacgtagcgtttatgtggcactagaattaaaaacatatacgtgggacccatttatcattcacacaaaaaaaacatttgtgggacccactgatatgtgggcccacatcctttcttcctcatccctctctcccttctctctttctcttttctcttccctttctctttccttttggctggagcagcggcggtgacaggcaagtgagggtcgaagcggtgaaggggagcccacaacggtgatcacgaaggaagcggtagagacatggtcgacgaggtcgatgccgacgccatctctccccgctcttatccccctatgctccgtcacatgaagggcctctcgatggacgagtgacaggggtggcgccgtggtgggcaacaacaagatgagggagagggtcggaggggagatctccagctccccgatgacttcgcaaccaggctgcgccaaccttgtcgtgtcatcgccacccatggactccatcgtagggtaaagtagaaggcatggactccgccgagggaatcaaattacactggttttaatagttggggggtggtcgagatattcggtattatggtttagggatacaaaacagattcgattgctagttaaggaagttaaagtggacttattccgtggtatatatgttgcttgtcgctaccattggtagaccttgacgaggatagggttcttagtgagcgggggtggtgtcgttgcagaggatggagaaatgcgtccgagggaccagccaccgtcactgccaatgccgtaggagagtaggggtggggaggatgaggagggagagataagaatggagacatgtgagacccacttttgttttgtcacgtaaacagctagtcagcacgagtaaaccgggtcaacttgccacgtcagcgaaaccacccatcaacagcgcgagtgaaggatctaatttaatcgggtttgcaagctgaaagtttaatatttctggcattacggatagggtttgtaaattaaactcagcgtaaaggtgagggttgccatgtggacttattccgccttacgacataccaacagcatggaacccatcaaggcccactaccatctagcccagctgatagactatgaggcccagtcttacattccacgttttgtcacttttggatcgttgggtcgctcgtcgtgttccgtaaaccccaccccgtctccgcagatccgctctagctgcacgcctgcaccttgctggcttggcgagtggcgacgaaccaaatggactcgcatcgttgtcgccggggccggtcacccgccgtctgtgcaagccgtcgtcgttcgtgccgtccattacctcggtcgatcacgtccaaaacactctacaaccaagggaaaaaaaagaaaagaaaattggggaaaaactttggacgactccgcctcgttgaccggcgggccatggccatcagttaacgaggccgcacaaatcggacccgatccaacggccgaaaccccaccgaaacaccgtcgttttcctcccctcttttcccctcctcccccgcgccccaaaaagagagagagagaaggcaagtggcatggggcaagggggatcccacaccccccccccccacatctcccgcagagtccacggccgatccatcccctcgtgcaggccgccggcggcggggaggaggaggaggaggcgatggcgtcgtcgcaggccaacctcgacaagatgcagctccgccagagctaccgcaacctctggcactccgatctcaccagcaccatccaggccgacttcccatgtatgtcaacttttctttttcccccctctctgcgaatgctaatactgcgccttcccatggcgagatttcgttctgatgggttctccctgtcgttgttgctgctgctgatgcagattgctgcctcgcgctctggtggtaagcgatcctcgtcgatctccccggctccatttttttttaccccgacctgatatattcgacgccccccttttcttctagatctgggcgaatctgtctttttatttctgaattaaactagggtttaaggaattctaagtctgatgagcataaggacaatgtgtgattccgcattgagttgttcaatcactcgcagccgtggagattgcctagattcttaatgcctgtttattatgcgcttgtttgcattcttaaatttgatcggattttaggtgcgaggaatacattgcgacattaagggacgcgttgcacctttgtcagttccttttattctttattactgaaaggaccgcggaatttagattggcctcaggaatcagatccaggatgacacattactgtttcatgtaatatattttgttcaacattacgcttcaaagttctcataatggcaaaagtaaaacggttcctggataggaactaaactgaagtttgtcgttttaaagacagctccattagcttcaagcatcagcagcgtcaatgagcagtcaccgcataggttctttgattttcatgcaatgctttcctgatttccctagtcacctcctcgaccagcattactttcctctgcagccgcaaggcaaaggcattttgtctctatcgcaatgacccatatggggtaatacgggatattcgataagatactatcagcgtgatggatccacaaagcccattcagtacctgcaggccctaaaagaaagatatcttttgaatccacattggtgccagtgtttgtacattccataagaattgcaataaaatgcgttgagagcatatatggtagtcctttcatttgtctagttctatttcttgtttaagttcccgccctcaagctcattctggaccatgtcaccttatcatcaatagctatccacaaaaaagattttagtcttctgggtactctgcttttccacaggcattgcatttaaacggagtcgtgtttcattaatctgtacaatgatattctgtggtgtctttgagtaggcagaattagcatttagaaatgttaattttttacccagtatttgatcttttacattcccccctttctgttcagtggaccatgtgtgtcatacatgcttcgcaaaagggctctgtataatgacatgtcaaggtggggtttcttctattttcttctacttgctatggttagatacgaacattgtgttagacctccctgaatccattcccctgcacctctgtcttgtagatatgtctgctgtgctgggtacatgccatgcagtgggaagtgtggtgaaagccgatgcccagagttctgtcttgctactgaggtacaagatccattcccttttttgctgataaccttttgatgactgattaggctgaatttataggcagcatgtcacatgtaacagttctcatgtggctatgagtattgatggtttttatatttcttttctttgctatctggctttgtaatcagcctgtaaagactgttccatttccggtaatatgattatttatttatttatttatttttttttttggggggggggggaaagtggtggccaccccttgctaaagaaaaggagtattgatggttccttctgtaatatttgattacctatattttctactgatttctggatttcacatatttgttgtgctcaaaaagcatgcttttcatggtatttctgatagtctgaaatacagttcagtatgacaatattttttctgttcttcttttttcaatgaaagagcaccagggtcaatgattctggggtaaggataatttggctgtattttgttgttatcttgtttgatcaatcgtatatatctcagattagaacgggaacatgtaatgcttgtcttgaatggagtaatctccaatactgtcactattcctttaattatgctatttttgtgcttaccttagaactaactagtactttatttttcaggtgtttctgtgctttggtaattcagttgcttcaacccgcttcttgctccaagatgaattcaacatacagacaactaaatgcgataactgcatcattgtactgtcactgtcctcttgttgtttgttttactaacttttaggtataattcctatgttccctttctatgagactataacactgcagaagatcactcttttcctgtagggcttcatgttctgcctccaacaaattgcttgtatcttctctatagttgccgctattgttggtagtgaagagctttcagaggcttcccaaatcctttcctgcttgtctgatatggtctactgctcgtaagctctcataactctgttattttctcttctccatagttaagtcccccaatgttgataatcttgtgacctgtgcaccattttttttttgcagggtttgcgcctgtatgcaggtaaacatacataatatctttggtgattatttactcactcttcttaacttttgcgtatccatcttatccactgaaatgcatgtgcagacccaacacaaaattgaaatggacaagagagatgggaagttcggcccacagcccatggcagtgcctccaatgcagcaaatgtcgcgcatcgatcagcctattccacctcctgttgggtacacaccacaacagccagcatacggtcagccttatggtggctatcctcctgctccgcctgctcaaggttatccaccagctgcttaccctccggcaggttacccccagggtggtgcataccctccccctggctcttatcccccacctggttcctacccgcctcagggctcctaccctcctccacaaggttactacggcaagtaaaggaaatgcagaaattggagatatgtctttgtgacgaaatcggtatattgtgaacaatgtaaacattagggtggttgtagtgttattataggtgatgtcgatatattaatcgatctgtgactggtctgggtggtaaactgcaaacataatttggattcctccgggtgtggtatactgtgaacccgtttcgtagaaattatcagctccccgtgttgatcattcttgaatacgttcttctctgaataaaggatcgccatgaaatgtcaacttagatttggaactttttatcagaatttggtgataacattgcctgtgtagattgttgcttgtctacaacgaacaatcaacaactggagcttgtatgtgacccgtgttatgtctgaatctctgaatattacgtctgagagcaacacagattgacgcatcagatactttttttttttcaccagaactttgaatttacgatcagtatatgtttggttgctttatagattttggacatgagtagctggatagcaacctctatatggattatgggtgctgtttttcgctgccaatcttcagggaaccaacgtgcagcgtcttccgagacagtgaggtctcaacggagttgtccgttctggttgagacgtagctagccgtgcactagctccagccttaattgattggaatatttgacaatcagcacagcgattatctggaagatgttaagccacatactaatgaggaagacgatgcaaaactatcactaaccacacactaaaaaacagaaacgtgaatatatatatggttggtcttgtgtccctgctggcttgctggaagggctctcgcatatacgccggaaattttcgggattatcatgagaggctagtgccagccttaatttgtcttgtggtgttggttaggcctaattgtccaattaatcaccaatagtccaactccagtttggcatacctgctactacttgatacaaggcccacaaatatagatagagattccgttccatccataaacgcagttgaattaatgctggattgcaatggcgtgcgctttttgattatttgactagcagaaggttatagaatggtcaatgtatatgcacagcaaatgaattagtcttggggttatgtatgcatgcaggtacacccacgacaacaaaattaaaaactataccaacaagaagaatttgcttgagcatatctgctcaaaaattacaacgcatatgccagtggtcagactagtatgtatgtcatgaatttgtcacctctgactaattaataactagatatacaatttaagatgatcttattacttatgagtcaccatgtcttcttttgatttgattagcgagtacgtcaggtatacatttttttctgccctttacctgtattacatatagaaaaaagaagtttgtgttataattcagttgttaattactgaaacatcaacattgtattactgtggataaaatacttggataacggtttgtttaccttttacgctttgatttaagggttgatgtctgtgagttgttgtgccagttacgctttctctgattgatgaaccagttgttgatttgcttgagctgcaggccagtctcttcaacaagctttgccttatcatcctcctgtaccaagaaaatatatatgccactcaaccaactgtattatatccatgcaattcttcgtgcatatctgattagctaattaataaatattattgcttcttgctatattatatataaatattaattgtaaagttagcacatcaagatatattgatcaacaagttggagaacagctaagaagggctatctcgactagtagctagttagttgcactcttgcaagcatgcttgataggtacaatgtactcaccgtggggtatggccacttggagtgttgctgccaccattgcttgagtatggtggtggtgtccccaggcaactttcctgccctcctcttcctcaatatttcttctctcacatcctcaatccttgacttgaagccctgtaacgaatttaataatttaatcagagataagattgcaaaagtacgtatcaccctctagttaattacataatccaatataattaatttaggaactgattgaagaactagcaatagcatgcatgcatccagaagtagctagtcttagtcagttattgtcagtcacatatatagctgaggcgccgcatcaaacatgacaccaattaatatgatatgcaatgatctaggctcagtcttcagtcaaagtattctatgacacagtacaaggaacttaagaaggagattttcatgctagtaactagctcatttaagctgatcatgcactgtttttgccctaaaaagcagctagctagcagcagtagtactattttagctagctcggcatgatccttgcatgaacagtctcttatcaatgtttaagcatgttaaatgaacacgcttaaacattgataagatatatgcatgcatgagttgaagagacgaatgtaggtgcatgcaagacgtaagaagaaattaataacaatgcatgcatgtacctgcttgagctcaatcttgagctcttgcctgacccgctccatgagggatcgctcggagtcggtgggcatgagcgggccgaagcccatgaggtcgtgcccgtccgagcccatatccatcgggccctccagcatcggcgccgtctcatcctcgtcctccgacatggtcgcccctgtcccttcctccaaagttgcacctgatgatcaattgcatatgcatccaggtaagtgtaaatcaactactgtagttaattaattgatgatcacatctcttgtaactgtcctatttctttaatttatttgattagttattcctatatctaataacatgaaaaattaaagattagcttgaagcaagtataataacatgaaaaagaagagctagtagctagcaaagtttgtcggttatattcaatctagattgtgctacacagtgagttagagctaattagctagggcatgcatgcagtacggaggcatgcatgagggctttgtcgacgtcggcgatcgatcgagctgcatgaactggaacgtgtgagatcgagcagagatagacagttgtacgagctatgcgcatggccacttgaaacagcttgaaagctacccaatcgaaaagatgtctctgatttggagttttgcatatgcagctctcgccagctgcattgcctgcatgaaacagctcgcaggaactactagctagctaccagtgtactttgaactgcctagctagataagttagcatattatagctccaattcgatcttcgtctttatttcttcttcttcttcttcttcttcttcttcttattattattattattattattattattattattattattattattattattattattattattattattattattattattattattattattattattattattattattattattattattattattattattattattattattattattatagtttttttaaagtagcatggctttgatgttatgctctaaagcaaccaaaaccaactgaagcgcgcgcgcgcacacacaccaaaataaaaaataaaaataaaaattcaacctataaagaaccttagaatccaggtcaaaagagtggactagtaatttaacaacttcccagtgtcctaatttacaggtgaaatgtaatttttctctacctacaattgaagtttacgtatgtatgcgcatgctaagttttcaacatctatttcgccaatcatcatgggtgtttttcttcagttacattacatcaaccctgatgctttttgaatatgcaatgactactatagttgaatcccaatcgatgcatcatgattatgacgatgcccctcatgataagaggacgatcgccaagagctcgatcggccggtcatatcatgtcatgtgacacaccttccactttccatggtcgtgtgtgatatatattattcgacagaagcgaagcacctgaatcatttaattagctagtcgattagacgagaggcatggactttcaactccgagccaggattagcatggaacctagatgactttcatgtaacctagattctgtttgagggagcttttgatagtcgtagcttcttttatataaccttttttttcaaacagtttaaattttcatctagattctaagaaattatagttattgaatttaaaaaatgaactagaagtttaaagttagaaaacctatttttttccatattctcaccaattgagtgattgactactaactagctatgcttcctaaaatctcaaagctctccaaataaggcttaggtagctgttacactacctactagcttttcaatatcctctcagcgatttctcgctagctagcaaccaaccaaccaatcggccatgaccgaatggcagcgcttgatctgcgccggagatggctaaatgcattttataagttcatggattgttttcttagataacagattaatatccagcctctacactaataaggatgtatatatccaacccatggttctcttagcaaaggatagtttcattagatttatgccaaatagttggttcaaattttgttgttggaattttttttatttcaactgatcataaacctccaattgagactttgtgagaaaagaagaaaaatagctagctagtcacctcatatcagtatatatatgaactgattaagttaattttaccaagggtatcacgtctaactacgtacacatatatatatatataggccttagaaaccttgactatgctattctctgttaataacacaaaatgattataaaaaaaaattggtgcccttgtttttgaactggaaggattttatgctaaaaaggaatatctgaaattgttttcgtgacatctaccgttgggcttctgggctttccctagtatacgggctgccatctatgtgggccttggtaattccgtgttatttatcattccattgattcgagtataaacatcagcaataaagtcgctgttaggtacgtgtgttagagttttcatatttaactaatctcctctgaatacacctgtagaaaccggaaccttagaagtcaaggcatgcaaatctgttgagagggaatcaagagaccatatatatgtttgaacaagacgctgcaactaatatatcactgcaagagctagcggcaacgaactaaaaaaaaacaatttcaccatctaatctaactaacgagaagagcaaaaaggtgaacaaaaatcataaagacgacaccatggaaatcgaaaaaaaaatacagaaaagaaggcggcgagaaggagagggaaagtaatgaaatatgtaatatatagtggaaaatatgtaatgcatgtatgatactgtagtagttaattaccggttaggtcctgcaaggattgctcgatctcgcggcacgccatgacggcctccacggcgtgcacccggacgtgctgctgcagctgctccctgaacgagcacagcagcatcatgtactgcgcctgcatcgatcatttcagtatgcatatatacagttagcttggctggatagcttctagttaatcatgtagctagtgcgtacggtatgatacttgcatgtaatgtatgcatgcatgcacaaatgcaaagattaaattcaacctagtgaaattaatcaagcatggcgcatcgaactcaggaagaaattaaatagatgcgtacgaggaaggagtcgagctcctgcttgtcgtggggggagaggaaggggcggtggt

SEQ ID NO: 19928 - DNA, 33632 bp, Oryza sativa
ccacgcgcaggcagcccacgtgcgccgccaccagctgctagcacagcgggtgcaccgcgatctcccccttgagcagctgccgctcctccgcctccgccgccgccgccgccgccgcagccgccgcagcagccgccgccgtcgccgacgacgacgagcactccccgcctcctccgccgccggtgaacgaccccacgcccatctccatgcctccgtgatcaccgccttgcatacacaacacgatacgcgtatacaccgatcgatcgaactcgccgcgcgcgcgcgcaccaagagcgagcgagcttgttgggctcgatcggttggtgcgcgtgctcgctcgcgcgggtgaccgtggccgttgggtacacgtatgtatagctgtagctagagctctcgctagctagctctaatggccagcgagaaggcgcgcggagagggatttaatggggagttggttagcaaggacacaaaggagatggtgaggggtcttttcgagggttcctaaggtgggaggtaactggaaaagaaagcacccaagaaccttcaattcaattcccttccccctaccttagctcggtgaaactggagcttggatgctaaagcatggagaagaatatattaatccagcacgatgagagagaaggtgtgtccacgagaggatagagctgggaaaaagctagctcgctcgctctaacttaactcttccgatttcataattcttaatgttttgaacaagattaggattaaatatttagaagtgcgattatcagtaactttaaaaatattaaaaataaagacactaagagaacatatataattttgtctaacaaaatattaataataaaagcaaaaaatatatttatttattatatacaatatagataaaagaaattaatcaaagatgtattttggagatcatgtcattggaaccgaaacagtaggttgtaataagctagctaggataggtggaagaagaaggtggacgaggagggtgaggtggttttggaatctaattaagcatgtccaaacctaagaaaaggtgcctaccgaattgcactatatgcatgctgtgctccaaaggcggtagaatcgatcgtacataggagctttcatcttagcttttgcatggatcattctttcctttctttctttcttttttcaatattttagatcaaacttaacaacagtcggtttgaagctgattgagaaacgagaatcgcatgcacgaattatatatatgtgtatgttgctgtcgttaacaattcctcatgtttcggtcagcgatggttcaggattatacatattacataccatatatatagtatctggagttcaattaattgttgaatacaaccgatgaagtgtcaatgatcatgtacaggaataggccggggagtttgttcttcctgtaaactaacctagatagctaacctaatcctggcttagcttgttgttctccttgtaatttggtgcgtgaataattaggagttggtttcaagaaaggaaatacctttggtggtgtttgggagtttcggttgcctctaccaactttgcggttggcgtcgggaatgggcttctgctggctagctagcttagctgctcctgcttctgctgctgttggtcgtcgtctccattattggctttcccctgctatagctgcagggtgagtgcatgctttgttagtattagtagtacgtaatcaatcagcgtattagtagggagatcaacgcctttaatcgatcgtacgtactgctcagcagtataataatggtattggttaggcatacttttgacagctgttgtatatataatcgcccatggtatgacgggcccgtcttctgtagccttgtctttatcatatcttaacaaaaggataatgacatgcatgctgcctgctgtttagggttactgcaactttaatatattcgctatgttttattttctcttatgaggacgcgtagtcatactgaatcatatatatatatactaattaacttagtttgtttgggcaaaaataaacatgaatagtactacgaatatatcatacgattgctggtttgtttgggaattaagcgtccagcaacgactcttattggtcagagatcgatcaactctagcttaggctgcactgcactacatgatcatgctcaagagatcatcagttaattaattaatccgtaccgtacatacacctctcagaacagcattaacgtagatcatgctacctagcttgtccattatgtttcaagttagattgcctctctccagccattaactagctagctagcttcattcagtcgtacgtactcccatcgcgtatcagctgcagccggcctgcaggcgtatcagatcaagagatgcttgcattgtcagcagtagcagctggtagtagttgttatagttgttcgctctggtagtctcttgtgcctcttgatttgccaactgccgtcttccattaattaatcctgaagaaaattttccaaattaattccacgtttggtctttgtactccctatcagtggtgatttcctcgagtttaacaatgaaaaaaaatagcattgtatacaacctgccaatttaagagaaactattttaatccatcgagaggatgttctctcgttgtttgatatcacttaaatagttattaaatttttttttaaaaataagaagatatattaatagcatgtgatatatcacaggccataaacgtgcaagttcaaattcatcttatacatctcgcaacgaaaaaacaaattaaactataagtagttaacgtatattcataatcaaatttggtttttttacaagatatagaagttgaatatgaacttgcatgtttgtggagtgatatattatatgcaaataatgagagaacatccccatgagggatcaaacccaatttaattctaaatcgaggggtgggtggaagctaatcagatttttatcaagctttcttcgaaaacaaaatcatgatttactttttttttactattttgtttcataacgagctgaggcagggtgaaaacaccttccatacaaaattaaatatttttaattttaaaagaaaaaaatagaccattcagagcaagtttgaaccgagcccccgagccagctaaatgatgtaaggtaagtacattaacattagtagttcgcagctgagagcaagtacgataacagaatattaagccagctataaacatagtttaaagagataaaaaaaagagagaatagcagcgggctatagaatctgtagtcagctgtagcacgaacttcaaaacgtagcgtgtgtataataggtgggactaaatattaatagtatagtaagcaattattgtatgaatttattattatattggctctagatgatttggagttagtagttgactagagatgttaataagttaccatgggctaggcgcggttaattaatcacggcagcggcggccggacggcggagccggcaggggtagctttgcagcctgatcatgcatgcaggtcagtcaaagactcggatttgatcgggtttgtacgtgtacttttggtcacccttgacgatgattatgcccacacgttttgcacaagattactatagatcgctggttgttgggcatgttggtatattaatgcttaagagcagtaccaactactagttctaaactatatatagtcaatttcatagttaattaatatatttatattatacttacctataaatatatactctactccactagtaatatttggtcctacctgtgtctttgtgctgtagttcgctgcttttctctttcattatttattttttcgatatgtgtttatagctagcttatagtttgctattgtacctgctcttagccctgatggcctccttgccccgcccgtccaattaacgaacctctcccttgccggtctctacctctctgactaaatccatgcatatatgactccatttcttttgcttgcatcggttattattaactctttttccttaccaattcgtgcacaaaatcgatctttttaatgagaagcagaggaagaagtagtacttaatagctagcagcaacacaaccaccttgtccacttttaagttttctttagtggacagacatgacaaatgaacaaaacacatgtgcctttctaagcagcttttagctatataatacatttctttatttaagattggtgtaacaagatatatagagccataaaattaattcatcctctttcgttatttcccattaaaaactgtgggctcagggagcaggagattagctcgaccggcctggattagcgacttgagtttgttacttaactaccagtatcccgattcgtatcctaatatcttatagtggtgtgatcctaccaaatcgaaacgatatcgatcccatatagtattttaattttgatagtatctcgatcttactattcattactatacgatcatacgaaatcttacgtggttttccaattttacaatccctacgataatataaaataatatttaaaataacatggtttaaaaataatgcaaataaatatgttcaaatttaatcagttaaatatatcaaaaccaacgtggtttctcttgataagtgtctatatttgcatgacatacatcattactatatttttttatatagaatggctatatagaattaatataaatattaattaaacttaaaaaaatctcatggtatcccaatactacgatatgattctatgatacgatattactttaagcaaaacaatactaactattatcccgatcctaacaacagtttgtagtgtccatcttctttagccaagttttgccaaaaatcaaatggaataggtagcagaatcttggactaagtccgggaaacaaaagcacgcagatgcagtccggtcccagccgacgtactctaccagtagtagcatacaggaaaaggcaccgtacgtctttggaaagtgctacaggaaaggagcgtatcgctggcacgactgtacaaaactacatactactgcgtactacgtagtactcgtatccacaagatgcagagacggagtaatgataatcatggatatgatatgttattgagatgcaggattattagattgggggagagagaagtggtgggatatcgtacagggcccaagtcgcggaagcggatcgggaaagtacaaaatattccgtcggctgggggggacgcgcgcgacacggtgggggagtgggggcggtgggagaagggccgcgcagccgccgcgccggtggttgggcgagctgcccgcgtgcgcgacccagcgcgagcctgctgctgctggtccacgcacgcacggcacgaccgcgcgatacggagagaaggcattgcttccgccgttgcggtcggccgcgcggcacggcaacgcacgatacgaacgatacggcgcgagaccacgagacgaggcgggaatgggattacgcggaacgccgcgcggggcttggctgcttggggagttggatccgcgacagcgacgcggcgcccacggcctacggcctagctgtcgcgcgggcttaaacctgtcggtgcgctgctctcccacacgcgcctctctccacgcccgctgccgcctgcccgcaatgcaaatcttgccgttgcacgcggaccagtttttcaacacactgattatgtactactccttccattgttccgtcatgggaaccataaatagtgctcgtattttcgactaaaaaccgatcaataactgtgaaattttttaggttctcatgcgggatgaatggcctgtttgagaagcttaagattataagaagcaacgggttggagatagcttttgaaaatttaaaaatgctaggtttattagtttctagcttttcattttttttattatacaactgcaacttctcaaaaatcaaaatggactgtttggaggagcttctgattttaggaaaagctgctgaagctagaagctctctcaaacaggggctgaaagtagattccgagcgaaattttgaatgtttttcgagaattcaaatttaaaacagtaaatttgatcgaaaccgtcgttgcgctcaatcggggaggtgctatactgtagggaatagagtagtgcatcttgctttggctgtagagagactgccacgagtaacagaggggagcacgtacaagacattctcgaccccggctgactattatttattctacgatgagtcctgtatacttctgggacgtacatgctgatagctacaccaagcttttccctgtattttccaggccgagtcactgtcgacgagcaatcgaatcttgcggggaaacgttcgcgtccacgtcgctccgtcgtacgaaatgcaatcctcccgtgcgggggcctcccctccctcgttgcaaaatacatatccactctgattggccccaacggtgatgcttcttgataagagttactcctagcttctgcttcaggccggacagttttgcttctttctggctcataagctcatcgtttgtttccaatttcactagtagctctgcattgtgataagccatttcggcagatttcaacagtatggagtatgtgcttttagttaataaaatgctgaactgattagttagtgctggtgctaacatttgaggcagacaaatggcacaaaacggtggccgcaacagattagttagtgtgtacgcttctacacactccaaaggagtcagaaaggcaccaaaagagaggacaagacacgagggaaagaagaagagaaaaaaaaacaagaataaagcagtagactttggttgcatgggaaaatttgtgtgcaagacgaaaggagcattacaggcttcttttaatacagtcttccagatttggatagtaggacctgaagctttacggaaagcaaagtttttaaagcgaaagctcaaaggaaaaaaataaaaactcctagcagggaagagacggccggagagggatgtgacacgaagtatttcttggtgtgctgaaatttcacctccatttggtagaacaactgttttgatgtagtacaacaaggttacttccaagttcatcaatcgtagtttttggatataaaaaacgagccatgacattcagagatcgatcgctttacttgctttgacaattacaccatccaatggacttccacacacctgatgaaaacttcactgaaaacgatcatttgctagacaaaagggtatccagcactgtaccatgttttgcaacagttaatctgactttgtttcatctgtataaaaattggcaccatctgtatggaagcgtatgcttgttagagtagaggagggtattttgattgggaggagaggatcgagcaccaaaaatggtggagaaataataatttcggttggtgagagaggcgtcggttggagagggcgtagaagggtcccaatcggttggttggtccacctacaggcattatctatcccatttttctttctttctttctctaatcttcttctcttgtctctttgatcatcttcttgccgggctttcacgctacttcttctgggcctcaactcgaccatgcattgtcccatcggcccagagaagaaaaaaaaaaactgcattcgtttctgcgtcttcttgctcttcgcctgaaactgtctgcccgttcatggcgattgcctgcagcatcattgcagttgcagcctcctgtgttagttcgacgtacgacaagacgattcgtgccctggttgttgcttgcgtcttcgtctctaaaagaagaagaagttgcgatatcacacatgctaatttcgatgatatgatcgcttcgcgcactgtttgctgaaaaacgtgtttttctagctttctttctttcggtcacatatgcagatatgatgggcttgccactgtttgctgaaaaacatgtttcatggagaaggaatcacgataggctgcttatctttctaagataagaggtcacacgttcgatggaggaccacttcgacaagagagggttgcagttaaaatgaaaaggaaaggaacaaggtccctgtcgccaagggcaaattacacggtttctgaacaatcgcgcacatcttgaacatgcatgattgttcacattaaccacttctctgagtgagaccatccgaaaaggaaaaaaaaatatattcatgttaatgcactgcaagtacataaggatcccataaccttatttatttttctagttctaagattattggctgtgtccaacggcagaaaccggagataccgaagatgtgatacattttcaattatccaaaaaaaaaaaagtaagtacataagaagctcttggacgtttcatggagcaagagagactgagagagtaggcctacaatacaatagaatacaaggagaaaagggagagaaatcaaagagtagttggtgattgaaacttgctggagtggttctctgttggcccaatccaacgcaccttcaaaaggtggcggaatatagttagttgtatactgtgttccaacttgcaagtacattttgctaacctcagatatgggtgttcatcaggacctactagcagctaatcagataatcccatcttcgttatgcctttccaagaggctgtactgccctgattacgacattgaaccagaaccaattagactccaacgaatcacaatatggagaggataatgattgcatcgagctacttcaggtgccctgttctgtaattcggttgatttacaactaactgattagcttctatagttctagtaactagtcctagtgaatttgcacgcatctgcttttcaggcatgaatagcctatgtggctatgtcaatgcaagggagacaagttttgtgtcgtttctttagggccgagtttagatccaaaatttttattcaaacttacaactttttcatcacatcaaaacttttctacacacacaaactttcaacttttccgtcacatcattccaatttcaatcaaacttccaattttgacatgaactaaacataccctagatatggtatgactgaagtctgaactccaggattgaatagcctctgtcaatataaaggagacaagttttatcttgtctgtgtgttttttaaatataagtatgactgaagtctgaacttaacttcaggatacgttttcagcaagcctcaacattatgtctgtaatgaatgatggagagttggaaactaattgcgataggatcatcataagcgagttgacatagtccacaaaagagaagtggagcccatacatacgaatgaattacgtcaacctgaagcatggcaccagtggaataaacagtatagcaatgaagctccatgacgataactcaactcaatacattggcgtcataaatcttgcatgaacagttgacatagatcagtacaaagttgccgcgttggcatagacgcatagtagcaagactggctcgattctgagcctagtctaccagaactatcagagaagtgcaacagtgcaagaaacaacaccagctggaataggacattgcaccagaaattctccagcttccttagcatattccaacttggatgcaatgagcatcatgagttggccaatgttgttaagccctagcatggtatacataagagctccagctccaagttgactcagcaaaaacaaaaacaggaggccgtgaacttatcaatggtacattgcggatggtcagtgtttgccatcttcgctcctacaaagccaatgaataaatatatacagcattcagcaaatgagccactccgaggtctgcgagccagtttcaccattctgcatcctactatctctaaaatttggctaggtttgatggttcatgaactggtgatgcaagtggtacaaatggaatgatattgatgatcatcaacactctgctgcagtagtgttatgacttatgagccaagtgttattagattaccacatctcagtgtcaccggatgtagctcctaacaaatgatgtggccccgatgctacttaggctgtcagaactctgtaattgaaggaccaattattatttagaagctatatatgaaagtgaaatttcattcaaattgaaataaggaccaattatactatttttaaaaaaggtacctgggacttgggagatggaaacacgttccaaaaccgaagcgtttcatcaccagcgccagttactatagtctgttgacataaaatgtcaaaaacacagctatgccaaaatattctagatacaataaacagaattcagtagattcaaagactcaagagataacttcacctgtccatctggggagatggctaaatataataccctatatgtatggcctgtcaatgtggcgagctacaaaggagaaatcgagcacaattaatacaagaaaaaggtaaagcgtactgagttaagaataagcttgcaagcatacctttgacattgttgggtatcgccaaacaattatctgattttgagaatatccatgagtgctaacaagctcattaacattctttgaccatacaagattacagacctattcaagattcactcagcgtcctcagtacataccaaaaaacaatatgcttaactctacagtcttaatgacatggcatttctgtgaaggtttcagatatgaaaacaagaaatagaacttcactattgaaaatagagctcagcctacatttcttacttttcggaactgacatgactaaagaaatgttcaattttttaagtgcgtccaaagattgagagttatcatgcttatttcacataccatataccacggtatttaatatggtactataaatagaataaacaagagttcattaaagttcagaactataaacatgggctgcacaatcactaaagaaattagatgtgtagcaaaatacctgactgcctgtgtcgacgcaatttaagtgcatattcgtggtggtattccaaaatcgtatgcatctatctgcagttcctccaccagatgcaagcagcccatgaagatgaggtgaccacgcaatagctttgacagctgctgtatgctcagtatacttcagtaccgggtgcgccgagtgttgattccatacataaagctggaaaagagacattgatatggacataagaaattgcaaccttgaattccatgtaataccaatgatccaatcaagaaacaattcatggatgcattcttactctgttgtcattaccaccagatgcaagctgacggttatcataagaccacttgagcccacagacctgaaaggtgtttggaaacagaatatgcatattataagaatatatcaaaagggagcacaataggataatccaagaatctgacatgtcggaaaattcataatgatgtataaaatagatcacctccgatttatgcccagcaagtctactaatataatcatcctgggcacggatatcatggtgaaggatgctcttgtcacgactgcctgacgaaagcaatgatgaattccatgcaagagcacctactcgcatccgatggctttccatggttcttattctcttacaacgagtggcatcccatacctaaataagataaaatccaaggtgacagtcagacaccaaattgaaattgtagcattgcataccaatttcagagctcaacaggattaatcgataatcatcaaatactacagcacatttgtaaacagagattacaatggaccaaattcattctttggagtaaaaatgaaagtcattcagtttagtcataaaactctactgcgtctatcatatattatttgtgcgaaaaattaggtccactgttaatagtattgcaatttttctgatctttccataagtgagttgtatacttctcaatgtttccattgacactctagataaagattaagctaaggcatcgttccaaattttggtggatcatgactatgttatctgatcatttcagaaaggggcatacgtctaacctgaactttgccttggtttgtccctacagcaaggtgagtgccacgctgtgcccaacccactgaacagacattgtcatccacccccaaatcacatagcttggtgacctgcacagcaataaacttctttacaaaccctcttcaagtacccaaacaagaatgcgcatggatggccgcagttggctcaccttgctgctgcatgcattccataagtagacacaattccccaatccaactgcaaggatattatgcgaagaccaatccacaaggttcaggtagaagtcatcctgcaatgcgggagcatccagcacctaagagcaacagaaggaaaattcatgtgagattttgagtaataagctttcatatcagtctctttatgcatgacaaataacacaggattcttggtacagagcagatgaataataaagaccatgtttttctcaattcaaagaaacatcaatcaagaaacagaccatatcaattgaaagaaactatgaaatcgaaggcgaacacttctcaccttataaggtgacctagggatcttcctggggccagtgcccctcgtcgtgaacaccccggggaagagcacgccctcgtcgtccccgtcggagaaaagggcgcgcttagcattccggggcacctccgccttgaacctgaatatgttgccggtggcgggtgagcccacgggcgacgccccggcggaggaggaggaggagcacgcggacgccgacgacgccacccggtcgggcgtggtggggccgaagagcgcggcgcggaggagcgcgcagtagggcgacgaggccggggtagatccggaggggggcggcgcgccgggggaggcggcggcggcggcggcgtcgtggtgggacggcgacggggcgaggtcgaagagcgcgaggttggatccggcgcggctggggatgaagcggtcgctgtagaccgtccgcgaggccggcgtgggcgcggaggaggacggggaggggtgcggcgccgcggaggagacgcgggaggacggcgcggcggcgaggcgcgacgacggggtggacgccggggtgggcggcttggaggacgcggagttctccatcggcgaccgcggcggcggcggcggcaggtggtggtggtggtgatccatgggtgggggcgagagatttggggatcgggagttggaggggaggagaggagaggaaggtgggtgatgcagttgctgtcgttcgcgcccccgcgctttctctctctctatcccttcgcgggctttttttttctctctctctcttttgcctattttactgcctttttttactcgactttttgcttcgtcttgttggtgttgccgctctttttttgttcgcttcttccggtttgggccatatacatacataaataaataaataaataaatgagtaaattgtcatttggtccaccttttattatctaaattttattttggaccacctttaaatctatcttttcaatttggaccgggtaaatttaccattgttgcggtttagactaccgtgacaacttttctcgtcatatttaacttctctttcagcaaacatatgaaccatatatagaggagatcgactgtatactagagctgatgtgtttaaggttgttgattgtatgagaaaaaaatcattcgtggtggtccaaatcgcaacaatggtaaatttatccaatccaaagtgaaaagatacgtttaaggatagtccaaagtgaaatatagataataaaatatggcccaaagcgtaattcactctaaatgagtaaatgctcacgctcagccgctcaggatgatgtaaaccgaaaccgatcccgtcttttagtactaatccgacgctaagcatatacatgtctctctcgaatctcgatcaggttgtgtttaggacaccacctgtgacgtgtgtgatcaacataaaatcgatgttatatgaatttgatatgtttttttcttcaaacatttcaagtgaaggaaataatgtactggactacctcgcaaaagcaaattagacggcagatccttggaccagcacggctgattttatgtcatcgtttgggggaaaaaaaaacttactactccagatggtgtttaaagtgtacgacgatgtgtatcgtaatagtcgcccagtgacagggatcgcggcatccagctacgacgatgctgccagcaacagcagaagataccttcaagattttctttctcgctcgggccgtccgaagccggccaaattgtgaagattaacatgatagagctggaaaacgaacaagcaacgacatggttgctgcacgctgcaagtctcaggattgattgccgtggatggcgatggagaggggaggacaggttcaaatcattttaagatacatgtgttaacgtgtgaggcaatatatagaagagtaagattcatgtaccagtgattgtaatggtgaaattatctcaaatcgagcatctagcgggggagttaaaatcgggcgcccccacgccgtgcctcccgcgcgcgccgcccccgccacgtgtcctgcaccgctcccgctatgtgtccccaccacgcacgccgttgcaacaaatcacctacatattacggaaaccccctattaagggaatttgtttcattttttgttccactaaaatgtttcacctaatgtactcataatatttcactatgtatgaatcaaatgttgcagtgagttgaaatattcttttgcaataaatcaccagtatactatgtaaactctctgctaaggaaatccatttcattttttttccacaaaaaagtttcacctagtgtactcataatgttttactatgtatagatcaaatgttacagtgaattgaaatattttgtcgctatttgctgaaacattgtttttatatagggtgaaacaacgctcgattttttagaaatcgttgtttcatacgttgtatcaaaatgtttaatgaggtgatttagttgtgttacagctttttaaaagactgaaatattttcgatctatttagttaaacatattcgatctacttgatgaaacagagcctgattaaaaaaaaaatcggacacccgatttataggcgcctcgttgtaaggttagtgctcggggagggcacaagtccgacctggattagtgtggctggacgtgaacgcgatgctgcttgagaacctgggcccaaaccgatgctcttatctcaatcctactattataaggagcacctcgttttaatttgagctggtcgattccttcccgtgctgaaatgatcgagaaaaggacgttcccgatccgtgtcctcccagcttgtcgagttcatcgtttccattcgggacagagagagaaaactcgaatcatcatccagcggttagccagctatctccgagaaatgaacaaatggcaatcaatcaatcatgctcctccagcaagccgttccacggatgccaattgcacacctgacaggcaagctacgtacgtacaggaaaacgacgttcctttgcgtaatctgatcaatatccaggaacagatcacacacagatctccgattttaatctgatcaggcgcgtttcagctgttcagattgggccaaagctcagttgcaactatcaactagtggtaggagcaagtagtagttgggttaaccaaacacaggagaatcattccagttaattagaagcaccaagcacggcacaaagccaacagggtctgaaatctgaacttcacaaccgggcaatgtctcctccattgcaagaacacagggccccgcagcggccagaaaatcagagacatgttcttgtcataatgagatatcacgggcatcttatttactgaccacatgttcttgccaggacgggaagtgaatgaatgcgtcgacaaacaagacctgaaacaaacaaaatccttgtccatgtagtgatgagctcagcgactgccttttttctatatcatgagatggacagtattatgagcatagttacccctcccagggcaccacaaaagatgcataaaaccaaccagaaaacatcaggcagtggacagcagacagcatcaagcattgacagcaggcgtgcgtgcctcagggagacgttaaaatgcattggagaaggcattccctgcaaacaagtactgtgaaaagcatatactctagttaaagaacgtctattcagatgggatataatactctaaaagattaggtttagttctgagctcaacaattactaactttaggccctcgacatcaaactcaatgagacaacattccaacatcagtcgccactgctatgaccagatagttatatttgacagagatttctgagaagtgtttataaggtcgatattaagtagcaccaagtatttgtcacacggtgaattacattctacatagagattgatgcaagaaacaacactttcagtagaaacttaatacggatatataaccgtaacaaaactgagggagcaaaagcataacactgaggctcgctcatgctcaaagtttactatctagtagccttcagcccctgttactgacagcatatgatatcttgataggtcggccgcgcagttcagattgattcattcctacagccttctcaagcgactcgtcgtcctcaaaatcaacatgacaaaaaccacgagaatcacctgttctcttgttgatagcaaaccttatcgatgaaatcttcagtgacttgaagaagtcccttaagtctgtttctgtaacatcccatttgagattgccaacatatgctgacagacacccatcagccttcttaggatcagtttggaactccacagtccttttcctcttcgagccagcagccaacctgcatctttcaactctcataaacctgttgccactgtaaacacaatgcatatatcagtatagagcaaatgctccatggcgtgcttccatgagttgaagagaaatagccactcctcatccttacattttgaatccgtcaagctcaagagacttcattaccacctcgtttgactgaaatggcacagtagaacaaaatcagtctatcaaatcaaactaaaagtaaccaactttggcaagtatgttccatgacaaatgaaaattacaaatatagtatgaaaaggaattccactgttaaaaattttatttctttatcagctttccatcgatccaacaaagtcatgacatacagtattgttccatgcacagacatccaaggattgtagtataagattaggaatacaactatacaaggcttttaatatgatacatacaccagtagaacgacatttctcaataccagtgaaacgacaatcagagcaatgtaacaataatcggataggtgcagaccataagactataacagcaacttcctctgtagcaactagcaagtcataacaccaagttgattcagaatttcaggtagaggatgaagcggccatggctgcaaatgagcattcggccaaccatttgttacctccaaagtccaggacaacttaagacaaatagtagtacaatcatacggatgctgaaattatttggtgcaacatcaagatggaaataaaatggagcataatagaagtgttaattcgacagttacctcgaaggagacgaacgcgaggccgcggaagttgccggagtccgggaagcgagagagctggagcgaccggaggggaccgaaccgctcgaagagctcccggatctccgcctcggtggtggtgtacggcaggccgctggccaccaccttgccggtttcatagatccccgcctcctcctcctcctccgccgccgccgccgctgcgggcgctgggacaggctccggctctggctcaggctccggctcaaccgccgggcgatcgccggcgtcgatgataggctggccccacttgtccttctgggcttcttcctcttcttgctgttcccggtgctgggtttggttcgcggagtctgctcctcagctgccatggccgccgcctaaaccctaatccttcctcccggctttgcctacgcgccgccgccgtgggttatgcggcaacaccagcagaacagcacggcagaagatcaggaccgtctatccacttgggacatggccaccataacaaatgtgttgcaattgccttttttttttaaagaaaaagaaacatagtataaacacgaacgctaatgacctacacgcatttaagaaaatcttactctataaaactgaacaatcttattataaaactctttacgataaagttttcaaccgcttgatttaactggatgagagtcgtaaacaatttagattttttagagttcagtaagaaaatttgtgtatagccttttcctctatttttttgagcggacaatcgtcccattctacttaaatccttgtgcaaagaaaaatcaaacgtatagtcaatgtatacacaaaattagtgtatatgctgcataataaatattacatccgtcccgcaatatagcaaccaagatcggatgggatgaagtgtatatgctgcataataaatactacatccgtcctagaatatagcaaccaagaatcggatgagacgtatccagattcgtagtattaagatacgtcccatccaattttagattgctatattctgggacgaagagagtaagagtaaacggcagctctttacaaaacataaaccttgctattgtgcaaggcactagcagtaccaaactaaagatatcatcattgtgctgaatcatctggtaattgtacaagtcactggtctgatcacaatttcacatcgtaattgactaggaacaaaagattagcttcccagctttgtagttgtacaaggtaattatgcgtcgtccgtagttgaagtccatcgttattgtctgaaaacccagcgctagtacgtatcggtaacttaacgctattgctgccagagatataccggcgatagcataactgccagagaatgttcaggttacagaaaatcccagcagagcaagtcaatattaaggttagagaaattctgagcaaagcaggtgcactgtgtacttacgcctccgacgtttacattattttcacctctgtatagccgacagatccggatcaaaacagaaaaaaatgcagaaaatatggaagttgccacatctttttgcaaactaatatgtttcgtcgaatttaatctgggttttcatatagactagcacagaaatagcaatactcttgagattgcctgccaaaccaatgtttgacattatcccataaagcaagcactcaaacggttgaaaaatcacagttaagaaaaccgtttacatccaagacggatctcacaagacattagtccacaacgatgataatacttctcaaactccgaaagcaccctttttccaggtcatattttggtctaatccatatttgcagaggcactcattttagatctagcaagaactaagcgaatgtgcagcatgggtccctatgccaatattctcagacaatcggaggatactgcttggcctgcagccgaacacgcctcttgtattccgtaggatcctgcaaacccaaagagcacattaaaactacaaagcttgaatatcttagcattattgatttatagtaaaaattagcagaaccctgattggtcactttttactgatggctaacctggataaaaagatggtaaccatcggtctgagcaggatcagcaggattaggctgatcaagcaagtcctggattccaacaagaatttgcttgacggtaatagcaggtctccaaccctgaaagcagaaaatcagaacagttataaatgatatctaaattgggattgctaaaaacctaataaatgcttgtaaagcttacgctgtcttcattaagaattgaaaggcagactgtccctgaaggatagacatttgggtggaagaaaccctgtgggaacttgcacttgggaggtttgctagggtaatcctcactgaaatgaagagtgagaggaaagtatccaccttcccaatcagtctgccaaaagagagagagagagagagagagagagagatgtgcattagttataggcttctagctgcaatgcctttttacaaacacttctctacatgaacagagaagcaatataagaatgtagttttgtaaagtatgacaagcttgagaaagtaacatataagctgaccatgtgcaagaattcaaagcataacatcaatcaacacgttagaaatatagaagactgatgaagtaaaagcaaacaattttgtttgttaacagaaaaaataagtcttttcaggaaaaaaatatatattactgtgttacaccaccaaggacatgtttcaaaggattctgagtattaaaaaaagctgtaacacgtaaatatggacatgtttcaaagtcttaatttatatttgcttcagatagaaggaacattaatatatcctaaatcacaccaaagcacctacaaatggcaggacagcctaggttgccaggaacttactgggtttcatatattttctaaaacactaagataatgttaccagacagtggtaatacatgtaaagatatgaaaatctctggatggtgatgttttgtaagagatcgtgttagcttgaataatgtgaaacttggctcacatcacaactaatgtgcagagcaaggcctgagggtgtgctaacaagttcaaaatgttattacccctgcccttttatgtgatgttttaggattttgattttgttcttcagtagatgatgttttagattttttaggcaacatttttccaatatcaccggtcaccgctaccctaaaaaggggagctataaggccaaactttggattaattcaagagagcgtttggtgtatctaattgaaatctaaggaagccataatattttgatcggagattcgcatggcctagcgttcgctcacatccactcgtggcaaactggtgcttgcactaatcaatgccaatgcactcttgtgggtcattggattagaatgcatgaacatttattattatcattatttatggagcatgagctattagtaatactaatgaaggggcaatttttttctattttcctcagcagttaaactgtgctgttctctgtgcccaacattaaagcgtcatcctttagtgtacggaggtagtactacgcatgccacttttaaaaggctagataaatgtcagcaattcctgctcaaatgctctctagtttgttcaaacttcttctagaccaaactgagccaacaagaaatcgagctattctatctcaaggactcctaacttggtcaaactcctgaaggagagactgcacatggtccctcatgcacgcacatgacacacgcaatcactattcctctttgttgtcttttgtcaaagctgaatctgaccataaaagagaacccgcaacaaatatgaaatagtgttaatccagacctactgagtagtattatctttttcatgacattctactcgcttatttggcctagtaaatgataagaacttgcagaagcccacgtgtataattcaaccgaatttatgtgtgcacttgattttaatgcccagtccatctttttatatatcattcggggcaatactcccttcatcctatggtagttgctgtcttgctgaaatgaagactggtttcaccctttgatatatcatttgaggcaatactcccttctacctacggtttgcagtagttgctgaaatgaagactggttttaaagcatgtaagcacatcatgcaaaagcttggtgactgacagtgaaccagaactcaacttcgatctatggtgaaaacagtttggctagcccaaaaaaaagacagtcttttcgcggcacaaaagcaccacacctcaaacccaggccatggcaacaaatgtactacagcacaatccctaattccgatctcccaaaacaagagggagatggcactgaaataatctccgcctgaagagatccatctgataacacagtggatagctaacgggataaccatcgaaaccatcctggttcagaatcggacgagaaccagagaggcctctcgaatttcaagttgtactcttactattaaattcagtgtagcattcagggcgatgcttaccccttgcttgccggggattgtgcagtgccagatcatgaggttgaccgtcccgtcggccaacgtctccggcttggcgacgaaaccctacggaaccaaatcagaacacagatcagggggatcaagccccgcggcgcgacatgtaaaagggattaaaaaaaaaaagaggggaggcgttgagatcgagaggcaccgacgtgtgggtggttcttccgccacgccttccgctcctccgcgaggcggccgcgcgcgattccccccgacatggctgcggcggcggcggcggcgtctcctccttcctccggcggtgggggtttgggtggggtggggtggcgcaagtcaagaagagggagggccggtcgctcactttaactccgccttgcgggcccacctgtcagccaccgtgggccccacgacgtgccatcacactgcggggtggggaccgcaaaaggctcggggtcgggggggtcgctcccttccttcgcgggtaaggttgggcgcgccgggcccactcggcagtgacacagcgagctgcttttagtggtggtagtagtagcggaattgttttttttctttcgtcgtttggggcatctgattcgtagcgtgagccgtcgtccgatgggcggtcgctgtcgcgcgggtcaacgttggagtagtgtggtacagctggatggatgacccgaccgaaaggggccaaagggggccgggccagaatccggttcgccttccgcgtccttttctaggcttgcaaatggcccgggaatggaatgggatgctcctcctcgatcaacttcaactttggtctggcccagaaagcgatccaaaggcccagcaaaatctggtgggttagaaaaaggccgtgttgggtgggctgcgctgcacagtggctgccgtaccagcagctctgcaccatagtacaattgcgtctcctcctattggctgattggtggtgaccaatcagaactcttctgcctctgcctctctgggctggcattgatgacgctgtttatgaatgcgctcgatgttctctctttctggctataaactgcaggacacagttttgttctgatccagtaacatctctgctccttggcattgatgtactacagtggagtatatatgtgtatacttctaccgactggccatgaatagctggagagaccctgaaaggaaatggagaggtatcctttaaacgcaccacctgccccggtttctggagtactcccacgctccaaggactgtcactgttattggaccattcacttaaagtgctctcccctttggctcttccacacagctatcaaaacctacgagaccagctaggaggagtctaggagtatgctccacctttagaccgcagttgattcaaagaaaatttataagaattttagagcaccttcgaatcgcaagaatggaaaaatagagaaatagaaaaaacgcaggattctgacaagaatgcaagtgtaaaatagagtaatagaaaatacagaaaaaaacacaggaatgaccgtttgattagaccacaggaaaaacacgagaatcaaatgagagaaatagactcaaaggaatttttccaagaggttagacctcttgctaatttttctccaaaatctatataggattgtccatttcataggaattttaaaggattgtataggattcaatcctttgtttcaaagactttcataaaaaaaattccataggattgaaacccttcaaatttcctacacttttcctacaaatcaaagggaccttagaggattttgttcctataggaattcttcctatatagacctttgaattaaaagaatgaatcctatggaatcctacgaaattcttacgtaatgcctaataccatgcaagttttggaggaaatctaacatgagattctacctcgtggaaactttcctttgaatcgttatctctcctctattcctgtgtttttcctgcggtccaatcaaacgatcatttgtaagttgttactgtgttttacacttacattcatatcaaaatcctgcgtttttcctattcctatgttttctcaatattgcgattcaaaggggcccttacttcctccctcttgaaataaatttatttttcactaatcgcacatcccaatacaaaacaaaaggactagaatacatctacgtcatcaaattcaaatgcaactatttctcaatttctttatcctttcaatataaatattttctactttcacaaactctagcgcaacgattattctaaaagtaaacttattttaagacaagtgaaaagagctatccacaattatcattttaaatgtgacttttatcattttactgcccacactatccgcactacccattggtttgttacaactctaaggtcccctttgaatcaaaggatttatgtagaaatttcataggattcaaatcctataggaaaatttcctatttagccttttgattcaaaggattgaagttttccaaatactatgaaattcctatggaatggcatattgcatgtggattttggaggaaatttagcaagagctccaacctcttggaaaatttctttgagtctatctctctcatccgattcctgcgttttcttgtgctccaatcaaacgaccattcctgtgtttttcctgtgttttgcaatcctctgttttacacttcaattcctgtcagaatcctgtgtttttcctattcctccgtttttttctacccttcgattcaaaggggccctaactagttcagacctatatcttacccacattaagaaggcaactacttaacacatgtgtcaaaggctaaaactttactccctctgtcccataaaaaataaacctagtatagggcatggcacatctttttgactaaaaaaactaatttactcaggtagggctcatatgaattactctctttgttgtactgagtaggtatatagcaaggaagatagggaaactattctaatttctcgaggggatgtttcctcgtttgctcaaaaaccatctaaacggtcatgaaaaattctggaaaaatttgacaacattcatacaacacatatatacaacttcacaaaatcttaagtccaaactcaactcacacgtcaagatataaaaaagacaaattcagcatatgaatagtagcgtactgtttatatctaaatttgtcttttttgtttctcgatgtgtagatcgaatttgaacatgaattttggtggactagtaggaatcattatactctacattgtcaatttttttttagaatttttcacaactatttgcatcgaatttagaagaaaaaggtatataaggggatatcccctcgagggattagaatccactcccaagaagatatcgttcttctttgggttaattagacacatgccattactaatttgaaggtttggaaaaataccattactatttgacaaattgtaaagatgccattacaaatcgcacgatactggaaacatgccatgttctacgcctgatcagcgattgttgaccacgtgtgactaaaatttgttcttaatgaccaaaatgcccccgtttgaccggctataccgactggagtcgggtcagcaggagtagcacacattttatcccctttctcgttctcttagacctaaccctagcaggagtagcgacgacggcggcgacgtcatctacggcggccgcggcaacgacaacgtctacggcggcggcggcggtggtggcgacggcgcgggctacgacggctgcggcggcatcttcggcggcggtgacgacggcgtctacggtggcagcagcggcgtattcggcggcggcggcgacggcgtctacggcgtcagcggcgacgactctttctttccatggaggggtaggaaacgtactgcaagggatggagcccaaatcaaggtaaggtagtcgattccttcgattcgatgtgctgtgagctggatgtgtaggtttttttttctgtgcattccatgtgtggttgacttgatttcattccaatgtcaatacactgttgttctcgatagagttaaaggttcatggttttaccaccatagattcggatggtagacggaggtatactaagggttgtgtgctgaaatgggatgttgagtatggtagcttctctttggatttgttgatgctaagcttaagctcagaggttagatggggtgagcagcagactgcaaccgtgtggtttttggacaagggcagtaatgaggacgttagaattgtccatgaatctcaactggttgacatgtttgaaatgtacaagtcagaaatgcatgctgaattaatggtcttagttgttgagagtgtactctgcgatgctagtgctaataacatagagccaacatcaatgccattgtgtgttcttccacttactcagacagggcagggagcatctgcatctaaagtggcagtttcaagtgaacctgcaactcaagaagcggatgaaacattgcctaatgtgtttgacatggaggaggagtatgtgggtgttgatgatgagggaatttatattcaacctattcacaccattccacctacagatcatgctgaaacctctggtcaacctagtgctgaaaatgctgaaccatgtgctgaaaatgctgaacctggtggaccttctgggactgctcaacctcatggtgaggttgaggtcactgatgatgacccagcagagtttaatgttcttcataaccctgagatgccaatgattaaggaggaagctgtttttcctgacatgataacattcagaaaagctattaggcactttgcggttgttacaggatttgaactctctaatttgcaaacagatccaacaagactcattgcccactgcaagcatgaggggtgtaaatggcgcattcatgcatcaaggttgtctgatggcaaaactattcaggtttgtatgtcaatttgcacatttgtatccattttgcttgaaagttgtgacttatagcactatttaaaatgtgtgtgcagataaagaagctaccatttgcacatgagtgtcccacaaccaagctcatggaagggaagatggccactcaagactggattgcagatagactgaaggattggttaaagaaaaaccctgacaagtgagctaaggcagcaaaagagaaacttgaagagcgatatgagatcaagctgaagtattcaaaggcttgggtaggaaggaggcttgctgagaaccagattcatggcacttatgaagatagttttcagctgttgttcaactggaaggcagagattgagaagaggtctctaggtacaattgttacaattgatttgcagaagttagggaaaaatatgtgtttcaaaaggatgtttgttgctttcaaaacatgtgtagatggatttgttaatggttgtaggccatatataggtgtagattcaactagactaactggtaaatacactggtcagctagcctcagccacatctgttgatggacacaattggttgttttatgttgcatttgcaatttttgactcagagacagatgacaactggttgtggtttatgaaacagttgcatggagctataggtgctcctgaaaggttagtcatatcaacagatgcatgcaaagggctagagaaagctgtaggtgctgcatttgagaaagctgaacatagggagtgcatgagacacctttatggtaattttatgaagaagtttaggggtcctattttcacactacacttgtatcctgctgcaagatgcttcacagaggatggttttagagatcatatgcagcagatttataatttctgtcctgaagccattgattacctagacaaacatcattcaaggatatggtataggtctggtttcaaggaaacttgcaactgtgattacttgaccaacaatgcatctgaaagtttcaataatcagattaaatctctgaagggtctacatctccatgagctagttgattctcttagagagttattcatggagaagatgtatttgaggagacaagttggtgagaagttgactgatggaatcctgcccagtgtgattaaacagctcaatgcagcaacaaccaacctgaaagttgtaaaggttgctaggagtgatgatgacatggctgagatcacattggttgagagtgacaacaataccagaaggcacactgtgcatttgatcaaccaaacatgttcatgcagaaagtggcaggtttcaggaaaaccttgcaaccatgccttggcatggatatgttccaacagaggagttgagattaaagattttgttttagagtacttttctgttggcatgttcagagcagcttatgcagggagagtgccaactatgccagacagatcacaatggcctgtggtgaatttaggcttcaaagtctgtccacctagactcaagaggggtgcagggaggcctagagtcactaggatcaggggtgcacttgaaccaggggcaagaagagtgcgatgcaggagatgccatggttttgggcactttgccaagacttgcaaagaggctgaagcaccagaagacactgatgaagtgcctactgcttcccccaagaagaggtaatatgctgcatggttgactatttattttgaattcttttacatatgttgcatttgctaactaacatatccatatcactgtttgcaggaagaaaactcaagatgaaagttcatcaaggcctgctaagaagaagaagacacccaagaaaaagaagacgcctaagaaaaagaagacaccccagaagaagaaggatgctcgagctgcctcagaaggcccagctaaagttgttagaagcctgtcacaatatctacaatcctgaagcttgtgtgttttgaggccttgctgacatgccactgtgatatgcactatatattgtattttgatgccttcctgacttgctgtagtgatatgcactctatattgtattttgaggccttcatgttacctgccactgtcttgaacctgtattttgaggcctatgttgcctggcactgtgatatgcactgtgtgcaacatgtgaacatgcagtgtgctgaaattagtccaaacttgtgaacatgcagtccatattgtgaaatattgctgatcatctgaacacatgccatgtgaaatatttgttgctgatcatctcaacttataccatgtgaaatatttgttgccgaaatatttgttgctgatcatctcaactaataccatctgaatgcacaaatttcctgtgaactcattttcctgtacttctttttcatctgtctcaatgatgggcagtcttttcaaagaggaaataaaaacacagaactttcagttctttatatacttcacaccaaaagatatttcgatgtcctataccttccttttttttacaccaagtgaacatatattagcatagctttagtgtaggagtcagcagttagctcttgctgcaaacacacaatatcagcttgtaccttgagctgccagacttatccttaacagagcacccagagtgggaaattaaatccacataattaacacacctatgtcattactcagaaattgaatccacataattcatagacagtgattaacattacacagaatggcactgatttacctacttgcaccaaatatggccacaaaatttacagaacatacatagaaatacataattatggccaacaagaacaacatcacataaagttgtctactacgactacacttctcttctttcaacatcttctttagctgctcacactttttcttagaatcattcagctgctgatatatggattgcatctgcctatggtttgcctcaaccaaaccctgcatcctcgacctctcttccttatgctcttctgcaagctgtcgcaacatgtctcttagaccatcgtcctcgccagcatgggaataagcaaccatttcctccacatattcgttcaacagatcctcccatatccacaacgagcaacactttggctgcacaacacatctcaaatcaatggcatcaatcaagaaaacgaaacaaaaaagaaaggaatttcaacaaaagaaaatgaaaaacaatggggtttacctctttcccgcactgaatccaccgccgccttggattcctcggggtgttggatttgttcactacagcggctttgccgcaagcacatctcaaccatggtgccgacgacgctgcggcccgtgtgcgctgaaagctgcaaccgctcaagcccgtcgaatgaatcgggctgcctctccccgccattgccgccaaagcccgccgctgccgccgacgctgccgccaccgccaccgacgccgccaaagcccgatgccatcgccaacgccgcctccaaatcccgccgccgccggagaagcctagtgttaggtttacggttcactgtgaatgcacttggtcaaactgattccactcggtccctacatactcatacataagggcattatggtccatacgtaaatacggtacgcataaaaacgagtacaatcgcggatcaggcgtagaacgtggcatgtttccagtatcgtgcgatttgtaatggcatctttacaatttgtcaaatagtaatggcatttttccaaaccttcaaattagtaatggcatgtgtctaattaacccttctttttaagtggtctcactttcctagaatagtaagtggtactgaagttgatatgcatgtattctatgagatgggtttctctgattttcatgagattattatccatatccatatgggcttatagcgcacacataattccaacaaatccggcctgtcaactcgtcacacagcttactcgacaggttcgttaacgatgattatattagtctaagtgacaggtttgttaatgatgattattaattagtcgagcatacagaatgtagcctgtaggttgcagatatcaagcggccagtgatcgtggtcccggatggacgtacgaagctacagaacgtaccagtagaaagctccccggggcctcgtggcggcatcgcgtccacaacaaagagaggcaacgagccaaaaactaatagtgttatgttggtttctttcatgtcgtcgtcggtgaagggcaaaaaagtccatagacccagtgggtcgataaataaatactgtcatgttgattaattactactagtacttgtactcgtataggagtagctagcatatatgctcttccattccatatgatatagtcaaattaaagcacccgtgtgcactttatatgcacgactattgctttccagaatacaaagacgtgcacttgcgtccaacaattcacatatatacctcagattagtgtaacacagataattcagtgtatagcacaaccattcaagttacctatgtatgagcatttgtcaactaattaaattcgacaagatcgagccctaaaagtcagttgacaccaacatcaaatccacaatttaaaatctgcctagtgcatactccctcttcccctaaatatatatggaaccgactcctctgactttagcatttaaagtcagggaagcacagtaatttgagtcttatgctacagtacaaaacaagaacgtgcggtttattacggcagcaatagtgaaaaacagtggatttgactgcacgaggtactgtccaccgatttattgtaccgatcgatctcgttcgtacattgtggatcggacagttaaaaatacctccaaaatcatggcaatgtagctctctgatctcattcccctaaatataaggttttaggttggatgtgacacatcctaatacaataaggggtcacatccccacctaagttgagtttttttaggactaaataagtatctaagtgtaaaacatcatatatcaactcctacacgaaaacaaaactctgaaataaagatgtagtccggagtagataaatgagttcttgataagaatggaagacctagccctaccgaccaaaactactcggaactataccctaacttgtctcctgagttcttttggaacaaataaacaccctaattaataaggcctttaaggaagggagatgatcgaaatatcaaaccaatgcaagttgacacaagccaatacaagtcacatccggtcccatcaattgaaatccactgctctataaagttgcttcatatatatgagcagtgtgttggccgcggttatgtaatgggtgtgtcctcgataatggctttagcgcacgtgacacactttttccccccgaggtcacaccattttgcatggtaaattccctaagatgatatttgtacaaaatatgttgattatgtaaaccaaacaaaatacatgcattttgttgattttgtcttcgccttgcacctatgctcccaaggacctcatgtgcttgtttggtggtcactctgcttagctctctcgcatgttactatagtacccttattgcttgctttctctcattgataatccgaataaggattaataaaattgaacggttttcgtgaaaacaacttgattttgatgaaactgtcaatggtcagtttgtggaaactgaacggttttggttgtgtttttcgtacgatatagatataaaatggttaatgttttttcagtttccaataaaccggtgagaagtggtttttacattcaaacgaaaagctaaaccctgatccgaatggtccagctgtccgattgtccaaacctgcgcaggctattcatcataatcgtcatactcccaaccggtcaagagttgaaggagcagcaggcagtagtttggcctggtagtaacaacttagtactacagtgtctgccgcggtagagttatggctggctatccgtacaacgccggctcactggctaccacaaacactctactgcagtctccagccagcaggctgcatgcaggtgccctctgccgctacaagcaaagcacatgcctccctgcctccgccaaatcggtgagaaaacccgcgagccgaccggctgctgcttggggccctgaccacacgtgaccagtgaccacggtgcgtcatggatgccggcctgcagcctatgacgacgtgctgtacgtatacggtgtgccgggttgtagctgtagccattccggccttgcttccctttttttttccttctttttttaagaggattccttgcttccatttggggcctgtttagttggaaaaaaaattcttgccattgcatgtcacatcggatatatagatacatatttgaagtattaaacgtagtctaataacaaaacaaattatagattccactagaaaaccgcgagacgaatttattaagcctaatttatccatcattagcgaatatttactgtagcatcacattgtcaaatcatggcgaaattactctgtgtaattggttttctttctgtctacatttaatacttcatacatgtgtccaaagatttgatgtgatagcgcgaaaaattttatcgggactaaacagacccttgattggtggcaacttgcattgcgaaccccgggacactgcccttttccctacgtttagcttccactggttgcttttaagctttgatcttttcttcaggttttgcttttgcaaaccaaaaaacagtggtgggaatgggatatcaccatcaaagtagtactattacttattagtgactactactatagtactccatttgtagctatatctacttgtactgcgtgttttccatatatgcacacatgagatcttaagatatgattcgccttgtataaggagcacaaagaaaaaaaaatcaaactttttaaatcactagtattgcatagagagaagcaagtgtgtctataatgggggccgcaggaa

SEQ ID NO: 19929 - DNA, 5213 bp, Oryza sativa
tttccatgttatctttttttttggcggaggaaatactaccaacactccatcatttgtcattgcacaggaacaatatgcttacaagtctgatttggaggagtagtaaattattggccacgccgccctccgtttcccttcgtctctctagcatcctcatggtggctgggggaagaggaccgctctcttatcgcatcacataaatttgagtttttttcaaaaagtaatagatatatacatttatcaagtagtctagtgtttgtatttcatttattcgccgttgtcctagcggaaaaaaaaatctatagtcctttttgcctttaaatctctgttgttatatctactttatctatgaggttctcgatggagactttcagaaagtcttttgttttaattatacctgctttattcatgagattcttgactgagactttggaaaaatcttgtttgtagggctgctgacgatacagttgatggtgttgtggtattatgactattattacaaagttgttcgcatatttctgtgtatgttaaatttgatcagttgtgagattacatccgtctgcttatattcttgcagttacgaacaatctacgaacgatttggagtctcttttatcatggttatgtggtccattataatcacacaaaataaaggatacaaacatggacggatataatgggaagatgtacccactcagaggcacacctcatattcgagatcgcaaccagaccatgttgctaattggagcaggggcagagatatagaagttggtcaactagagctgtagttatactaataaacctaaatatatatccattgaaatcgtattaaaatttcaacaactagaagataaaggcaaaattatgtaaattacactaagtgtgttcttgagcctgtcgaaatcatagtaaatgaacagagatagagaggacgaagaagaggaggtaatatatgaatgcaccactgggacgcacgttaatatcaagttaacgcatatcatcctcattgtatactttcaagaaaatggtgcaatgagaaattaatggatcggtgtttcaaataaaacatcgtgcaagttttgccactttctgaacatataagatgaatgctttgattatttgagttatactctctctgttccaaaaagaacccaattctatatttaaatccggacaaacactatatcaaaatttaaatccagaattgggttttttagatagggagtagtagaaaaacgaacaaagcaatcctatatgttttatcaacggttctagaaagcctatgataaaatataaactatgttgacaaaaaatctaaaattaagttttattttttccatgactaataagccagatagaagcaaataaacaaccacttgacgaggagagagaaatatagaaatgaagttgtaaatagtagtacttaaaaatactatgataactttacagttgagtcgttctgaattattttaacatagcagtataatatataaataatgatgaatagtgatctatacgatgcgtacgggatacaagtgggtgcaccacggcttccacttgcactgatttaaataggagaggttgtccctccgtcgtcctttgggggggcgttggcacgtgaaagtctcgtccgcagacgatccacccagctacgagacggcagtgggcatgaacagcgttggtgtgggctggcctgtccacgtggcgctctcggaatgggcattccgtacggacgctggtcctaggacaccgacctgtttgctccaccctcggactcgctcgggattggctaatgcctctccatcaaaaagatgtggtcccaggcaaggagtagtgttgttttgtccatcaaaagtttactccaagactgacatgtggccctatagatgcatgggaccacgatgtcattgagcttgcctagctggttgcacactttcatgtggtaatgtttgatgaaaagtaatggagagaataagctgacggtgtagggccatgccgtttaggagaagctgatggcgttgtcaaaagaataatttggacctgccgttctaacattggcctcgtttagttggggaaattttttttagtttgttcgtcacatcagatatacatacacatatttaaagtattaaatgtagtctaataataaaaaaaattacatattccgccagaaaactgctagatgaatttattaagcataattaatctaccattagcaaatgtttaccgtagcacaatattatcaaatcatggcataattaggcttaaaagattcgtctcgcaatttacacacaatctgtgtaattagtttttatttttttctacatttaatactccatgcatgtgtcaaacattcgatgtgacaccgtgaaaatttttgttttggaaactaaatagggccattgtagatcacctttttcttgcatcctccaccttgtaaaacaatgaaattctacttttttcatcatacaattaagaggtttggtttgaaaattcaaagatgccatttaagcatccaccaaaaagacacgaaccggcgtgtgaggctagtatcaaagcagaccgggagtggaaagtgacatgctagaatctggaaggaatggaaaatggtatccgctgtaacccctttctattccatttttaattgctcccgatactttaggtccacgaaaaatatcccatgtagagcatcttcaatgtgtttgctatttttaactccctatctaagcagcaagtagcactccagagggctacctaaggctgagtttttagtgagtttggtctgaaaaatccttattaattatgaggacggttcttaaatcgataaacagtacattatatctaacacttttctatatataagttctttaataaataaataaatctattttttaagtttgtaataattaatactagattaatcatgcagtaatagcgtgttgcaaattagctcatgcaaatcgctcggtccaagggagcctaaatctcacttcctattttcatccacatttttctacaagtatcttgtaactaccatcaacaatttattcgcaccaaacattccactcgatttatagttcactaaaaattcaacaccaattctctagtatatttaactatttaagtacaaatccagaaaaaagaatgaagcaattccttagtacagatttactatcttcccatgttctgtacacgttcatcagtatcaaattcggtacaatttcatcgttataaaataaagatcagcttagctctctcgagctcagagctcccctcctgaacgccagttccctacctcaacacttctcctctttctcggctagagctatagaaggtccctaaagcctacccgatgttcgaagtggaggagatgcggctcatacctagtccacttgagctttgtttttgggcaaatcaagctggagtttggtatgaacttcatgacaagacttgtatgtagatactacccacttacaatagtatagttgacacaagaaagagccagaccattaatccacgggaataattcctttttattattcttcactcctcttcaaaaccttctaaaactagcaaaatattcgtatgccattatatatgggtttttttttaaaaaaaatatcatggacatattgcaaataagaaaaaaataatttatttctaaatttagtcatggttttatgtttctttaccttttaatcattgcttttggaccattaaaggtagatgttaaaggtgtaaaatatgtaggatcgaatcacaagaactaagccaaccatagggggggtgaatggttggtatacccaaaaaccgaaaaattttagcggaaataaaagttaccctcgaaatcgatggaagtcggtctgaccgagattgatctgccggtctgaccgagtcgatgtcgccggtctaaccggtgatgaatctccggtctgaccgccgagatcgcctgccgcgcctgtcgccgctgtcggtctgaccgccgtgctcccgccggtctgaccgccgcaatgccgccagtctgaccgccggtgagttgccggttagacctccgaaacccggtgaaacacaaatcgaagaattcttaaagtagatgacgactttattgattctctctgtgtttacaaagtgcaccaacagcactccttacaaaaatttcgactaaactcgaaaccctaactcaaaactcaactcaattgctctcaaaagcaataccgggaagcctcacgctccccctctatttatacatgaggtaggcagcctaaagccacgaaccaaactcatactaagagtcctaaacaccttaggaaaccctctagtacaagaaagaaactttacataaccaattgtaccaaatttggactccttccaaattcgactccgcatcccatacgcacacaataactccatcgtatgccatatggaatctccatcaaccacgtgcatcaactctagcctaagtatcccgcatgatctttgaccaccacggatgtcgtcttatccccaagccgactcccggtccatcaccgcaaatactctcccgagacatcgagtcacctacacatggaacaaacaaagaaaccatattccgagaccaagctatctccaacttgactcatcagcagcaaacaatagtattacatacgtatagtatccatctagaagttataatcatgaaataaattcggacatctaaataaacaacccgaaaccgaaaccgacacagaccgcgggctgcgccggtctgaccgcgcattacacgccggtctaaccggctaccagagctcggtctgaccggtcacataaaatgacgaatcctgcgatcacgtgtgaaatccaatcatatccaaaaccacttcgtgaataaattccaaataacaaaaccaataatctccaatgcccaattgttcatcacaaaataataataaaaaacacctttgattttacaaaatatttaaatgcaaaaacgactttcacgtaggttccatgtgtcagtttaggggacttggtggtgggagtggcagactcaccatatccaccactcttttttttcttttaaagtagtatagatcttctctgaaagtccactaggagtcgatgttaagcttaatataacatcggcttttatctcatctcttgatccaaaaggaaataggagcacatgtgatttgaaatgtcacagtaaatcccagtgaaaaaagcctaaggaagtga

SEQ ID NO: 19930 - DNA, 11006 bp, Oryza sativa
  unsure (1)..(11006): unsure at all n locations
tcctgcagcccgtataacatctgcactatgcagatgccatgctgccctctctctctcctcccccaagaatctgcttatcttgattatttcttcgagctctttgcctctttcccccaaccgcacgtctccgcccgagagattctcgcctggattttgccgacgagtgcgtttctgatctccttcctccaatcctcatgcttgcttgctgcaatctgggctcaactttaaagtgtccactgccgtctggctataaggacagttgctactacatgtaggggattcactattatacccgataaatttaatgacgacggccaataggaaaattcggcctgaaaagacggcaaaaactatatttccccgtgtggcgattgaggtcagtctagaaatttgtcgagaacgaacgcacttaatgctttgtctgaacgaacgcacttaatgctttgtctgaagaaatatttcagaatccctagagcaagtttaatagcagagctcactgcttattataagtcaatgttggagctaacttgtataacaggttagctataaggttaactttattttttccattctctctctttctcactctatgaatttaatgcaaattttttggagcttgtgtggagctggctcttgtatgagagccaacactacccacttttttttatctctctcttttacataagcatatagcttgcttatagcccattactattcttgctcttactgtattttttgggggtccgggctgcttagacgtacggctagttaatcagtgatttgttttgcaatacatgttctttcttgggctacttgctgttgctatcatttgggctgacatgacgtgcagaaacaaaaccaatgcatgtgatagtgtactgctgctgtatgcacgcactgtggtggattttatttcctggccacgtactgtattaactagatagaattatcggttccacatctaggggtggtctattgcttcattagagagtactactatgttgtattcagtggtacataaccaccggttctttacatctcaccggctaatcttatcaatttccaattacacatgacttaattagtatacgctagttaactagtgtattagaaaagctatgctaagctactgaattgccaaacttcactttgctttgttcagttgccgtctaaacagtcacactacttccataaagaaattagttgtgagactggcaaggttagaaattctgaaaacataggcaacttagtactggcattccggagggcaatatgatatgagcactaattagttaatgataatgtacgttgcagtaatcttgccgtgcatatgaatttctatgcgtaacatgcatgaaagcacactaacgggagtttccagggagcctccaatcttattaatgctgtacaactaaaacaacatgtagcttattgccaaaactgcatacatctaaaataataatggataaaagaaaaccatgaaattctatgtctctgatctttctcgtcgtctgaggtcattacctgaagataatatgtaatgcacccatgtgattgaatacaaggtaataataatatatacatgaacatagggtgggcactgactaatatgaattaaaccaagataatacttggggtggaacctgagaaccacgttattatttagatatggcagccgaccataataatccagaatggtagaatgaaacaaacatatttgcttaccctacgattgtctattagtcaatatggatatttgccataatagacataaataagttaatgtggttcattggtcttcttgaatagttagtacaactagcatgtattcaggtttgtgcagaaattaaaacaggacacacatattttatctgtcagttattgttttgagttaaccttactgaaatatatgtgtaaaattgtgtactgcaagattattttcagctgattttattgatgcatgttttgaattagaaaaggcagcattatctcctaaaatgtgtcgtataaataaatatgcattggatctgttttcaacaaaaacatagactatggcaattgtaggtgttgattgaaagcatgcaataacaaaattttcctgtcccttaggatagaaaaggctcctcttaccttgaatgcaatagagctctttgtcattatggtttctttgagaagaactttgggttgttggtttcaattctctaatggaattagtaagattattgtgtgatcataatttggagtaacatttcccattacccctatgtacgcaataccctttcgtttgttacatattcccttaacttgcttacttatcataatgccacttgttagtttccctttataacaattgtcatagaatagttctttgtcgcatactccatagagcaacaaataacaattttagttagtttgaataaaaattctgtatttaaatttcaagatttcatacctataggtgtatgtatcttttggcatgtttgcaaccttttattttggatatagacattttagtttttagcatatacatcaaaggatgttatagcttccttatccaaactaatagaataaaccaaagaatctatgatagagaagacattacatttggatcgctagcttatatttcttttatcatgcatagcaaagagaagcaaataaaattatttggatgcaaagtctgctaaatgacgatatgcgtgtgtgagttcgtcattgtttctacgttttcttgctcttgtgggtgtaggcccaatttggttctctaccagcgcaaggtctttgatgtcattattagccttttcttttctagcggagcgagaatcttctagcattaccaaatggcatgcctttcccatcaaggataggatttttcctttctagatatccaagcgtaccctacattatctcacccaatgatacttctctatcattgattattcttacttaaatttcaaaggattgtaataaactttcgttttgtgcatgaaccttcatactaaaagggtaaataacacatagtttgttaatattaattttatagataatatataatgtttggggctttgcataacatttgggtataacatgatatcatctgataaaagttggtaaccaaaagaatatatcagcatgcatgctttcagcataaaaaaggaacgcatgagtttcgtaccaaatttagtgaaccgttacatgtagagaaatgtggtctcaaactcaacttcaagatcataaacagtgcacgtatcacttaaaaaaatgagagacaaaacattaaaaaaattatgaacacaagttacaatatattatcttgaaataccatctcatttagaggatgagttccttaactcaatatccaagtcttcatgatcatttgttgatgaggattgagaccacacttccttctcttttcctaattggatcaggaatatgccccaaatctgaaaaaaaaaatcattgaaaaaaatcaccgatatgccaatacatcattggtaaagtctataaatttatcaacaaattttcaacgccatgatattactaatacacgttgacattgggcctttgttgatgctatgttccacatcaccaatctattgctgatatatacaagcttggaaatgataatgaccaagccatatagtatcctcttcctaagagagtatctaatataagatacgacatcaccttactttttggtacttataatcatacattgatgtgtcaagtatttagatactagtgatatgcacttttggatatattcatttaaactatatccacattttcaccatgaatcatacaagatttagcataaggttcattttggctgaaaattataacttaattctaaagtttttagagaacctaacataattgtggacatcatcatggtcttgtgactttgattcaagttggttgggtgatgcacatcaattgatatctatgatagtcttatagtattagaaaaagtcatgttcatcctagacatttgcatcatgctccaatgtatttttaggtgttcagtcaaagatcatgaaaagatagaacaaacacatatggtggcttccatggatgcccctatgctacttttagtattagaaggaaaaatatttctggggccttttgaggtgtagatgatttggtaattccaatattaaaaaaaaattaaatagttgtatccaagctaattcaacattcataaataagaacatggaaaaactagagttggggcaaatccatcttgtacctcattttgtgccattgccatacaatattcccgcggaaaacgtgtgtagtttcatctagttttatttagattgggagaacgaagtactacaaagacaacatcaagtctgatgtcgatatatctaagctagcgttgctactttgacaaataatgagctaggcactagtttgaaactgccaggcactattgccatatgttggtgattggtcccactagccttgtcacatgcaaagtccacgaatcctcgttttcgctccgtgctacctctggtgaacgacacatcccctaaaagacgagcatttatctctttctagagaaaccaagaatagtgtatcgttgcgttatccaaaacctatcgccctattttatccaaatgataatgttggctagtgccattgcaccattactctagcatgatctagcctcctaaacacggagcaagatggtcagtaatcctttaaaaaaatctcggaccacatataaatgtaatagttatagctaccactctttgatgttcgaaaggaaaaattcaacactttataaagttcaatacctactttacgtacataaaataattaacactatcttttgtatggtaggtatttcattctttttcaatgaattgcttttggatttctcatctaaccattactctttaatggccacacaagaaacttgtcacaccctgccctttcaccacctagcagtgacacctgagagggtacgccgtaggaaatcaacgcaagctgactcccctggaaccacgataacggtactagtctcaggatacaattgctggtaccgcggtcaatcgagatgcaccatgtcaactaaacgcggtacatatatattatacctttaagagttcacactttcggagcaacttctggagtgtaataggcaatcagggtagcaacagcgaaaccttgtgtaggtagacccaatccacaaacaacggtttgggatttgtaaggaaaccctaaccatcaagttcacttctcttctcgagaaggaaaaaacggcggttgagtacatacgtactcagtaagtcatgggtaactgagaatgcaggctggaaaggagggttgggtttgtttcgcaaattttgaaaacatttttccaaaacactaagtgtggcattgtttaccaagtggtcggaaagaagcatatgccttgatcttgtccgcgaattgctttgcaacaactcaagcggacaaaacaaatattagttggttaaaattattctgccggttgaccttatcatgacattggtggaacaccatcagccctcaggcagcttccaactccttatcatgacattagacaaatattagttccttttcactttcaaaccatcaaacgttagcccatctcatcaactcatctctttgggtcctaaagccttccatagtctccaacacacaatgctttccttcgggaaacctaatatatgacgctaattgacatcctgatctacacaagattgtttcagaccacgtaatggtcctccatcagtcaccacgactgattctggtaatgatttccaaacccacaaaccactttcgcaaagcataggcaaacaaatctacgtgagaggaatcgccacacattcgcccattaccatttgtaagactcttcgaattagtagacctttacagaggttgtaaacttcacccacaagatgcgatcttactccttcactggccaagctgggaaggtttgtgacaaggcctttccaaatccaactaggggtacctcatgtcacatagaaggattctctttgaactgagcatcagggaaacttcggccctcgtctactaaagaatacgggatgccgctactcaatcgtgcataacacgttaaactttgttttgtgcctagcgcaacaaatcaactcacatctcctcatccggggcattccccaactattggaaacaaggcatacttggccaactatttacttagccagaggtgccccataccacccatatagtcgcactatgagaagctcggataaaattaccaaggaataagtccttatatgcaaaatataaaccaccgcgtgtcagtttttaaaaggattcacaacatatttttccacatcaacaaacaagggtgatgtgagctcatgagcacggtttaccgaggtaccacggggtggagcgacaagggattgggggtcatcagcgtcctattggagtaatgcaactactgggtaggtctgttggttcgtcgtgcgaactgagaccagtcaaatttaacgtgctcactagcaatacaattcgcaaacaaaacatttctaaaacaaggagcaatatgatgaaaaagtgccttgccactgtcttcgtcttcgaagtcttaaaaaatcttcgtccgaaataaattttgtcgtcgtcgactacgtgcatcaaagagaaaaataaacaaaatcctaaaataaaataccattgttaataattataagtgtcatttggtagatttcaatcttagaaaaaaaaatggagacttgaatgggatcgatcggagttacgaatagggatatatgattttttgaacatttaaatgattttctggaaatagaaaaggaattatttgaaatttggaaaagaatattctttggatcacaagtagggatgcaagcgggctgaccggtgaacctacttatctgtcaaataagtagtaacccacgggttcacgcattgtggtccggtttgtcgcacctagagatacaagtggattgatccataaacccatatatagatcaaattaataggtaacccgcgggtcaatccgcgggttatccactattttgcttataagcgggttcatgggttggcccgcttgcatccctaatcacaagtgggtccacaagtcattgagtgggtgaagaaggagataaactggatttttttaaggaaactgggggcacggacttggtctttagcccaaagaggaagaagggtgacgagggtcataaggacttggaaatgcagtgggttgaagtcgacctatgcacacgtgtcctaggtggtgagaggctggcgagtgggagtgtaggggtggtggcccgcagcggccgacgtggtaggccatgcaggctttgaccaaggaaggaggagactagctagaaatatcgatgacaggtggcactcactagcgcatcactaatttacggtggtttcaagccgacggagaccattggcacattgagtgggcaggtgaagaagggtgaatggctcggatggggtagatgatgcatgataggggctagtagcgtggagccaagtgtggcggcgagcggccctcgctgtgcggcgaccaatagagcggtgacttgggtgtgtgatggttcgggtgaggtgtgactcttcaccaattgaagatagaggggagaaagagggctcatcagaggagaagaggagaatggtggcgacaaaacatcgacggatgagatttggggaaaatagctccatcgatgaatagggctcgggggatggctggagcgtggtcgcttagtggtgatgagtgtggtggtggcgttgagttggttgttttgaggttggtggtggtggaaccgcagtgggcagagtgatagcgactgacatggagcggcatcgtgaaaaggtaatggtgtcggtttaggggctcgatatggagggatggacgcgcgtaagacgttgagcgggaaggatggaaaagaaaagaatcgagagaagagagggaaggaaagggatcataaaagagagtaagatgggaggagagagtgggcttgacaggtggttctgtggggagcacggtcgctaacatatggacccgcgcgagaggtggtgcatgcatgcatgttgggcgtgtgccgacggccttgcgtgagttaaggagaggggatcgggccgttgctgatctgggttgaggggagagagaggaggctagtgttgggctaggcttgtggtgcgcgggagacttgaggaagagggaaggggaggagggagaggaaatttttagggaagcttttgaaaatttctagggaagctttctagaccatgtgcatagtaacaagtgaaaatttctagggaagcttttgaaaggctatttgaggatttcgagttcggatttgaatacaaatttgatatttgaactcaacaaattaaggggattcgaaggaaaggaactcaaggaatttgttagaatttgataatgagaaattcaagaggatttgaaatacagaaagtaattttggatcggggtttttgtggtcgagggagagattcaattgagacctttggcacctatgtccttaatcacacacaatatttcactaatgtggtaatgggcaattgcatccattcccccactttcaatcccaactgttgttttacccccactttttagggtttgcaaatttgcccccacttttttgaaaacaaacctgacggttgccctcacttttgacggtgttagttccaggggcgaaaggacatttatatctttagtggttgttgcatttttgccccctttttttcatcgtgtgattttaccctattatgtaatgatataagattgtgataaataattcaaatatgagcacatctcgtgtgatgtttttgtactttaacaaaaaaaatgacaaatactagtcaagtatagaatttgaacataattctagcagcatttcaacagaatttcgacacaaatagcacaagtaacatatatatagcaaacattacaaattgtccaacacaaataagccacaatacatagatgtcatagaccacaaacattacttagtgttacatagtcataacaacacacattacatgtgcacaacatagaaggcacaataccacatattacaagtccagatcatattgcaagtccatattagcacaaaagtgcacaaaattatttaaaaggggcatatagatgtccaaatcatgcaaaccatgaagctagcctccctcctcttcattgccttccccttccacctgcatcgccactgccacttccccttccacctacatcgccactgtcacttaccctttcccttgcacttgcacttgatggttaagagagatcaacaataacaaaataagcataagcaaaatctgaaataagcaaaaattgaagataaatataaggaaagagcaatacatgactcactttgatgtgcaacacttggttcgttgttcccctctctactgttccaatttctaaagatgagtgcctcctcttttgacttgctgtgggacctccttggcaagtcttggccgtgtggcctagctcattacattcagtgcattattttctcttactagtgccagcctcatcacttgcctttatcctagccattcttggtctcccagggttccgtaacaatttaggctcttgattttatatcctatatcaacatgtccatctatccttcaatgtcactggactgaaagtccctacatatgccttcttgaacttctcaatggagaaccagtcatccacaaaatcatcgatatggacatccctactaagcttcgcaatgaaagctaaagcatgaccgaaaggctttccagtcacttgccaaaccctacaggaacatgtttgttactctccaaatgtactgcatgcctaaaggtgcccacagttacttcagctgttccagcttcacatatcaataactcatgttcctggatanttctttggccctttagcattcagagactttgtaatagctggaattattctttcctccatgttaccaacaatattccatcttacaacaaacttgtttgtgatgatctgtcttattgcatcatgcatgtccacaatccgtcgatccttggttgttgagacccaactattgaagcattcagaaagattattattgatgtaatctaccttgcactcttcagaaaatttggttatgctctaaatgtatgaatgattgttatccaaccaggaaagtgcatcggaacacttctcctctatctcactcatgaagctgttggtagccgctcacatattttgggcaaatagagggccatggaacttctttttcatgttcttccacaagtgcctcatgcattctctatgttccactcctggataaacatcatctacaacactctatattcctttgcctgcatctatactaatgaccaaacctacaataggactatagttcttggttattcagttgaaattgaatagatggagcatgcaagaaacaacttaaagaatagacaacttttggagtaccaatagctttgttcatgttctgaacaaaccaagtccaattttccttagattcggtctcaatcaccccatatgcactggaaaaagtcagttatgaccatcaattgcaacagctgatgccaactggcctctagaccttccagtcaagtgagtggagtatatatctatgtaacgcctacatcctttcaaaaacccattgatatagggtttgagagcaacagagaacctcgtgaagcagacatcaccattgcactctttactgtccaactcatctaagctgcttggcactgatcttaatagctcttcacgataggtaggcagaagatcgtagctgtcatcccactttccatttatcctctgaagaccctaaattataggatattaatatggtgcttgcagatcctatgctccccgttgaggggttatcccgcaacaagtccaccactcgatcaactacccacttagttgaggccatcatttcaccatacttgttgaaagataaacaagtgcgctttgg

SEQ ID NO: 19931 - DNA, 1867 bp, Oryza sativa
aggtaaatcgtcgtcgtcgtcatcctcgtcaactatttcttgatcaggatcaaacttagggtcagagcaattagagtcagtagattcggccaaatctgaatcatagctactatcactatgtgccacaagtgattcagtgtcagagtatatgccctcatcatcaattcctaccgcatcgttatcatttgaaccctttttttttatttcttggctctcttttgtgtgtctctcatttgtggctccctaatttgtagcaatctcacttatccatgctctaggccttactgaaggatgacacctacattttgtgggtgaaaattgcaatggaccattgaaattattggcttgggcatcgacgcacacaacccccttatctacattgagtctaaaccactctagcatatgcttatgtgattttatctcaacaataccatcatctaaagaacgccgcaaaatcaagtactgtttagaaccccaaatgtagtgttcagctataaaattaacaacttgcaggagatcatagttatgcatatcaatattttgggttggcaaggttttacattggaggtttttctttggccctccatccggcaaactaaaaaacgacttaactctaacaactaattccaagcgcagttttcagtgaaaaattgaatggcacagccagcgacttgattgaaaatctaagaaagaaaggatgaaaaggaaagaaattggtagacgtgaataaaaaaattgaaaaaaatagtcttagcaatatattgggaaattgcgcggggaaaaagagtaattgatgttttcatgatatatcatgccccgttaaactttttcatgtaaaaacttatagttgagaaaaaaatgtcaaagaaaagagtacaacctacagatcaatactcaaaaataaaaaattagctactctaatttttcctgatctaaatgaaggttttgaactgagtgccaattcctggttgtcagccagtgtattgtgtatgttctgcagctagctcctatccttttatgcttagtagtatttcttcgtcctcgttgctcaaacatgttcttcggtcctcaataatttgtccgtagaggtttgaaggccgatttggaggatatcgtagatacaggtaccatcaatacatctcgtgctagttttgaagaggatatgacatcctgtgattattccacaacctgtgtacattgaagtgcgacgattcatgtctgatggcgatgctatccaaatagttggacaactctatcgtcaacacttggttgaactaccattgccaccatggctggaagatgagcctccacaaattctgctacactatgatttttcttacctgttgcaagggcgggtgtgggtatttgcaatgtgactccctaaaactttaattcatacttttggaacacctaaaatgatttagtattaacatcagaataatagttggaataatcaacatatttagtttctccaataagtgaacaaagattgaggaatcgatgtatttccctctaggatcaagaataaatgcaaaagcatacaacatggggaggtttttccaatatttaagataattttgtttcacactaaagactgctggtcctataagttcatcactatcatactctttgaacaaagtggcaatttcaagaatcttatgcaaatttaaattagctgttggataatatactttagaagttcagataaaaagaaattgaaagaacctctcaacaacatactaagtatatgtctatcaatagcagttgcccatcacttgtcaaaacatcacgtgtttgaagaaaaataataagcaaatccttataatgtaatacactttaacattagataagtggcattccaccgatg

SEQ ID NO: 19932 - DNA, 507 bp, Oryza sativa
tttatgtgtggatgaaagttttgatgtgatggaaaagttggaagtttgaagaaaaagttgagaactaaacaagcactaagattttcagcaatgttatctgaacacctaacctagtccattatatactctgataaaagaaactgatatatgcatcacctgtagctgatcaccaatgttgatcaccagcgcgttgggctgtggattcacggcgatccacctgccttccttgagaacttgcaggccggccacctgctggtccatgaggaggatggtgagggcgttcgggtcggtgtgcgccggcagtccgaacgtcagctctggctccgggcacttggggtagaagttcaccgccatatgctgctcctgctcaccaagaaccttcttgatgtagtcctgttccaagcccaggcttctcggggggaaatttaattttccggggcccccagacagtctgaatccgagctccgaactttttgcagtatgtgcttatgatctccctgcaccatc

SEQ ID NO: 19933 - DNA, 8190 bp, Oryza sativa
  unsure (1)..(8190): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctaactagtaatcctcagggaaaactgagcatttgaccacaacttcaaagtggggatacggtatgaatgaacaccaaggataaaaactgtgatgtacccttttactctcatccatatcagccttgttgccaaccaaaattttgttgacattatcagaggcatgttgctcaatattccgaatccagttccgaatgtctgtattgtcaaataaaacagcagtgacaaaatagttcaaaatggaataattaaggaaggtatatatgtaaggagacagtactgttgaaagatgactcgtcggtgacatcataaacaagcaggatacccatggctccacggtagtacgctgaggtaaaatgagatttacttgatcaaaaggttctcatttaacttcacagggttagtatgctgaatggaacaataattataccagtggtaattgtccggaaacgttcttggccagctgtgtcccaaatttgtagcttaatacgcttcccgtccagctctattgttctaattttgaagtcaatactgcacaaacacaaatactgcaatcagcgtggagaagataataaattgaaaagcttgcgggcaggagccatagagcggtcttcccaacatcagagaacatacccaattgtggtaataaagcttgtagtgaaggaaccatcagaaaaccgcaggagaaggcaactcttgccaacacctagaaatggaaaaatgagaaaaaagaattcttataagaaaattggccagcacaaaacttgcctgaggaactgccattagctactaaataattagttcaacagaatacactaacaaaagtgaatttgtaaatattatggactttaaaacagtacaactgctagagaaatagcatgctaccaaaggttatgcctagaaaatttgaactaatagacttacattggatactagaaagaaccaaaaacaatttgtaaaagactaaatcatagatagtcataattaaaaacaagtagtcatcactgagcaaaagaatccaagatcaagacctattagagcacgagctttatgttacagacaatcatgaataatctggcaattgtcatgaaaacaatcacttatttgatcctatcaatgaataagtctcgacaaggaatatagtggaagctctacgggtagtggctcaaagcgagagcacaaaatgcccctggttgatttgagctattggtataaaaatataaatttctgctatgaacttttaaacaattacgctatttcatatagctgtaatgtttgacccattagtttcacccctcactccaactttcttccaacagctacacatttggagcatacaccctcacgagcaaggaactatctagttccactctcaacaacatgtagcacaaattccatggcatgcactaacgaatgaaaattatagaggaaagaatagcacataacatactctctttaactctatctcctattgcatgattgagtgccaaaaaagaaagcattgcttcatgcttatgtgcaacgtttctcagatggccttgcacactgtcgaaataaccttagtatcagcttaatcagaaaagcctgcaattccagttgaccatttccaaggttcttccatccaaggaaaaacttactgaaccacgaaattcatttttttttctcctcgccattttcataactcctaactttgcttcttcttcttctttttcttttttttttacataaagcacagtagtggtagttcctgcctgtatgtactaggcaagtaggcattatgtatattgtaggttgaacagaaaccaaattcacatgaaagacagatcatgcacacaagcgcacaccaaaggcaaatcctttgcaggatcctagttgctcgcgtggcccaatccacctgcgatccaaccaacaccgaggcgcgggaaaacccacacgacatcactcgccgtggaatggaaatgggaaggcaagatctaagctcgaggtggtgtcaccaaccgctgtccccgatgaggaggagcttgatgaggtagtcgtagtccgcccgagccctcgccggcggcgcagccatctcgtcgctccgcttcacaccctcctcctcctcctccccctactccacagcccacccggcgcgcctcctccaccaatccccgacctgcagcgaacggaaaaaaaaaaaaacagacaccgtgagaatggcagcacgacggcggcggcggatcccgcgcgggtggcggccggatcggagaccgcaccggtaggcgcggcggaggatcgcgcggcggcggcggtggcggtgcggatctggagaacggggaggagggagttggttttttttttctctccttttttcccttcgcttttttagtttgctggttgattcgtcgccggccgcatgagcgagcgagcgactgatcagcgcgtgcaagatcagagctgggttttgtaatttgttcggtttttttatggggtccggttcggtcggtcagggtcaggtcactcgcttgcgctgatcgctttcttttttcggtttttcccgacgcgcgcggccaccgaccggtgaggcttttgcgggcactggttggtgggccagctgcggagtggggcccaattgtctgtcaatggaagatgggtacgcgcgtgggggttccattccaagttgcaaaatgcgtggtttccgtcagattgattgattgggtcgagggggagacaacagaagaggtcacacagctcaaacacaagttcagtgggagataattaactattttgccatctatgcgtatggtgtttaataatttatcactggatacacgtattatagacatgtaataaatatatgagaatccacgtatcattgatatatgagtggtaaacggctaaacgtcaaatctaaaaatgacaaatagttaaatgcttcattcattaggttattaagaaagtatgtagaattaaataagaagaggcttgattggttgaaaagttgagatactctctctataaaaaaaagaatctaaaactgaatgtgatacattctaatacaatgtgtccagattcatggtacgaatgtgttacatccaattcttagttgatttttatgagacgaaggaagtaggttggaaaaataaatggttgagtgttgtgattggttgataagggaatatcggtggtggagttgttatattatgggatggagggggtatcatttaaagtagtatagatgtactccctccgttcaaaaaaaatgcattcctattataccaaggtggaattaatggagatggagaataactaaaatatccttaatcattgaaaaaagtagtaagagtgataggtaggtaaagagtatcgaagggataaaactttcgttttacatgctgagggtaggtaggatggtagacgttagttcttagtgtgacacaatttaaactctagaagataagttttttttggcaggagggagtactccctctgtccaaaaaaaaaagacaaaccctggttgccgtgtccaacatttgaccatccgtcttatttaaaaaaattatgaaaaaaattaaaagataagtcacgcataaaatattaatcatgtcttatcatatcacaacaacgaaaatacgaattataaaaaaaattcatataaaacggcacttgcacggcacatttgacgtgtaacgataccgatttgtactgcttggacagttggaacaatcacccaaccattcgttcatgtgcgaaccaaccgtttgcttgcttccaactccacaatgccctttgtgtgcctacacggcttccgtgctacaaaactctccactcggcagctgctttttttcatgcagttacagcacgcaaagagttgctttcagtccaggggattggcaacaaggaacaccaattgcatgtggtgcttgctgctgccacaggcatgctttgccttagagcaagtttaatagtataggccattactagctccaaataatctatagccgatgtaatagccaattcatacaatagttgcttactatactattaatatctgatcccacctgtcatacacacattacgtcttggagtccgtgctgcagctggctatagatctgtagcccgctgctcttctctctcttcctttatttctttaaaatatgtttatagctggtttatagcctgctattgtacctgctcttaaggcaatgttcagaaatcgatattagtgtatgatcgccgttaacttgatcattatgtggtgaggtgatcaattgggttccagtttagttgatgttgagaagtggcaattcggatttcaatggaaaatcaagaagagcagatctatcgtcggtgcccagaaatggacaaattgaggccacgttcatcctccctagtgcatagtaggacacaagatccaaaatattttctccaaagcatgttcttcattaatccgtataactagaatattaagtgtgtactaatatatatgtataagatacagggtaattttcattctaatttcaccttagtgatagaagtgcatcctaaaataatcacaccaaccgtgctggtcaaactacacttaaatcaaacaaaattatactagcagccaagactaggggattacctatacatttgtcaacaaattctttttaaagaaaggaacatttgcaaatttgccactgttttttttcaattttgcaaagataccactcgaataacagtttcagtggcatttttgcaattttctagtgacagttttgcaataacgattcaaaacagtagtaaatttgcaattgcccctttaaagaaagtttaacagatataattacagtgcaatcgtaattacatgcaagtttttaagagagaatttatcgaaaatatatagcaaaattgatccaaacatgtatccgaaacgcttcgactggtatcgatcctgttggacccatcatttgcagcccacttatactctacgactaataaagatggcccatgtggaagcgtggagccatcgataatttggagtgaaaattcagcctgaaggcaagcacaacaggaaaaaaaaaaacccagcgcagcgccgtgcgttgtgcgaggcgtggccatagcagctggagagcagatcgaccgaggcgccggtgaacgtgttcgatagagtcgccgacaacaggtcaccgctgaagcccagcatccagccgccggcgaggccgtgccaaggaggaaaaggactcggcgcctggagctggaccctcgtgagtaaagtagcagcagtggaacagactcgtcaccgggcggagggcgatccccacgacgggcaggtcggcgtgctcggcgatcgtggtcatgctcaggcggcaggtcggacacaacattacgagctcagcccccatgaacattacgagctcaacacaagaaacattccaggatcacaattgagccaatttctcagtgacagaagtaaaaattgtacaaaaacacgcacatactccatcaattaagagggattgctagaagcattgaaataccactcatgaacttccgaatcaaaaaaaaagagaggataaataataacatgggattataccccttgtaaacaaatgatcaggtgcaaattacaaattatcacgagtaatatcaaaatcagagatgtattattatgagaacactaaatacagtgccctcgtttaataactacacgagcattcatataaacaaggtcaagcaaatcagctcgttatcttactcttttttttcctaccaaatgtatttgaaaattaaaaacggatttccaagtgactgttccagaattccaaacaactccaaggttccaaccccatcgaacaaatcgaatgcaaaagtacaacataagtgcataactgtcaagcaacaaattggagcatacgaacatttttttctcgaatgcgcaaaagaattgaacgtcaatatatacaaacatgcctctgtttttaccaaactactttagaaaaatcaaatacaaatatcatcagaagttatacctactgacttttcatctttaaagcacaacaattcacataccatgtgaccaaattcaggtaaatttagaatttcatatcctacctacttaacaagtagctactagcactaacattcacatttcggacacaacagataatagcgcatattagctaggtgcaagttggccaatcacaaacattacaatgatcaatcaacaaacagaacaagatgcaaccgaatcaacaatcaccagacttaacgtcaccacatttaagctcctgtccattttaaactacaataaatcataagacagtaaaatggcattatcgcaacttgacacttatgcaagtatcagcaaataagtaatagtattatcacaactaactaaacacttatgcaagtagacaacaaataggtgataaatttatgataactaactaaatacttatgcaagtaaacaaaaatgtgttataacattatcataactaaactcatttgcaagaacacaaattaggaagacattaacaaaaagcaccaactgtaaacattaactactagtgaacatcgcactaccacagcatataaatcagtcctattgcaagcaaggaggcatggcattgcatatgttcctataaccacaattccctctgttgcacctgctgcaagctgcttatctaattacattcttacgttgatgtcacaatttccgcttacgacatacatacctttccatattccagcaaactccacaatgttgggatgcaattcatgaatacaatctcataatgtatgtaaagcaatcacattacatgatatcaagctaaaaagtgccactacataacatgagaaacagcatttccccaaccacccaagcaccccaaatggcaatgctattttcaataattacccaaacacaaacgaagaaccaaataacccaccaggaggcatatatgtgcatccactaccaaacacagatcaattgttcgaaattatccaaatcttaacaatattattacaggcagcatctaacaattcacagttcccccatccctctgcccagaccacactcctcgaccctacaccggtgttaacctacacgggtacaaactgattggcttgactgtccatctattcagaaaacaccacaaattacgtacaaacaaccgaaccgattcacgacaaatgatatagcatgcaacgaagacgatgatgatgacgattgacaacagataggagcgtttcagttcagacaagagggagagggaagcgggggacaccaccaccaagccggcattgcgtgtgccctaagcggccgccgccttctttggcgacttggtggtggccttcttgggcgacttgggggtcttaccctccttggcctccttggccgcggcggagccggtcttcttggggagcagcaccgggttgatgttgggcagcaccccgccgtgcgcgatggtgacgccggccagcagcttcccgagctcctcgtcgttgcggatcgccagcagcacgtgccgcgggatgatccggttcttcttgttgtcccgcgccgcgttccccgcaagctcgagcacctaaaaaaaaatccaattcaggccggctaccgcgtcgagggtacggggctgtgcgcatgcgcgggcgcggccaaacctcggcggcgaggtactcgaggacggcggcgaggtagacgggggcgccggtgccgatgcgctgggagtagcggccttgcttgaggtagcggccgatacggccgacggggaactggagcccggccttgacggagcgggacaccggcttcttcttcggcccgccgccgccgcggcggccgccggcgccggccttcttgggcaccttcgctcccacctccatcgatcgcgacgagctcctcctccccaagctttctccctcttctgttttgttcgatttttttttcttcctattttttttccttttgggggaggagtgcgtgtgcgtttgtgttttcgttgtgtgtggtcacgggggg

SEQ ID NO: 19934 - DNA, 7430 bp, Oryza sativa
attaaaaagatgtgacggaaagttgaaagtttatatgtgtagtaaagttttgatgggtttgtgtgtaggaaagttttgatgggactttcttacacacaaacttccaactttttcatcatatcgtttcattttcaaccaaactttcaatttcggcattaactaaacacactctcaactccacattttctttagaattagactgacctccacattttcttttcacggaaaatatacacgatgctaaaattatttgatttatagaagtatatcttttattttgttttttattagacttaatagtaaatgaaaaaggaaatatgtgtgcccaattgtcatacttataaaacccaataaactcaagaaaatgttgaccattcagtttttaacaattttgttaataaaaatttgaattttcatctattgtttctaccaaaattgtatttttaaaatatttgaattatgttacatctgtcaccaaatgtcttgttttagtttttttctcaaattcaagcctaacattttttttaaaaaaaaaaatctagcaccaagttttgaaagtaaaagaaaccatgttcaaatcgaacaaagctctacgccacgttcactatctaacaagttatctagtttaatattacatttcttgttaactcctcttacccgaattggtattatgatcatgactatgattctatagtacaacttttatggagctagggacctcaaccttaaaggaagttttttttttctttccaattcatttattggataattcaaattttagcttagagaacggtccatatggaatgagtagcatgtacacatttaatagtttaagatttaaaaatgtatttgagaaacctacccaagtatacgaaatattagacaatcatattagaaacatgtaaaatatttgtaggaaaccatcggcatccaacaatttcgacaagggagcttgggaatatgtagtgtcacagtaactaatatgatttatatttttcttggtgaatggcacaaataatggaaccatcgatggaacctgtatgttctgaccactttctttatgtaaccgtggagggaacaatacaaagttttacatggaacacaccatttaaccatttaagaatgttctaacgaaaaatgagaaaattaccacagctaaaaatcacatcccaaggagccctaagaagggttactctattatatgcgtcgttgtgtataagagcaagtatagtagaagtacgtctgccggcgataggagcgcctccttagctttactggtgacctaaaagagataataggagaaagagagagcaagtgagcaactaagagcagggaactataagcctactataaccttatgtggaggagagaggtagaagacagttggctttcatgcaagatctagctccaagacaaatatattaaatgtataagtgagagaaagagagatgagaagaaaaaaattgaagtaggaagtgagctctacgattatacatgttagctttaagataagctaatagtagaaagtgagctctacaattatccttagtctaaattaccgctacctcctcacacactccaataagcatgattaactttcacttgcatgcagcaaatagagcaggtggatgagtgaatgatacaactatcactactaaaagaaactcatctttaatcccagtttgcaacccctttagtcccgggttgcaaaccgagatgcccaattcggaactaaagatgctcatctttagtcccggttgaaataatccaggactaaagtttttttttctttttttcattattttttttctgcatgcatattgatttccaaccaaactcaacaacaaaatcacccacattcacaaaaacatcatagaatcatccacaatttcaacaacaaaatcatccacaaatttacatcacaaaatcatccacaaatacctagattaattagatcatcaattatcagcttcattctccatctctagaggatcaaatacctagatttattagatcatcaatcctgtagcctaccgccgccgcactgggcgccgctgccgcctgccggtcgaggaggaggagaagaaggagtggaggaggatgggaaggagtggagaggcgtgcgggcatgcgacgatgccgaggagataaggaagagagagagagagcgagagatgcgtgggagagagatatttagtcccgcttagtaataccaatcgggattaaagatataatctttagtccaatttgttcggaggcctgacagctattaaaccgagactttaaaatgatcttgttaccaatcgagactaaagatcaaagagagacgctgaacttttgaactgggactgaagaaagcttactacactattaaacttgctctaattaaagtataaaattttactgctcataagggaatcttttcctaccgatatgaagttttagtgcatatgtagtttcgtacgtactatataaatgtatcaactgtagtttcacagtatccctttttggttttggataaatttgcaattctaatactgacaacaattacttatgcagttgtagcctctaccgtttgagctgaattaaacggtacagactatccagagtgctgtagcaaaagtactatataaaagtttttttttttttgattctgctgtttgatcacgtagctgtgaatctgaattgttgatcatcaaaatatcaaaatgaagggctgaatatatatatacagtcctaagtgcagtcatagttatggctggaactaatctcaatcctcgaggaacgacaatacttatttttctttgaaatctgttagcacgttttttaaacatctaaacgatgtgtttcgtataaaaattttatctgtaaaattagctataaaataacatataaagttattttttaaaaatatgtaataactaaaaaataattaatcatacgttaattccctttctcttctttttacatgcccaatacccattaactctatctccatcttcaccatttcaaacacctctctgcggcgagaaaatggacatttagccacgtccaaaacagggtttcactaaaatgttatcccgaaaacgcgtttcgctaaaataccaatatgaagcgcgtgctcaccgccactttgccagtttggaccttttgtgcattttcgaaatcattttcactcctccaccggatgatgagacaaaattgcccttcatgtcctccgtcgccgtcgttgagaaagaggagctcgtcctcgccagccaatctccatgtccaccacgagcacctcaccgtcttcctcctagacggcgaggtggccggcgagtccttcgacatcatcccctccctcaacctcgccacctccgccgactacctcaccgcggtcgacgacgacggctagggtttcgaggaggccccatgacctcgccggtgacggaggcgaagggggacgcggtggagagacaacagcagttgctggcgggcctcgccggcgacggagggttcaccggtgacggaggcgaagggggacgtggtgaagaggcagcagcagctgctggcgagcctcgccggcgacgaagacggagagggacgcggtggagaggcagcagcagttcctggcgagatggagcgcaagccgccgccgccgtgaggcctcctcgacgacctcacctccgcctccgcctcgtcaatgtcgtccgacggcggcagacaggggcagccgccggtggttccgttgctccgcgcacccgcgcacccaaatgccctcgtcggcagcggcagtgggctcatccggcggcgttgctggccatcccgcccttgtcgacagcagcttcggaaggggaaggatgatggatggaagggcattttcgtctcattacctactgaagaagcgaaaatgatttcgaaaatacacaaaagggccaaaatgataaagtggtagtgagcacgtgcttcatattagcattttagctaaaccctttttcgagatggcattctagcgaaaccctgttttgaatatggctaaatgtctattttctactccgcggcagtgcggcacccacacacccgcaacagggaaaaaaaaaaagcgctctccaccgcgacaccgctggctcgccacttctccgtccgcccgcccgcgtcgcggaggtggcgcgcgcgtacgcgaccggaccacacgagcgcagcggcgccagaaaaaaaaaacccaaaaatgcgttcgattcttcgtagtacgtaccaacggccggcgaaagccgcgacaccaacacccacccatgtgtgcgcgcgcgcggtgccgcgtatcgccgtgtgccgcgcggcggcgcccatgtgcctcaacgtgggtcggttcccccctgcagtctgctcctcgatccctttctcctcgatcgatcgctcgtcggttattatccatcgagctttcggtggaagcgtgcgcgcgtccagcgcgatccggacacgcacgcacaatgctgtgctgcagcgcatgcaattgcaagtacatgtgcgcgcgcgtccgcgaccgcgagcgccgtcgtgcgtgcgtgttcccggcaagattcttccggaacatgctaaattattgacgctaccaacggcccgaaaagcaagttcatgttgttgtctaccgaaatcatcaatctaaaagccctctccaggctcacaactccagaggttcagatcgacatactgctgcaacgttgcatggttggttattagaaattgaaatcgacagaacagaagagtcgtagcagcaacagcagcagcagtccacgccaaaattttgttcgatcggttcgcgacgaacgagcaatcagacggcatttgagacttgagagggataaggatggacctcgcattatcagctgcatgcaatgcacggcgacggggtcctcttattaaatgttgtggcagggtgacatgcatcgtctccactctacagtgctgtcagtgcgtgcatgcatgcactggtggtggaccggtgcaccggccatgatctcttatccacaaaactgaaagtagcagcggtacagctcactagatatcccccccccccctaattttgacagttctccgtaataatttttgggactacctatacatttgtcgataaattttctcttaaaaatttatcaaatgtaaatacaatataattatactataattactctataactacaaaataattacactataacttacatgtaactacactgtaactatagtataattatattgtaactatagtatgactacactataattataataattacactgtaacttacatgtaattaaactgtaactataatataacttacatgtaagtgagattctacctttagaaaacttatgtttggcactgctcacgtgaaagagggattatgaactcgcaatgtatgtttgtacgatgcgtgcggaggccatcattcatgcatacatgttcggatatgccctgccgctttatctctgcccttcatctgtcatctacgagtgcatgagccgcgcctgtggccggcggccggcggccgtcacaagaaacaaatcaaagcgtcgacgcaaaagcacgaatcccgagattcatcaagcagttcaaaaatcgataaattctgaggaaggaatttgtcaacagatttatagcaaaatcgcaattttttcttgttagagtagtatactcagtctttttctttaaaggatatactcagtagtatttctaatgtacattcgtgctttgcgacgaaccaagctcatatgtaatcaaaatttgggtggaaagttatgctttttcgatagatcagaccaattagagattgattgggggatgaataattaaggataaatcagaatggttatgtacgtatacatgagaagaagcgaacattatggcggggaacggaaggagaacgaaggtagcaatagataacattgttaagtttcgaacatgcatttaattgcttcttataaaaaaatatactaatcattatttcttttattgcgatatattttatcactaaaagtaatgtatgttatatttgtacaaaattttttaataagaaggtggaaaacatgttaataatcacaacgctataactttaaaagcataagcacttcattcttccatagggacgactatgtttttcaattctactagttaattaggattcacgctattttttttcattttaacaaaccacaattaattatttcttttttattcaaaacaaagtacaatgtagacacttataaatcacatgtacacttatccttataaaacgagcacatgagcacatgtacaccctattctaagagcaactccgagcgtctgattaacatattttgatgctgaagtcatcataattagctcgttcgttgtcgacataactatatcgcttaccattaaaagtataattaatcgtaaatacgagtacacatgccaagtttttaacttaatttggtgaacggattccaccgtgaataacctaaccagctaaacttatgctcaatttgtcataataactactccctccgttttaaaatgtttgacaacattgactttttagtacgtgtttgaccattcgtcttattcaaaaaatttaaataattatttattcttttcatgtcatttgattcattgttaaatatactttcatgtatacatatatttttatatatttcacaatcttttttaataagacgaacggtcaaacatgtgctaaaagtcaagggtgtcaaatattttgaaacggagggagtaattattttcgtaataagtttttactagagttcgattaatatatccaactccaaaagtcgttgaattcacccacacctgcaaggctacaactgagatgcgcaagtgtatgaccacaaggtgagaaatacataagcacttttaacctgcggtccctccaacccaagatgtcgctgggcagccggtctcgtctttatatataccaccactcgcttcccttctctcctcacattacccccggccgcaccacccccttcttctccaacctcttgcagctgcagacacaatcgttaaatcgcgatcaccgcagcaagccatgtcgtcgcagcggcccggccgtcaccagcggagggcgtcgcagagcgtgttcgtgctcccggataacttcgccgacctcgacgacgtgccggccggcgccggcggcgccggcgaggacggccggaagggcgccgccgcgacggcggacgcggccggcgggcagcagcaggctcgcccatcgccggcggcgcgccaccggagggcgatgtcggtggccgtggcgtcgtccagggagctggagatgatcaaggaggacatgggcagctacaagatcggcgcctgatgcagcatcgatcgcacacacaggggcgccgtgcttagtacttgcggctaaatcgtcatgtgtatggccggttaattt

SEQ ID NO: 19935 - DNA, 20499 bp, Oryza sativa
tatttagacggagccttagtcacttaatggcaataccgcaatagcgtacagaatctcatactctgcgcgtatgcgtagctggttgtcactattcgcaggcagcaaaacgcatctcaacttatcgctccagcgtgcgatgcgacgtgtcgacacggtgggcatcttctgggacgctgtaaaaaccaatagcaaaagcacacctagctttcgttttattcgacagaggcctcgtttagttcccaaaataaaaaattatcatatatcatattaaatgttcggacacatgtatgatatattaaatgtgaaaaaaactaattacataatttacgtttaaatatgcgagacgaatcttttaagtctaattgaaccatgatttgataatgtggtgctacagtaaatatttgctaataacgaattaattaggcttaataaattcgtctcgcagtttcctagcggaatctgtaatttgttttgttattagactacgtttaatactttaaatatgtgtccgaatattcgatgtgacaaccaaatctaaaagttttccctaactaagcaaggccagaatactcaagataaactcaggttacgatttttttcctaggaagtaattcaggattgtaaaaaatcaatcctaagaacatgttcatatgtgtacaggtttaagatttgatgttctatgacactccataaccagacagttatgcatgcatgtggccatgtcccagacgacaccgagctgagaaagcctgaaaccgaaatgacaaagatgccggttgctctgagattcgctcgcggaacacgagcatatgcatgccgatcatcttcgcgtcttcacccccgttttgtttctttccccgggccggaatattggccccgcccgcctgccaaccaatccaaccgagccacatgcgcaatcacgcaacacatgttctcaaattactacttcctctttttaagttgaacacggttattaaaaaatacgtagaattaaataggaatagattgtaattggttggaaaggaaaggtaagtcgaaaaaataaatggtgaatggttgtgattggttgaaaaatgaatgtttgtgaagaaattattatattttagaacaaatgttaagtggtaaaattattatattttggaacagagcgtaccagatttacaatcatcaacgcgagagatccgattgtacgtacacaagcacgtacgtacaaccggtacttgcatcattgcatgataccacctgtgttattgcgtttatttttccatgtcgttttcagggttttgattagcaatctgttgtacacttgtgtactgtatttgtaatgcgggtgtgtgtatgattggtgtttgctactagtgtgcgcccccagatctcgatctggaacatgcacacatgatggatcatggatggatggatggaccagggcaccaaaggctcaatcatcttgatttgataggccgttttttgggtcgatgtacgtgtcgatggacatctgtacacttgcaaatccgtagcgaatcgattgatggatctgttatggattgatgatatattacaccgacatgacttgtgtgtagttttctctttttttctaaaaaaaaatcatcggtgtgttaatgtgtttcgtggtggattatttgattcgccagatttgacgaaagttaaatttggactcttcgtggactcgagttgggtctacatttgtctgggcttgatttgttcaagagccccatggcccattcaccaaagcagtttgtttgtggaataagtccagtttgactcccttagttagtggctgattcgtaccccagaaccacgatacggatatctcgatcccccattcccccaactattcaaactggtacaatttgacttcctcgacggttttggaggacggtttcgctaatgtgacccctttgtagcagtgttgacttggtcttcgtccaacgtggcgttgacatagcgcttacgtgacattagatttttttaaaaaaaatatgtggggtcccattttgtctcacaaaaaattacgggacccactaacacgtggggcttaaatgtcatcctcttaccggtgcacgcacgagctcggcggcaccgcctctcccctttcccttctcaaccccctccccccgctctatagcatcggatggcgagattcgaggtggtgctagcgcaggtagagacggaggagtcggcggcggcagaggagaaggccgcgtgccccgaacatgattccggcgctgcggcggaagagggagatgatggcacacctcgtcccctccctgaccacatcttgtggcatgcagggaggctgatgcaaacgacccctccccgaccacttccgcagcgagatcctggagacacaataggcgagatgcagtcgctctctctcgtcctccactcttgctctcaacgacgtaacaaaagaagtagacatgggcattgtggtcagaacacatgccaaacaatagtttggcatcggttgggagtgactttaacaatccgcggagtggcatttgagtaaaactctcttttagcagtgggagaatgtcctatttccttgttattttctcatgcggattaagattttatctcggtttccgttagcacgcttttcaagctattaaacgacatgtttcgtgaaaaaaaaattcttgatgaaagttgctttaaaatatcaaatatatcatctttcatgtttgtagtaattaaaactcaatttatcacacgttaatagctttctcgttttacatgcccgctttaaatcttaatttaaagtagaaacgaacggaccgacgtctaggactacatctgggttttctcggttattttcgttaaacggcacacactccctctataaaaaaacaaacttcgaagtctttgatctttggacatacagattcatttccagaagttttttttattgagaccaagagtgtatggttgaatttactgtaataaatttggtcaattccttaatacgtaacgtaacatgaccaataaactattttagtagctgtagcactggttaattttttctccatccaacatgtgacatttcgatggcttcgccagccatgcatatttcgaataccctcaatttatcataatcgcctatccacaacataaatagtaatcatgcttcaattatatcttcgttataaaatacagctctctgtcttatctcataaaaatacttcaaacgtgctgatattttatagtgacggagagagtaccaatttgtcaatgacagatatagtacgatgaaagctatcggatcggtgataattgtgcaaacatctcgcgagagctatcagctactacgtactatgcattatttcagttgatgtgcactttttctgaccaaaatgcatatacactgaaagaatttctctctcgtcctaccgaaaatagagtactactgcactacattcagattcgcaaaatcgcaactcgaccgttcaaatcaaaatcctaaaaatttctacgggacggaacacgccaacctgagcttttgttcgtgtttgggggcgcttttccacagtataaaatcacagatacccttttgattttgataaaatcccctatgtacctatgaacagagttcacccttccccgcaaaaaaaaaaaaacataattcacctaatcctttctatactcttgaattttgctcaatcccttacatacccctgaattttagtttggatcccttccatgcccttttcgctagttgaccgttaaatttttttaaaaaagtccattttaccctttgctatgaagaaacataataaattaatgaagtatattgttggaatgtaaaaatttattggatgagactattatatttatgagtatgtaatgcaccatattatttgtgacaaatttacttttacatatgatataaaaagttaatacttatttattagttattaaaagttcttttgtgtagcatatgtgtttttatagtaatacaacatatttgtttattactatcagaacacatatactaaaaaaaatcttttaataactaataaataagtaataatttttttatgtcatatctaaaagtatatttatcgcaaataatatggtgtataactgtctcataaataaaatagtctcatataacaaatttctatgcttaaacaatatactctattaatttatatgcttctttataccaagggcaaaattgactttttcataaggatttaacggtcaactagtggaaagggtatggaagggatccaaactaaaattcaggggtatgtaagagattgagcaaaattcagagatacagaagacattagataaactttcagggtacacagattttctctttgattttcgtgtgcctccatgccgcgcgtttccccttggccgcaggaactaaaacccgccttgaatctcagccctccacgtgtctgcctaagagcaccccacgtcaccaccgctataccaacaataccgcgcctttttctccctccctcctcgcggcggcggcggcgacggccgacggcggaggcggaggcggaggaggaggaagacgagaggagccgagacgggaggcgtgtccgtttcttcgtcccgccctagggtttctacgagggggaggcaatggctgccgcggcgggggtggctgctggaacgggaagaggtagcggggagggagaggagctgctccccaacgccgtggagggagacggcggctgcggcgggggcggcacgtgcgcgggggaccgcccgtggcggctcaacttcgacggcctccgccgcccggaggcgcaccaggagaagccgccgcgccgcttccatgaccgcctcggagggctaggtactacctctctaactgtctctcgtgattggtggttctctggaactttcgtatcgtttgtgtttgggtgctattcgttttagttgtaggattgtttttgatctggacttgtgttttagctgttttagttagagaattcagatgtcagcgtcttatcctcttcagtgacggcgattgggtcaggtgatgtatagtgaacgtgtactggagaatggggagtggagaacttgcagcagcgatagttggtattactgatcagtgtgtttcatccactgatgtcccttttgtttagtagtagttgattggataccgtaatttgctgttactcaacagttttgtgccatgtctgttctgtaacgatggtgatcgatttataggtttcgttgtacgttcacattatatgataatttgtatttatgattgtattgtgttaataatatttgaaaccaatattatgtttgatagtggtgatagattttattactctgccatgagttactaattgaattatgatattaattattaagctgaagatattatattgaaaggcggaaagcgtacacatcctgagacctgttttcttaagaaattgttgtacccttttgatgctggtaaaatttactgaagggttgtttatggactgttgagttgactattttttacttcctgctttgatattttgtctttaagctgcatgtgtcaagcctttggtttctgttgtttgcaatttctaccttacagctatgtaacatggtaatttctagcaccaatttactgattctttcctctatatttcagtgctcaggaatctggatatttcaggtctgtatgttttatggaagaaaacactggttttcaaacagagatataagttttagctctaagtccaaagttctcattctgcagatgtagacaagaatgtttaatacagatggtggaagtcatttctttggtgtttgaaaattattatcaggataaaaaggtcatgtacaaaacaagtttaactaagttgactgttgagtctatttccaacttcgcactggtctcattgtgtggcattgcactcatcataatcagataacttagtattcttcttttgttatatacttctatttacagttcaaagccctggagatgatgttgcagaatattaccagcaacagtcggaattgttggaaggttttaatgaaatggatacactcacagatcgtggttttcttcctggaatgtccaaggtctacattcttgctctagtaaggccttgtttagttcgggaaaatttttgtgttgggttgtcacatcgaatatacggacatacatttgaagtattaaacatagtctaataacaaaacaaattacagattccgctaggaaactgcgagacgaatttattaagactaattaatccgtcattagcaaatgtttactgtagcaccatattgtcaaatcatggcacaattaggcttaaaagattcgtctctcaatttacacgccatctgtgtaattgtttttttttcctacatttaatactccatgcatgtgtccaaacattcgatgtgacagcgtgaacatttttgttttgggaactaaacagggcctaacattaaaagaaaaaaaacttcattttgcagataaaatgttgaaagatgcatctatactgttttctaccttaatttgatcctatctgtgcaggaagaatgtgaaaaagttgccagaagtgaggcattagccatccggttatctaatatagcaaacatggttctttttgctgcaaaagtttatgcctcaataaggagtggttctctagctataattgcctccactttggattctctacttgacttgttatcaggttttatcttgtggtttactgccttttcaaagaaaacatcaaatccatacaggtacccaattggtaaaagacgcatgcaacctttggtgagtttccacaccaataactgccaattaggcataatttgccctgcatgttctatgcttttatttcttgaatttttctattactagaataagtcaatcatttttgttgaactctgatttgctgtagtatccatttatacgttgtttaagagataagagagacataaactgtataaatcgttatgtttcttgatcagtattcctcttattaacgaactctgacacaatccgtttgccagggaatacttgtttttgcttctgttatggcaacgcttggccttcaaattatcctagaatctacacgctcattgttttatgatgtaagtcttttcttttctcttcttaccattctttgactgcttttttcaatacaattatttgattcatattgattagcgtagttggtttttcacttctctattcaatctaaaccttctagcagatattatcagaatgcctcatgttccatgtgcttttgaaaaaaagtcattttcacgtccctttaatgggggaagattttctaaaaaaaaggccaacttgtccgttttcaattttgtacatgcctgtttggtacacttatgatagttaatatgtgtgagtactccatttcgtatcgttgacaatcttgcacttaaacttaactaactgttaagcacaccgtaataaaaattaggacagtaacataatgatcagattaatcaggtagctattgattatcttgtgctccagggggatactttccgcttgacaaaagagcaggagaagtgggttgtggatatcatgctttctgttacatcggtgaagctcctactggttgtatattgccgttcattcaccaatgaaattgtaaaggcttatgcacatgatcactttttcgatgtcatcacctatgtcattgggcttgtggcagcacttctagctaattatgtttaaggctgtattgacccagttggggctattatagtaagtatactaaagtagtacttgctctgtataattccttgtttattagaatttcactgaaagaactatcatttcctagaattgtgagatacactatagaatttgagtatgtcacgaatttaatcgggtaagacaactattttggctatggaactgaatgatgcactagtgataaatcttctcacattcgacaataacttgaacttgaataggtttttattatctttccttctttgcagctggcgatctacacaatcagaacatggtcaatgacggtgctagaaaacgtccactccttggttggccaatcggcttcaccagagtaccttcagaagcttacctacctgtgctggaaccatcacaaggctgtcaggcacatcgacacagtgcgagcatatacattcggctcccactactttgttgaggtggatattgttctgccatgtgacatgcccttgcaggaagcgcatgatatcggcgaggctccgcaagagaagctggagagcttgcccgagattgagcgggcttttgtccatctcgactacgagttcacccaccagcctgagcatgctcgatcccatgatacattatagcagtccgaacttcagagaacccaagttgaaattattgaagccatctcagtttcacaaatctgggagtagccaacatgcttcgacacattgcttatttcagatgcgttgttttttttttttttgggtgtggctaggaatcatatctgtgcctgtgggcgtgtaggggatgactggatgggtggcattggcaatgtttgaatcaaatgattgatgcgatgaggtgagatgagccaaaatgcttcgacacattgttttttttttttttttttttttttttttttttgttttgtggctgggaatcatatctgtgcctgtgggcgtgtaggggatgactggatgggtggcattggcaatgtttgaatcaaatgattgatgagatgagatcttcagtgtatgtgcggtgattgatggtgcctgatcgaccgagatcttcagtatatgtacaggccttgataacaagtgcaaagcaaatcatgctttgcagtttgcaccatatcccactttaattcctgaaaagcagtccagagactcacaccgttgacggaggcgttcgttttgttaatttcttgcactgtgctgtctgccaatctactcatcacagaaaaggtttgagcgctcctctcccagaaaagctcagtggtctcgccgtcaccagaccgagtgcgacacacgttgtgttggagaaagctagtctagaatccggggcccctctcccggagactacactgctagtgcccgctgccctccgtctattggtttcgcattctcactgtagctcgagcgagacggccgtcgtccggccccggcctacctctacctgcgacggacgcgtcaccttcatgggatcagcgctcgacgccggatcggctccccctcccctcccctcccctcccctcccctgccttacctccgcgtggtggcgcgcgcacgcgtcccgtacgtactcccgtgaaacggctacaggacaacgacgacgccagctcacgagaaacgagaaagggacatatgattaattaagtaggagtattaactagaagtattataaactttaaaataaatttatttgatttctaaaaataatctacatatttctttctaaaaaaacgtactccctccgttccaaaatataacaactttagccctcaagatttgtcccaaaatataacaacttcttccccaacattctcttcttaaccaatcacaaccctccaccatttactttttacacctacccccactactcatccaatcacaaccctccaccattcacttatacctactttcttaataactgtgtccaactctaaaactccttatattctgaaacggagagagtaccatttagcatacttacagaaaatgagagagtagccaaaatgaaaagtttattcaaactcagccttatataagagacaggtgtcagcgataaattaattgatgtttgatgacatctctaaggtcattcccaactcaataactaggatgttgtccataatactccctccatttacttttgatagttatatttcatcctgacacacagaccaatgataagtaattctacttatcatccatttaaacatgtggagtactccctccatctacttttgatagtcatatttcatcttggtacacagaccaaggataagtaattatacttatcatccatttaaacatgctactagttattcctcgtaaacaagcgattcattaatatttacatttttcgatgcccatttaaccaatcttgtgtagaagaatggagagtcatgcattaaatccgaaaaaatcattaagaggacaggttattggattgaaatatgcctatcaaaaataaaattttcagatttggaaatatgaatatcaaaagtagatggaaggagtaccagttattcctcgtaaacaagcgattcattaatatttacatttctcgatacccatgcagccaatcttatgcggaagaatgaagagtcacgcattaaatccgagaaagtcattaagagaataggttgttgaattgaaatatgactatcaaaaataaatttttcagatttggaaatatgactatcaaaagtagatggagtattaaataagctgctacctaggatgaaaaatgatatgacaagtgaataaatgaggaaagagaaggaaaccatgtcttgtataagacatggtttctacacaatatccaagacatcatgtgagctaagtagcattaaatttaagtatggaatagtggtgtttacattggaagagtagtgtctagtattagtttcttgatgatgtggagtttatgaaaactatgtcttgtgtcttgggttgggaatgatctaagttctaataaaacacacatcaccggggcataatgggatgcagctgggagatgttttttcccctcttttagggatgtcctaccatttattgcaatgctatttaaatatttataattttttttcacaaaatttaataatatatatcgatatgtgatatttcactccacaaataaacaagtttaaattaacctatatatgcacgttgaaaaaaacaaaaacaaattattactccaaacaaaatataagcatctgcacgtttaccaaaatgtatttgtatatcttttaaaaaatataaataaatgcttatacttttggaatggagtacactcgtattgttcgcaatcatatttgttatttttctaaaacttaattctataggtcgaatttagattgcatatgtgttgtggagttatatatctcacattaatgatacatgcatgctgttatatttttttttctaaaagaacttttaattattttaatgccgtggagaaatgaggggacatcggcatggagggttaaaagactctcctgcatttataactgcgtatatcgtaattaatttaaacattttgctacctactccctctgtcaaaaaaaagtaaaccctgggttttttgtccaactttgactgtccgtcttatatgaaattttttcataattcgtatttttattgttgttggatgataaaacatgattaatattttatacgtgacttgtctttttaattttttttcataatttttttaaataagacggacggtcaaacgttgggcacagaaaccagtgtttgtcttttttttttgggacggaggaagtatttgtttccctatatatgtttttctatttttttggagagaattatcgtcccatttgtccacaatcatgacgacagagtacagtgtaagaggtagagtggcaactagctagcgagccatggggtcctgagtgtctgtctgatcggttaggtacacgtcaccatgccacgtgtcacaaagggattagcaacgacagtgcatcagctgcacctgtagatcgcaaggtgcatgaagacaatcttccatatcctgaatattccacgcatgcattcatgtttgcatacataagatgcacatatatactaaacagtacatgacacctagtacatgatttcttgtgctaataacatactacacacaactacatgttcatgatttaattttgtggcagctagctggctagctaatctatatatgatgcatgcttacggcacatttatattaatacgaggattgaaaaagagctctcaatgggatggagccaaatcaaacaagcaagctagctagctagagagctcatgtgaagagctagtcatgaactctagctatagctatagcttagctagagctagctctcgtcgtcgtcgtcgtcgtcggagcccttggatgccgcggcgtcggagagcatcttctggatccgctgcatcgtctccgcctcgatgttgcgctccgccctgtccttgttgtaggtctcgaagaactccttgttctccttctccagctccttccatactgccgccacaaagatcaaaatatatttttagataatgcaaatggattacatctccggcttctgtcataagatacatagccatacaaagattaaaatatatgctcacatgaaatgatatatatgcatatataataaggtgcaaccactagcttgcgaagagaatgcgcatacgtgtgtatatatataatttgggagagaaactagctagagtctataggtagcactgcacatggagatatatatatgttcttgaagagaagtgggtaagtaattaagtatacctgtggaagtgacgacagggttgatgttggcatgcttctccagggcctccatgcactcctccttgttcaggttgaagcaaatgcacttctctatcaggtggtgaacctgcagtaattaattaacaatggcagcttaattgtaaacacctctcatttgatgcacacccagctaacacacacaacccagaagaaactcatactagcatataagtatatataccattctgatgtacgaagctgaggatgatgagtctcccatggcgcctagcttgagagagacagagatcaccactaattaagctccagctagcttagctaatggcagagtagtactggactactggatcagcaagctccaggagacaggagccgctgctgattcagctcactgttagctagctagctaggtagctcactgcttacttatctatctaaactatgggggaagaagaagaagaagaagagaggagatagaaataggggaggtggtgggggaggagggggacgtggaggcatgtcacgtgggcgccgccgccccattggcggagaggtggccgcggagatttttccgggcccgcgcctcgctctcagtctcagcagcagcggccttgctttttctgtggctggagcgtgcactagctttagcttgggcggctttgctagctagctttgggccattttggcgtatcgttgctactcgatcgtccctagctacttggagacgttgatgagtagtcgttgctacttgttggacgttcgtgagtggtagtctcattgctacttgcttctcttttatttaattaacctcagtcataatcatgctgtggcggagccagcgacgtacgccgttgagtctggtttgatcgatgaagatcgaacatctctacccggtggccgctcgacctgtcaagtagtggctccgccactgatcatgcatatgtgtctgaaaagccatatatgttatttttgtaattgttcctaagtaatagatgcaatatttttgccctctagctatatcgaaagatgtatatagtcatctgaacatattagccgctaacaagccacaaaagatgctaatagtagctaaagtctagctagctaaaggcttactatgtgtagacatgaggttattcgaaaggagaggcaacatatattagttagtaattaattaagaccgttcgtattactatgaaaattagtctagagttgtatttaatatatatatttatatactcctatatagtatttattagtgagtcttgagagatctagaattgagatgcgcatcgaacacaccctctccaattaaaaagcatatttgaaaggtttaataatgtattgatccaaatttatgtacaatagtatttattcagccaccgcccaccaggttacgttcgtaacgttattcttatgcatcatcacttcatggattgcgcacacacgatcatatcacctttaaacggccggctcaaacacaaagctttactactatacagagcttactcttagagtatatactattccctccgtttcatattataagtgcttgactttttttagtcaaagtttattttgtttaaccaagtttatagaaaaaattagcaacatcttctatgtcaaatcagtttcattaaatttaacattaaatatatattttaataatatatttatgttgtattgaaaatattagcatattctactacaaacttaaaaatttaacttaaaaaagttaaacgattttataatctggaaaggaggaagtaacagtcaagctgtcaagagctaagggctcaaggcaagtgactatgaggtaaatagcgattgatcgcacttttttaggactatagcacagcaactatgccacatatgccccctccacataagaacccaaacggccaaactatcccctcaaatgtagatagcatggcccactgcacagtgaccaaagatcatctctcatgaaatcgcgtggtggcccatctgaccaaaatctagccaacccgcgttctgtccgaaattaagcacgcgggcccaaaggcgtatcaggcccacgcaagtcacgcgacgagtatacaacgtaaaccgttgatcgagcgatcagccgatcacgaccgttgaatcgaaggaggcagcaataacgtacaacaacgtaccggaccaggaagcagactgcagtttttgtaagctcgtcccaaaatatcatcatttttagggttttacaggtgattaggaaaattgattgagtaaattaaagcctctcatcgttccctttacaactgataagccatataaaaatacacgaaatatcaaaaaatagtttacaagtaaaatttttatacctaggatcttaattatttaaaaggtaatactgaaaaataaactataattaaaaaaaatcttaaattaactttaaagtttaaattttggttgtgactcataatgtaacgagcaattaatgatgaagcaataaaatggttgtgattataggtgatataagaaatttggtcaggaagttaaataagatgaagaagtagttggagaagttacatatagactaattttatttcaaggttgcatattaattattttgaaatggagagagagcataaattaatttacgcctggttctcttgtgatgcatgcatgcatgtcattgttgagcaattgggctagctcccgtaagattgcgcaccccaatggatacaaacgctataaatgcaccgaggtcgatagtaaaagaatttgaagatagtggatgttcagaaaaaaccaaaagaatttgggcgacagtggatgtccagatagaaacgcgtatgtatgttcgttcagtatgtggattttttcgtgttaaatacttaaatgtcttgtaaaatcatgtaaagataaaattttttatatatttacacatcaaaaattaaaaatcaaagttggaataccacaccaataaaataaaagacggaggaactaaaatgggtgtggtaactctacagtgtagcatttcgttttgtacaagtgccagacgctttagcgtttggcaaataaatttcctttcaatctaagttctaatataatattattacttcggagaaaattatataaaaactagggagatgtgacatttagataacataatttacatatcccacaaataaaatataacaattaatcttagctaaaacgtaaaataaaattccacagcaactctaaaaaaaatcacagtaaaattaacgcatcgtgacaacagcaaactgatcagccctgtttaaagtagcaagcacacggactagctctactcctcttcgataaagaagaaagaaatatcgcccgaaatgggtgatgaaaacgtgttaattgtttctaaaggatcgatatcgatggaaacgtgtgaaagaatgtgcagctgtgaatttgcatggttagaattagttagaagagagctgatccaggcatccagcaaggcctgggtgattgctggtagtactgtccaaagcaaagcaagaaaagtaatccacgcttcacttcatcgcatccgagaagcagctccctgacgtgctcgatcatgtgacgtggcgcgagctaattggccgtctaaattgcatagggtgatcgagcaaatgactgaccagctagtggcagtaacgtcgtacgggacaaatgtaccacccatcgatcgctggcgctgctgctggagaatctttcgtcacccacgattggcttcccaatattgaattaatctgatgtacaattattttttttataaacgcatgtaataaatatatatatttagctatatcgatcaatatacaccattataataatattataatgagtgaagtacatgggcggtccctaaacttgtaccggtatgtcatctaggtctctgaactcctaaaatatatttttaggtccctgaacttgccatgtgtgttatataggtccaaacaggttctaacccactcgatgtgctgacgtggcaatgccacggtgacgcctacgtgtcagtgaaatccacatgtcaagcatatataaaaaataaaattaaaaaccatattttctcctcttaggtagacagaaaaaaagataaaaattttaaggtagagaggagaaaatatatttttctaattatatttttttctatgtgagtgacacgtcggtccaactaacacgtatgaactatcgtggtatgccacatcagcgcatggaaggggttggagctcgtttggaccggtatgacaccccaaaacaagttcaaggatctgaaatgtattttgagagttcagggatctagatgacacatccactcaagtttagggaccgctcgtgcacttcactctattataatctagacgcatcacgattaaatggcatgtgtctttttttttctcctgacgcggtaagataatagatatgatcaattagatcaaataattttactccttttgtggtgcaataaagctatctccaagaggaaaacaagactctctgtgtactgcaattttcccaaatcactgtatatagcttggcaggtctgaaccagtgtacctgttggacgacttggatcgaaacataaatctctatgaataccatactaataatgtctgatttagacctaacctgctaaccaagaagaatatatatctcaccaaccaagaagaatatatatctcaccattttgtttctgatatgaaaatgaaatgcacagggagggacaggaaacacaaaacaaaactatccaacattctggggagacaagtaacttcagcattagcatcatgcaacagtcatactgacaggaacccacaaataaaaaaagacatgtaacggatttagcaataggtagcccaaatggatttctcaccaactctggaaatcggttttgctaaaaatatgacatcacattttttttatttaatttcgatcggtttctatcttgcttgtcttctcttttcaagtagttaatcaattacttttaatcgtgtttttatatataatatgaattaagagatttataatttatttacaatgtaaatataggtaattaatttgtagtataaaaatgatttgactgtttttttttccaatacggcacctagttccttcgtaaatcatgttatactttttttttatagagaagtgtattattttacccgacctctacattaaatcagatatatgcatcctttttaaatagtaacttagctcatcaaacaacccaatttgaaattcatagccttttcaaataggaacttcgcgccttaaatatcccaatctaaaattcactcatgtgaaagtttgaactcaatatcttgggaggtgctactcagcacaccacaaccactatactacaacccaatctataaatcatgttacatgatattcgtttaatttaatccattaatttcctctctacctacctgtatgtgtgctagctgatgtacctgatccttgcgtatccatctcagaggatgatgcgcggcgaccaaatgcgctgtggatcacaagttgccgatctcgacgtcttatgacaatgcacatggcttcttcaattttttcatcatagttaataaaatatgaggtgctaaaggtcttataataatattttagcatagtttaatattgagattatatgtttatgtcgatgtaattggtacgttgagtccccaaatttttgtttctggatcctagggatcgaacgatcgatctatcgagcacggcgccagctgcagacaaagctgctaacatgaggacagcaatgtcacagcacagctagtagcaacgacgaaaccacatgcttgatggtgcacagacactgcagctagcgtacgtcgtacctgctgctcttttggctgcatctacgcgtcctcgatcgttttacttagctaacataattactactcctacccttcgttataaaataaataagtttaacctttttactatcaatataaaaccgaaaatactagagtactcatgctttatcaaatcctgataaaattatttctctctttatccactcctaatgtatttattctatatttttatacaaattctaatgcaataattgttttaaaataaatttattttgagataaattggagggaccgaaaatgatcttgttctatgatgatggagacggcgggattagttaattaatttttagacgatgatccaatgaaattagtgatgatcagagaaagaggttgcaatctcacttttacagcagcaacgacggaattggatctatgccgacttctctatacattttctgtgcgcgtgccaattatttttcttacagtaccggtttgtttgtctgtttcgatctctggaagatcgagaccggcatttagaatctcacctgatagaacaaaaaagcttgctatagctgtagctccaaaaaggctcacagtgacactgaaacatacccacgcatgcacggccggccggccagccggccactgcgcttcatataaacacattgcaacgaagtgttcacttcagagctagcgcaatcggcgcatgcctagctttgtgccatatttggactgggacagtttaattaattgctagcattactgcaatttcccccaataaatatcagccatcgtttgcacatggtctgctaatcatcaaacaaattaacaattgtgacgtgaaccaccaataacaatatactcctactcttacctccaatattttaatatctaacgtaattgacttttttttctcaaatttaaccaataatgtaaactcactagaatttatgaaaatgacccactaaaatatgaagcaacggtattcgaccccacaaggttaaacttctggccccgccactgtccgaggatactactgtggtgattatgttactatttacaggttaaatagagagagaagcacataaaaagataaaaataccctttagataacaacatgtcaattatagctttcctaatttttcttctctccctctaaagttttgcctacacttacttccctgtagatgtagatgtcagttcccaaattttctcctcgctcccgatcagttaatgatgatggtgcccaagggccatttttgtcttttctatgagtttttctctccattcaacctaaaaaaaataaagcaatcatcacggtgtcttccagaaagtaatagagtttaaactttatccaaaaataaatcaacttttatattcttatctatatcgggtcgcaaatcaataaattttatcctttcaatatctccctcctacttatccactaatataactagagaagttatgacgattagagttcttttttttaataggagtatgaaaccatcggggagaagttctgctcacggcctggaaaaccatccggaactgcgactcggcagaagaagctgaagtcatagcctgtcgggagagggtgagtttatcggtagactggatcagacagccgataatccttgaagctgactgcgctaatgtgatcgcgtgcctcaaggccagagaaattgaccggtccaagctgtgccatatcctctacagtattaagtcgtccctgcaagtcttgccggattttcgcctggagaagattagaagagaaagcaacggtgtagctcacgctttagctaatttggccttacgaaccaaacattgttctgtttagcgtatggatgcccctgcttgtattatggagctattgaaccgtgaatctcaacaagttgttgagtaatcaataaagctttctcttcctcacaaaaaataaaaaggagtatgaaagaacttccaaactgccgctaagtagtagtactactaaagagcctaacgtattattgtcaagtcaaaatgcaaacgaatatacctgcctgacttcaagtgttgcaactgagaaaaatattttctacatctataggtgccataccacctagttcatgtgatttaaatggttatataaaagatttgtccttgcaactgcccttgctgcatgaacgcgagcccgggcttgatgccagcgatggc

SEQ ID NO: 19936 - DNA, 9167 bp, Oryza sativa
cttttgtggcaccgcattactttcctattatagtaaattatacacctcaagtttatacacctcaagtttacacatctaaagtttagaccaaaagtttataagtcaaaagttatatatccggttcaaatttgaatttgaatttgggtattttttatatatagtatttctatacatctaaagtttatagacctaaagtttatagatctaaagtttataagtcaaaagtttatatacccgtttcaaatttgaattttaattatatctgattcaaatttgaatttgaattcaaatattttctatatatagtatttctatacatctaaagtttatacacctaaagtttagtttatagatccaaagtttataagtcaaaagtttacatacccgattcaaatttaaatttgaattatgtccgattcaaatttgaatttgaattcaaatatcttctatatatagcatttctatacatctaaagtttatacacttaaagtctatagacctaaagtttataagtcaaaagtttacatactcgattcaaatttgaatttgaattcaattttttttatatatagtatttctatacataaatttttttaacttttgttttttttaaaaaaattgtgtggtatactgtagtagaaagagaagaaggggaggaggaagggggagaagagggaggagtatagggggaggcggggccaaccgatcgctgggcgattgcctgtcggagtctgaaactaaaaacttgcatccgaattaatgtatcaatccctggatcagtaaatattgatacatacaatataactggttcttcattgcatatgttaaagttttacaatactaagggttttacaataatacgtactcgcctaactaattaatacacagcggaagtttctatacattctgactagggaggtataaccttaagggattctctaagttatcggggtcatcgtattaatagtcataggggtcctccttgacccaaatctgaaaaaggggttataagagcaaggatgagtattcgcaatactcagcaagttatcatggaaatatgttatgcattaatacatagtagggttctttgcaaaaagcagtaataaacaatctggaaaagttatagaaagaatttataaaacgtatagactttagatttctaaccagggtaccatatgagtcccgatactcaattccatgagtacggctattcgaatagtttcaaagatattctactgcagcagatgtacgttttacccgtagtccaggacttgctgataatcatcggctttagtcatggcccagtattaagtcattaacaattgtggcacctgttccatgaacttatatcctcatatgctctgaatgtattgttaacagcagcaagaggagttctggcgttcccgaggtatttaagggggaactgatcgtatgacaccacgtcatctcgatcagggtttagaaatataccatatagtttatactcgagtatcacaaaccatttacctgtacatggtaatggttaaagttgcccttcgcggctatagttgcctcctgcgcgaggatttaaaaataagaaccactatacagagatgccatattgctaattaacataatagctaggtctgtccccgttctagaaactgcggtcgtacccgttcgttcgacataagtacctggtaataactatatcgattgagacagtacttgacggagcgtggggctcctcaccgggagaccgcgtaggtccccctttgccggttcggccgggggcgctgagtgaggttcttcaccctcgatctgtggaacgttcgcgagagagcaaatgcacaagacacgggcgatgtatacaggttcgggccgctgagaagcgtaataccctactcctgtgttctggtggatctgtgtatgaaggagttacagagcaaatggagagcaagagagttcaagctctagaacccctctttttccttctcttctggttcttttttttctctcaatctcctcctcccttttttaggtgggcaaggtcctccttttatatctcaaggggataccacatgcactacttctacctactcttcttttgggtggggacccaccctatcttgaccaaatcttagactcgcgcctccgcctggaagctaaatcaccgcttgtccttgagtgatgcccagcgtcgtcactcgtcggacacaggggatcaccctgtcatttcttcattaatgggaggagatctgcaatggccgctgtctgaatgaccctccgatgggatgggtcatacctacctccactccgccggaagcagatgcaacgtgggagcacggttgtctgccgatgacgtgaccagcgtcagtccagtcacagaccggtcattcttttccaccacgcgtcagtttagcatgccgcacatctgcccttcttcatacagtgacttccttgcaatggttgcgatgaagcctggcatgaatcgagccgggactgacgtgctaactccaggagttaccacgccggctccagctagggacgagtgccaagaggctctcatcattccgacaggacggggcgaggcgtgtgacaggccgcctgctgccacctaacccgcgatctgaccggtctgtgaccggtcacacactgcgaccgatcacggaccggatatgcgtgcgccgtgctgcattaaatgcggcgtggcgcgcttgtccattccgcaataaatgtggtttggtgagcgccgctgtgcccacctaacccacacacgtggcgccaataccacagggggtcggggcgccccagccctcggggccgaaacaggagcggcccgacccctcggggagacagacgagggggtgggcacgtctccctcgggcccaacccccccgagggggctcaggtccacgtggtgtgtaccgcggctgcccaagcctctagtcatgatactcccggtcccatgtcaccgacaagtactagccacccgggaatcaaccaaatcttacgtactgtcccaatctaagtatgaggtattttaaccagattgtaagcaaaataagcaatactaaattgtttgggtttctatgattgatttatgcatagaaaatagaatattgaatagaaagctataaataaataatttataaaatataggcttaaatgatcaaaaggtatatggtaacttgccttgctcgatgtcctgagattgattgatattatctattgagtcagaagaatcctcaagacctagggttagacatatataaaattcaaattcaaaaggaattcaaataaaatccaaaaatataaaaaatagagaaaataaaataaaatgcaaaaatagcaaaaaggggctcaaaagatagagaatgattttagaagaatattggtccaagtttcactggaattggatctatattttaaaagatatgggtttctaaagtttaaaaatcaaataaaagtgaaatgctactgtgcgcgggtcccacctgtcagtctctctctcttctcttcttctacctccggccgtttccccaaatcgggccggcggcgctagggttggcgattgtggcggcgatagagggggaaagtggttgcaaccaaagaggggagggagctagggttctccggcgacggcgagcggcggcggagggattaatttgaattgtggatgggttggcggctagggcggcggtggcacggttaggccgtaaaggcgattgtgatggtacgagttagacatggctaggggagggctcctaaagtatctacgatgtatctagatggattccagcagcttgccaacctttggcaaggcgcggagggtagttgccgacgagcgcctccataggcggcggccgtgctcacgtcggcagcccagagggcgacatgatagtgcaaagtgattgctaaaatggaatctagggggtatgtagatggttaaaatggaagaactcaccgagatatgccgagatgaaggattgcggccggaaaaactcctcggcggcgaagaacagagcagcgcgggggcggcggtgctcggcttggtgcggcgaggtaaaactcgacgcagggcttcggttagggtctaatatactagaacatagttgatataaagtgttctaaggggtatttagggcggaggatagatggagaggtgtggagtcgatcgcgcacaaggtgttcaaccgacgggcgatggtggttgatgagatggattggtgaggcagagcttcggggttgtggggttatggttgttgatgatcgatgatggacaaggaagggattggggtcctatttatagggctagaaggagtggatgagctcggacaccgtcattgccatggatgagctcaatctttggatagggttggggcggcagaggctgtgagagggcggccaagatcaatttgagtggcgggaggccacgtttgaatacttaccggcgaaggattggcttgactgcatgcgaattcggctggcgatgtgttggcgccaatccgggcacgacgcgcggcggcggcgagggtgaaaatggctgactcgggggtgaatggtttgaattgtgagaggggataccaccgtctatcttcaatccaaccgcgcggcaagaattggcgcaattcacctcgggtagaagcaaaatcgcattcggcggcggctttggacgagcgcgcacggcgtcgagcggcgatttcttgcggcggtcgtcgtcccggctttgtcgttgtcaagattggtgcggcgatgatggtctgagggcgtcgaacggctagcggcgcgccaaggcgatcgagcacgcgcgatcgatcccgagaccgacgcgcggcggctcggcgtgcggcgaagtcggacgccagagagcgcgcataaaggggaggaagtagcaaagagatccacggtatttgagtgggatgtggtcccctaggatcaattctagactttgtgcaagattggatagggattgggctgtgttcgttgggctaggcattctgccgaacaccttgaaggcaatgaacagtgaaattcaagaattttaaatatttccctagaaaagatttgaatttaaactatgaatttggaagggtttcactagggtttgaagtatagcaaatcctcattaatattaagataaactaagaaaataatctatagtttgaaatttgagagaatttgctcaattcactaaggtttggagtaaagggaataattagagtaaattaatagggctctaaggaagtaatacttgaaccaatttaagaatcaaatagatttttaaaacacactaatttaatcaaaagccagcatgatgcagtcaaattttagtttaaaatttgagtatgttacatcgccctggcgatcaatcgcccattagcctcccccgggagggagggggaaggggatcgatcgctacccccgtctccgggcgatcgatcgcccattagaatcccccagccgcgtcccgcgtacgggggtcggggggacggtggcggcgcggccggtggaatccatccaattctacgtgacgtgaataacgtgaccgtctcttggatgggggcgggatggtgcgcggcactgtcccatcttggctttacacggacaaagtatcatttgctcagtacttcctgcgtcccactttaaacgcaaccataagctgaatgatagaaaatactaattaacacgcgaagttaagcacgcatattcaaaccacgtaggtgtaatctccgtgcgtgccagcgctggcagttcatacgctgagagcctgagacagaaacagttttgcctgcaccgggcggggccaaccgatcgatcgcgcgaggagaggtcgagactcgagacgagcagcgcgcgcgggtgcggccgggccaaaaccaaaaaccacattgatctcatcgtgcgcgccgcctccccctcccccggcttgatccctcgtcgattttctctctcaatcccggcctccgcgcgcggcggcaggttcggcggccgcttctccctctgtttcgtccgccgccaccgggcgcggctgctggctcggtcgcgatgcgcgcgattggtaaaccgagcgtggaaactagcccacgcaaccagcagccggcccacggggaggcaaagcgattttggcccgtccgcacgcgcctgcgccgtccgtgtccgtccgcgtgtgctcccgtgctccgccccgcggtgcagcctctgccggtttgagccacatgcgggattgcggctgccgcgggcggccagtggaatgtgctgtagcggcggctgggaaactatttttttttaagactagtcaccgagggggagagcttccccacctgtattttcattgaaagatagaagaagtatacgactttagattacatagtgcgaagggggaggaaagaatttgtttccaggattctacaacgatcctgtcagcacaaataagtctctctgcccacaaggttgcatcctcaatacatctagtaactagtctatgcagagagggggattctccacggaagacaacatcatgacgattattccataatccccagagacaaagcaagaagaaaaccttgaagtgctttgttgggaggcggccatttgggcgcagagcatagaggtcgctcgcgctggtgatagtctgggggatttcaagctgattccagaatgcagttgcaaaggggtagaggaagaataagtgagccaccgtttcttctgccgagtgacaaatagggcataacaccgactggacgattccttttttgcacagattaactttagtgggcagacgttcctttgtgagaagccatgcgaagaattgagctttagggggatctctgttccgccagacaaagagccaattggggcttggtaaatctcctttgtgtgcaaaatcctcgtcataccctgggccaccctagagtccggctcagaatttagggatgtgttttgtcagatcatgagcagttcatccacctgagcctgggcagcagaagacagcctgggagcaaactgctcgctgaaagctccactgcaaacctgcgccactgggaaactattttgattccctcgagggattgaattcaatcgtttgtttaaaaattatctacacagttatatttttttttcaaaaaaaaattaataacttttatacaacatgcatatgatactttacaaaatctttcaagcttaactcacgcatttagatataaaaaacatattcagtaaataaatagcagatgtatttgtaaacaaacttagtaaatgtatacttatctgaatttgttttttttctcaatgtgccgaatttgaacttgatttaaaatcaaaggctgatagaggtcgctatattatatatttgtcattttattcttatttttttataactatttacattagatttaggagagaaaaaaaacacgagagacattctcgaaggattttgaatccattccaagtagtagccgtagttgcatggatgggaacgccggaacgggatggcatcggtagcagcacgggcatatgcacacgttctgtctggtgtgggcaaacaccgtcccgtgctgatttatcacgatctaacccgtactccccgttaaaaaaaccaatctagatgatgatagaatactactagatagatatgtccagattcgttgtactagatggtgtcgacctatctccatataggttgaattttgtttggacggagggagtacgtgttatcccatctgtaagtacaactactaccaacaattattcctaaggtaaaatgtatgatttcgctcccttctcttttgaatggtggtgaatctgttaacccatcttcttccgtttggaaagtatgatcattttatacgtttttcttgtgagaagaaaaaactgcacacttgcattgcatctcatgttatgtaaaactggtttgttcgtacacttacatacatacctcgcatgttgcaaataaagaatgcagaaaaaaggagagagaaaaactttggcaatttgtgggcaccggagatgccgggaaggtattaagctactataaactaatgcttgtttcagttcatgcttatcagccatacctgcagtgctcagcaacaccaatttggtgtctaaaattgcttccctttggctttagtttttctttcctacctttgattggcaatggcacgcggacgctaaggactattcgtttctgcattttctttacgagatttccgcttaaagcagagaggaatggaattatttttctccttcagtgggatccttttgatctgatttaggacggttagatgctgacaagcagtgttctttatgggggaatcattagcttgacgtgttaataaattatcgaattattctgttgtagtttcacatcatgtgatgcttagccatgaggagaaattctggggaaaaaaaaccctagttgctgtcttgcagaattggtttttatcagattatcaggcaatggtgatgtaggatagatgatcctgtctgttgcattgcagctttcatgacccaaaacatgagtaaaatatggaagggaactggtccttgttttctgcttttggacttgtcccctcgaactaccaatctctctttgttttatctcacatctaactacaccttagtttggtaagactgaatgtctgaatcactaatatctgatagaaaaacaagggcaacaccataagaaactactcgaactagcaagtagcaacaaatctatggctcactgtcagggaaataccatgcaaatgtttatgatttttttttcaaaatatttgacaatatttatatagcataacatatacaattccacgatattccatgactcgactccacgttcttttccacttacgtattatggatgctaggctttcaaaacttctgaatggtatagttgttacaaaaactttcttcattggcgtttcttaaatattttttgaacaactttttaatatttaattccttcgtttatgtcctcgaataacttgtcttttaactcaatttcatccataacccatcatccaacagaactttacaacatacaaaccatctgccatacttttctaccattttaattgctcacagtgttcaagttggagatgaaccaagttcacatcttcagagaaatgaaagagaaacagttgtctccctccaaaatactgaagcatgtaaaaaggtacatgcccaaa

SEQ ID NO: 19937 - DNA, 1102 bp, Oryza sativa
tctattgtaatctacaagttttatggccttaattgtaagatattatatcttgctgttgtcactcaatgactttatgatcatcatattattctgcaaaaaagtactatctttgcttcagttatgtgtcttcgtttcttgatgctatgttaagttgcttcgaagtagtgttgtagaaatttttgctctgaaaaaattgatacaacacaaagcatataagaggccatttgcttcataatttgcttcatacatctaattgttctcctgacaaacgggtttatatatgtttcttctctttactttatgctgtcgcacatgcatcctataatacagataagagataattaaatcttactactacaatataatttgagagctaatttgctctgaactgtactccaaatctatgcaaaattctggaattttccccacatatctgacctgcttattaccacctgataaaaatggctagctgccacatgttcagatgatatgctgattgctgaattctgaatatgatctagtatgatgaaaaagtttagaggccattcatttgatcgaacaaactcatcatgggtgtttcagcaacacacgtttttttttgttcagttttacaaaactttcagaaatccatcgcgccattgtaagtacatttatcacactcacgctcgctgtcgtcatcaacctctgcaaatctcgacgagctcttccgggccgtcggattccgcggcggcgatcttggacgccgccgacgagaggaaccggaagccggcgtcgctggcgctcttcctcaccgacgccagctgctgcgacctcttgcagtaggcgatcagcccctggatcgggttctccacctccgagctcgcgctgctgctcctccgcagcgccggcgccgccgcgccgccgtcggactcgctcgacgtccgcaccgacgaggaggaggagcacgacgacgactgcggcgcaggggacgtcttgttcgacgtcgagtaccggacgatgacgctggagaaggacctcctgtggccgccgtggtcgcgctctttgtgcttccctcctccgaccgaaccacggccgccgccgctctgtgaggaggcgatgcacc

SEQ ID NO: 19938 - DNA, 5103 bp, Oryza sativa
tactcctccacgttgagctccccgctggcgtagcacgagttcgccggcgacgcggtgcacgagtcgtacggcgtcgccggcgccgtgcttatggcgagctgccgccgcccggcgccgccgacgacgacgcgcccgtcgagcagctcctccaccatctgtatccgcggcggcaggtgcagcggcagcagcttccccttgtagaacagctcgtccgccggcgacgccagcggctcctgctcccaccgggcgccgccgccgcccagcggccccgacatgtggaagtcgaactcgaactcacccggcgccgtcgccgcggcggcgctcgtcaggtccatgtcgatgtagtcctcctcctgcatcgcctcctgctgccccagctggtgcttgctcgccattgccaaggtgagagctcgtggctccggagctgaagctgagacaagagggcaggagacggtggctgcgtcttgctacttatattagccgcttaatcatggtggattaatgggcttagagcaaaaatggacacttggacagtgtcatggcatcaaatgaggcttaattacaaagtataaatactttctttatccttatttaatcatcacctaagattttcgaggtcttttcaaaataatcatcctataacaaatgtctctttatttgtttgtgtaaagagtaaatgagcatcattgaatatgctgcatgcaaccaatcaagattaatttttattgatgcaactacatgcaatatttaaaacttggtactattcacgagacacgaagcaacataccatcttaactaatgagaattaattatagaatgatggaaatttggttgtttcagtctctgtgtttaggtgatgatcaaaaataggatggaaggagtatcttgtaactttatatgtattgtgattacaggcgttttagcacataacacgatattccggatgccatgatcatatatctttaaaaaatcatgccgtaaaatcaattgttctttatttcaccatacttaaaatcaaatcaaatcttgaaattaagattctttttattaaaaaaaatttagccatgtcagttaagattctcttatcttgcttaactttaatagttttgcacaacttaaaccatataaaggggttaatgaagtatgaaccggattaatcatactattatggtgggccctaccattagccgtatgatctgcctcttgtttgcatgtaatgcagaacgagttgtgtgctctctccctatcattgcatctgatgtccctggctttagtgcagtattatcactcactcaacttcagcttcttttctgtgagaaaaaatcggctttagcgatcgcgttagtgctgattagggtggtgttcttttgcttttgtgccttgcgttagctgcatgcttctcttctttccatggctacctctcgtgctaatgctactaatcactagtactagtacagagttactagtattagtgcaagttaatagtacaaaggtgtggttaattaggaacgcatttctagttccaaccagtgagtgaccgcgagttacgagatgatacggacgatacgcgcgatctgtgtagattacttcaaacaggctctgatcattggctcagttaatcagtgattagcagtttagcactactaagtaatttcgaaatcgaaatctttctaaattaaacattttgaatttgaaatggtgacatagctcattccccaagaacaatgaggagaggaaaaaaaaaacaaagcatggagtggtgcagtgatgttctacagtacttcgattgagcttgtaggcgtgtgcattctctgaattttttagacccttcttcgtgtcaacatgttggagtgtgtgaaggtgtcattcatgtagtacagtacaaaatggcctggctgactgtctcgtcggattctgaatttcaggtcagcaaccatcgattcagaattcagagagagagagagagagagagagtgagagaaagacagcatttccatgaattttctagagcaaatcattttatttcgattcctactagcacgtttttcaagctattcataaaaaactttctatataaaagttgttttagaatatcaaatatattcactttttaagtttataataattaattatgtgctaatatttctctttttatgtgtgtcactttaattttcatctttatcattttcaaacaccacctgaatgcatgtgtgacttcgatgtattcaagggattgaggtaaaactgcacaacagcaattgtacacaatctaaagatttaacggccaaaaccgattcaccacattaaaatcgaaacaatacattttcatagtaagttgctacagtgttaggatgtatctcaagtgtctattttgaatcatgtgatgctagtgtggctgtttagcttgcagtcacattagttactacatgcacctaaacgggaaggtaacacgctgacgcgtgtgtttcagtggttctcttatctcctccttatcttagagcaaggttaataatacagtagctgcatactgtatagatttttagtctatctctcagctcattcatattgtggttaactcttcactataaatatatggtacacatgtctgtctcacagattttcttggttcctgtacctaagccggatgtaaacttacaacccgtttctcatctctctcctctcctctcttctcttctctcatccatctcagcattcagttttcttacagcccactattattcttgctcttaccttacgaatgatgttgatgttggtgagaaatttggcaaagccgtgaatttcggcgaagaagtactcaacctggccagccaaagtacagcatacacgcataaaagaattttctttttcttttttctctccgatggtgtcatggtgatacagggccttgactttcgtgtgttcccatggacttcctctattattactccacataggccgtaggaacaccctataccgtgaccatctgaagtaaaacaatgccatttacccataaaaagataggaaaccattgtatccattcctttccatattgtgtgaactcaagtcattttaatttgatcctaaatcaaacttctctaattctaattgagtttaaagaaaaatacacaatcagctataatattaaattagtaccattaaatccaccttgaaatatgtgttatagttctcttatttgttatattcggagtattacagatgttgccgtatttcttttatagactcatgggctgtttggttgctaccctgagaagaagtggcctgacctaagactagcctggcacattttaagtgttgtttggttaccagcctgaaggttctttgcccttgcctgacctgatgcatgctgtctcgtgattagcctgaccttcaggcgtagcagcgaacgtgtattatcttctttcatgtagcacaaagccaatgagccatcgctatttgctgccgccgtcgtcgcgcggaaccccagcctccgtcggcgtcgtcgttcgcgcacgaccttgcctcctcctccgccgccatcgtctctcgaaatcccaacctctgatgccgttgttgtcgcggacactcggaaaccgtcgctgccttctaattcgctcgaagcctcgtctttgccggcgccgtcgtcgtcagatccggcacagtgtcacacgaagctactgcgaggtcgccggccgggcccatcttcagcacgaagcagcagccgtcgccggtgtgccaaagcgatttgatgaatgcttggatctgggggatttctgtccttgcgttcttttctcctgctctctttttaacttatgcaattgatctatcttatctaattatgtgattgatatgtctataaagaaagacatatagtagatggatttggggattttttttcccttgtgttccgcttgtttttcatccttaatatatgcaattagtttgttcatgaatctgctaatagtgtttctttcctctcaggtagctgtgcacaacctgaccaggcaatgtaatcaacttttctcgtgcctctcaggcatgcaaatttctcatgctagatgcccagggcacgaaccaaacaagccctcagtcaaagttacgtaagtttgcttacaacaaaactaaaatgacttacagcaataatgagtaattcaacgtgaatattaggaaatgacctaatatcaaataattagaaggggtgaggcttcgaacccaagtcatctagcccatcaccttgtgaagctagtcggaagacccatgagtgtttctacatgactttgctatagcagactcaattacaatgatcttttatagtactgcacagaaaccggaccgtactagaagtagagtgagaacacttaagcaaagctccataaattgcttaaagataacataaggctaacatcaccatcccaaacttgcaattgaaggagtatattttattccgcgtataaaaattgttattttagtagtagtgattgagtcatcttgtagcctactaggaggatgtagcgattaggggctgtgaaactcaggttaggttgtggtcaaccttcaaactccggatttagggagaaaaaattgcaggcctgaaaactgaaatgagtgccacttgcaggctggctagctgctatgaattggtcggtagtggtggttcgaacgtggaagattcgcgttagtacgcaaagtatctaaagtcagcactttgttggttctaatctgcatgagatgaatctaatctggagtgtattttctaagagaaaggaagagagagagaagaggcaaacatgtaaaatacactaatgtaaatttcagacccaacttttgtacaatcttttgttgtttttttttctaattcatacatggtatatgatcttttgtgtgtggtccacgagcagtgtctactaagattacttcgttttaatttgtgtgcctgatcttttggttgcttcgtcccattaaaagtgagattagcatgacttcaactccttacgcctcacttatttcggagcttcttttccccacaacacaaggccacggcacaacattaagtgacaagaagttctatgatttttgtagtgtagagtttaacaagatggatatcgt

SEQ ID NO: 19939 - DNA, 2347 bp, Oryza sativa
actaccgcttccagaatataataagttttagggttaagaaatgaggtataattaaatatgagaatactatgattggataagtggaggtagtgaagaaattgaatgatgaatgattatgatttgttaggaatgattggtcagaaagaaaatgttagtgaaattgttatattttgggataaagggagtaatattttttttacatatatcctctacactgttgtccttgtattgaaagctgctaacacgagtacacagcggaggatctctcaattgattgttcattgtttcctcctgaatcgttaggcaaccggaattttatttgcgtgcgtccaatacgctaacccagcaaagggaccagaaaggaaggtgatcccaaagctcgaggtgtttctttgcctcctcttcggctggaagcaggcaaactggcaaaggtttctgtttcctccaactcctaggaaaactcagggtccctgatgatcacctaatggcaggaaaagtaacctgaatctgacaccagtttgtccatttgtttcagcatgcagcccctgttcagttcccttttctggtaaaccttggatggcgagttttaagttcttggtggttgtggcaggtgatgcacccaggaagttctgacaactgatgctaaggctgtgtttagttccacgctaaaattgaaagtttgaagaaattgaaacgatgtgacgacaaaagttagaagtttgcatgtttagaaaagttcaatgctacagaaaagttggaggtttgaagaaaaaagttggaatctagacaaggcctaacttttcttcatcagcaacagaagacctcaccgcgggaggccataatctgaccaatcacaagacaaagtgagccatgctctagcaaaattagatgggtttcacatcataaaatgatcagctatagagtaattcattccatccaaaatatcagatgacgagcacatgaaacttttaccagttacaggcattgaatgttacatacagcacaaggagaaggtgaaaatggggtaggaaatgtacaatgtttttctcttgtacaacatacagcgtgttttgacagttttgggttgcctgttgcttccatgaaccaggagtaatctaatcatagaggagctgcagctacaagaacacaaagagaaaaattgctgactagcagctgctgatacaacttggaaagctgacaagctaaggccgtaagttcgacgaagagtatcacagatcactccctaaaagatgtatgatcatgagagcttcgtcaaagcaaataaaatggcaacctttgcgttggagatcaaaaccataaatatggaaactcctgagatgctttacagattggacagaaccccaccatagcgttgagaattagtgtacacggacttgactgttatgctgatgcagaatctagtgttatctacttctgtgtttgttagaactacactacagatcaacatctggcaatggcatcttccagtaattccaggaattgtagtcttcctgcaaggcatcatcattgatgatcagcacaaaaaggaatttgcatgttatggagtatgaccatacatgagtacaacacaatcacactagctgcccttgctcccaacagtaacctgtatggttcaggcagcatagaactggaggtgactatgcgctaaggataaaaacagttctagtcttggatagtatgaaagaagccaaacaagaaaaagaaaaacatgaatgtgcatgttttcggtctagctaatcccatgaaaagtattgctagaaggcaagaatgacagctaacctgctcaacaagagtggttggagggaacatatcatggacaagggtatgtaaggaggtataggacttcacgtcgacagaactgtttatggctacttccccctgcacgcacaggatgactttaaaaaaggcacaatacaagcatggcatcactaacttttaactagtgtaatggccatacctttgggttgatgataaagattttcccttttggaattcccatctttttgtaactaagctcatctgtatctctgttgccaaatccagcataaaatggattgtaatcagaagggaaaagtgctttaatgtcctgccaaagaacaaaaattagaatttcaagagcctgctgtgataccaacatggagtttcaggtctatggaagaatctaaaatgtgtgtttctaagattgtcacctacccgttaaaaaagaattgagactaacaacttttcttaattcttgcaaagttatagtttatttctgaaggatatgagctatgatgccatacaagaactacaacggagccagctaataagaaaacttcggtggcgt

SEQ ID NO: 19940 - DNA, 655 bp, Oryza sativa
gtctgagctgtgtagtaatggtagctgaatgaaaagtctgagctgctgtgcaattctgctgctctctagtgtgactgtgaggacatgtttagagctatattttttcaaaagcaaactatagagataatccagatggccgtttttatctccaaggtttcggatgaacaaaaagaaacagccaggaatttcaaactacactggcaaaagcacagatgaatcacaaaaatcgccaattttgagctattcaagaccaaaatacaaatccctatatacaattagcagaacacaaatatgtgcatcgtctgcatttgcaaactctgaggaatatgaagtctatgaagtattagtgagtataggccttaaaaacataaaagtataacataatcttttttttttgcgaggaaaagtataacataatctccgccgtagaatcagtgtatacatcgattccttgtcctccaattgcaggcaactattcttgaatcttcaacaaaagctagcaagtataaaaggaccaaaataaaatctgattctatccgattcacctcttcttgtcacaactacttatcatccatgccctccttttattttcagtagtataaaccattcaaacatacacttcactgattagaacttaaaacaaattaattcatca

SEQ ID NO: 19941 - DNA, 755 bp, Oryza sativa
ggcaagccttgctgattctttcttagcggatcttgatgaactttcagacaatgaagcctatcctgtgagttggtttcagttactatgataatacagattttacaatgatttatttattgagaatttgttaactaatcatcaaatttcaggaggaagaaaatgctgaggcagtgggcacggaagagattggtgatgatgatatgcctgacctcgagtctcttaattatgatgaccttgatagtgtttcaaagcttcagaaaacacaacgttacaatgacattatgcaagtatgtgatcaagctcaaaatctcctttttcttgaagatggttttgtcctcttgttttaattggattgttgtttgacttctttcttctagttttctgattttgaagccctgtactgtcctattgtcacaagaaggctatttgcagtcaaacattaatgggtgtgttttagagtccaagacatgtttaactatatactcaatgttacaaatgctttgcgcaaaaagtacaatccttctaaatttgattctaaaggggactgtcatttgtatttttaggtaacaaagccttatgtttccatacatggcaacttacagaatcactctttgtttgcagaaagttgaaaatgcacttcagaaaggtacagatttttccaatcaaaggtcgatcctggaggaagatccagaataccagctgattgttgattgcaatgctctatcagtagatattgagaatgagatcattataat

SEQ ID NO: 19942 - DNA, 1287 bp, Oryza sativa
aatatcagagttgatatgcgcctgcattgtaacatatttgcaattacatcgattagtatttttaatgtaacttttcttttcatagttaactgcgtaggagtcctctcgtcattttgtttttctaatgctctattatttgttttatcgtccaggggatagagttgtcaaatccacaggcccacggcaacctgcttggaagtggaactcagagcacctatttttcagagaccgggacgttctcgaagatcaaaaggacctgagctgataagcaaaagtttcttcttcccatcagcccacagacccgtcataatcctcaggatgcaccgatgaatccattttgtaatgtactccaccttatacccgaattcagcagactttcgtggtgctgtttgcaatctctagaagttcgctaacttccatacggttcaagttaattcgacatgctgcgtttgatctgatgccgtctttgcgttcaacacaatttactgtttttggtaggtgattatcttatctgtcatctcatctttaaagtgtaatccctcttgtttcttacaaggtgctagttttgcgtctagaatttctgaaacaaagataagcatcagttggtgttcccaacttcccaatgttcccatcagtccgctatcaaggcagcgtacacgcaagtggattttacataaaatctttgaccaattaacggcgaatagtctcagcataacctctatgtgatggttgcatccgtatactcaaaacatagccaaatgccaaaatttacatgtacaaaaatggggttgctcacactggttcaccctacagagaattgtaagacagaaaactgtctgaaccgagcaaccaaaaatggatacaacgctgcaaacaatgtaaaatgactattcacccattctacaaaaagaaaaaccatcgggatttttacagggctactcgataaagttcgtttactcagcagttcgctgaataatatgatctgctggatatggtgtacgacctagcctttgctcagcctaactcgcaggtcctattacttatccactttgtacagatagtacatctcgagccatcgattcattatgctaacacgaacagaaaatgatctttaagctagtaatgatttaccaaaataaatgctttttgctcatgactgaagaagcccgtcaccttcccaaccaagacgtaacatctgatccactaccttcaagctcaactgcaacattaccagctctattagaacgaaggttaagtggcaaggtagtactttatgggggatccact

SEQ ID NO: 19943 - DNA, 1415 bp, Oryza sativa
tttaaaagagggggatagcatatggggcccacaattaataagtgagtgtggttgatcaaatttggcaagtgatcagtggagggatttggtcaaccggatggtttgaccattcagtgggagaggttgttgaagcacgatttttaactgaaattatcaaaatttagcttgagaagactgatggagtgattgttggagaacggagatgctccaacccatcaggaaaaaagcagcaagaggtcgtgttcggagctcatcggcccagcagatggcaccaatcaggcccaaacctcttgggtcacctaaaaggtgtcaccatgggcttgcaggtgtcaagtgtggagccgcaacgacccgtacgcagatcggttacaaccccaatcctccactgtctctggactctctctgcgtccgcttctccaaccgccctcgcggtcgcggcgcctcccccgtccgcaagcctctgtgccgctatacgcgcagcgtgcgtcgtcaagtctccctctggcgtcgcgcatggcgcggacagggtgcagtgacatcaagaccttttcgtacgccgattcccaaactcaacggtgttccctccttcctacggtcttacccgggcgtttcgctgtatcatctgttgtacgtgaaaaggcgtggtcaggcctggacgctggggaggctttcgaacagaggaagagttcccgcctctccgacgggatgatggagccctgatcgacgggccggctgcgaggtgcaccggctgttgttgttagcttggatctgggttgggatgtctgtcttttctggagcagccagtttctcctgcccatcacatttgccttattttactagccgattgttggcaagattgaggtggaggggggacattcttgggaagattgagatacttgtcacagtattggactcgtgtgtggcatatgccccccaatgcacatggatcactcctcgggttggcaactttaactataagtactagtactgcactactgcttggttgttccagaaaccgaagcttgtttctgcacaccttatttttgtcaagtcaacgacgattttccatagagcttctcttggatgagactagtacttgtgcttgcttgcttttggtgcaaaactgcaatctctaatcttcctctaatgatgttaaactgagaggcagcagcagcagtactaagagcaggtgcaataggaggcgctacaccggcgctaaaacaaccacgtaaactacaacgatgagctggcggagaaaaggtatgagagagaatatgagtggacgactaaatagtcgctcagctacacacgcgtttcaagatggtgaaaggctcacggacaaatcagaggaaacaagaagagagagaaccagataaatgaggaataaaatattgtttgacattaggggggatcca

SEQ ID NO: 19944 - DNA, 699 bp, Oryza sativa
ggatcccccggacttttttttcctgataacaaagataaacatattaaaatcctttgtagaaaacaaagagaataacagaaaaccgaaagaagcaacttactgcacgagaattctcagtggaatcttcatcagacgaaccgtcgtaaccagattcaatgtctggcttttcacggttcgatgatgtcatcattaccccgacaagtccatcaacgacttcaacaagttcacgcttactgatgtatgtcacacacaatgaagaacatggatgcttcttggatgtaaccaaacatggcattagatttgaaggcagtgccaacactggctggcttttgatcatgggattggtcatgagtggcaaaccgttgctcatatccactaccaaaatgaggtggaataggccttcttcaactagatttaacccagggtcttgtcaatgaaaaaccacttcttgagtgttttcttcttggtgtaggtgcgtgcacagttgttcaacagaaagttagcagagatctggaaaaaaaaaacacaagataataatatgacgcaactaaacgcacatatactttacaatcacaaaaatgtgatttaccttcatgtactctccagttcaagaaggtatgtgcatcagaaaaatgacagccagatagaaaaggccatgtaatccgccctacgcatatacctggtcatatagcattggtg

SEQ ID NO: 19945 - DNA, 612 bp, Oryza sativa
tgaaagaaaagacattacgatgtttagggaggttaataggcactacattgacctgatatgtttagggaggttaataggcactacattgacctgatagcttactcctacgttttgttcagagaggtaaacaagcgatttcaaaagcacttgtcgaactgttaccatcaacctcttgtgctgctgctgttgtttgctgctcctgctgctgactcgcgttcagaggaggacggacagcttgtccggttacttacctccggtgcaccccctcatatcagcatcaggccagttgtgcagagcgagagctttaaaagaataagcacaagtgttggtcagtacataaccccctggcttaagaaaagtcagcagcaataggaaggcaactttaacccctacggaccccagctttggtgtcctgcaggctgcagcagccagcagggcagcgaggagaggttgatccgttgatgcaaatgcagtactagtagtacacatgcaaacaaggtgcaaaagcattggcagggaaaggtacatggcagcataaacaaatacagtacgggctacacgagagacttgccatcgcttgcgtcgatcgcttaagaaaagggagctgtcagt

SEQ ID NO: 19946 - DNA, 1157 bp, Oryza sativa
gaaaacgatttagaagcaggtactgcagtagaatccaacgctgaaatggcaggctattcaaagagcgtaacatacaggaaaaaggtactgaaatcttaccatctgttgctgaagcttctgattttcttctactggatattctctctctgcaaccagcattgattctacagagacaccctgaacagccacacgcaaatgcaatatgagcaaggcagagcaaactgatagattaaagcgtcagtttactgcaaaaaaattctgagtataacccgctaaatagtattgtctcaaccaaccaaacaagacaatacactgaattataacatacaggttctttgttttaggtatcatactgctgtactgacaatggcatggtaccaaacaaggtcacttatctacccagacaaaacaaactgaagaaagaagttgactactaaacttttgataatgacatcaagagtctcattctgcaggagaagcatcacaaggttgttaggtaaaacacgttagagataactttgacatgaaaatttttagtattacattagctaacatgtgattgtgatgaacctgaaatttttgttttcttttaaaatcggacatcggctcgtgtgcaatgtgcatttttactatagaaaaagcatcagagtacactcaatattttttaaaaaatgtaaaacccggatgccattatgacaatgcaaccaacaagactatgcatcactcatcttagtgactaaaaaaactttaaccgagcaaatggttacctcagcagatgaaactttgtctgctgacctatcggtgagtgtggatacctgagaaggaaacatgtatgatattgttttctctgtagcaccgaataaacatcaatgcatgatattacttacagttacagcatcaaacactgatgtcattttcactccatggctcatgacctctgactgaggggatgcatcctcttcctcttcctcttcctcctcaggcactggagagggaggattagcagcaacatacaccacccgcagcttgaactcctcgatcaccctgcctggcgctttagttaactagaaaccacaacaccatcagctctaaattttggttagcccccggctagagatatcagatatccatgaagattgctacaagaacttaccaat

SEQ ID NO: 19947 - DNA, 1027 bp, Oryza sativa
ggaataggatattggcctgaactttatggtgggatcgttgcggcaaatatcatatttaagggataggattagaatgctcgtcatggtaattgcaaaaacctccaatccaatcgcattcgttggatgcgacatcaacgttgccgatgtgagtcctctggattttctttttggtgtcagctttgggtatgcccttttttatatactagtatattactactactactaatctaggatttttttccccctggaatgtgtagcctatttcagttaactaactgcctaatgcagaaatttatagaactcataatgggcacactagtttgttgcaaaattggctaaaatttccatctgcaaagtgcatttgcagttctctactctgaatcaacatcacctgtcaaacaacctccacaaaggataatgtatcatgtagctagaactgggtaatccaagatttggtagagtgtggtagggtaagcctaactaaaggcctcctcaactgcctgcctctgcagctgaaacctgaaacattcagctaattgatattcctgagttttgtttccttcttatcttaaaagtgcacattcggtagtggttgggcaatcaattattgttgagatatcagcttccaagactatacgagtgcgaaattgtttgggcttgtttagatatcgactggatttaccataaacgggggatccacaacgttcaaatgccccatgtataattcagttgttctttctctaattcagtttatccatcataattcacggccggcttgacaggccaacaccacgttgaggcccattagttgtccatgccccacatggccttcaactgctgcgaaccttcataaaagggcccataatagctctattggaaaaagtccactttgactcccttaattgttcaccgaatctaattcgtgacccttaactagaaaaccgggcagaatgactcccccaattactaaaaccaatacaaattgaatccctcagcggttttgaagagtggtttcgctgacgtggca

SEQ ID NO: 19948 - DNA, 752 bp, Oryza sativa
gaaccataaaacattctgcatttatgcagtcgtgcataaataagcagagacgcgaaagggcacatagtcaagtaagtaattgtagtgacttgagtagcactacaaggttcttaattcaaatattcatagaagcaaatttcagattgaattatttaggggactaacttcctaatttaaaaacgttgcatatatccgatttgatgtaaagactgaataaaaaatatccttctctaaaaataaatgtaaagaataaataaatgagcagagacgagaaaatttcccgatcaccttcgcaacaggccgtgaagaagacaatcttaattggcaaaccgagacgagactacagcctggtctaggaataagttcattttgactcttttaactagtgaccgaatttgatgcgtatcctgaaccacagtaccggatatctcgacccccaactatttaaaccggtgcaatttaaatttcttggtggttttggagggcggtttcgctgacatgacgcatacgcgacggtgttgacctgatctttatcctacatggcattgacatgacgtttatgtggcactagaattaacaaatatacgtgggactcattgtcatttacacaaaaaaaaatatttgtggaccccacatgtcatcatctctccgctttcccttccccttcttcctcctccctctctctctcccttatctatttctctttctctcccctttttccaacttcggccggccgcggggagtggggctgg

SEQ ID NO: 19949 - DNA, 1135 bp, Oryza sativa
ctactgtactatgaacagcttttaagaaaccatcgggcttaacccatgcaactttctgcccttgtatatattcccaacggcaacccctccgtgtggcccttctctctgtttccctccttgcacgcttgctgctcgatccttggctcattacactgccatcaagatcacctcatgtctcccttcatatccatttcttcttgctgatcattatcactactcgtgtgcctagctagtgccttgccatgtcttgcttgacctctcctcagctggctcccaagatgcagcttaagctcactgccgctgtcgccgctctcctcgtcgtcgtcttctttgcgctcttcgtcggctcatgcgaggcgcgccgccttcgtgcccttggcagggtcagctcgctaaaaccatcgtcgtcacctcctacgccgtacaaggttggtgcagttgaaggaataacttggtatatatcggaatataaagtgttccttttttttggctgttctaatttttccatgcttctcccttgtgcaggatgcggcaagcatgaagcttcatggttctgatccaacgaaccagaagaaggatttatcaagtactagtatggatcatcacatggctagcggggacgatgcgaaggcgaaggacggagtggcaatggcatcaccaggtgcagttcagactacgattgtcgttagggtttcgaaccggctctctcatcaggagcgaagggtggacacagcgtttcatctggactacgctggccctagaacccatcccccctctcacaactgatgagtatgtcgttctgtggcattctctgactctgtctgatgatcttaattactaatatgcaacttaagtgatttatgtatatgagtgttcaatctctaattctggtgcatattcttgcttgtttgctcttatatatgctcaatttgctaataaattaatattatcggtataaatagatcgtagaatgtgtagttttgtagaaagctcgccggctagatattttgcttgcttgaaatatgaattgaagttcacacacatgtttatacatgtaagtttgatagccgtgtgagaactatatgttgacatctatatgttgactatatacaaaacttgatagaaacatgaatcg

SEQ ID NO: 19950 - DNA, 549 bp, Oryza sativa
ggatcccccaatgttttttacttactgcaatgttcctcgtacaactttcaatggtcgcaccatcgacgatggaagctcaacaataattctctcatcagcatcactaggcacatatccaggtgcaataaccgtcgaccgaaccaaattgcgatcagcagaaatgccagaacctcgtgaatctattgatcctttcacagactgttgatctgcttgttggagtcgatcgtcaacactgctttgagttgtgtctgattctaactgctcattgtcctcatttctgtcatccactgacatggcctcagccgttattataggtgcagttgatggaagtgtgtctgttactaaaggttctgtaccctctgggttgcattcatttgattgtgcaacattacttagctttcgctcttcataatcagcagctgcacccaaatgatcagaccccttgtggttccttttcataaatcttctcatccttgaagaactttcagtaaaatctaatttccagaaaatctgaaatacaggaaagaaaagaaacatcaaaagatgtcc

SEQ ID NO: 19951 - DNA, 786 bp, Oryza sativa
taaccccgagttgaggaaacggtactcgacgagcaccacctaagcgaagtctcatagtattgttattctcttgttccgagctagtgccataatgcctcccagtattagcacaatccaatcgaccataaacaccataacctataaccttgtttagacgtgataccctacaataatcgcgctgcgagcaaaccaatatataggcacacactcacaaatccatagtgtccatctagagaacgagtaagatgtggacataagcgatattgtcaatcaaaaccaagatagcaccaatctataggttggtgtggaagaccttgaatatcgatgaaaacattatttagaagtacacgttaggtggcagcagtcaaggtcggatgtaggcgtgatgccccaagccaggccccgttgccgatgtcgtcaactagcacgctgccagtggcacaacagcggttggtgatgtcatgctgcttgtatctagctagatttggacgctcctatatcaacttcttggcacacaagacgcccgatgatatctctgtaccctatcgctgttgcacctcggatgacgacacaacataagacggggagaagatcatctaccatgtgtgtgccaaagtgccagatcaatgctggagacgtccgatccatggttggctccctaggcagtcgagggggaggggaagtaggatgaaacatataatagagtcctactgccatcggccatcgccattgtgtttgtcagaaaccaatgaggatgaagagcatggtgtagcggcttggatatct

SEQ ID NO: 19952 - DNA, 444 bp, Oryza sativa
taactcaacagcaagaatgcaaggagaaagcaagacgggtcctgctcttgcaagcaagcgaataaaacagacgcaaccagaggatcgcactctctggaagcaagcagaagaacaggggtccatagaaagagagttaaatcaggcccctcaaatttgcaaggcaaataaataaggcagacgaggcgatcccgtttggccgaccagaatctagtttttttctagacggatggaagatcaataaaaagagaggagatttatcctagaaaatgggaaatttaagccaggagaggaggcgaagagatttgatcagatggagcatgcaaattacctgcagtcttgcagatagaggttcagaagttggctgttccaggaatcgtcctagaaacagcgtggttcttcttcttcctggctgctttggcgccgtgaggaggcgagcggaccgcg

SEQ ID NO: 19953 - DNA, 697 bp, Oryza sativa
attcctgcagccctcgttttagcagcccaaatatcacaatttatcgaatatctcacaaccaggacgcacaatctctctcaacaaacttcaatgactctaggctacaaagtcaacatgaatgcatatgcaaactcaatgaccgtaacaaggtacgtaacagttacaggatatcattccgaacaagcagcatcttcgtcgaatagtacggggagaaacagtaatagtaaccaggacatggcaaggacactgccaatccgcaagccagaaaattcagagaaaaatacagcaaaacaaggccaaaaaaagagagagtaacaacaagcttaagagaaggcaacaaacgacaatcgaagaatttgatacggacagggaagaagagattctagccatttatagtggcaccgatcacatagtcatcaattggcataaaacggcaagcgcggtgctcaaataaccaaacaacttcataagaatcagcaaaggcaaggtgaccaaaaaattgcattgagctacgggaagagctttgcactaagaaacccacaaattcgcatcaaacaacaaaacaggcacgaagtcaaccctccagcgcgtgaaaaaaaaaagaggagagagagctgaatcagacctcgattcaaatatactccaaaggctcaaatcgaacatctacgagggagacagattttgatcattacccagc

SEQ ID NO: 19954 - DNA, 532 bp, Oryza sativa
cctgcagccctatttttcgtcacccctatgtgacttagtagcatttcaggcggatacacgatctctggaggcgagctctttcccccagccgaactcacaaaaaggggatctcacgatttcccgctagagaggatcactcctcgacagggacggagggagtatatggaattatatcaacagtagatatatatgaaccagtaatatcaaccggtgttagaagaagaatgttgtattgcatagtgcatacatgatcccgctgaccatcttagatacttcctccatttcacaatgtaagtcattctaacattttccacattcatattgatgttaataaatctagatagatatatatgtttagattcattaacattaatataacagaaaacctacaccacggcatcccgtggagacgggatcccctcctcctacctcactcctcttcccccaattcatccggatcccctcctcctacctcactctccttccccaaatcacacgacactgcagccctctcccgtcaccttctcctacc

SEQ ID NO: 19955 - DNA, 521 bp, Oryza sativa
tggtgagatgctgatataaaacaagtcaagacacttatccggttgctccttgtcaagtgctggagttttcttttccgacctacgggacgacgggaagcatgctgagctgctgctgatcagcgatcaattcagcatcgtcactatggtcgatcgaattatttgtttccgcgactccgaggacaggtcggaaccgaacctcccgatgagacgagaagaaaacggctccacgactgcaccacacatgccagtagccacgcgtccacgccagtgcacagtcccggagtacttgcctgctccgctccgtttcgtcggacgaacgtcggtctgtcacgctcgaaccggcgcgcgagtgcatcccctcgcgggcgcggtgaaaactgagcgcgaccggccctagagattcgtcactccgccaagcgatccagatacgcgcgctgccacgccgtaagcgtaacgtcgctgtacggcgttctcattcaagagttgcccgtccgcgcgcgcgcgtggtatctctatcccct

SEQ ID NO: 19956 - DNA, 1361 bp, Oryza sativa
tcatgatggtcgaggcaggtgtgatcagcatcgccatgctgagacggatacaagctcgccacgctgccaatagagtgcaaggcctgctccacgcttctccacatggaagcctcggacctgcacccgcttcaagaggcagtcagcctgtgcctccgcaaggttgctgagtggttgaggtgcaaaccctgctgatgttagcactgtccgccaagcgatcgctttgtcagctctacgccgcccaagaactgcatcctccactctgggctgaatcagaaacctctcgatcttactgacagcatccgcatcagtgccagcagcatcaagtgattcaagaagacatagacaagactgtaagcaattcaagaagtgttgggaaaatgggaggtcgctccgatcactgccatagtcaatagcaaccacaatcttaggagcaagctgtttcaccaactgaagcatagctgggagtggagtgcgtgctgagcaaccaactgggaggcttactgcaacaacctcatcagctgtaggagcaatgagttccataggatcaaatgcgtcgagattaatagcattgaactcaaatggaataccaagatcagcagcaaactgtgagaggttatcctgagtaagatgcagctcaagcgggtggtgggaggcggctgagacgaaggctgtgagcttcaacatcggcaaggacacaccgccagagccacagcggtgagcaagctcctgcaagaacgaagcccactggccgccgacaccgaggtcgaaatcaatgacgcggatacaagacgcggttgtgctggcgatctcatccagaagcgcctgagttaccgtgaagttggcaaactggagcacgggggagaggtcggagaaggatttgtaagcggtgagcttcagggcgacgtcgagcggagacgtgagacgggtggcggcgtggtggccgtcggcgagcgcgaggaggagggcgtcctttaggtaggaggcggagcggaggaaaggcttcccaattgggggaagctgctgattgagccgcgccaatatctctcgcgcgcctatggagttgccgacttcggttgccttcgccgccgctgcaagctcgtccaggaggtgttgctgctgcgccgccgccgccgccgcggttgacttcatcgcgttgcgcggatgctgcatcgaaggctggagctggaagggtaccgcgctatgtagcgttggaaacgggaggcattgcgcgggcgccggcggcggtggctggggctggttgtggaggaggaagagattgtcgggcacggagtggtggcgcttcggcggtggctggagcagtggctgttgttgatggtcggagaaaggagggggaaccggca

SEQ ID NO: 19957 - DNA, 1855 bp, Oryza sativa
ataccttatctgggttttatttttattgcccccgcgagcttgaattgtggacctcgaacgtgtcgattggcccagctagctttgacggttactagttcgtttcctctcagttgcaagtggagcagtacgagtacctctgtttagattttactcctacataaggtgtagatggatcataacaggagctgaaacgaactttcggtttcggattggaggcaaactttctcgttggtaatctcccctatacactgtagttgttctcgcgtccgacgccatgaatcgccgtcaatgcatactccgtaagtccgtatggtgtagagaggtatgtccactacacactaccgggctgtatttggacacggcccgcgtcttccagtcccaaccgccgagcctacgtaattgccggcccaactgacatgctgcgctcaacttccacattttcccggcccttctttgggccaactcgcaaaccgcccctgcgcggcatggaacgcagcgaatgctcacgcagtcacgccgtcatgcgtcggcgttggagtaacagcgacgccaagcgggcacgcaccgccggctagccgctaaaccaggttttgaaaataattattgatgagtttattttaaaagttaaaaatgcttaaaaattattttaaaaatccacattctgctcctgcctttgctcgacgatggttttgagcaaacagttttttgttagatttctctctgtctcaaaaagaatcaaactctaaagataaatttagatttgtttttttttgaaatagagagaactaaagaacggtattactatatctttgaaatggtatagccatgatatctactccatataatatcattctctagattctctattaatagtatttctagacgatatgattagtctcttcctttatctttggtttttctctcttccctaagtctcttcctttatcctttgtttttctctcttttctgctataaatcggtctgactgatttgcattgtgtaaataaatactcttttcttctaatacactattcacgtattattattttacgtgttcgttaaaaaaatagtaggtgcaagtgtaacctgatgataatgtagctgtagccctgcgtctgcatgcgagcctgctaaggattgtggtgatagtgtggtgacacggccacaaggacgtttcttcattgcttgcacatgaatctggcctatcttctgtctcaatagccactttgctagggaaaatcagtcaaggtcgcaaaggacgctggtaaactttttttcctttcaatgccctgtcgtgttgacacttgacacaatgaaaaccctccaggacgagttgccacgggggtaggcgagagctgcagcacaaggaccgtgcgcaaatgtatgcatatgagatgtgatatgatatgacctgaccaaactcctggtcctgctttactgggacaacatctacagcaccgtaataagttctcattgctccaacgcagacagtactgggatatcagattggaccaaagaacagtaggcacaaggtcttccacaaattcaaccgctgtcacggtgtcacctaccacaacttgcaatattcagaccaaatcaccaaagtttttttttcctactttacacagggacgaggatgatttttttttttcaaattgtttgatgatctgacgttgcttggctgttttttcaggttttatctctccggggaatctccttatcatccttgtcatcaaataatgtgggaggttgaaattagttcgaatgttacatttcattccaatgccaatctgcctaacagccccaaagctgatgcatctgcccactgggttcggagcaatggagcgggggatcc

SEQ ID NO: 19958 - DNA, 502 bp, Oryza sativa
cgaattcctgcagccctggtttctatataagccaaagataaagaagacagtcgttgctcgttagcctggtgtaagagcatctccaacaacatctctatcttcctctccaagttaaaaattgacatttttggacaaaaacacactccaacagactctctatctccctctccaagccatccggctggccaaaccactcctcccgctggccaactttggccagccaaaattgacttgccaatcatgggccccacgccttttcccctctccctctcccctcccatattctctctccacgccctcaccctcctcccagattgctcgcgccggcgccgcccctctgtcgtcgttgccccttgttcgcggcgccgtcgaccgctgccgtccgctcgcatccttcgcccgtgctcgccgctgccactcgctcgcatcctcagccatggctgactggtgcagcgagcagagcggaggaggtagtgcaacggtgagggagggagggtgcggc

SEQ ID NO: 19959 - DNA, 488 bp, Oryza sativa
gacggcagcctcttcgcggagattcaggccaagaccgacttcctaaagacgcttatcgccgcggagggggagtgccacggcggcgcgctgccggagcacctggaggaggccaaggcgcgcttcgccgtcctcaagggcgcgttcgacaagtgggcgcggcgcgacgacgcggcggcgccagcggaggaggagcagcccgacggggcggccggctcgggggtccgagtgctcgtgcaccgagtcatgcttcggggtcgaggtcaccggctgcctggaggcgacgtccgacgtcgagcgcgaggccgtggaaatggcgacgctcggcgccacgttcaacgccgagcgcagggccggacacaagccgtcgccgtcgccggcggctgcgacaaggaacgctgctcggcggcgcggatggaggcggagcgctgcttgctgcggtgcagccggcgccgtggcggtgctcgcgctaaaccatccggggggatcca

SEQ ID NO: 19960 - DNA, 498 bp, Oryza sativa
ttttaaccgcccccgccacgccaacgcaacgcaacgcacaaccgaaccgagctgcgacctcgattcgtcgagagcgaggcgagaagccgatcgatcggggggagagcagccgcacgcgaacgaatcgaaacccttaggcaaaggcgcggtggattcagggaggattggaatcgcgcgtgaggtttttttttttgtgtgtgtgtgtgtgggaagatgcgggaagcgagaggagaggcggagatgttgccagctacggaaaggaggacgattttttttcgcctttttgattcctttttttaccgcgtcgcgtcgctttgcggtttggtcgggtggtgtcgtcactagtgaggaggaggcggcggaggagagagaaggggacggtgagatgcgttcatgggccgttagatttgagcccatgggccataaatgattggtgggcccagcccatttggacccaacttctccacaaaaaaaaacggctgttctttttgtttatgt

SEQ ID NO: 19961 - DNA, 3565 bp, Oryza sativa
ctatgacttcggcggttgatcgggcttgttccctcctcgttccccgatagcttcaatgtccatggtcgcttctctattgcaaaaatggaatgtctctattcagttagtacgatagtagtatgagcaacaggattaccatcattttgtttaccgcgactgttgacgtcaaacacgaggcctgggagagtacaggttcaaagctcgccttcgggtgtgttagcgtgccaattgaattgatcctgcaatcaacaagaaatagaaacagagagatcgcggttaaatctataaatgatagccgatcggctaagtgtcgatgacatatcatttatctttgagccgatgtcatatgtgaatcgatcggcgactataaatagataataaagacttaaacctactcgatcggctgtagatattaccaatatatagttcttatatcgatatatatttaaatcaagtgattgggatagatcggtcgccatgccaagacaatataaatcacttggatcgaaatatatattaataacaggactatatatgtttatagcatagccgatcatatagatctagcatgtatcggctaatacttcgatactactctatatcaggatattaaaacaagtataatatatcaaacaaaagcttaatatacttaaatgcaataagatcttgacataaagggcggatttaacatgtcactgaagcatatagagcgaatatggttaaatcagataagatcggctgaaactccgatactaccctaatcggcaaccagaaggcaggctagagattgatattctaaacacgacttaatagatcaaactcaactgatgcagcattaagtatgaaaagaagaacaatatctagacaatcaagccgctggaagtttcatagagtggtggatatcttatataatctaaatcaacatcaaaatctaacctaatcggctgccctctactagcagatgttagccgattgtaggttagatagtgatattgccagagattatgtacgatatatgataactcgacgaattacgtaaacaagattagagtatcataaagatggaagcactaatcccgataacacaagccatcataacaagttttacctcttgttgaagatcgaaacgatacagctcaacccgaaagtaagaactcgtcgaaataaaactaaagcaaaaaggtggcgatgcgccgaaattgtattgaacgtgtgtgtgtttttaattacatagggctcggggtctatttatacccgagaattacaagatatgtccataccggacacgactattatctctaacaaactctaagataccacaagtctttacggcagacttttgcccaagcatatctataaggaaattacataaaatatcctaactaatagatacaattgccttcccaggactctatccatgcgtggcaattatcttgaagcacctcaacccaacccgatgtcgtacaccaagtcgtattgttggaatcggctgcatcacctaaccaaatctgactccaactcagccgatccaatcgtagccgatccggacttcagccgatttttactctgtttccgcgacaatcttcatcttcgaccccgcttcaatctaatcttcatctccgatactgatattaccaaatttggtcgttaagagtgacatatgtaccatttatttgaaattcaaattgaaacaaacaatttagttgaaaaccaatttattcatgttgaattcgacctttgctgcttgctgatgttctcaagttgagcaacataaccaaataattgttaatttttgggaaaagtttcatccagattgtcgagcccatctatctcaaagtccacgggttcaatgcaaatggccccacttgttcttaacccatttaaactttttttcctttcctgattagaggcccctagcccacatacgtgtctcggtggccaaatatagacatttattcctaaaaactttatatatagaaattttacatatgtgaactttctacctgtaaactttcgacagagaaactttatgtggaaaattttcaagcaaaataaaaataataatttcataaaagaaaaataatgtgtaaactttctattgggcttattggcttaaactagccaaaaagtggaaagtagattcaaaacatgcaaaagtcagagaaaaatgtgttctacatatctcatataggtgcatgtcatgaaatatactcttgatgagatcatcatgtgtttaaaactaaagcacaaaatcagtaactaagaaagggaatgcagaagattttttggagaagaaaactcgaaaattaacatggggggttattttgcgtgattgatcggccttatcttttcgcttatgcttatgcttatcacccaaaaattaaaatttcaatcttaaatttggagttgattttgggtttttttatatcgaagtttatttttcagtctttgcttttagattgctaagaacacgtatataaaagtcttattcataaattattattcgaataagcgaaacgatgaggcggacgtgcgtgtgcttgttcacaaagtactcttttcacatatagtcttgactttagagaagagtcctgtggaggagactacaaatcgggcatctgatttttcatcaaaaatcaagtgtcttgtcactcttagtcgaacaatgtttcaccgttaaataaaaaaaatgtttcaatctattaaatgctgaaacataggtgaatcatgattgaaacaattcgatccaacaaacaaaacatcaagcttcaaccgttaaaatatcaagggatatgcacagatcgatgaaacaatatcaaactatccaatgcaacatttcgatccaacccaaagaaacatcaaagatacattggttgaaacatcgaaaaaaaatgcaccagtctagattgagcttcttcctcctctccggtgaccactggctcatttggtttccgttgcagatccacactgggacgtgcaaggctcttctactccaccgaggagggcaaccacagctgccgagacactaagcccttgtcaccccaccattgtgccatcgtcactcagacgaacggaggccgcacccaccagagagctgcggggaggacgcctcactggtcacggcaatcataaccgcttggtccgccgcccacctacatatatatggtgattcgaccaaacaactgaaaaatcattgtagcaatttagtttttctaactaaatgaaaaaaggaaaaagtacggattacccctccctaactatcacggtcgtccgaattacacccctgaaccataaaaccggatattctttaccccgaactatgcaaaccggacgaattaccccctcgatccaatccgcggtggttttggtctacgtcgcatacgcgtggcagtccagacggcattttagttattaaaaaaatgtgggacccacctgtcatacccctataacactattcccccctctctctctctcctctctctctcacacttcctctctctctcctctcactctctgaacgcgcacggcaccacggcggcaggcggcggaggaggcgaggcagcag

SEQ ID NO: 19962 - DNA, 3665 bp, Oryza sativa
ccgccgcccacctctcgcccttgtgatgcccgtgagagagagagagagagtgaagatagagagaggaaggagaggtatgacactgacaggagggtcccacaatttttttagaaaaaaattgctgactggactgccacgtgtacgccacgtagaccaaaaccacctgcggattcagtcgaggggggtaattcgtccggtttgcctagttgggggtgaagaatgtccggttttatggttcagggggtaattcgtactttttccatgaaaaaatggaatcgttattgtttagaattagaacgcacgttcatatcgtcgtcgctaaatatagttctttcctttgatgtagcccatgattattattgaacacttaccggagttgagaaaaacaactcggttaatcctatttagtggagagaaatagataaatttgaaaaaaaaaggaatacacaatcctaaatatatcggaatattttgatttaaattgaaacacatattttgggcccctaattttagggatctatacggtcgcatagctcgtatgtgtgcagagatgggcttgcacgaaattaacttgcactgtactcctagaaagtgaacaagcatttcgagatttctttataagggcttgtttgttttggaggaatttaaacacatataaataggaagaatggaggaatataaatacatacacacttcaattcatagaaattttccaagatgtttgtgtggataaatttttttctatgttttctcattacaactcgtaccaaaggaaattttcctttagctttcctatacctacattattatgaaccgaatgacactaatagtaattaattctaagtaatcgatttccctccaaactgaaagaaccctaaatcaactgtcattccacgagtaaaatatatcttgcttatataagtagccaggtgaaatgtgaattgtggcaagagagcaaatatcttttatctttttcctcgcagtgggaaaatattctttatcttaaccctcaactgaacagaaagttactttgttgagtaaaacaacacaacacctttttttttcatgtacttcatccattttaaaatgtatgacgccattgactttttcataaattttaaccatttgtactaaaaaaattatatggatatcatttattttgttccgacttgttttaatatcaattaaaaaaataatcttaacttatactttttacatatttatattaaatttttgaataaaacgaatggtcatatattgtgcaaaaaattaacgacatcgtacattttgaaaatgagctataattacgactggttcatctttttagaattagacaggagtattaagaaagtaggtgtaattaaatacgagatgaacgtgtttgcttgaaaagagaaaataggtgaagaatttaaatggtaaaatattatgattagttaagaaaaaataggtggaaaaattgttatattttgggatgaattctaaagggatataaatggttacttcaggttataagacattttgattttggtcaaagtaaaactgcttcaagtttgactaagtttatagataaatataggaatgtttataatactaaattaatttaatcaaatcaataattaaatatattttcataataaatttgtcttggattgaaaatgttactctttttttataaactttgttaaacttaaagcaatttgactttgatccaagtcggtggagtatacggagggagtacgaaatttcgggcctgtttggtacagctcaaactcctaaatttaactccaggaggtggatttggagtggagtccacaactctagtttattttgtgagagagcttcacccagctccactcccagttttggtggagctgaaactgtttgactgggctgaagctagagctgtgccaaaaatggccttccggtgcaaacttcgaaactccaaataccgcgccacgcggcagcctgaaaaataaaactggcgcctcccgtacgaaatttcgcacctgtcccgccaaatcaccgatccgcgcctcacgccacgtcagcgattcgcgtctcctctcgccatccagatcccaaccgtccactccctacccatccaacggcagccacctccccactccatcctctcgtccccttttaaaaccccctcccctttcttcccccaaatcccactccaatcaccaccgcttcttctcctcctccatttcctctcgttcctctctctctctctctctctctcgtgcggcgagccaccggaatcgtcgtcgtcggcggccatgtcggggcgcggcaagggaggcaaggggctcggcaagggcggcgccaagcgtcaccggaaggtgctccgcgacaacatccaggggatcaccaagccggcgatccggaggctggcgaggaggggcggcgtgaagcgcatctccgggctcatctacgaggagacccgcggcgtgctcaagatcttcctcgagaacgtcatccgcgacgccgtcacctacaccgagcacgcccgccgcaagaccgtcaccgccatggacgtcgtctacgcgctcaagcgccagggccgcaccctctacggcttcggcggctgatcgatcgtgcctccatcccccatctctcccatgttgtctggccgtggaatccaccttgttcagttcgccgtttagttttgtagggtttacctgaatcatgaaactgtgaagcagatgatgtttgcacctgggatttgaattgaaacatgtttcagggccaatgttatggatctgtcctcttgttgatgtgcaatttgtgttcgtccttgtgctgcacgattattctactaggccttcgcgttttgggttaatgcgatttggttaactttgaggctgagttcgatataggttagtggtgttgagattataggcatataatgatttaatttattccataaataaatcatgacattatagatgaaaattagcatgaacgcatcattagatctacacatggaaactatacagtataacatgaacagatcaaatatacgcaacatattgaacacgtaccgaggtggtggaaagaccggctgctcggtcgaaacttttcgcaggcgtctacgaaggcacgaagcacgtgagcgaagaggaaggcgagccgtcgcgaacgaacagggagcagtcgcgcgaaacgcttcccaaaaaccttattgccgccttctcccggtgcaggacgtcgaaggcagaggttccggagacctgctctcccaatcgccggtgcacgctggcgagcgggatggagtagtctatgagcgacggcgcagtatagagtaggaggcaaaccctagattgatttcgcgtgtgttgcgtgaagacggcgagtcggtttatatagagaagagtcgcttgatcagggcgcccgcatgatcttcactccacgcgtaacttatccggactccacgccgtttgcacgcaccggatttttcggaacgtttccaaaacaaaaatgaatccgaatttgcagcaaaacgcgtgtgttgcgtgaagacggcgggtcggtttatatagagaagagtcgcttgatcagggcgcccgcacgatcttcactccacgcgtaacttatccggactccacgtctcccaatcgccggtgcacgccggcgagcgggatggagtagtgacgagc

SEQ ID NO: 19963 - DNA, 9374 bp, Oryza sativa
gcgtaacccatccggactccacgccgtttgcacgcaccggatttttcggaacgtttccaaaacaaaaatgaatccgaatttgcagcaaaacgcgtgtgttgcgtgaagacggcgggtcggtttatatagagaagagtcgcttgatcagggcgcccgcacgatcttcactccacgcgtaacttatccggactccacgtctcccaatcgccggtgcacgccggcgagcgggatggagtagtctacgagcgacggtgtagtacagagtaggaggcaaaccctagattgatttcgcgtgtgttgcgtgaagacggcgggtcggtttatatagagaagggttgcttgattagggcgcccgcacgatcttcactccacgcgtaacttattcggactccacgccgtttgcacgcaccggatttttcggaacgtttccaaaacaaaaacgaatccgaatttacggcaaaacacgtgtgttgcgagaagacggcgggtcggtttatatagagaagggtcgcttgatcagggcgcccgcacgatcttcactccacgcgtaacttatccggactccacgccgtttgcatgcaccagatttttcggaacgtttccaaaacaaaaacgaatccgaatttgcagcaaaacaaaactgcaaaaggagcgcaaggtgaggaaccaattttggcggaccattcgacgcgtacgtcgtgcacgcgcgccgcctgccctgccctgtcaggcgaggcgagcgagcacgcgcgtgtgttctcctctcttctctccaccacacatgcttcaagtagctaggagggcatcctcccttttaaggaggtccccatctcctagaataagcaatgtggtactaaactccacatgcatgccatcccatgaggcgggcttttgtgattttccaaagaattaattttcgagtgggctaaggcccattcattaattccaacaagtggttgatatctagctacattgcagttcgatatactccccccattccaaattaatctacatattccataggtacaccaagacaaaaaaaaagctaataactctctcattctatatttactctagcaataaactcaatgcatgcaccatccccactattttctagccaatagcaaattaaaatattgcatgtgggttataaatgcttgtgtgcatggatgcatgtatcaatgtctatttactccaatgcacaaataacgaatagacctaatgaatgaacacaaatatgtagatcatttaggaataacctcaaaaaaattatatgtagatcaatttggaatggagggagtagtattgatttgaccatcgttgaccaagaataagaacagcgaatttgcataatgtcaaacggtgtctgagtcgctttaatttgacgatagatccaattcgtttaatatttcggacttcatatttctgttactgcagtagcctttgggttccttcagcaaattcatctgtgcttttgtttgtatatttctgttactgcagttgcatttgtattccttcagcaaattcatttgtgcttttgtttcagttggttctagcagttgaattagcctgaaatccggatagtttcaggaaatttcatctgagctttagtttcaacagacctccgcaggaaaattttaacaacagtgagtgagtgtgacgcactgacgctgcacttggcagttggctcttgcacatcactctcaattgcaatttctgaaaatggcatagcattgctcagagtcacaggaattcacttgaaatcatatcaacattagggcagagattaatggaatagcttcaaaacataaacaaaaagaacagccgtttttttttgtggagaagttgggtccaaatgggctgggcccaccaatcatttatggcccatgggctcaaatctaacggcccatgaacgcatctcaccgtccccttctctctcctccgccgcctcctcctcactagtgacgacaccacccgaccaaaccgcaaagcgacgcgacgcggtaaaaaaaggaatcaaaaaggcgaaaaaaaatcgtcctcctttccgtagctggcaacatctccgcctctcctctcgcttcccgcatcttcccacacacacacacacaaaaaaaaaaacctcacgcgcgattccaatcctccctgaatccaccgcgcctttgcctaagggtttcgattcgttcgcgtgcggctgctctccccccgatcgatcggcttctcgcctcgctctcgacgaatcgaggtcgctagctcggttcggttgtgcgttgcgttgcgttggcgtggcggcgggcggttgaccggttcgctagggttggagctccgggagggggaggaatgatggcgagccacggcgccggggtggtggctgctggatccgatgccgctcctgccgaggtagatgacgcgcctcgtctgatgttctattgatttttgaatttgttttttttttgaatatgtgatcgtttatttagtgtctatttaggatgcaacgaatttgatattatgctaattactgtaccaaacttaagctaatttgaggatgtgggtgattggtagaagtaaaatttagccaagggaactaaactattcatgcaaggtggcttcgttgaatttttgcaaagaaaaattagagcagaagtttgatcggatttgaacgtctttgctatgcgtagaactacatgttaattctgagaatctatggttgtatggaagcctagttgtacgaatcattctagttgcaatatagtactgacttaaagcattttgccaatgaattactgaaatggttaaagctgcagtgaggatgaatcttttggtcatggcttttgtaactaagttgctatgtgcattatgccattatataaatgatcatgagttcatgacccctttatttgctaatggcaggtcagcattgtggggcagacaaatccatctacttatccacctttagctttagggcatcattcatggtcctcttcaactggggcagctacagtcccgtggagctatccagtgaacaatcaaagccaagatacagtttactatgatccacaaagggatgtttcggtttcgggagacaatcagagtgtggcaagcagtgcacctcataatgctcagccaactatgggcacagaaaatgcgactcattctcacatgccttactcaagttcacttcaacatgggtacactgctgcagaatatgcaaactattattatagttacccacaaactacaaatggttcttctgtccagcaaggaggaacaaatcaacattcaggtgcagctcatcagcctcttacttcatttcagaattcagagtcttacgttggtcccacaagtaacacatattacaatgctggtggtcatcagactgctccaggatatggaactagcaatagctattatcagaacagcacctggaatggtggaagctttgaaaataattatgctcagtcatatcagaactacccgtcatccaataccaacacagtacagcattccatttcagtgcctaccaattctttctcataccaacagcagtacaaccaatggccatactattacaatcacaccgtgccaaatcctgctggtgatccagtcgggaacagtaactcaattgttaacactacttctagctactcctatcccagtatccagccacctcctccaggaactacatcatggaaaagtaattcaagttcttctattgcgcctcctattcaggtatattccttcctttctatgtatatcgctactaattgtacatagccttcttggtcacaccctggacatttattgatcatgggttttaagctatctggttatgttgctattttgggacaatcatttctttttttcgatcaacagatggtgtttacttattttgtgttgcatatgtgttatgcctagtcagcttatctcaaattcaacttcctccgcttgctgtgcatctgggtgcagcattcttttcgatgagtttcgtgggctataaacacgctctttacgatatggaacatcagaatgcatgatgattgtttccgtactttgttcatgtagatttggttggcactagcacttctctttgtgtttgcatggagaagtttatagcacattgcatactaagaaaatcatctgtaccgtatgaaggttttttgttgcttgtaggtcttgaagtgtcatgtcttttctgtcttgtttgacttgtggcaattttcttgtgttctttagctcgctacatagattgtttcatcatgagaatagaaaataattatatctaaatttcatctacctacaggcttcaggtggtccagggcctcaagatcaatatatcaaccaggcgcacgctccggtgttggaaaaccagtatgctggccaggtagcaggtaacccaaggtctcaaaaccattatgccagccagacaccagcctgcccacagagcactgtgaatttgaaccccgttcagcaaagcaatcatggcgatcaacaaaatactgtaggttcaaacggtccaaactcaaatatttactcagtcgaccatgtatctgaaaatttacacccaaattggcaggtttttattgcaaccgaaaattcaagtgaaaacaaaatgcaggttcctcgaattgctccaggtttttctatggtaataccaaagagcgagaagaaaattttaggtgctgatttgtcaaagaagcctgcttatgttagtgtttccatggtgaagaatgatgctgtaattttctgctcttcttttcttcatttctggcacatgatgttctaactttctaaggctattttttttgctcatatggaaaatgactatttggggagctattggcatataaaatgattcattaaattatatattagtttgttagttcaaactcatgatatttaaattcgttcgatgtctatgagaatgcattggcttattccttggaaaaccagcgcaaaaagttagcacgtattatgcttatacttaatcaaggaagatattggtacttgcatattcaccacctacttttctattctcatgtttagagatcactccctttttcattacataattatgctacgaggaatctcaactgttgcaaggatgaggcccagaaggctgcttgccagagtatgatagaagaggtaaatctctgttatattgttttggcgttttgttagttgccagcattttgttgtaaaaaagattggcatcgtggctgttgccaatttgccattcacaacaaatggctgatcacagttttctagttgaattcactccagttattgggccagcgattgatgtggtgcttcattcatatgttttcctttgtttattttgtggttcttttacgtcaatttagaatgatgtaaattcgttgactctgtatctcagtcttgttatcttcctaatataatatcagataaaaaacagcgccattgctgatggaacccttcttactaagaattgggacactgagccactgcttcctttggtacaaaatgttgcaaccattccagaaacaaggtttgtgcttctggattctctggacagtgataatgtagtgttttgagtacttaactacgttgactgatattttttatctgttgttttggacttatgttgctatagaattatactttcgggcaaccagcaccatgcaatgaatgaaaattccagcttacaccttcttaacagtgttatcttctgggtaatttatatcagaagtgttatgatctaagcaaatatcgcaaaaaaataatttatctataataatagtaagatgccttcagatttatataattggatatgtctcaactgtcttggacatatgttaatcttattgggcagtatatggtggaatcatggatgtatcatttcatgaagaatatttaaaatcctatacccttcctccgatttctaaccatgataaccctagaaaataattaagatgtgattattgggaattggtttttgggtgcagaactattcatatacttaatcaaatgtttgcattacatagatactgggttaaaagtgatccatctaattttgccacaaactactatgcccaaattcgtgttgtaggcaaaattaggattccttcctttcactaaagaaagttttgagtcattggctcattgctgcttctgtgctatgcagaatcacatatttctgaattaactttttgctatttgttttccatatagcagtgcaaacaattcaagtccctccttgtcgacatctaccaataggagacgccaaaaaagtaggtgggagcctgttgtggaggaaaaggttacagataaggtggaaccggtaaaagggttggtgaatggtaccacccacaataatttggaagccaaaaacagaatggtaagaaccggcatgtgaactcttgcaaaatctcatactaatcagtcaatgtacaagaggaacagatttccatattttaactacatgtatggctttccatttctgaattgccaatatcaaatacctgtgttattgctctacttagtatttgaaatatttgaatgaatgccatgcagagtaataactgggattccagaaaatttttccagtctcatcatgcgactgcaaacaaagtcagtcagcggcctgccaagaagcaaaagatcagcagttactcagatcaaatgcaaaatggaaatgcttcaagtgatagtgataaggagcaggatctaaccaaatattatgccagtgcaaccgcactagcaaattcacctgaggagaagaagcgcagggagcataggtcaaagcgttttgagaagaaccagaattcatcatctaaatcgaggaattctgcagcaagtaaagatgtaatggctaatatacatgcacgaagagctgtttcagctcttcttgccagaagctgtgaagatggcactaccttggctgtggaggatatggattgggatgcattgacagtaaaggggacatgccaagaaattgagaaacgatatctccggcttacatcagcacctgatcctgccacagtaataaaacccaccaactgttgtcctggattcttaattgaaaagcatcaatagcaaatcttttttcttttgcaatttgatcatatctactgtttcttctccttatctgaataatgcttggcaggtaagaccggagcatgtcttggagaaggccctttccatggttgaaacatctcaaaagaattatctttataaatgtgatcaactgaagtctattcgccaagatctcacagttcagagaatccagaatgaacttactgtcaaggtatcctcttctcatgaatcatgatcctattgtgcttaccacaatgtgttagcaactagaaaactgcagttcctttataagttacttctgtcaagatatcaatatcatattagttatgctgccagttactattactgaccataagaaaatatttgtaaatgctgtgcaccaggacttcagttatgccactagtgcttctaacctttaggtttgttatttcaggtttatgaaactcatgcacgtttagcaatgcaggcaggtgacctacctgaatataaccaggtatgctttgttatagtttattctcttgggatatcaaataattgtgtttgtgcatatgctcaatatttctgttgcaggacatagttttgcaacttcatcttcatgtttagttagataacatgcataaagaaaatagaggtcaagtaattttctatcggtgggctgacactgacaatcccaagtttggtcccacttactactccctctagtcacaaattagtaaagtagtaccattttagaattttcaaggtcaataatgcataactttaacggcttaattcttttgcataaatgaatccaataatagtcgcatagtgtaatatcatgaaagcttttatcattttcgtatacccaaaacatatattctaaacaatagtttttttttcaaaagttaacttctgttgacttcacgggttctaaaacgacacttatttttgactggagggagcttcagattaccatgtggagtattgatatggattagcttcggataggcttttgaagaccaaaggtagagcactgaccttcatctagccgccaacatggcttctacctataagctagagaggctctgaagcttagttttactttggattttatcatcgtgtaacgaaaagagacaagaatgcatccttatataataggataacttaaaccctaagaaaattatcttcaatattcttatggaatagatgatactaataaatctaatcctatatctatagaaaattaatcctcatggtgccacagtaaaacgtgtgaacagtaccaaagactagtccttggggccataagcccgtaacggtactgctgtttcacgaaagttgattgtcattggaaactgcaactacatttgtaaattagaaaatttatgtttgcaatctttgtgcaaaaaaaaaaaaatgttaagtgatgcatgggtattgtagttctaactgtttatgcacgcaacatctcttgcagtgccagtcacaactgaagaggctatatgcagagggaatcaagggctgttactttgaattctctgcgtacaatttactctgtgtcatgttgcactctaataataaacgagacttgctgtcatcattggcaaggtactattttatactagtacactggcagaatattgaccagtttttgttcttaaactgaccacgtttgacatactcattattttcaggttatcgaaacaagccaaacaagatgaagctgtcaagcatgcccttgcagttcattctgctgtttcatctggaaactatgtcctatttttcaaactatacaagcaggcaccgaacttgaattcttgcctcatgggtaaaggactaaatactatctgtatcaattcaatgtgcttctgtatttggctaaaaaatctattctgtattcatgaaaaaattgatgtctgttgaggatcactttgacagatctatatgtggagcgaatgcgttttgaggctgtaaaatgcatgtctaaatcatatcgcccgactataccagtgggatatgttgcacaaattttgggattctcaagaattgatagtgaagcatcagaagagtgtgaaatgtggttaaaagctcatggtgctattctttcaatagacaacagcagagacttgcaattagacacgaaggtactactaatctctcttagaacattgtaatgatcatcataggacagcaagtgcatagatatgaatgggtgacttattttcagtctgcacgaccagtggaagggtataatataaatataaatgggtgacttatttcccaggctcccagctaagtgatacttcctccgtttcacaatgtaa

SEQ ID NO: 19964 - DNA, 15818 bp, Oryza sativa
gatccccctgtttttttatgcaccctcatgcacaaagccattcagctagcctaaattagtaccatcattctctttctcgagttattttaattctacataagagctccaattgaatatctgcttgatttggattgtgcaaagatgcagataatcttgtattagtttgcagggatgatttcacaaattgagtccatttcatactaattgaatacttatggtgttttgctgaaatatgtgatttacctggtatattcgatagctatacgtgtacatgttttcctcgaatgtcaaccattgaccttagcgtatttctataatataatctggtaatgttcgtgcctttctttgcttggcaggcttctactactacactttacatgccagagccagagaatgccgtcgcacatggtgatgcctcacttgcagttaatgactttttggcgcggacatagcgacaaaaattgtaaccatgatagataagtccagtatgtttgtgccgatctgtgagcctgtgatgtactgcaaatgtctccagtacacatcgtgccagttatggagctcaatgaaatggagcagcagatgaagggcattatgcttccggagctttggagttggagcaaataggagagtgctgactactgagtgctcaacttgttcccgggtgtttgcacctgatgcaacaactgcaatgctcaatgcaacggtgaggcatatactggacaacacatccaaaacgagaagcctgcagaaagctttgccgctggcctgtggtctcacagaaacacagaaaatgtatgaacttctggtaacccagatcccagatacatgtaaagtgtaaaccaaaattttgagagtgaatatgtatggtacatttgtttgtacaacacacttcacacataccattttcaccaactatttgtagctaaaatatatttctaatacgtgagccccgggatttttttatacagtgtaatactcatacataggagattaagcttttatttctttttttttaaaaaaaaacctcacctattttgaaccaagttacataaaactacatagataaactacatagattttgtcacgtgacatataatccagtattatggttctgaagttttattttgtctttgatgtacaaaatcaatatattacttatatagcttatccgttagataatagggttttgtactaacatgtttattactctcattgtgggaaacgtattctccaagtctaatggtactcaaatttcttgaggagtttgcagacattatatgttagggcggagccaccgcctggcccacaaaagctctattaactttctatgctgttgaatgaattgataaaatttctataacaaattactagctctttagcaaaatgtctctggcttcgccactggttatatggtcctcgatatgagtagtttgcagcgtaaaatttatatgatttttatttatgctaatcttcagcgttagaaagaaacacgacggatctagcatatttttatttttctcatatttatattcatatatcctgatctctacgctgtggggtttcccatgtctatttgagtgtacttcctttattcaaaagagttacacgtattacttttgccattgagatcaagaaaaaaataatctgatactacatccatattttaatgtatgacgccgttgactttttatttaatgtttgaatgttcgttttattaaaaaaaattgtgtaattatcatttatttcattgtgacttgattcataatcaaatgttctttaagcatgacataaatatttttatatttgtacaaaaattttgaataagacgaatggttaaacattggataaaaagtcaatggcgtcatacattaaaatacggagggagtatgtaacaaagatttagagtgtatgcatgcatgcatgcatgcaaccaatttagagtctaatcgaaagtttaatttatcttttaatttaagtcttgaatgaatatataaagattacaaatacgatcaacttatttaaaaataataattaaaataagtctaccacttttgagtggaggaagtacaactctaacgactaacctccacccggttttcttttcttgcgtccgcccttgccatctccacgactccaccggaacccaagacagaggaaccaggagccgacgcgaagcgaagccatcatcctgtggttgtgtggcacgaagagcaggtgtcctgagcttgaccggctcgaatggagaatacggcgaccaccttgcaaatccggtactactgcactgcacagggaaagggagaattaggtgcagaccgaaagaaagcggatttcgtgacaaccaaacgacaataatgctgcagtggaactgaaagattccagaacctgtggcgttagttggtaaccactgggctaattgcattatatttgccggcaaccaacctgctgtccttagccggcagcgatttcgtgaatggcactatggatacatggatggtggtgttatggtaagtaacaatttcagacatgcagcgaaacctgaacattctgtttgaactgttcgttcgtatacaccatattcctctctctcttttttcagaatttataagcatgggaagtaagctgtggtaaattttggagaaaattgttggattgatacgaagtttactggcctcatcgaccgtgctggtgtctgagactgaaacgacgccgaaaaggagcagagccttaggttatgcacattttagatcttcagaagcattggtagtcctctgaaaaaaaatgcattggtggtagagctcacgttacttaaaacatgaggagagatacttgactactatttcctctgtttttctaatagataatgcattaacttttgaacacacgtttgatcatttcgtcttattataaattatgtgcaaatgcataagatataaatcatatttaaaatattttagtaataaaatatctcacaacaaaataaatgataattatataaatttttgataagatgaatgatcacatgtatgtgcaaaagttaacggtatcatctatttaaaaaaaacaaatataatacttatcaaatgtactggttataatgactgaaatatatgccagtatagggagactaccttcaatacgggcaacacaactcacacgaactaaagaattaactggggatgaatcattgggctcaccgacgagatcttgccatgccttttccaccaactttggtagtcattatagtggttagggtcttaataattttcaaatgctgttttcaattggcaccaatccatgcaaaaaagactggagagtgatgtgctaccaagcgagcaagttgccctgttgtcccatccattacacacatgaccaacttgagaccagcagtgctcactctaatttcaatttgggatgctgtcctgcccctcgtcatgtgaggtcacatgataccatgaagatctcaaactacaacgtcccttttttattagatgatactgctgttttttggacacacgatatgaccattcgttttattaaaaaaaattaaatgcataagatataaatcatatttaaaatacttttagtgataaaacaactcataacaaaataaatgatagttgcataattttttttaacaggaatggttaaacatgtgtttaaaagttaacgacatcctatatcctatatacctatacaattcatccccactaactctaattctctcatctcacagcttgccacatcactctaaattagtctaaccattagatttgcaatcgatgtcttagattttcactgattaggatctacagcaaaaacatcaagctccacttgagtacctccatgtctcccaagcgctttatctttcgaaactgccagttttattacccactatgattacttcttaatgactgatgtgttcacagaatcaacaggtagcatttgtttcctcttttcttgcttttcctttgcctcttccgatcgttctcctttctattcctaatcttggtttccttcgggatatgttttccctcgctaacactcttcagatgaatgcagaaatctactcgattcaagattgaatggtgaactctcgagcatgagaaaaaagcccatacaggatagtactgctaatctttttgtttattaattttgcattgttttagacatggtaagcgtaatataggtctatccatgttctcattttcttcaagtcctatttgataaaatagacatactttatcatcttccctgttttacaagagctcttcaaacaaagggaaaaggactactaaaggtaactccttgcctggcttcatgaaatttctgctttcactggaatctcactttgggataattacgtctatgcatcaacgtgtaaatcaggccattagtataaattacattcatatatgtgccacgtgttgctatattagttcttaaatgtaccgtctatttcatagattttgttaacactgacacttcgatgatgcaaatgataatacaaagtggtcgttattttgcgtgcttttgctatataacacattctcttcggatgaatatatgtgttaggccttgtctaatatttttagataatgctataggcaaatcatcgaactgagagatacaaacaccatatttaatcttgagtcaatatatgtttaatgtttagaacagagcatgagagcatcaactatttggatattcatggagcacattcttcacaacaaactagcatctacgtcaaagagcaattgccagatcgtacttttttttaatatacgacgttattgactttttaaatatgtttagttatttattttattaaaaaagtatgtagttatcatttattttgttatggcttgatttattattaaatgttttctaagcatgacttatatttttatacgtttgcacaaacaaattgaataaaatgagtagggaaacgcatataaaaagtcaaatgtgtcatatatttaaaaacatatatagttatttttagcacattagtatttttcttctgtaatttagttaataagccttcttacatttttataagtttccgctgcaacgcgcggggtatttttctagtttaaaaaacaaaggtaccccagtgttttatatttcagagaggacaatttgtacataacaaatggagagaacaatgcaagtaagagaaaaatgggtgattggacttggatgcatttaagtggtcattgacaaaccatatcaatagaagggttgatcatcacatcaaagaactaactgatactactgaatgtatagtactccgtataacagaaggagcacctgaagtcaaacatgccaagtgaaaggactgtctaccacacaaaatgcagacagcttgaagctttccctaagcaataatacatgctgaattaattccttccttccacattgccctccaagcaagaaaacaatggagaatttgtacacaaaatgcagacagcttgaaggtttccctaagcaatagtacatgctgaattaattccttccttccacattgccctccaagcaagaaaccttcttgtacatgtccagtttagtatcctgagtctcatcagtaaaatttgaagctacaaggagagaggaacaaaacaatcttacatccctgtagtaaatacaagacaatgagctatattcctgaaatttgtatggtgtgctaaatctcacagggagaagagatcaaatgaacaaggtgagcagattttccaattgccaggcagccgccattgctgcgaatcgccgcaactcatcaaagctcgaattcctcttcccggagcaccatctcagcagcctcctcctcatcttcgtcgaacgaaaagtatctgctcctctcggccggtctgaatgtgtagaacatgaagaggtagaatgccaatgtggccacctcctcggccaagacgctcacccaccggaactggtaactggcaatggtcttgagcgcatacacgacgatcctagtgaagtataggtaaccgatcaccacaatgtagaattgccggaacagggtgagcttcgatagagtccgcgctgccttgccatcagtcttggacgtctcccggagcgatcgcatcgaccagacgaccgggaagagcacggcgcagcagcaggcgacgtcgacgaacagcaagatctggttccatgtcacccacccttgcaagaacgggccggtctccccaatcacggcggacgcgatgttggccatgacctgcagcgggatcaccaccatgagcaccttcttctccctgtcctgcaagaccggcctgaggaacgaccaccccgtgccgacgagcacgatcaccgcgaacaggacgacgcccttgacgagctggaagaggtagaacgcgacgtcccagccgtgcggcgtccccgtgacgcggatgtagtgctggtcctcggcggcggagaggcagtagagcaggcgcgcggcgaggaggcccgacatgaggtggtggatctggtgcgccgcggcgcggtggtcgcgggaggagagcgtgaggtacccccaggcggcgaggaacgcggcgtagcaggcggcgaagaagccgtagatcgccggcacgggcgcctggccgacggggaggtagtcgacggagccgtcggcgtttccgttgtacatctcggtgcgcaccctcatggtgacgagcgactccggcgcgcagttggcgaagtagaggctgtactcgtcggggtgggtgaccgggaacgtcttgttgtagtggccgcgcttgaggtcgtggaaggtgaagagcgtcttgacgtaggggctcgtgaggatgcagcgggagacgtcgggctcgtcggcgccgccgcccgccacctcctcccgcttctccggcggccgccgcgctgcgcctcgtagatggcctggaacatcgactcgtcggagaggaggaagaacccgagctgcttggggtccgggcgggcgaacgtcgaggagatgccggcgccggtgatgacgatcctgaccgcgcccgtcttggagaacccgaacttctcgaacaggatggtgggcctcgggtcctcacggaaggcctccgtcctgatttccgccgcggcgcggggcgcgagggacaccgccgcgacggcgatggcgaggaggaggaggcggcgcgcggcggcggccatggctgcggcgagatctgtggcgcgcggtgtgggtgggtgagagaatgcgggggagaagtgtcggtgtgcgcgtggcggggcgaggtgagcggggggtgcttatgtggtggggcgcgggagggtcggatgcgcctcgagattggtgagagttcggtgtggggaggttgacttggggagaacgttggctactactcgccaattgtttgatgaatttttgtgctaaaattcatagaagaaataataaattattgggcatttaattttatatgagaatattatttatagcccaattttactgaatacatgtgaggcgtgtctctgtgacgtgtgggtctagaaaaattcaaatatcacataatgtccgaatataatcaatattgggctcgttttgttgtacatttcaaatagaaaataatggttcgaataaaattcaaatttaatgcacaattgaagagatataagcttgaaaagagaagagatccactagtactagcagtatacccattaatcggtttgttacttcaccggtgggtaattatcactggtaacaaattcaaataagacgtggggcccaccgtcatcagccatgttaatctcagtgattatctccgacaccagcaactctatccgcatgcatcaggtggccggcatctgcatgcgtcgcacttatctgcagtagcagatcgatgaggccaaaacagattaaacgcgttatcacgctcgattcacggagaattagcgaggccgttgtggtcatcgctgcctacataaagcagtcgacccctcgtcgcggctgggggaacacacggcacaagcgctgcgccattaaagcagcaatatgccctagagaggtgaacactcgcacccacacaatattctctacatcgtagagagattagaaagaagatgcacgcgcatgacgcagggtgcgtgatcgcggatcagcaacctgtagtcgccggcgctgatggcatctctatcggcgagtcatcaataacaagctaatctcgttctccgtcaagttgcttatccaatacaaacacaacaacgcccggcattatcttctagagggagcaaatatataccgtagtgttgtgcagttacacagtccggacggtaaaacagtaaagtggagtatcgatgaatatgtcgtggatgcgttgtgaacttgtagccatggatataagtatccccagtggcgcatgcacacgcacacgtcatctttgtcaagcgattaatatgggctgcaaataaatataaggcgagcttgaccctcgtgggggttggactgtctaaattatcaatatcaaatattggagctggatatttatttgtataaacttgggatgagtttgagacttattggtatcagaccaaccatgatttatacatatttttattcatgcctgaacaactatcgatttgcctcgtgcatgtcatgtacgggagcaattccttctctatccaaattctaccatatgagcgggagcaatccccacaattcttgaagacaacaaaaacaatgctagctaggagggcgaggcatgcagatttaaaatacacgtcgacaccatggccgagtatcgacgagatgaaatggtcgatttatcaatatttgtgctacgtccgagaccgacgaggccggacaacatattagctaaagctaacaagattggagccattcactcattccatctgtctatgactgacgaggctagacgaaaccatggccgagtgccaacatggccaggtcactatactattaacacgtctaaattggacaggaaacggatacaccgttgctgggcaccgacgaggcaaaagcaaccacaaaatccatgtttgatgaaggctagggtacatgactgggcaccgacgaggcaaaggtcacccgcttcaccaaattctctccgcacaccgacgtgatggtagtgtattgtgaccgggttttggcgaaacaaagccacctgttccacattcactatattcaacgttaaatctgcaccaacctcaaccttcggcgagtaattaattttgaagacaacgatcctaaagcgcagcttaatcggaggtgttccataggctcgctcatgtggatgtaattaaccggtagccttattgctaggcgccgggaatcagcggactgtacgcaatctcgagtcagcatacctttccattaagcatttctcgtgaaggcaaaaggcgaactcctgcgggagccatcatgtatttgtaaatattcatgttaatgaatcatgattaataaaatacagggttttcctattttctgtgtgttcgtggttttgttttcatcaaacaccaataaactcctcagctatatatagatcgtttctttaacatatgataaattagaagtagataaataaaagaataaagggtgatccaaagtgtcgctgagataaaattgtctagtctaaaattaaaacattggtttgaaggatgatccaaaataaaacatcgggaataaaaaagatagtatgaagtgaaatttactcgtaaacaaatctaatactaatactccctccgggtttataatactcgtcgttttgaacaagagcacggtcttcaaaaacaactttaatcattattatttattataatatgtatataaatgttaacaaatatataatttaattgaagtatttttaagattaatatatacatatagtcaccatagtttaaagacaaatattttagaaaattttcataatcaaagattttaaagtttgatatcattcttgtccaaaactttaaagtttgatatcattcttgtccaaaacgatacgtaaactactctcagctcggagggagtacgaaatatgttagtacgatgcagttttttctcatttttacgctactaatacatcagtggggccaaatgaaaccgcatacagtgctaatcaccagaaaattcacaaagcaccagcacctcctccagtaactgccgatgccgacggtttcgatcggtagtcctgccgatgccgacggttgagaattgtggtactggtggcaggtgtgtgtgtgtgtgttgcggcggtcggagcgtgaccagctcagcttcccccggcccccggggaagtaaccggccagctgaagtgcgctcggcccgcggttctccaccggtgcgcaacggcaaagtcgacggttcggctgggttgctgggccgctcatcgcacgaggccgttcgactgcctctccccctcaggattttgcctgtttgggccgtgcacatcaagcccgcgaactctgccgcggcgagtagttcgcttcaggttggtttggttcggttccaaattccgccctactaatttattggtaatttttaatagtatttctagtttttttattaatgctaaattttaacaatatatctctttagatagtaaaagttttagccatctaaatttagtagtgccaaaaattatctaaactttgataattttagtatggcaccaaaccaaacttgcccttcatcttcaatccccccatccccatcggtgccacgccgccagtcgtatccaaacttttctcggaccacaatcccgatgacggtcgcgtacggcgggacggcgacggctactggaaagcccacgaggaaataacgtacaagttcacggtgacacggtcgcgcacacagccacacacacacagggtcgcaggcacagcaccccggttgcgtcacggaaccgaccggtcaccgcgtccgcacgtacggagaggatggcatactggcatattccccgcgcggtgctctactgctcttctctccggaagcgccggatttcgtcgaacgggtcgaaacacgcgggcgacatcaatacatcatatccgcacgccatttggcttttgcttccttcgcgcaccattccatcgcgcgcacgagcggggagacgacgaagacgaagacgagccaggccgcgagggcaggatggtgatttccgcggtcgcggtctcgtgagtacaaacgattaacaaagttcgacgtttaggttaggtaggtcaaacgcgtgcgacaacaataatgacaagaccaatcagggacgtgtacttttttttaacagaacataagcactcacaattacaccctcaccctcatcactatgaatacatactgacatgctccttccgtctcaaaaaatactccataacaacttctcaattaacattcatttcctaaccaatcacaaccatctattattcagtttttccacctacctctacttctcaaccaatcacaatcactttctatttaattttacctattttttaataaccgtgtccaactctaaaactagcaatattctagaacaaagggagtactccacagtgtatatcatcatgttatctattattaaaaaataattaattataaatacaaataatcatatcgaatctaatattacttaaaaataactgaatatattttaaaaagaacctaaataattagggtgtagctatatatatggcgccatatttttcatcaaaaaaaagtcagcatgtatttacattgtaagtccctaaattacatatgtaattttagtgtatttacaatgtaagtctcaaaattaaattacatatgtaagtactaaaattacatatgtaaattcgaaaattacataccaattacatacgtaagtggggtgtaaatgaggtgtaactactctgtaagtggctgaaaaaaaatcgactgtagtatatggcgccatatttctagcaaatccgaataattaagctacgttttattcacagcaacgttgtatttcgttatactagtatactaatgctccaaaaggcagtttacaaaaataaaaaaacaacattatcttgtcagtactaaagtttttacacgtggacaccccatcgcacaaatcttgtggggcgcacgatgccaggctcacgtgacccgaatttttttaagcctactttggttaatctgtcccatcaccagaacattttggcgtgttatacgtcgccagaaatctctacggccacctatagcatcacgagccccagtctatggcacgtggtcccggaggacatcgtggcccacgtgccagtgacacgagcgtgcggtgcaggcggttcgcgagggtgtggatcgcatgtgtgccccacgcgatgcctcccatccaacggccacctgtccatccccaattccaacctcgacatggaaggttccagaagcttccggaaacgaccttccccatgttcgcgtcgcgtggcttctcgtcgaaggaaattttgccagaattttcgcggatatttccttcacgaaaccttggtgggagaagggagatggaattcccaatggcgtgtagaatttcaatttcgaattatgttttaaaaacggcgagaaaatgtggaatgacgcaaatgcccttctgcctcctcgcttctcttcttctcctcctccctcctctctctccgtcgtcgctgcctcccctctcgttgctttgcttcccccgatctgcagagccggaggcgctccgccggcggcgaggcaggcacggcgtggacggcctcccccatctcccgtcgccaccgcgccctagccttctcactccctcccggcccccgcgcgcgcgcgcgcggccgaccagccggtggtcggcttccgtctccactcgaatcgaattcgaggtatcatccattcccctcccgtatcccgccctcgtctccctccgccgcttcacgtgcccggcgtggcgtggactggagacccctccggcttggattggattggattggtttggttttccttgttctggaattttttaaaaatttttgatgcgtggtgcgctgctgattttttgcagtttgtttggagagaaatcgggggttctaggtgaacccccatgcccgacgttggcgcggtgatcgaaggatcctcgcggcggagatgaacgtggttgggcgggtagggtcgctgatctcgcagggggtgtactccgtcgcgacgccgttccacccgttcggcggcgcggtcgacatcatcgcggtcgagcagcctgacggctcgtacaggagcacgccctggtacgtccggttcggcaagttccagggcgttctcaagggcgcggagaaggtggtcaccatcaccgtcaatggcgtggacgccagcttccacatgcagctcgacaactctgggcaagcctacttcatgcgggagcttgtgcctggcagtgaaaattctgggacaagttcggaggaagaggaagctagctgtgagcctgaacctccggcgcggagtaagagcgacggggatctttacatcggagcgaaaggcagaccaggtagcccggagtcgaatgtagagtgtcaagagaagcaagctatagaggagtttgattcatacggttatagcaggatggaggtagcggaagattcggcaaagcaacctgatgggagcaattcagagatggttttggttagtgtggatgggcatgtcctcaccgcccccatttcctcgaccgaggagaatgtggaggatgtgcagctaagtgaaccccaattccacttgggacctggggagagctcaagtggtgatttcagccgcagtggtgaggtgtgggaagctggcattgtcggtgatttatacatgccacaggaaaaggttaagtttgattctggaaatcaacaagaggctttggaagaacttggtgatgtaccaattgagacggataagtcacatcatgtccctgttactggagatgaagtgctccatacctcagtttatgaagatgtgactagtgcattgaccaatgaagtcgaatctctagttgtcccagagttagggaataatgatgaggactatcaagccttgatcaatgtagatgaggtccatgacatctcagagaacaaaaatgagggttgccgacccccttctagccaatatgaggtttgtgatgtctccaagaccgatgatgagggatatcagcccttggccactgaagaacttggtgatgtaccaattgagacggataggtcacatcatgtccctgttactggagatgaagtgctccatacctcagtttatgaagatgtgcctagtgcactgaccaatgaagtcgagtctctagttgtcctagagtcagggaataatgatgaggactatcaagccttgatcaatgtagatgaggtccatgacatctcagagaacaaaaatgagggttgccgacccccttctagccaagatgaggtttgtgatgtctccaagaccgatgatgagggatatcggcccttggccactgaagatgaggctcgtgatgtctccaagaacaatgatgaggggtatcagcctttggccactgaaaatgaggcttgtgatgttccactgcttgagaatgacgaggcttgcagggtgccagctaatgtagacaaggtttgcgatgtcagcaatgaggacactgagttagaaattgctagtcctagttttggtaaatatgatacttttaaaagttgcttagacctctcatcacaaatagatgacggagattcgggaactgaaccattttctcctgaatttgatcatcagcagggttttgaatttagtctgagtaatcgttctgttgttgacatagatctggaggaagatataagtaaaactacccactgtgatcgaaatgatccattacagtatctagaggaggataataaaacagaaggtgaagatagttctgcccactgtcgcaaggtatctgatatgtccattgtaggaggttctcatggcaagaccaaggagacagcctcttctgaaaatgaggcgaataggcctgatggtttacattcaaccattggaaccagtgacaaagacaaattaggtagcattccagagaactcagcagctgaagaggaactaaataaagaagagcatcccaaattacaaaagggcttgggtaagcacatgtcaggtcttcaggctattcttttcctttttttggtttgaagtttcattgtttatctttaatatgctggcagggttcgaaatttctctttgtgggcacatgctacggccaggaatgggccaagcatcagctgaagaagttttccaacaacatcttgttcttgaggaagatttcaagttatcaggatcatcaattatgaaaaatgtaaaccttgttgtcaaatttgatagtcagtatttcttatggagtaaaatttctcatattattcttgggaaagctgtctttggtccgaacttctgcacagaacatattgatgctattccggttgaacaccaagaaacacctacttcaagagattctcttgggctgtctccctcaagcaggagatggaggctttggaacataccattcaggatatcaagatcccttcagcgcagtaacagtgattcatccgaggacatttttcttgacacagaaactgtcttgagtccaatggatgagcaaactccagagaataatataaatcagtcaccaagaaagcaatttgtgcgaacattaattcccactagtgaacaggtggcatcactaaacctgaaggagggccaaaacattgtaacttttagcttctccaccagagttcttggaaagcaacaggtctgtgcccctatttcttaataataatattttattttggagatctgtaaattgatttttctttctttttttactaaggttgaggca

SEQ ID NO: 19965 - DNA, 1120 bp, Oryza sativa
aatgatgttctgggcgagaatgtcatgtatatctttttttaatgcataataaaaattcgtactaaaatttaccttcatttggtgagtgataataagcgagatcctactttgtctaacaaatatagtaattttagtccaatgattctccctttaagtggacttgcaaaaaacacttcatgtggtccttaatttcttggttatatcttctattctgtctgcctgaaaatgtcaattggcaatggtatcctggacatggtacagataagtcagtcctacaaattttaggggctaccacattattttcttcacagaatacaactgttatacatgttcctttttctgtttattttcataatggctgaatttgagtaattaatgttccatatcaggtctgatgtgttgggccaggtcatgcctttagttggacgagattggagtcagtctggtgttgctcgtcttttttctgcaataaaggtgtgcttcagaatttattttagtttttgtttctctttattttaggaggatattctacccagttttgcaaatatgggtttctgatgttcttttattctcccaatcaggaaaatggatatcaactattattcctcagtgctagagctatagttcaggcatacctgaccaaaaactttctattcaacctaaaacaggtaaaatatagcatctgtccgttgaatgtgttacctaccattttcatctttagtgatttaatcatatcttcactagaactgatagtaatttttaattctatattgttggtatgtatataaacttggttatcccttggcaactttgcaggatgggaaggtattgcctaatggacctgttgtgatttcacctgatggtttatttccgtcattgtaccgggaaggtaacatcatctctccaatatttacatatccatattcttctattatgacttgctgaataatgattagccttcactgaactactaggatggtctgtataattcaggctcaggttcaacaaagaaaagtagctaacaatgatcaacaatactgttactttatgtactgtaataaaatttgtttaccatgttctaatgtttcctttgttcttctcagttatacgaagagcacca

SEQ ID NO: 19966 - DNA, 680 bp, Oryza sativa
ggatcccccgcgaaagaatggatgtgggattcttgtttcgcaggtgcccaagaagtctgaagcctttttcatgctgagaggcccatcagaagtagtgatccttcctgtcatgcttaacttttttgctgcccttctgattatgcctagttaattcaaaattgctttggtcatttcacttaacaattgccatgtaggtgatggaatttctcagttccttggtgagatggaaggaacaatcaacatttgaagattgacagcttagccaatcagttttagttgggatagctagctgacgctagcgtttaagcattccctgggcgacaattttacagtgcccggacgtggagctggatagtagctagatagtttagctcccatagttgcaaagaaccagtcgatgctattccgtttcttctaatatttatcatcagaggcagagttctagtagttttttttttatgaagtgaacaatctttcagttctaccagtgaaaattcacaagcattacggcactgtgctaatcctgatattttctccattagtctccatcttggttaggtaccaggatttgcaataatgtcaactcgcatcccctttctcccctgaaaatgacagggaaaaaaagaagttcactggacccgccgtagacggcgacgtgattctctatatctctaagacta

SEQ ID NO: 19967 - DNA, 733 bp, Oryza sativa
ggtgtttccgcctgcacggctggcctttatgccgccgttgttgggcgtctaggtcttcaccgaccggtttgccttcgccgccgcagactggtgtttccgcctgcacggctggcctttatgccaccgttgttgggcgtctacgtcttcaccaaccggccgcctcgtccgccgccgactggtgtttccgcctgcacggctggcctttatgccgccgttgttgggcgtctacgtcttcaccgaccggcttgccttcgccgccgccgactggtgtttccgcctgcacggctggcctttatgccgccgttgttgggcgtctacgtcttcaccgaccggcttgccttcgccgccgccgactggtgtcctcgcctgcacggctggcctattatgaccgccgttgttgggcctctacgtcttcaccgaccggcttgccttcgccgccgccgactggtgtttccgcctgcacggctggcctattatgccgccgttgttgggcgtctacgtcttcaccgaccggcttgccttcgccgccgccgactggtgtttccgcctgcacggctggcctttatgccgccgttgttgggcatctacgtcttcaccgaccggcttgccttcgccgccgccgactggtgttttcacctgcacagctggcctattatgaccgccgttgttgggcctttacgtcttcaccgaccggattgccttcgccggcggcaaactggtgtttccgcctgca

SEQ ID NO: 19968 - DNA, 409 bp, Oryza sativa
ggggtaagccaaagaccgccgttcgctttcccccttctctccgctctctcggggccgctccgccgcgccggtggtcgccggcggtgaccatcggggcgcgggcgcgccgctcccgtcggccgcgccggcgaggccgcccttgggcgcgccctcgcggctgccaagtgggcccggccgtcagccgcccgcgcccgcgggtgcggctgacgcgcgggacccacggcgccgaccgccgccagccgcgtgctcccggtccaccgtggaccgagaggtgacgcgtgggccccactcccgtggacccggtccgcgcgcccgccccctcggctgacgcaataatccgatttttaattaaaatttaaatgaagaaattcgcaaatatccatttaaagagcatataaacttcaaatgg

SEQ ID NO: 19969 - DNA, 608 bp, Oryza sativa
cagcccatcccgatctcttcgccagttcttccgaatctcggggtcgagattccgtttaaggggggtaggtttgtcgcgtcccaaatcgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataattgaaaagaaataaacaaagttaaaagggttttataaaaagaaaaatcctaaaaagtcttctttcccccccttctttcttgggccggctcggcccagtccctccctctctctctctcttcccccgcggcccatcggcctcccccgcgcgcgcgccgctgacaggcgggcccgcccgccactctcgctgacgggtggggcccacctgtcatcgacttcctcccgccgggcccgccgccctgcccgtgccctagcgcctccgccggcgcggattccggcgcatcccgccatccccgcacccattaaagagggggaaatcactccccgtgattccttctcccgtt

SEQ ID NO: 19970 - DNA, 742 bp, Oryza sativa
  unsure (1)..(742): unsure at all n locations
atgccgtccgtacacattgcgaaacgcatgtttcttgggtcatttgagaattcctggtaaatcctatcgattgtcctccactgtactgaatctgctgggtgcctcagcatactattgactttccgttcttcggcatgccagtgcacaagcttagcttgttccttattcgcaaacattctcttcatgcgctccgcaattgggagatactacaccacctttgctgggcctcccctctttgacttacttccttcaccttcactctttgctcgtttgtatcttgatgccccacagatagggtagacattcaagtcagcgtattccttgtaatacaaaatgcagtcgttcggacatgaatgaattcttctgacctccaggcccaacggacataatacttgctttgcttcatatgtcgtctgcggtaaattgttcccctctggcaacagatcctttaacagctcaacaagttctgtaaaactcttgtccgaccaaccattactagccttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19971 - DNA, 3783 bp, Oryza sativa
tgacatgatgttgaggttgtgtcttgtgggtacagtggtacacctctgatcagagtaaaactattcgaatagccgagcccgcggttatgggcgggtctaacaatgtctttcgtgattagtttcacacttctcaccataataaaagatgctataactggcaataatttgtttagctcctggtttggaatggtgtattcctggtttggagatagaactgtgcagccgggatggttgttcagaacgattgggcctatgcaacagggtatgttgtatagcgttggattaatattgtttaattactacttaactattttattaaattctgaaatgtttgtaaatgccatttatgcaaatgaaaccatactatgccatcctttgttatcctgtgcacttgcatatttgctgcgtggcttgctgagtatgtcatatactcaccttgcaatcattcatcagaggaggagttctacagtgatgctgagggtgtggaggattaggtgtagccctggtcaagctgcctgtggagtggagtcgtttgcgccgtttattttaattttccgctgcttagatttttattgattgagaggaactatctacctctgtaatgacattttattcgcttattaattagagtaataattgtactctattatcaatttgttattgtgtgcctcggctgattcctggacgagggttcacacacatgtaagcgtttggaattttggatagaaattccgggcgtgacaagttggtatcagagcccccttgaccctaggttatgccaaatggttacctatagaagccctctaaaaatattggaaaagtagaacttatctcctctctttctcttttaattaaaccaaactaatggcacatgcagtttatatttgtttttattgttctcacttaaaatttatttactattcctgtgctgttagtactgtacatctattaccgtgctaatggcccatttaccatcaagagttttataacaatgcttgatttaattttgctgcaatgagctaagcttagtataatgattttataacctgttattcaaaagtgcaaagtttgtgaacatgtttctgactgcttcatcttatcatgcaagcttggtttatttaccttttactttgattttctaactctattcaaattaatccaaaaacttgtgctattaattggataattgacttaactccctcctgtcacttgtctttagatgccgcgctacaagcctgagtacttgttcggtactgaaggatttgtccaggagttgcgtacgatgtccttcctcatagggtttggaattgcccctttgtatgcccagatcccgcatgatcgtgatgaagaaaaatgcggagtcaaagtcaccttgaatagcaaccgtgaagatattccatcagtgatgttcgaggctggaggaggaagctacattcatgcttgtcaggaggtggcaaggatcgccataggagaactccgggaaagctataatgatcggttggccgacaccgagtaccgctaccatcctcgtcaaccccagggaagtgattgtggcagctactttgaaccggctgggatcgagaacgacgctaccacaaggcatttggttgagatgctatgggctatggatgaaacccgcgctgagattgtaatagccgctcaagatcgtgaagaccggaatagggggaagatctgcaagctagaagacaaggtggatcatttggagaaggagctagccgcgttgaagggagaagcaccaccgcagaaggccagagtccgtctaccgcaaggaagagagctctattcgtccctcgctatcagttggcaccaaaggttcgtctggtggaaaaagaagctaccccagcggatcctccggttgtcaatgtaagtgatgatgaaaaggaatccaaacgtacccattccaagatcggtgggggccaactcaagatgatggggacgtgccgaacgagccttcaatcaactccgatgcccagaagacctagaccgttttgctagtcgttgccttagaacgttgtgttagtttgcttgtttaagtttggttgtgtgtgtgggttctgcgtgcgtttacatcattggtgggatgtaaatgcatgtctttatttgcttttgagtgttaggaagttggtgagttagatggtgagagagtcttcagctttgtaataatgaaactcagttaagatcaataaaagttaagttaattaatttaattatctgtcctaagtagttctcccctgtttctcttcttgtgctcctgtctatgtcagatggtgctcactcgcagcaacgggaacggccccaacagcaacaataacaacaataacaacagcgccgagaatcccacactcgctcaagtcttggcccaacaggcacagttgatgaacatgatgatgcagcaactccagaaccagcagaaccagggaaataaccaccatgcacctccctagaacaagctggcagagtttcttcgcgtgaggccacctgttttctctagcactactaatcccgtcgaagctggtgattggttgcacgccatagagaagaagttggatctgctccagtgcacagaccaggagaaggtctccttcgcatcacaccagctgcatggccctgcttcggaatggtgggatcacttccgcctcaacaggactacccctgaacctatctcttggcttgaattcaacgctgctttccggaagacgcatataccctcgggagtggtgtctctcaagaagaaggaattcaggtcactcacacaaggttcccgcactgtcaccgagtatctgcacgagttcaatcgtctggctcgttatgctccggaagaggtgcgcactgatgaagagcgtcaggagaggttcttaaaaggacttaatgatgaactttcctacccacttatgactggagattatcatgatttccagaagttagtggataaagctattcgccaggaggacaaatacaaccgcatggagcagaagaaacgccggattgctcatttcaaggcacagcaggggaatagtcaaaggccacgccttactttgggaccccagtccatgccacagggaggttcttcgtctgttgttcgtccgcagcgatagttcttcaacaacaatgctggcaacaacatccgcaatcaagctccacgccctgttgcatctccaacacagcaacagcctgccaagagggagcaaggcagtaagcccggggtgtgcttcaactgtggagacccaggacattacgctgacaagtgtccgaagccccgccgcgtgaaggtcgtccctgcccagaacaacccctccgcacccgcagccaaggctcgtgtcaaccatgttgctgctgcagaagctcaaggtgctccagatgtgattttgggtacattccctgttaactcagttcctgcaaccgtgctttttgattctggtgctatgcattcatttttatccatgagttttgcgggaaatcaagggatggaggtaaaggaacttagacgtcctttgatggttagtactccgagtaaccaagcactctcctcacaacgtagcccctctgtcagaatagagatccaaggtgtacctttcctggccaaccttattctgttagaatccaaagaccttgatgtcatcctagggatggactggttagccagatataaaggtgtgatagattgtgctaatagaaaagtaactctcaccagtaatgatggtcgagttgtaactgttcatgcattatcttctgagtctataaggtcacgtctgaaccaattga

SEQ ID NO: 19972 - DNA, 1045 bp, Oryza sativa
actcggtccatccaacgagcccccgggtgctaggaatcggcccaaaggcaaccatccattggcaaaccaaacggaaagcataggaagatagaactccataactcgataggtacttttgtactcagattatgtcgcaaggaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtaatattccccttggtgatggcatggacgcccatgaacggtggtgtgaccgaccaaccgtataggcgatgacaccagtcggcggcgacgaaggcaggccggcggtgaagtcgtagacgcccaacagcggcggcataataggccagccgtgtaggcggaggcaccactcggcggcgacggaggtaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcatgccggcggtgaagtcgtagacgcccaacagcggcggcataataggccagccgtgtaggcggaggcaccactcggcggcgacggaggcaggccggcggtgaagtcgtagacgcccaacagcggcggcataataggccagccgtgtaggcggaggcaccactcggcggcgacggaggcaggccggcggtgaagtcgtaaacgcccaacagcgg

SEQ ID NO: 19973 - DNA, 4583 bp, Oryza sativa
tcggcggcgtggaaggcaaggcggtcggtgaagaggtagacgcccaacacgggggcataaagcccagccgtgcaggcggatacaccagtcggcggcgcagaaggcaagccggtcggtgaagacgtagacgcccaacaacggcggcataaaggccagccgtgcaggcggaaacaccagtcggcggcggacgaggcggccggttggtgaagacgtagacgcccaacaacggtggcataaaggccagccgtgcaggcggaaacaccagtcggcggcggggaaggcaaacgggtcggtgaagacgtagacgcccaacagcggcggcataaaggccagccgtgcaggcggaaacaccagtcggcggcggcgaaggcaagccggtcggtgaagacgtagacgcccaacaacggcggcataaaggccagccgtgcaggcggaaacaccagtcggcggcggtcgaggcgagccggtggtgatgttctgactgatccattcctggagcgtaagagataagcttaaagccatgaatcccttttatgcatatctggatctggatcctgcagaacaaacatataggatgagtagtatctgatataaatataatactcgagaaaaaaatcaagtattttaaaatatttataaatatgtatttctcctcttgtcaattttgatttccccgagcagatgattcattacgtttaaacgctctgtccgactagtcatagcccccaagcaccgggagtcggcctaggcacttcccagacatgcatatgagtgacatgagttcgccattaatggaacaaagtttcacggattagaatttactactcaggtacttttgcaattattaagagcaaaaaataaatttatctcatctctatgcttttgatttattccgaataatacttagcaccttgcgttactcggtccatccaacgagcccccgggtgctaggaatcggcccaaaggcaaccatccattggcaaaccaaacggaaagcataggaagatagaactccataactcgataggtacttttgtactcagattatgtcgcaaggaatcaagataaatattatgaaaattgtttaaaaaatacgatataacatctatagcccccgactcactagtcaacggcgaaccagttgatgtagtgaggcaaaggaaaagacaaaatatcatataaagaataaaataaatgatgacttagctttgtaatattccccttggtgatggcatggacgcccatgaacggtggtgtgaccgaccaaccgtataggcgatgacaccagtcggcggcgacgaaggcaggccggcggtgaagtcgtagacgcccaacagcggcggcataataggccagccgtgtaggcggaggcaccactcggcggcgacggaggtaggccggcggtgaagacgtagacgcccatgaacggtggtgtgatagaccagccgtataggcgatgacaccagtcggcggcgacggaggcaggccggcgatgaagtcgttgttgctatcagcaatggcggtggcgaggacaagccggcggagtggactcgcggccgatcgaccggaaagctgagacgcctcgagtccatgaccagcatcaatcgcctcaatagtgccgcgtagttatatgcgaacaacaacaaaaaatagcaagaaattaatctgagattaaaaatcaatatgataaataatgataaaaatcagattgagtttccccctgactgatttggatcaagtcagagaagaggagcttgaagaagtggtcgacggaaaggaagtgaaaactcccaaagcgaaagcgaagtcggcgactcatgaaattgattccatcgcgctcgttgataggaaactcgacgcaacccctacctggcgcgccaactgtcgaaacatgatttcggcaataataaaagggggtagcatacgagacctaaaagtggatggatgcagagacaaaggatttagacaggttcaggccctctcaatgagaggtaataccctactcctgtttggggatttgaatccgccgggtgtgtattgatctgacgatcaggttgtctctcatgccccctagagggcctcctgcccaccttatatagggtggggggcaggattacaagatagaaaccttaaccaatacggtatcggtttcctaaatctactttacaatattatcaaaccaggactttaggctgttccgtaatatataaggaaacgtaatacccaagtcatgatctgttacatattccatacatataagttatcccctataactagtcggataaccatgccgtgtgggtatggggtacccataatctccacaaaatgtatgctaccctagcttgcaagcctgtgaggcaaattgcaagccaattgtttgatcagcttatcaagcctgtaattgtaaagaaatgataataatattgtctgttgttcaccaatcaagagaatgatcaatctcctcatagatgaacgtggtttgtccttttgtttaggggaaaagtataactgtcttattgatacataactggagatggccacaggagaatcacgagaataagcgcaagaaatagtatcgtatagtccatatggcatgtatgcaggtttgatcatagtactcgtttacagaataatgtaggcactgtttttgcaagtgcggttcactagattaaatttagttttgaggataaatcgaaaataccttttcatggcacccaaacgaagccttgaatcaatgggcaaccttttcaacttgggtctgcgtggcaggccaaattggaaccttctgtattgtaccatcattttttacagtgtgcatctccttcgtttttttttaccatagtgtccatctccttcgttcttaagcacaataatattatcacaagcaatctttcccccgtgaattatcgcaagagtttatttatagttgtacccctttaaagaaatcatgatattgtaaccttaagaacgaaacttcctgataatgaggtgaataggcacgagctcgtgtgattgttccttgtatcaccagtttagtatccactatggagacaccattgtcacccttttttaccccatttcaactacaaacctattcgaataaaatgggtaatatagagatttgatgcatcaatttcattggactaacctgtttccacaaattttgtaaacgcggtaatcacaaggatatgtttggttttcaatacaatttcactctgcgtgatagattgtaaaaaatgggcgtcctggttaggtatttgtcgcgcccggaaaaagtgtctttttctgaacgctagtgtattaatccccgtcccagaaaaagccgggtacaccacacaaacatgatacaaaagacacatctttattatatcgttaatatttacattatttcaaaggcacttcaggcctgacaataaaaaataaacaacagcggactagcgggcctacggctccatcttcacaggcgctcaaatggggtataagccaggactccccacctaggacttcttctccaaagtttttcttagtgaaggggggaaagatagagcaagaatgagtacaaccacagtactcagcaagtcacaccggtagatgtattattaatgcaagggggtacaaggggtaataatatagggtttaagttttgcagtaaacaacatttaaaagtcacttagttgctcaaagctattttgtaaagacgatcctagagctacacagtattattaatcaaggacgtgaacccacacgaacttgccttaactcaaggcctacgatgattcagactgaactggcaacccgacctgggtcccagctcgtcccaagccaacccaggacaaccattccacattttagttgttaagcaaattttaagaattaaaccactaacttgggtacattgctaggcttgcctataaccgagggcgcagctattcgaatagattattgtcgcgtcccaaatcgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataattgaaaagaaataaacaaagttaaaagggttttataaaaagaaaaatcctaaaaagtcttctttcccccccttctttcttgggccggctcggcctagtccctccctctctctctctcttcccccgcggcccatcggcctcccccgcgcgcgcgccgctgacaggcgggcccgcccgccactctcgctgacgggtggggcccacctgtcatcgccttcctcccgccgcgcccgccgccgcgcccgtgccctagcgccgccgccgccgcggattccgccgcatcccgccgtccccgcacgcattaaagagggggaaatcactccccgtgattccctctcccgtttccccctcttttccctctctctctccctcggattcgtccgatttgaatcccgcgagtttcgcaggcttcttcaatggagccgagatctccgcggccgattcct

SEQ ID NO: 19974 - DNA, 2795 bp, Oryza sativa
ccttgattaataatattgtttagttctaggatcgcgtttacaaaatagccctgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagtccagaagaggagctccttgaagatgaaggttttggtgtctagctcgtgcctgccgtcaagcgcctgtggtcgtcgccctagtcttccgctgcttcttcgtttgtctttgtgtgttgggccttcgctgcccatgtaataattctatttacgcttccgcttgttaaactctgaattgtatcaacttttggtgtaccttgcctcctgggacaaggattaatgcacgcacgtcaggaacgcccgttgggttatttccggtcgtgacaagttggtatcagagccacccttgaccctaggacgagccgtagatcccaagccttagcgatattttcaaaataaaaatctttggttatttgtgaaaattgtctagtctctctctgtcttgctgcttcatttatcgccaaaatctgatcttttaaatgttgtttctctttttgtttttgtttgtagatggccggcacagtcacccgtcgtggtttggatatgactggcttcgttttggagctgcgaggcatgtgcgtggtcttggggtatccacatggagtggactaccaggccaggccacttccggatcaggagggtgaggatgcagagcctcacgctggttgggaggtcactgcagtgatcctctctggctctcctgagcggacttcgctggcagtcaccgcgggtggagactccttccccgccgcttgccagaacgccgctctcctcgccatcggcacccttcaccagcgctacccggacgagttgcagcactcgccctaccgctactaccctcgtcgcggaggagcccgcgactacgccaccttccgagatgctagctcggaggatgacgctaccgttgtgcacctggcacgcatggtggaggcgtacgacgcggctcgtatcgacttccatcagatggtgcgccgcgggatggttgagaacaacatgaagatcctggggctgcggcaggagaacctgcagctcaagaaggacctcgacgcgttggaggcgcagctgcatcagctcaaggtcgcccagggtgaggatagccgccccaagcgtcgccgcgtctgccgcagccagaagatcaccgcccgcaagagcacctccaggcctgagcttgttcgtcagtccctggcgtggacttgcttcgtcgagacccctcgtgccgagcctgcgcccgtggttcctcagtgtcgcgaccgggaaaatttccttttcccgaacgctagtgtattaatccccgtcccaggaaaagccggggtacaccacacaaacatgataaaaaaggcacatctttattatatcgataatatttacattattacaaaggcgcttaaggcctgacaaacaaaaaataaacagcagcggactagcgggcctacggctccatcttcacaggcgctcaactggggtataagccaggactccacctaagacttcttctccaaagcttctcttactgaagaggggaaagattgagcaagaatgagtacaaccacagtactcagcaagccacaccggagatgcacaattaatgcaaagggggtacaaggagtaataatataggggttaagttttgcagaaaacagcatttaaaagtcacttagttgcccaaagccattttaaaaagacgatcctaaagctacacagtattattaatcaaggccgtgaacccacacgaacctgccttaacccaaggcctacgatgattcagaccgaactggcaacccgaccctgggtcccagctcgtcccaagccaacccatgccaaccattccacattttagttgttgagcaaattttaagaattaaaacacctgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagtttccaacccatcctagccatagacaagagtaccgacccaatcccacctacggccggaacctccgggacaggcaggcaggactgagcccctagcagcagggcaccaaccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgagcttaatccttagagtggccggggtgctacttcccacaactggcatgcacccaacaaacatgttttaggggttttgaaagaggaagagaggtgtatgtccaattccaccataaaccaacaattccatagtgtccaaatgatatgagaattcccaaagtctaaaattataaaaccacctaatgttgcctaattaatcagcgaagcatctacctaaattcatactagtggaaccatgaatagagtacccactagttgggggggttttgtttatcctagggtgaacaaggtaataataacaatagcaacaattataagggccttaaca

SEQ ID NO: 19975 - DNA, 7035 bp, Oryza sativa
attcccattggcttgggttcttgagtcatcggatccatcattcccatagcctttgttaccagtgttatccatctgtcacaaggtagaggttgagaggggaagcatacaaggaaagaatagaccagaactagggacaagaccttaaaggaactaactctttttgttgatgtgttgtttgttttgcttattctgcaagttgattaagcaaacaacctagcatggtcacatcacaacccaccgatgcaaaccacgcgctacacacacaagcaaggaaacacacgactgacaacactatcctagaggacggcttaggttctgcgactggttcccaagatcttcattcttgcttcacatctggcttcactgcttcctttgctgcgctgacggatccaacagtcttccggagcttcggcaaacaactgacgacatcttcttcttcgcaaagctgaccatctagtactagttgaaatttgaagaaggaagaaaagagtaaaccttttgcaaataacattaggggaaggagaaaaagaggaactttcgcaaatagttttatttataaaatatgtccttaggttttatccacttggcttatcctacagtcgagatggctctgataccagcttgtcgcgaccggaaaaatttccttttcccgaacgctagtgtattaatccccgtcccaggaaaagccggggtacaccacacaaacatgataaaaaaggcacatctttattatatcgataatatttacattattacaaaggcgcttaaggcctgacaaacaaaaaataaacagcagcggactagcgggcctacggctccatcttcacaggcgctcaactggggtataagccaggactccacctaagacttcttctccaaagcttctcttactgaagaggggaaagattgagcaagaatgagtacaaccacagtactcagcaagccacaccggagatgcacaattaatgcaaaggagtacaaggggataataatataggggttaagttttgcagtaaacggcatttaaaggtcacttagttgcccaaagccattttacaaagacgatcttagagctacacagtattattaaacaaggccgtgaaccctcacgaacctgccttaacccaaggcctacgatgattcagaccgaactggcaacccgaccctgggtcccagctcgtcccaagccaacccaggccaaccattccacattttagttgtcgagcaaattttaagaatttgaaacactgacttgggtacattgctcggcttgcccataaccgagggcgcggctattcgaatagattatactctgatcagaggtgtacatctttacccacaagacacatcttcctcacgtgcaaccacgtgccacataccaccacggtatacggacggaagacgtgacatagttcccaacccatcctagccataaacaagagtaccgacccaatccccctacggccgggacacccgggacaggcaggcaggactgagccccctagcagcagggcaccaaccctctgccatgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtactcgaggtacgactaacaaaacccaaccacgcacctcgagcccagcctaaaaccattttgggggttttgaatagagggggaggtgtgtgtccaattccaacataagccaaccattccatagtgtccaaaagatatgagaattcccaaagtctaaagttataaaaaccacctaatgttgtcctattaatcagcgaagcatctacctaagttcatactagtggaaccataaatagagggtccactagttggggttttgtttattctagggtgaacaaggtaataatatcaataacaataatagtatggtcataacaaaggtaaataggcatggctaaataaaacagtgataacgcgggaatttaaataaagcgataatgcattaatttaaattaaaaataattttgtaaactgggattcaatatgctcaaggatgatgtgacttgccttgctcgctttcccaaacgccggcttcaacttccacgaagagcggatcttccgaagctgcagcgtctacacgaccgacggaaaagcaaaggcttttactctaataaactccacataacagcagaaacaaagcacaaaaatgggttcttgacttcttaaggaaaaattagagacttgaacggtccaattccgagttcaaatggccaagatatggccatttgaagtttatgtgctctttaaatggatatttacgaatttcttcatttaaattttaattaaaaatctcatttattgcgtcagccgggagagggggcgcgcggaccgggtccacgggaagtggggcccacgcgtcagcctctcggtccacggtggaccgggagcacgcggctggcggcggtcggcgccgtgggtcccacgcgtcagccgcacccgcgggcgcgggcggctgacggccgggcccacctggcagccgcggggcgcgcccgaaggcggcctcgccggcacggccgacgggagcggcgcgcccgcgccccgatggtcaccgccggcgaccaccggcgcggcggagcggcgcccgagagagcggagaggagagggaagcgagagggacggtccacggctcaccccgggacaacgaggacggcggaaacgacggccggagtggagaaaggcggcggcgcggttcgggatgccgagggcgacggtgctccggcggtcggcgggcgaagcggagcggcggacggggtcgacggcgacgcggcgacgcggaaaaaggtgacgccgagtcgggaagaggaccggagcgacgacggcggcgaaacggagctcggcggcgacggcggagagagaggtgcacgacgcgagcacgaatccgacggcgagagcgagcggcgagcggcggaaacggaagagcgaagcacgggggacgattttatagcgccgagagggagagagggcggccggggaggaaggaaaccggccgcggagttctcgggctccattgatgacgccggcgaggattgcgggcgcgattcgaacgaatccgagggagagagagagggaaaagagggggaaacgggagagggaatcacgggggtgattttccccctctttaatgcgcgcggggacggcgggatgcggcggaatccgcggcggcggcggcgctagggcacgggcgagcggcggctgcggcgggaggaaggcgatgacaggtgggccccacccgtcagcgagagtggcgggcgggcccgcctgtcagcggcgcgcgcgcgggggaggagccgatgggccggagggagaggagagagagagggagggaagtgggccgagccggcccaagaaaggaagggggggaaagaagacttcttttagggtttttctttttataaatcctttttaactttgtttatttcttaacaattattatttgtgctctgaaaattccactaaaatttgagggctccttttagaccaaggagaatttgacaaaaattctccaggccacttttgaatttttcttgtacgtattttagtgtttgccaatttcttttcgaattttaattaattctattattccttttagagaatgaattttaattttgggatgaatttatcaggacgtgacactcaggagggggaaacctccggcgttggtagcacggagggtgcgctgttgctcaccttccgtcctggcccgtcgcagcggtagacgagcagttagtaggcttgcgcgtgtgtttttcctcgtttgtcttcttgagtcgtgtggggcatggttatgccggtgtgtggcgtaattatgtcggagcctgtcttattttttatttgcctaagcaacttgaacattaatgaaccaatttaatagaagtaataaattcaagaattatagtagtcgagggtggttagttttaattgtcagctttctctgtttgccggttctgtgtggggttttcagatggtgacgaccaggagaaatgttaacaccggtgaaggcaaccaacccgaaggcagcaaccccaaccaccaaggcaatccacctccaccaccaccaccagacaccaatgccattctcacccaaatcctcgctcagcaggccaacatgatgaccgctttcctccaccacctccaaaatccgccacaacagaatgctccaccaccacctccccaacactctaaactcgccgagttcctccgcatccgcccacccaccttctctagctccaacaatcccgtggatgcgttggattggttgcatgccgtggggaagaagctggacactgtgcagtgcagtgatgaagagaaagtcatcttcgccgcccatcagctgcagggacccgcatctctatggtgggaccacttccaggctacgcagccagagggacagccgattacttgggctcgcttcaccgccgctttccggagaacccatgtgcccgccggagtcgtggctctcaagaagagggaattccgagagttgaagcaaggcaaccgctccgtgatggagtatttgcatgagttcaacaatctggcccgttacgctccggaggatgtgcgggaagatgaggagaagcaagagaagttcctggcaggaatggaccccgagctgtccgtccgtctagtctctggggactatccggatttccaacgtctggtggacaagagcatccgcttggaggccaagcacaaggagctggagtcgcacaagcgccgcttggcgaacttccgcaatcagcagggtgctaaccagagggtccgctacaccaatccctatccagggggatcctcctcgcagcagcaacaacagcagcagcaacctcgttccgcgcctcgacctcaattcgtggtgcgcgtcccacagccgcagcagcaacagaatcaacaagggactcgtgcgccccgtcctcctacgccagctgtgcagcccgttcaaggccgcagggacgctcaaggtcagcagcgtctatgcttcaactgcttcgagcccgggcactttgcggataaatgcccgaagccaaggcgtcagcaaggccaagcgcctccccgctccaacaacggagggaaggatgtcattcggggccgtgtgaatcacgtgacggccgaggacgtgctgacaactccagacgtcatcgttggtacgttcctcgttcattccatccctgctaccattttgttcgactctggagcttcccactcgtttatatctgtgccattcgtggggagaaatcagttgggggtagaaaggcttaggaaccctctgctcatcaccacccctggcggggttatgacagcaaagtattatagccctgccgttcctatagaaattcaggggattccttttccctcggatctgattctgctagacaccaagaacttggatgtgatccttgggatgaattggttggctcaattccaaggagtagtggattgcgcgagacgcacggtcactctgtaccgaggaccggaacaaccggttgtcttctttgcacccccaacctctgtcagaagttcagaactgcatcagataggactgtcagaaatccccatcgtcagggagttcggagatgtgtttccggaagaactacctggtatgccgcccaagcgagagattgagttccggatagatcttgctccaggaaccactcctctgcacaagcgaccctaccgtatggcagcaaatgaactggccgaagtaaagaaacagttggaagagttgaaaggaaaggggtatatacgtccgagtacttccccctggggtgcttctgtgatttttgtagagaagaaagacaagacgaagaggatgtgcgttgactacagagctctcaatgaagtcaccatcaaaaacaagtaccctcttcctcggatcgatgatctgttcgatcagcttaaaggtgccactgtattctccaagattgatcttcgttccgggtaccaccaattacgtatccgcgaggaagatattccgaagaccgcattcaccacgcgatacgggctgtatgaattcacggtgatgtcattcggtctaaccaatgcacctgccttcttcatgaacttaatgaacaaagtgttcatggaatacttggataagtttgttgtggttttcattgatgacattctgatatactcacaatcagaggaagaccatcaacaccatctccgtctggtgttgggaaagttgcgggaacatcaattgtatgccaagcttagcaagtgtgagttctggttgtccgaagtcaaattcttggggcacgtgatatctgctaaaggagttgctgtggaccccgaaacagtgaccgccgtcactgaatggaagcaacccaagacagtcacccaaatccgcagtttcttgggtttggcaggatattaccggagattcatcgagaacttctccaaaatcgctcgacccatgacacagttgttgaagaaagaagagaaatttgtgtggagcccgcaatgcgagaaggcgttccaaactctcaaggagaagctggtttcctcgccagtgttaatcttgccggatactcgcaaggatttcatggtgtactgtgatgcttcgcgccaaggattggggtgcgtgctcatgcaggacggtcatgtggtagcctatgcctcacgccaactacgacctcatgaaggcaactaccctacgcatgacttggagttagcagcggtggttcatgctctaaaaatctggcggcactatctcattgggaaccgctgtgaaatatataccgatcataagagcttgaaatacatcttcactcagtcggacctgaatcttcgacaaaggagatggttagaactcatcaaggattatgatgtgggaattcattatcatccgggtaaggctaacgtggttgcctgtc

SEQ ID NO: 19976 - DNA, 3725 bp, Oryza sativa
gaaagggggggaaagaagacttcttttagggtttttctttttataaatcctttttaactttgtttatttcttaacaattattatttgtgctctgaaatttccactaaaatttgagggctccttttagaccaaggagaatttgacaaaaattctccgggccacttttgaatttttcttgtacgtattttagtgtttgccaatttcttttcgaattttaattaattctattattccttttagagaatgaattttaattttgggatgaatttatcaggacgtgacaaatccaccccccttacaagaatctcgtccccgagattcgaggaggctagcaagaagataggttgggcggtctcctcttcttgtctgacttcttccgctctggactgcttggctcgatctcctgttgcagatgaaatcttctcttcacccgacttgtcccgggttgcacctttaactgactcagactaggctgcggtggttgaggatggggcttcagttctagaacttcttatcattcatatctttggcgtcaacctcataccagttaccaccttcgtgacatgcgtcgacatcagctttgtcattactaagataccatgcttgtcatttgcttctaactcgccaccaactgcctcatattagctttcctggtctccgggtgatagctacttctgctattcgattcgagggtcgataactttgcctttgaattatgtttctcaacagagccaacttatcccacttgacatgctttgacgcctttccagatgactttactgctggacttgttattgtttgatcgttaccctgccaaatctgaagcttcgctgttacatgtgattttactctgacctctgtagactatcttcgaacatatcacttggttcataactgggaatagctcccacgaacaagcaactcggattcactttctttacatttggttcgcttcccactattctcttcatgttgtcatcatttagcattcaacctattcctttgcaccttccgcatggatgggttctttctcgatggatcgattgctagggaagtgcgttgagcgatactagtgcaagtgcttttattctagtagcatctgatacaaagcccaaggttgaaccgagctttagattccactgttcaggttttacttcttgacttcttggtcatgtcacaaaagtttccatccttgtcccccatagaagtacttctacctgtggtcatctctcttactcgtgaattcacctgctttaatgacagggcaactattgtagggttgtttgctatcgggagtcttcctcgagtgacacaaatcatggttctcgttatcttttatcaatcacctttcgacctttctcaaccaggtactcttcgctccgggtgttgaggatgtttctggggcaatgaggtgcttgggcgtgctgcctttccgtgaaaccttgatgtggttcgtcaaaaactgtactgactaccttcagggaaatacattgcttgctatctgtatccatgccactagggtttaattgccgatgatcacctttagtgcttcttcgagatgggaagcatccaaattgttcttctaccataccacctttgccccttttctgatacctgatagactaattaccaaccatcgactactatgtcctcaaatgtggatgtctcctggatcttcttaactgtttgtaggtatatccgaacttatcaatgtagaggcatggcgggtacccttatgggtttcatccaacaatccttatcttgatctgtaaaaggcgtatccaaactcctatccccaactactgtctcattggccttttaacccaactcagtttaattggttttcttttccatcaacaggttggttattaactcaaggttagaacatagttcctctgaaatgagaccctaggtctcctttatcagtaagcaattatacacataatcacatacccgcatcttccaaaagaatcctcatggaacttgtctgtattacacatttctccctcattacatgaatacgaggcactgccttaaacaaaaaaaggacggtgcttaacatcggtacattgtatcctcaacatgaatcatccataagcatagcaaacccactgtttatagacatgaatatatttatgtattacatgattgctgcaaactttcgattacaccatgataagtagcggactgaaaaccacaaacatggctgctcattttgattctggagagatatagctggcattgttctagtgactgcatcatccttgattggttctgtgatgatgtgataggactgcatattgctatcattcacaggagaagcttccttctgattgctgtttgaagcggatgatggtcttctgcttggtatcgccctccggaggttgattgccctttgcttggcctggagtaggtcggggagagacacaacttcttccatcaacgacaattctttgctgaggctgtcggtgcagagaatggttgctatgatttattgcagagtcaggtgcagcaggaggagcattggtgcattgtttctgctatgggttctgattaacacgaggcctcacgggtacggcgtttgctccagtgaccacaatacgattggaatgtctgcttcgtgtaaattggcggtaatgtggaggtcgattttgccttggttgcaggcagtccctcgagtaatgccctggttctttgcaattgtagcaaatcaacgtcttctttgctgagctatccgtctgaggacgatcattctgacttggagttggagttggtggttggaaatccttgctaacattggcatcagtggtaccatagttgctatcaccattggagtctttctcagagtcaaaattgctagggttgtcattctgggtgccttcattgatactatcgtcgatatcttggtgaatgctgttgacattgcacgcttgatctaagtgatcatgaatggggcaagaaccatggtggttggtggtattatcagcattagtagtgctattgttgttgtctgcattgcgttcatcttcttggggcaggaactcttgatacacaacagaagatccggtgatctgaagtggctcagtgcgctgtctttggttaccacctggaaatactgggttgttgaccatccttctcttgcagttcgtcatccgattatgctcactttcaagttgcatggctttgtccacaagtttctcaaaattttcataatcctctaggagtagttgcactgcaagctcatcttttaacccctggagaaacttctcttgtttgtcttcatccgtttccacatcttctggtgcatagtgagccaaacgatagaactcatgcaggtactctgtgacggtcaaatctccttgcttcaggtagcgaaactctcgttttcttagtgtgatcgttcctgcgggaacatgtgatctcctgaatacagatgaaaactcgttccaggtaatggtatgtccttctggccgtgatgcttcgtagcgatcccaccactctgaagccggtccaaccagctgatgagttgcgaagccaacccgctcctggtcggtgcactgaatcaaccctagcttcttctcgattgtgcgcaaccaatcactggcttccataggatcgacggcaatggcaaaggttggaggttcagttttgagaaattctgataacttgcactgttgctggactgtaggcacttgaacgttggttgcccctgctgggttgctcca

SEQ ID NO: 19977 - DNA, 933 bp, Oryza sativa
cgagtttcctatcaacgagcgcgatggaatcaatttcatgagtcgccgacttcgctttcgctttgggagttttcacttcctttccgtcgaccacttcttcaagctcctcttctctgacttgatccaaatcagtcagggggaaactcaatctgatttttatcattatttatcatattgatttttaatctcagattaatttcttgctattttttgttgttgttcgcatataactacgcggcactattgaggcgattgatgctggtcatggactcgaggcgtctcagctttccggtcgatcggccgcgagtccactccgccggcttgtcctcgccaccgccattgctgatagcaacaacgacttcatcgccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtcatcgcctatacggttggtcggtcacaccaccgttcatgggcgtccatgtcttcaccgaccggctggccttcgccgccgccgactggtgtttccgcctgcacggctggcctattatgccgccgctgttgggcgtctacgacttcaccaccggcctgcctccgtcgccgccgactggtgtccccgcctatacggtcggttggtcacaccaccgttgatgggcatcgtcatctacaccgccggcctgcctccgtcgccgccgactggtgtccccgcctatacggtcggttggtcacaccaccgttgatgggcatcgtcatctacaccgccggcctgcctccgtcgccgccgagtggtgc

SEQ ID NO: 19978 - DNA, 1281 bp, Oryza sativa
tccgcatgcacggctggcatattatgccaccgttgttgggcgtctacgtcttcacagaccggccgcatgcgccgccgctgactggtgtttcagcatgcacggctgacttattataccgccgttgttgggcgtatacatcttcaccgactggctgcctcgaccgccgccgactggtatttccgcctgtacggctggcctattatgccaccgttgttgggcgtctacgtcttcaccgaccggccgcctcgtccgccgccgactggtgtttccgcctgcacggctggcctattatgccgccgttgttgggcgtctacgtcttcaccgaccggccgcctcgaccgccgccaactggtgtttccgcctgcacggctgacttattatgctgccgttgttgggcgtctatgacttcaccgaccggcttgccttcgccgccgccgactggtgtttccgcctgcacggctggcctttatgccgccgttgttgggcgtctacgtcttcaccgaccggccgcctcgtccgccgccgactggtgcttccgcctgcacggctgacttattatgccgccgttgttgggtgtctacgtcttcaccgaccggctgcctcgaccgccgccgactggtgtttccgcctgcacggctggcctattatgctgccgttgttgggcgtctacgtcttcactgtcacgtcctgataaattcatcccgaattaaaattcattctctaaaaggaataatagaattaattaaaattcgaaaagaaattggcaaacactaaaatacgtacaagaaaaattcaaaagtggcccggagaatttttgtcaaattctccttggtctaaaaggagccctcaaattttagtggaattttcagagcacaaataataattgttaagaaataaacaaagttaaaaaggatttataaaaagaaaaaccctaaaagaagtccttttcccccctcccttcttgggccggctcggcccagtccctccctctctctctcttcccccgcggcccatcggcctcccccgcgcgcgcgccgctgacaggcgggcccgctccccgctctcgctgacgggtgggtcccgcctgtcgtcttcctcctcgcgccgcgccgccgctcgcccgtgccctagcgccgccgccgccgcggatttcgccgcatcccgccgtcccagcgcgcattaaagagggggaaaatactccccgtgattccctctcccgtttccccctcttttccctctctctctccctcggattcgtccgatttgaatcccgcgagtttc

SEQ ID NO: 19979 - DNA, 6498 bp, Oryza sativa
  unsure (1)..(6498): unsure at all n locations
ctgtggttgtactcattattgttcaatccttcccttttcaagtaagagaagcttggtaaaagaagtcttaggtggagtcctggcttataccccagttgagcgcctgtgaagatggagccgtaggctcgctagtccgctgctgtttattttttgattgtcaggcctgaagcgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaagtggataaaacctaaggacatattttataaataaaactatttgcgaaagttccttttttctccttcccctaatgctatttgcaaaaggtttactcccttcttccttcttcggatttcaactagtactagatggtcagctttgcgaagaagaagatgtcgccaattgtttgccgaagctccggaagaccgcagggtccgctagcgaagtgtaggaagcagtgaagccagctgtgaaggagtgaagatcttggagaacccgtcgcagaacctaagccatcctgtagggtagtgttgttagtcgtgtgttccttgcttgtgtgtgtagcgcgtggtttgcatcggtgggttgtgatgtaaccatgctaggttgtttgcttaatcaacttgcggaataagcaaaacaaacaacacatcaacaagaagagttagttcctttaaggtcctatccttagtttctaacctgtctctcccctttgttttccctctctccctctccaaacctgtcacgtcctgataaattcatcccgaaataaaaatcattctctaaaaggaataatagaattaattaaaattcgaaaagaaattggcaaaccttaaaatacgtacaagaaaaattcaaatgtgacccggagaatttttgttaaattctccttggtctaaaaggagccctcaaattttagtggaattttcagagcacaaataataattgaaaagaaataaacaaagttgaaaaggtttataaaaagaaaaaaccctaaaagaagtcctcttttccccccccttccttcttgggccggctcggcccagtccctctctctctctcttcccccgcggcccatcggtctcccccgcgcgcgcgcgctgctgacaggcgggcccgcccgccactctcgccgacgggtggggcccacctgtcatctccctcctcgcgccgcgcccgccgccgccgcccgtgccctagcgccgccgccgccgcggattccgccgcatcccgccgtccccgcgcgcattaaagagaggggaattactccccgcgtttccctctcccgattccccctcttttccctctctctctccctcggattcgtccggattcatcccgcgaagttcgccggcgtcttcaatggcgcccgagatctccgcgcgcggtttcctctctccccggccgcgctctccccctcccgttgctataaaatcgtccctcgtgcttcgctcttccgtttccgccgctcgccgctcgctctcgccgtcggtttcgtgcccgcgccgtgctcctctctctccgccgtcgccgccgagctccgtttcgccgccgtcgtcgctccggtcctcctcccgactcggcgccacctccatcggcttcgccgagtggttgccgaccccgtccgccgctccgcttcgcccgccgaccgccggagcaccgtcgacatcggcatcccgaaccgcgccgccgcttttctccactccggccgtcgtttccgccgtcctcgttgtcccggggtgagccgtggaccgtccctctcgcttccctctcctctccgctctctcgggcgccgctccgccgcgccggtggtcgccggcggtgaccatcggggcgcgggcgcgccgctcccgtcggccgtgccggcgaggccgccttcgggcgcgccccgcggctgccaggtgggcccggccgtcagccgcccgcgcccgcgggtgcggctgacgcgtgggacccacggcgccgaccgccgccagccgcgtgctcccggtccaccgtggaccgagaggctgacgcgtgggccccacttcccgtggacccggtccgcgcgccccctctcccggctgacgcaataaatggaatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgttcctgctgttatgtggagtttagtagtgtaaaaagccttttcttttccgttggtcgtgtagacgctgcagcttcggaagatccgctcttcgtggaagttgaagccggcgtttgggaaagcgagcaaggcaagtcacatcacccttgagcatattgaatcccagtttataaaattattttgatttaaattattgcattatcgctttgtttaaattcccgcgttatcactgttttatttagccatgcctatttacctttgttatgacattattattgctattgttattattaccttgttcaccctagaataaacaaaactccaactagtgggtactctattcgtggttccactagtataaatttaggtagatgcttcgctgaataattaggcaaccttaggtggttttataactttagactttgggaattctcatatcatttggacactatggaattgttggattatggtggaattggacatacacctctctttctctttcaaaacccctaaaacctgttttcggtggggtttgggtgcatgccagttatgggaagtagcaccccggccactataaggattaagctcgggcctctgttgcaaagcactaccgtacttccacatgtctaatgggtaaggcttagtttgtggctcagcctagtcataaacaaaagtacacggattggagatggatgaagtcgggcgtcgatggacattctccagggcaaatgaaggctacacgagctgcggcccggtagtcgagatgtcatacggcagagggttggtgccctgctgctaggggctcagttctgcctgcctgtcccgggtatcccggccgtaggtgggattgggtcggtactcttgtctaaggctaggatgggttggaaactatgtcacatctttacgacgggttccaaggccatggaatgcggagtaaagatgtgtcttgtgggtaaagatgtacacctctgatcagagtaaatctattcgaatagccgagccctcggatatgggcaagccgagcaatgtacccaagtcagtgttataattcttaaaatttgctcaacaactaaaatatggaatggttggcctgggttggcttgggacgagttggaacccaggtcgggttgccagttcggtccgaatcatcgtaggccttgggttaaggcaggttcgtgagggttcacggccttgtttaataatattgtgtagctctaggatcgtctttataaaataactttgggcaactaagtgacttttaaatgctgtttactgcaaaacctaacccctatattattatctccttgtacccccttgcattaatcatgcatctgccggtgtggcttgctgagtactgtggttgtactcattcttgctcaatccttcccctcttcagtaagagaagctttggagaagatgtcttaggtggagtcctggcttataccccagttgagcgcctgtgaagatggagccgtaggcccgctagtccgctgctgtttatttttgtttgtcaggccttaagtgcctttgtaataatgtaaatattatcgatataataaagatgtgtcttttatatcatgtttgtgtggtgtaccccggcttttcctgggacggggattaatacactagcgttcgggaaaaggcaattttcccggtcgcgacaagctggtatcagagccatctcgactgtaggataagccaaatggataaaacctaaggacatattttataaataaaactatttgtgaaagttccttttttctccttcccctaatgctatttgcaaaatgtttactccgttcttccttcttcggattttcaactagtactagatggtcaggtcagtgaagaagaggacatcgtcagttgtttgccgaagctccagaagactgcaggatctgctagtgaagtggaggaagcagtgaagccagctgtgaagcaggagtgaagatcttggagaacccgtcgcagaacctaagccaccctctagggtagagtcgttagtcgtgtgtttccttgtttgtgtgtgtagcgcgtggtttgcatcagtggggtgtgatgtaaccatgctaggttgtttgcttaatcaacttgcagaataagcctaacatacatcataacagcaaaagacttagatctgttaaggtcctatccttagtttctaatctgtctctcccctttgttttccctctctccctctccaaacctttgcaacagatggctgacaatgagaaaggcaataaggtcagaagtcaggacattggtacctcaagctcccgagtgaatgaagcaccagacaccagttgtgtggcagtggtccaacacctgattaaccagaacaaattgcttatagagatactacagcagcatcggatgccaattttgaacccgagtcagatgcaacctcaagtgcagttggaggcagtccaagcactcacaccacaagtcagcgcaccgccaacatcccagaaggcccctcatgccatgccacatgttgacccaaaagaagcaagtatcatctgttttatgtgtgatgagcaagggcactacgcaaggaactgtcctcagcagaaaagaaaagcaccaatgcgaaccgaagatgaagtccgtaagatgatcattaccagcacagaatggcctccaccaggaatgacaaaacatcagagaagaaattccttccgaggtgcacaacagttgacagagcatcttttagctaatggaggtagagtgtctgatagtgaagattcagatcaagtctcctcagatgatgaaggtgcgaagcctccccaaggttttaaccagaataaaatagaacttaaggcatgctctcgttgtggagaaatcggtcatgttgccagctcgtgtgcctctacatgcgttcattgtgaggaagaccatccacccgacaggtgtccaacgagtaggatcacttgtttcctttgtgaaggaactgatcatgtaccaaaagattgtcaattcagttttctgctgacgaagaagatggccaaccaacccgccagttccaacggagagaagcatcaaggaaacacaaatcctcgccaagattccagtttcagcctaactccagtgccaggacagaggaatcgaaatgagaaaagaaaatgccgagtccgggaagacatctgttgcttcaattgtcaaggaatgggtcatttcgccgacaagtgcccaaaaccgagaaacgtagctgccggcacgtcagtccacgcaactccctgcaatcagaagcttgctcctcaacgaattgtcatccatgcatcccgaagcagtcctatagcccgcgttgcaacaactccaattccaatgagtgcactaccacaaggtgtcaatgctcaatttcagccccagccaccagctgacaagacagaggccagtatctgcgttgtacctttggaagttccaatacagcagctgagaaatcaagtacaagatgaagaacccgagtgtaagaaagttattgtttgttacaactgcagtgaagaagggcattactccaaaaactgtccccaaccaaggcaaaatcgacctccacattaccgccaatttacacgaagcagacattccaatcgtattgtggtcactggagcaaacgccgtacccgtaaggcctcgtgttaatcagaacccatagcagaaacaatgcaccaatgctcctcctgctgcacctgactcggcaataaatcttagcaaccattctctgcatcgacagcctcagcaaagaattgttgtagatggaagaagttgtgtctctccccgacctactccaggcctagccaagggcaatcaacctccggagggcgataccaagcagaagaccgtcatccgcttcaaccagcaatcagaaggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19980 - DNA, 19670 bp, Oryza sativa
tacccccctggcattaatcatgcatctgccggtggggcttgctgagtactggggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacaagctggtatcagagccatctcgactgtaggataagccaagtggataaaacctaaggacatattttataaatgaaactatttgcgaaagtccctttttcctcctttcccctgtgctatttgcaaaatgtttattctcttttcttcctccttcggattttccactagtactagatggttagttttgcaaagaagaagatgtcgtcaattgtctgtcgaagctccagaagactgttggatccgtcagcgcagcaaaggaagcagtgaagccagatgtgtagcaagagtgaagatcttggagaacccgtcgcagaacctaagccaccctctaaggtagagtcgttagttgtgtgtttccttgcttgtgtgtgtagcgcgtggtttgcatcggtggggtgtgatgtaaccatgctaggttgtttgcttaatcaacttgcagaataagtgaaacaaacagcacatcaacaaaaagagttagttcctttaaggtcctgtccctagttctggtctattctttcctggcttgtttcctctctcacctcaatccctgtaacagatgtttaacagagaaaaaggaaagaatgtcagcgggtatgcctccagtaactcaagttttcaattcaatccaccactggcctcaagagagttaaccagggcacacccttggtccattccaagcatgctgcttagttcacagctaccattagttggaagtcaagaccaaaatcagtatgtgtttgatcgagcgtttgccacccaggtcaatgagcttccaatgccagaagaggatgtccccttttgtcacgattgtagagagcaaggacactatgccctgaattgtccatgggtatatgtcaaagaagccccttcctttggtttagcagggcagacatcgctaaaccagcctcctcgcaccaagtcaagtttgcagcctagtgtgcaaagtgaagagcccaatggagacaatccattgaatcctagaaaatgctttcctcctagcctttcgcaccacgtggggtcacgtactaagcaagccaaaggcaagaagagtaagaatcagaagagaaaagcaccgatgcgaactgaagaagaagtacgtaagatgactattaccagcaccgaatggcctccagcagggataactattcctagacgtcaaagaggaaataccttccgaggtgcacgacagttgacccagcacctcctaagccatggtggcagagtatctgatagtgaagggtcagatcaagtctcctcggattatgaagatgagtccccccgacatctcggcgaggaagagatggaatcaaaagcatgcccccgttgtggagaaattggacacgttgctagcatgtgtttcacactttgccctcattgtgaggaagaccatccaccaggtgaatgtcccacccgcaaggtcacatgttttctatgcgaaggtacaaaccatgtgcccaaggattgccaactcagtgtgttgttgaccaagaccgcagaaatccaacgaacaaccctacgattgtctcatcagctagtcagctccaacagcaacctcgacgatatcatccacagcaccaatgctcctcctgctgcacctgactctgcaataaatcatagcaataataccttcagcaccaaccattctctgcaccgacagcctcagcaaagaattgtcgtcgatggaagaagttgtttctctccccgacctactccaggccgagcgaagggcaatcaacctcaggagggcgataccaagcagaagaccgtcatctgcttcaaacagcaatcagaaggaagcttctcctgtgaatgatagcaatatgcagtcctatcacatcatcacagaaccaatcaaggatgcagtcactagaacaatgccagctatgtagccatgtttgtgattttcagttcgctacttatcactgtaatcgggagtttgcagcaatcatgtaataaataaatatattcatgattataaacaatgagttcgttatgtttatggaagattcatgttgaggatgcaatgtaccaatgctaagcacctttccttttaggcaatgcttagtattcatgtaatgaggaagaaatgtgtaatacagacaagttctatgaggattcttttggaagatgcggatatgtgattatgtgtataattgcttactgataaaggagacctagggtctcattccagaggaactatgttctaacctcgagttaataaccaacctgatgatggaaaagaaaatcaagcgattaaccaaagagacatttgtttggacaagagtttcagatgtgtctttttcggatgtcagggttgaatgtgtaaaggaatactttgaatgctaaataatgacaacatgaagggaatagtgggaagtaaactgaatgtaaagaaagtgaatccgagttgcctgttcgtgggaactattcccagttatgaaccaagtgaaatgttcgaagatagtctatagaggtcagattaaaatcgcatctaacaacaaagcttcagtttggcaggaaaacgatcagacaataacaagttcagcagtaaagtcatttaggaagatgtcaaagcatgtcaagtgggataagttggttcttttgagaaacgtaattcaaaggcaaaagttatcgacccttgcatcgaatagcagaagtagctagcacccggagagcaggaaagttaatatgaggcagttggtggcaagttagaagtaaatgacaagcatgatattcttatgatgacaaacatgatatcctagtaatgacaaagctgatgtcgacgcatgtcacgaaggtggtaacttgtatgagtttgacgccaaagatatgaatgataagaagttctagaactgaagccccatcctcaaccaccgcagcctagtctgagtcagttaaaggtgcaaccagggacaagtcgggtgaagagaagattccatctgcaacaggagatcgagccaagcagtccagagtggagaagtttagttagataagtttgttatagaagatgaagcggaagaagtcagacaagaagagaagaccgcccaacctatcttcttgctagcctcctcgaatctcggggacgagattcttgtaaggggggtggatttgtcacgtcctgataaattcatcccgaattaaaaatcattcgctaaaaggaataatagaattaattaaaattcgaaaagaaattggcaaacactaaaatgcgtacaagaaaaattcgaatgtggcccggggaattttttgttaaattctccttggtctaaaaggagccctcaaattttacttgaatttttagagcaccggaaataattattaagcaacaaaaacaattatcaaagtttattaaaaagaaaaatctaaaaataatcctccttttcttttgggccaattttggcccaaagacctccctctctcccctcggcccgcggccaaagtctccctttcctccctctttttctctccctctccttctctccctccttctcttgggctcccctttccctcggcccagcttcctcctccctctctctcccgggctgcctctttcccccccccctcccctcccggcctgcccggcccaggccgcctccccctcctctcctcatgggccgcctctcggcccaagctgagccgcccctccctctcacgcacgtgcgttgcacgagcgctgagcgcgccccgcgtggggcccacgcgcaggccgccgtcgccttcttcctccagccgccgcccggcttctctctcccccgtgcgaaccctagctcgctccctcctccaaatccgcttgattcacttggttaattccaaaattgattagggggtttcaatccccattgattcctcttcaaatgcccccaaattcccccttgattcgtgccttcaatccccgggaacggacgcgccaagtccggccgccttccattgccgccggccgtggttcccgccgccgttcccgctcctcccgtggccggctctctcccccatcctataaaatgggatcctcatcccccgttctctcgttttagccccctcccgagcctccccgtggtccctagccacctccccaccgtcgccctctctctcccacgctgccggccgcctccagccgcctgggccgcctcgaccgtgcgccggccggccgcgccgtcgcctcctccagcgtcgccgctacctcctccaccccggcctgccctccgtttcgcgcggtgatcgccggaggcgcgttcccgccgtcgcccttctcttttctccgcgccggccgcctccagccgcctctcccgcctcgcccgtgcgccgtccggccgcgccgtcttctccctcggcctcgcagccaccccctctccctcggtcagccctccgtttcgcggggaaagcaccggagacgcgttctcgccggcaaaacagtggcgttgccgccactgttccacctccggccgccactgtcgcgtttcccgtgcgccagccgacgtcgccaccacctccctcggcgttgctgcatcgccctctcctccggctgctcctcggtttcgccggaacaccgccgtcacgcgtgccgcctttccctcggtctcgtcggcacccactccggcagcccctttcgccgtgccagtgcgccggccgacgtcgccgtctccacctccggcatcgcagcggcaaggacgccctcggcctcgcctccccttcgaccgaaccccgccggtgttcgtcgtcgtcgtcatcgtcccgtcggttgcccggctcgtcgtctcgcggcgccgcctccgtcgtcggcatcgcagcggcgtggtccgcgtcgtccccgtctccgtgcagctgccgccggctgccctcatcgcctcctcgccggccccggtcgtcgtcgtcgtcgtcctctcgtcgttcccggtcgttgtggcgttcgtccctccgtcgagccgttctcgtccgccgcccgcgtttcccctagtgtgctgcagccccgtcatcgtcttcgtcctcggctccgcgtcgtcaagcctcgtgccggccacgtctcgccttcgtccaaggatcgccgccgaagccgtcccctcgccgttcgtctccgttgtgcccgtctgtctccgccgcgcccgttcgtcgttgtcgtccccgcgcctcgtcgcgtggtggtaaggatccctctccctcgctgccccgtcctcgtcctttcggtgtcccccgtacccgttgtgcggtcgtcgaccccggtacccgtgtaccggtgtcggtagtcgttcacgtgtgcgggtggtgaccgtgtagtgtccgtgttagtgtgcccgctcggtagccgcgtggtttccacgtgtgcaggtcgtgtggtgtttagtggagtccgtttgtcggccactcgcctcggttgacacacggggtctgcttccgtcgacccggggaccgcctctgtgtactcggtctaccgcggtcctttaggttgacatgtggggtccgcatgtcaacggcgcagccttcctgtcctttccaggctagcgcttacacatgttttataattgcaaagcttaattataataatccgcaaatctccatataacagcattaaacctcggatgatcatatcttggtcatacgaactctgaatcgacccgttcaagtctcctaatgtttgttataacctaaagaaccctgtgctttctttttatgtattgttattgcttctttataggcttgtagctttgcttgtgtgcttcgcgtagctttcgtcgttccggaggttcccgaagcgtggttcgcggtcgtcgccgaaggttcggaagtccgttctctctgagcaaggcaagtcacatcatccttgagcatattgaatcccagtttataaaattattttgatttaaattaatgcattatcgccttatttaaattcccgcgttatcactgttttatttagccatgcctatttacctttgttatgaccttattattgttgctattgttattattaccttgttcaccctaggataaacaaaacccccccaactagtgggtactctattcatggttccactagtatgaatttaggtagatgcttcgctgattaattaggcaacattaggtggttttataattttagactttgggaattctcatatcatttggacactatggaattgttggtttatggtggaattggacatacacctctcttcctctttcaaaacccctaaaacatgttttcggtggggtttgggtgcatgccagttgtgggaagtagcaccccggccactctaaggattaagctcgggcctctgttgcaaagcactaccgtacttccacatgtctagtgggtaaggcttagtttgtggctcagtctggttataaacaaaagtacacggatggaggtggatgaagtcgggggtcgatggacattctccagggcaaatgaaggctacacgagctgtggcccggtagtcgagatgtcatggcacagggttggtgccctgctgctaggggctcagtcctgcctgcctgtcccggaggttccggccgtaggtgggattgggtcggtactcttgtctatggctaggatgggttggaaactatgtcacgtcttccgtccgtataccgtggtggtatgtggcacgtggttacacgtgaggaagatgtgtcttgtgggtaaagatgtacacctctgatcagagtataatctattcgaatagccgcgccctcggttatgggcaagccgagcaatgtacccaagtcagtgttttaattcttaaaatttgctcaacaactaaaatgtggaatggttggcctgggttggcttgggacgagctgggacccagggtcgggttgccagttcggtctgaatcatcgtaggccttgggttaaggcaggttcgtgtgggttcacggccttgattaataatactgtgtagctttaggatcgtctttttaaaatggctttgggcaactaagtgacttttaaatgctgttttctgcaaaacttaacccctatattattactccttgtaccccccttgcattaatcatgcatctgccggtgtggcttgctgagtactgtggttgtactcattcttgctctatctttctccccccttcagtaagagaagctttggagaagaagtcttaggtggagtcttggcttataccccagttgagcgcctgtgaagatggagccgtaggcccgctagtccgctgctgtttatttttgattgtcaggccttaagtgcctttgtaataatgtaaatattatcgatgtaataaagatgtgtcttttatatcatgtttgtatggtgtaccccggcttttcctgggacggggattaatacactagcgttcgggaaaaggcaattttcccggtcgcgacattgccgacgctctaagtcgaaagagccattgcaacaatcttaacgtccgtggcattccgcccgagcttaaccaacagatggaagccctgaacctaagcatagttggtcgtggattcttggctgcgttggaagccaagcctaccttgctcgatcaaatccgcgaggctcagaagaatgatccgaacatgcatggactcctcaagaatatgaaacagggtaaagccgctggtttcacggaggatgaacacggaaccctatggaacggaaagcgggtatgcgttccagataacagagaacttaaacagctgatacttcaggaagctcatgaaagtccttattccattcacccgggcagtacaaagatgtacttagacttgaaggagaaatactggtgggttagcatgaagcgggaaattgcagagtatgtggccctatgtgatgtgtgccagcgtgtcaaggcagagcaccaacgaccggccggacttctccaacctctccaagtaccagaatggaaatgggatgaaattgggatggatttcatcaccgggcttccaaaaacccaaggcggatatgattctatatgggtagttgtggatcgattaaccaaggtggcttgattcattcctgtgaagaccacctatggagggaacaaactagcggagctctacttcgctaggatcgtgagtctccatggcgttcccaagaaaatcgtatctgataggggaagccaattcacctctcacttttggaagaagctccaagaagagcttggtacccgactaaatttcagcaccgcctatcacccgcagacagatggacagaccgagcgtctaaaccagatcctagaagatatgcttcgcgcatgtgtactagatttcgggaagacttgggataagagtctcccctatgccgagttctcctacaataacagctatcaagccagcatacaaatggcaccttatgaagcgttgtacgggcgcaaatgccggacaccgctattgtgggatcaagtcggagaaagccaagtgttcgggactgatatcctgagagaagctgaagctaaagtcagaatcattcgggataatttaaaggtggcacagtctcggcagaaaagttatgcagataaccgtcgccgtgatctggagttcgcagtggatgactttgtgtatctgcgggtcacgccattgcgaggtgtgcacaggtttcagacaaaagggaagcttgcacctcggtatgtgggtcctttccgtatcaatgctcggcgcggagaagtcgcttaccagttggagctgcccgcctccttgggcaacgtgcatgatgtgttccatgtgtcgcaactcaagaaatgtcttcgagtgccatccgaacaggccgactcagagcagattgaagttcgcgaagacttgacttatgtggagaggccagtgaaaatcctggacaccatggagcgcaggaccaggaaccgggtaatccgtttttgcaaggtccagtggagcaaccatgccgaagaagaagctacttgggagcgcgaagacgagctgaaggcagcccatcccgatctcttcgccagttcttccgaatctcggggtcgagattccgtttaaggggggtaggtttgtcgcgtcccaaatcgactctaaaattcatcctcgaaattgtgcaaagaataattaaaattcatgtgaaagcctccaacaattaaaatgtgcaaagataaaagtcaaatgaggcttggaggatttttgtatatttcctaaaagcctaaaatgtgtaaataaattttagtggaattttcagagcacaaataataattgaaaagaaataaacaaagttaaaagggttttataaaaagaaaaatcctaaaaagtcttctttcccccccttctttcttgggccggctcggcccagtccctccctctctctctctcttcccccgcggcccatcggcctcccccgcgcgcgcgccgctgacaggcgggcccgcccgccactctcgctgacgggtggggcccacctgtcatcgccttcctcccgccgcgcccgccgccgcgcccgtgccctagcgccgccgccgccgcggattccgccgcatcccgccatccccgcacgcattaaagagggggaaatcactccccgtgattccctctcccgtttccccctcttttccctctctctctccctcggattcgtccgatttgaatcccgcgagtttcgccggcttcttcaatggagccgagatctccgcggccgattcctccttctccggccgcgctttccccctctcggcgctataaaatcgtcccccgtgcttcgctcttccgtttccgccgctcgccgctcgctctcgccgtcggattcgtgctcgcgccgtcctcctctctctccaccgtcaccgccaagctccggttcgccgccgtcgtcgctccggacttcctcccgtctcggcgccacctccatcggcttcgccgcgtttccgtcgaccccgtccgcccctccgcttcgctcgccgatcgccggaacgccgtcgtcatcgccgtcccgaaccgcgccgccgccgtcctccgcttcggccgccgtttccgtcgtcgttgtagtcccggggtgagccgaagaccgtcctttcgcttccctctcctctccgctctctcgggcgccgctccgccgcgccggtggtcgacggcggtgaccatcggggcgcggtcgtgccgcctcccgtcggccgtgccggcgaggccgccttcgggcgcgccctcgcggctgccaagtgggcccggccgtcagccgcccgcgcccgcgggcgcggctgacgcgcgggacccacggcgccgaccgccgccagccgcgtgctcccggtccaccgtggaccgagaggctgacgcgtgggccccacttcccgtggacccggtccgcgcgccccctctcccggctgacgcaataaatggaatttttaattaaaatttaaatgaagaaattcgcaaatatccatttaaagagcatataaacttcaaatggccataacttggccatttgaactcggaattggaccgttcaagtctctaatttttccttaagaagtcaagaacccatttttgtgctttgtttctgctgttatgtggagttatttagtgtttaagccttttcttttccgttggtcgtgtagacgctgcagcttcggaagatccgctcttcgtggaagttgaagccgacgtttgggaagacgagcaaggcaagacacatcatcttgatcatattgaatcccagtttataaaattatgttgatttaaattattgcattatcgctttatttaaattcccgcgttatcactgttttatttagccatgcctatttacctttgttatgaccatattattattgttattgttattattattaccttgttcaccctagagcaaacaaaaccccaactagtggacactctactcatagtaccactagtataattttaggtagatgcttcgcaatctaattaggtaaccttaggtggttttataactatagactttgggaaatattcatatcacctggacactctggaattgttggtttattgtggaattggcttcacaccgctctctctattcaaaagtccccaaaatggttttaggctgggctcggggtgcatggtttggatggtagcacctcggccgtttaaggaccggtcttcgggcctctgttgcaaagcactaccgtacttccacatgtctagtgggtaaggcttagtttgtggctcagtctagtcataaacaaaagtacacggattggagatggatgaagtcgggggtcgatggacattctccagggcaaatgaaggctacacgagctgcggcccggtagtcgagatgtcaaatagcacagggttggtgccctgctgctaggggctcagttccgtctgcctgtcccgggggttccggccgtaggcgggattgggtcggtactcttgtctatggctaggatgggttggaaactatgtcacgtcttccgtctgtataccgtggtggtatgtggcacgtggttacacgtgagaaagacgtgtcttgtgggtaaagatgtacacctctgatcagagtataacctattcgaatagccgcgccctcggttatgggcaagccgagcaatgtacccaagttagtgttttaattcttaaaacctgcttaacaactaaaatgtggaatggttggcctgggttggcttgggacgagctgggacccagggtcgggttgccagttcggtctgaatcatcgtacgccttgggttaaggcaggttcgtgtgggttcacggccttgattaataatattgtttagttctaggatcgcgtttacaaaatagccctgagcaactaaatgtctttaaatgctgtttactgcaaccctaaccctttatattataattcccttgtactcccttgcatttattctgcatttgtgggtgtgtcttgttgagtacggtggttgtactcagtcttgctcaatttttcccaagtccagaagaggagctccttgaagatgaaggttttggtgtctagctcgtgcctgccgtcaagcgcctgtggtcgtcgccctagtcttccgctgcttcttcgtttgtctttgtgtgttgggccttcgctgcccatgtaataattctatttacgcttccgcttgttaaactctgaattgtatcaacttttggtgtaccttgcctcctgggataaggattaatgcacgcacgtcaggaacgcccgttgggttatttccggtcgtgacaattatactctaatcagaggtgtacatctgtacccacaagacacatctttactccgcattccaaggccttggaacccgtcgtaaacatgtgacataacccttcacccatcctagcagtgaacaaaagtaccgatccaaccctgcctacggccggtttcccgggacaagcaggccaggattgagcccctagcaataggatctagaccgggtgcgccacacacataggggtgagaccacccgcgtactagtcgagtgccatggcatctcgactaacggacaccggcccttgtagccttcatttgcctagacatctcgattaccgagccgcagctcgcgtagccttcatttgccttagagatatccatcgtcgcaacgacttcatctatctctatccgtgtccttttgttcaggactagactgagcaccgagttaagccttacccattagacatgtggttagtacggtagtgctttggaacagaggcgcgagcttaatccttatagtacctgaggtatgactaacaaaacaaaaccacgcacctcgagcccagcgtaaaaccgtttggggggttttgaatagagggggaggtgtgtgtccaattccaacataagccaatcattccatactatccaaatgatatgagaattcccaaagtctaaagttataaaaccaccttgtcggtgatatgggaccgggggtatcgtgaccagaggcttgaggcagacacaatcgcccacgcggcctggcaccttcggggacgtcgggcccgagggtgaggtgtctgccctcctcctgatttcccccgagggggggtcgggttactcctgccccggccccgaggaccgaggcaccccgaccccttgaggaagtttgcgccgcatatatgggataggtgaacacagcagtgctcacctaaccgcatttattgtagtctggtcaagcgtgtcacgctgcatgcagtgcagtgcagcgcgttcctttatccggtcacagaccggtcagatcacgggttaggtggcgactggcggtctgacgcacgccttgccccgtcccgtcaagacgaaagcctctaggcacttgtctcaagccggagctagcgtgttatctcttagagatggcacgttagccctggttagatttataccaggcttcatcccaaccattacatgcaagatgttacatgaagaagggcaaacatgcacgttgctaagctgacgcatggtagacaaggatgactgatctgtgaccggtctgacgctggtcgcgtcatccacagacagccataatcccacgtcgcacctgtttccggcggaagtgggggtaggtacgggtcgtcccgtcagaagggcactcggacagcaaccgtaccgatctccgtccatttatgaagagaagaacagtccagtttaaaaagggaaaggtgcatgtggtatccccttgagatataaaaggaggaccttgcccacctagaagggggacttttggctgattgatacttggtaacttgttcatacacagatccacaaaaacacaggagtagggtattacgcttcccagcggcccgaacctgtatacgtcgccgtgtctcgcgtttcttgctggcgagcgatctttccacatacagagagagcttgggatttcaccctaagcccccggccgaaccggcaaaggggggcctgcgcggtctcccggtgaggagccacgagctccgtcacacctaatgttgcctaattaatcagcgaagcatatacctaaattcatactagtggaaccatgaatagagtatgtactagttggggttttattttcctagggtgaacatggtgataataaacaatagcaatgataaggctataacaaggattaataggaagtgctaaataaaacagtgataacgcgggaatttaaataaagcggtaatgcaataatttaaatcaaaataattttataaactgggattcaatatgctcaatgatgatgcgacttgccttgctcagagagaacggtcttccaaaccttcggcgacgaccgcgaaccacgcttcgggaacctccggaacaacagaagctacgcgaagcacacaagcaaagctacaagcctaaaaagaagcaataacgatacataaaaagaaaagcacagggttctttaggttataacaaaaattaagagatttgaacggctcgattcggagttcgtatgaccaagatatgatcatccgaagtttaatgctgttacatggagatttacggattattgtaattaggttttataactataaaatatgtgtaagcgctagcctagaaaagacaggaaggctgcgcttgttgacatgcagaccccacatgtcaacctaaaggaccacggtagaccgagtacacagagatggtccacgggtcgacggaagcggaccccgtgtgtcaaccgaggcgagtggccgacaaacggactccactagacaccacgcgggctgcacacgtggaaaccacgcggctaatgtaacgccccgattttcgttcgggattaaaaatcattaaataatgcattttctggaaattaaataaaattaaagcaatttaatcaagtgaaataatgagtaaattaaaaatttccattaaaaatcatggccgagaatattttgtaatattctttgcaccttaatatattctctgaattttcccgtgaatttttggagctcaataagtaattataataatacaaagttcattaactcaatttaaataaatagaaaacaaattaaaatcccctctttgtctttgggccgtgttcggcccaactccctcccttccccttctctcctccggcccggccgcccttctcccctctccttttgggccgctcggcccgctcggctcccctccctccctcaagttcattcctcctccctccagccgacaggtgggcccgaggcccatttgtcaggccctcctgctaccttcggtgtcacgcctggaatttctatccaaaattccaaacgcttacatgtgtgtgaaccctcgtccaggaatcagccgaggcacacaataacaaattgataatagagtacaattattactctaattaataagcgaataaaatgtcgttacagaggtagatagttcctctcaatcaataaaaatctaagcagcggaaaattaaaataaacggcacaaacgactctactccacaggcagcttgaccagggctacacctaatcctccataccatcagcatcactgtagaactcctcctctgatgaatgattgcaaggtgagtatatgacatactcagcaagccacgcagcaaatatgcaagtgcacaggataacaaaggatgacatagtatggtttcatttgcataaatggcatttacaaacatttcagaatttaataaaatagttaagtagtaattaaacaatattaatccaacgctatacaacataccctgttgcataggcccaatcgttctgaacaaccatcccggctgcacagttctatctccaaaccaggaatacaccattccaaaccaggagctaaacaaattattgccagttatagcatcttttattatggtgagaagtgtgaaactaatcacgaaagacattgttagacccgcccataaccgcgggctcggctattcgaatagttttactctgatcagaggtgtaccactgtacccacaagacacaacctcaacatcatgtcaaccatgcgtcgcgatacttgacaagtacccgaatagagattgtgacaataccctctatataatacaattcaaagcagtgcaccgttcccggatcataatcacccccttataaacaaggtatggactccccagcgacccccgtgggcttatctccgccacttcacagtctggtgctctactatgaaccatactatactgaaagtaaagccgttgcccacgttggcttgtggttggcacgataaatgtttcacaaccgaaaatcgtgaaccggtccttaattgtcatgagcacaaccatcaaaaccatatgctcacaacccaccattatcatattttagttgtcaaattaattaattaaccaatcatgattaaccatcatgagctatcattaagccatcattaaataatagtgaatcataaattatcccattagtgagctaatgtttctaagcatggctaagcaattatacctaacatctagctgaacaattatataaagctcaactagtcaaattatactaacccaaggtatcaaagaataaagtaatcaagtacaaaagggccataacaaagaataggttaattccacccaatgacattcgaaaatagatgcaatagttgaatagaaacaatagctttaaataggatcaacatgctcaaagggttgtttgagatctgtgtgacttgccttactggccttggaactcttcaaattcttctccagcgaaaacggactctccggaaacgtcggaatctaaacagaaaagagcaaaaacaccaaaacagcacataaacaagcatgaacagtacatgtggatatttttagagacttgaaccaactaaatccgagctaagatgaattagttatgaattttcaaagattaaaccggattaaagcatttatatagattttaattgaattatgacgcaataatgaattatttttgaaaaggaaaaggggtttattgcgtcagcggctagggtttgcggtggaccgggtgcacggcggcggttcacgggtttggacggccgagatcgatcctatctacaacggacggccgagatcgaccggtccacggccgggccacgggagacgatgacgatgacgtcagcggtgacgtcaccaccggcggcggctcaggcttgcatgctcgccggcgaacgacggcgcgacgacgcgaacggagaacctcagcacgtagagagcaacgcggcgaactcaccggtgaccaaaacggcggcggaagatcaacggacggcgacggcgtcgaggaaaaggcggcggcgaccttcggcttgacgacggcgacggtgctacggtgacctacggcgacgacggaggggtggacgaggacggcgacgacttggcgaccacgatggcgacctccccgagcgacggcgacgactgaagcgacggcggcgcacggctggagcggcggcgacgacggcggcgcgagctacacggtgctagggcgctacggacgacgagaggcgaaggcgagggtggcggcgggtagaggaggacctgggggtgcttttaaaggggttgaaaggcggcggcgaaggcccacggcggctggcgacggcgatggaatggttagggttcggggagagagacgaatccgattcgagatcgaatccacggatttccaaaccgaaatagatgatgattccaaaagagaaaaggtagaggggatcccgaagatcatttcccctctattgatttcaccggaaacggaaaggcgcggccaaatttggaaggagacggcggcggcgcggcgctagggtttcgggcggcggccagccagaggaagacgacgagtccgatccgcttccctcaggatatcagtcccgaaaacctgacgatctcctgtctgatcccacaaaagtggagtgcggcatttccgaccatacagtgcttcgtacggagccatctgaagactagcttgataactgttgttgtacgagaattccgcgtaaggcaaattcttatcccaacttccaccgaaatctaaagcacaagctctcaacatgtcttccagtatctgatttaccctttcggtctgtccatctgtctgcggatgttatgcagtactgaaattcaacttggaacccatctcttcttgaagtttcttccaaaactttgaagtaaactggcttcctcgattagatacgatcttcttagggacgccatgcaaacacacaatccttgccatgtacaattcctccaaacgactcccagaataagtggtcctcaccagaatgaaatgagccactttggttagtctgtcgactatcacccaaatagagtcatgacctgacgacgttctggatagtccagtgataaaatccataccgatttcctcccacttccattctggtatcttcaaaggctgcagcaaacctgcgggtttctgatgttctgctttgactcgctgacaaacatcacatactgctacatattctgcgatttcacgcttcatacttgcccaccaaaatctttccttaagatcctggtacatcttagtactgccagggtgaatggagtataaagtatcatgagcttcctttagaattgcatccttcaagtctttgttgtctgggacacagattctctcacccaaccatacagttccttgctcatctttcaagaaactgatagctttacctcttctcatattcttcttgatctccagaatatcaggatcattaatttgggcttctctgacttgatcaatgagagtagtcttcgcttctaaagctgcaacaaaacctctgctgacaattcccagatttaatctttcaaattcgttgcataactccaatggcaactgtcgtccttctgtagcgtttcaatagcctttcctgctaagggcatctgctacgacattagcctttcccgggtgataatgaattctcatatcataatccttaattaattccaaccatctccgttgtctcatgttcagatctggttgagtaaagatatactttaaactcttgtgatcggtgtacacctctgtacgagtaccgaaaagataatgacgccaaatcttcaacgcatgaaccactgcagctaactcaagatcatgagtagggtagttcttctcatgcggacgtaactgacgagatgcataggcaaccaccttcccatcttgcatcagtacacaacctaatccaagcttggatgcatcgcaatacacttggaaacccttctttggatcaggtaaaatcaaaataggagctgatattaagcgattcttcaactcttgaaaactctgctcacattcttctgaccacttgtactttacatccttttgaagtaatcgtgtcatgggcttagcaatcttggaaaaattctctataaacctccgataatatcctgcgaggcctaagaaactgtgaatctctgaaactgtcttcggttgtttccagttggttacggattccacattactaggatcaacggcaactcctccggctgagatgacgtgaccaag

SEQ ID NO: 19981 - DNA, 2811 bp, Oryza sativa
ccacgaaggcgacctcccggagcgacggcgacgactggagcgacggcggcgcacggctggaacggcggcgacgacggcggcgcgagctacagggtgctagggcgctccggatacgagaggcgaaggcgagggtgccggcgggtagaggaggacctgggggtgcttttaaaggggttgaaaggcggcggcgaaggcccacggcggctggcgacggcgatggaaaggttagggttcggggagagagacgaatccgattcgagatcgaatccacggatttccaaaccgaaatagatgatgattccaaaagagaaaaggtagaggggatcccgaagatcatttcccctctattgatttcaccggaaacggaaaggcgcggccgaatttggaaggagacggcggcggcgcggcgctagggtttcgggcggcggccagccagaggaagacgacgagtccgacaggtgggacccacctgtcagcgagcgggagcgcgcgcgcgggcggcggctcggctgcgggccgacttgggccgaggagagagagagagtggttttgggctgactttcggcccaaagccaaaagagaatttaaaaaacctttttcaatttaaattattcattaaatgcaattccatttattaaaaatacttccttagctcaaataaatcccagaaaaatctaggaattatacaattaagcaaagtatttaatgaaattttgtctggcccacttttatattggaatttatttattaaaattagatcttctcttctaggctttttttaaaataaattctaataattccaattaaacaacgatttatatatttaggatttttagggtgtgacattcggcttcccaggccgaagccgccatggatggccgttcccgcccacgtcccgccgagtccggcgccctcccgctcgcaccctcgctctcaaaccaagtaaaatcggttccccactaccttctccaccttttcccccactctccccgcgaaaatcggcgccggttaactcctccaccaccccacgtcagcatcccacttcgccagccgttgccgttccgctcggctacgattctccctccccgagcctataaaaacaaacctagagctctctctctcattttccctcctcccccgagcttcccgttgcctccctcgctctccccaccgctgctcctctcgccgcgactccagctggccgctactactgctcctgccgccgcgactccgcgcgccgccatcagcggcttcccgtgtcgtgccgtacccggcatctcctcatcttccctattttgtcgccggaaccacctcctcacggcgctcccactccccaccactcaccggcgtgctccagtcgctgcctcccgtcgcactagccaccaccgagccgcgccgacaccaccatcggcatcgccatgtcgatctcaccctagcccatactccattttccccttgagcatgttaaaaagcaaggcaagattgtttgatcgcgaggaaaagagttccgtaagattgtttgaagaagcaaggcaagtcacacattccccttgagcatgttgagcctaatttataaatgtttttaccgtttgcaaataaagatgcatgttttgctaattacatgggatcagggtttacctatctgcttgcttgtgccatattatttgatatctgtcctttgtcaaccttgggtaataaatcgactagcttgtgttactttgttgatctagctagaactatcggcttagccatgtttaattaccactagctcagttgatgggataattgcagtattagacctgttagtatcatgatgagctgcggctcgagacatccggccatgtttcatggtcgtaattatccaactaaaactcgactgaatggtgggctgtgggtgcatggttttgctggtcgcacccatggcaattaaggaccggttcgtgggaaaccctggaagacatacagcgcttgccacaagcgggaatgggtaactgcctgacttgaagtatagcttttcgcttgctgacgcatctaggcaaggatgagcgtgatggagttcggatgggccctgcgacggcctatgcggctttctgattcgcctaggcacgagaggggactgcccgctgcctgctgggggcaggggtgaaacctgatgtgtggtgtgtttggtcagaggcggttatatgaagggtcttgtcacaatcactcgacatggtgacgtgtctggcctagcacggtgacatgccggtggattgtgtcttgtgggtacagttatgcacctctggccaaagtaaaactattcgattagccgtgcccgcggttatgggcgatcgaatagattcaccgtgattagtctcatacttaataaatcgacccaatgcactgtagttcaggtgggttggttgggcttgttatgggttggttgggcttgttcaacgtggtgtagcgttgatcagtagagatttaatattacattaatgactcaattgttttactgttttgctcaataaagtgttttacaactgcctttatgcaaatagccacaagccattcttgaatccccttgcacgtctgcatcattggtgtggcttgctgagtacggtggttgtacttagccttgctattattttccccttttcagaagtgtagtgcttctgagctgaagacgaagttagaggaccaagcctcagaccccagttgagttttgcctgtggagtggagctgaagcccctctaggatcgcattttttcgctgctgctgctttcgtttcagtgtgaggactaagtgcctcttctgtaaatatttacgttt

SEQ ID NO: 19982 - DNA, 14817 bp, Oryza sativa
gacgaagacgatgacgggcctgcgacgtactcttgaagaaacgcgggcaacgaacgagcacggcttgacgaagggagggccaacgaagagcgcaaccaggaacgacgagaggacgacgacgacgacgaccggggccagcgaggaggcgacgatggcagatggcagcagctgcatggaggcaaggacgcgggggagaggaggcggctgagacgccgagggaggagacagcgcggccggacggcgctcgggtgaggagggagaggcggctggaggcggccggcggcacgggagagagaggacggcggcggggaggggtggtgcggccacgggggagctcgggaagaggcaaaaactagagaacggaaggagagggtcccattttatagcggaggggaacgagccggccacgggaggagcggggaacggcggcgggattggcggccggcggccatggaaggtggccgggaacggcgcgaccgttccgggtgaataagagcacgaatcaagggagaataaagggggaattgaagaggaaggaaaggggattaattccccctaatcaattttggaatcccatgcttgaatcacgcggatttgagggagcaaggaaatagggttgtacggcagagagagagaggccgtgcgggaggaaggagatgcgcctggctggtgggtcccacgcgggaggcgcggtcagcgcgtgtgcaacgcgcatgcgcacgcggctggctcggctcggccaggcttgggccgggcggctgggccgaggaaggccgggaggaggagaggagggagaggaggcccgggagagaaagggagggggagggagccgggccgaggggagaggaggggaagactttgggctagactcggcccaaaggaggaaggagattatttttaggttttcttttaatatacattgctaattggtattgttgcttaataaatatttccggtgctctgaaaattcaagaaaaatttgagggctccttttagaccaatgagaatttaacaaaaattctcctggccacattcgaattttttctgtacgctttttaaggtttgccatttcttttcgaattttaattaattctattattttcttttagagaatgatttttatttcgggatgaatttatcaggacgtgacaacattgttgactttacatctttgctagcttgagatcttccctctaccttttttttctggtataccttgtggttcacatcgtatacctcggacaattgcatctgatcatgcaaccataattcaagtttggttgtacaagtgattcttgtcctttgtcaagagttatgcatggaatcatgctcacctaaagttgtagtcgcaccccctccccccgatcaaacatggcacctctcgggtcataccatctgctccagttggtaaaatttcataggatgtctagctccacctccaacaacccagtagttcagcatacaatgtttgccgctttaaccgttaaggatactttacaaaaatagaccaacaaatacatctgaaacgattatccaccaatcctatgttcattatctattcccaaaaatatatcaacatccataagtattttttacgagaaatccataacaggcaggggcgggcccactatgtattcatgggtattcagatgtatacccaagatttttggaaaaaaaaaataggtatatatactatatagttcatataggtattaaaaaaataaaaagaaagcttaaactgcttatattgggccttgtttccccatttcttctctattgggcctaaattttccactcgcctccctctttcctctcaacctgtggtctaattgggccacatatcagcccatttgcaattttcccccaattccccacccgcctggcgccttggccacccaaacctgcaaaccctagaccacaacacagcagtacagcacggcgacgggaggaggcgtgcggcggcgtgacgtgcggcggtcggcgggggctgcgtgcagcgtgcggctgccggcggcgggagccgtggcggcgtgcggcgcggccgtggcgtgcagcagcgtgcggcgcggcggcggcgacagcgaccggtgaggcggtgagccgccaaggccaagcgccaagcccgtgaccggcaggcgcaccgtgaccgaccggcgacggcgtgccgcgtgcgccagccggcgcggcagcctgcaggggcccaggaggcagccaggcaggaggctgctccaggccgtcagccgagcaggagcaggcgctgcacagctgcagcctgcaggtcggcgtccgccgttccacgctgaggcccgaggcagccggcggctgcgcgctgccgctgcggccgtgcggcatcctgctcgccggcgactgcctgacctgcaaattccggacaagcacattagcacagtgagtgactaaactccggacaacgggacaagcacaaaaattcattgatttagacatttagtattttagtgtagttgcttgcttgcttgcttgcttgatttagacatttagtttgtaggattgtagttgactagttgcctatttgagtatttgagtaattgagtatattggacactgggcagtagttcatagttcataccatattagcaaatttgtagtatttgaatgattgtttggttacattcattgaaagagaattctttttgcaagctaaggacaaggacatcatcaattatttccaaaatatcaagcgtcgaaaagttaatatctaaattgtaagttttcttcctaacttattattttctatcatttttgtattccatattttgacactttgatatgtttggtattagtatttctataagttaaacaatttctagtgatgatcaattctatcactgtgtgaactaatgatcaattttatgttctatacgctctaaattataattattagtgtatcataatatacaagcccattttttggctttttggtgtatggatatttttttaccccttcccatttcgaatacccaagtttaaaaagctgggcccgccactgattaacaggtaacatatggaaaataagggattatataatacaaagaaatttgctttgatcataaaacagatttatcaccaaacaacacgtaaatgtttttaaaattttcattgggaggtagagattataggaacggtaaaatatgtttaactacttttacaatcatctttttatagtgttgtaattctagtgacttttcaccgagtatactggaaagaatattagtggtaaaatttaatatgtcagaccgtatcatcgtgcaaaagatcttatatttcttacacgagggaataacttcgcatagattgtgcagaataaacatatcaataaatatttagctatcacaatgagtgtctagtagacgttacataggccaccgtccatgtttagcaatatgagtaaactgcaaatggtaagattagataagactatccaccatacttcatttcaataatatataacaaaactgtacatatgtttaggataagccttatatttggatactattaatcattggattacttttgcctatttatttcagttgtgctgtctatataaccatcgtaaaacaaagaagaagcacaagccacagcttcatacaaagcaatcacacaaatgggcaagcagatgccgaactgtagccgtggacttctgcttctgttgttggcccttctaggctgttttagcattcctggccacgtgtatggtaatctactatctaatattgaatctcaatggtgaatccaaggtttattttgatttcacaattattcaattcttctgtggtaatcacgatgtattaaagaaacatatctttcagagtaaaatttgtgattccaattttcttctggacatccatcttcacatatccatgtattgcatatggtttttctgtatctttcatgctttcctagtaaaatattttttatttttcaggtaaaaatctggattacaccaggagtgcatccatgaatgaaggacgcaacaatgtcaatataaatggtttggtacccgtaccaggcaacattttctccccatcgaaggtctgctgtagaaatgtatgctaccctagcttgcaagcctgtgaggcaaattgcaaaccaattgcttgatcggcttatcaagcctgtaatactaaagaaatgataataatattgtccgttgttcaccaatcaagagaatgatcaatctcctcatagatgaacatggtttgtccttttgtttaggggaaaagactgtcttattgatacataactggagatggccacaggagaatcacgagaataagcgcaagaaatagtatcgtgtagtcaatatggcatgtatgcaggtttgatcgtagtactcgtttacagaaaaaagtaggcactctttttgcaagtgcggtccgctagattaattttatttttgaggctaaatcgtatataccattgcatgtcaccaaacgaagccttgaatcaatgggcatccttttcaacttgggtcaatgtggcaggccaaattgggaccttctgtagtgtataatcattttttactatgtgcatctccttcgttttttctccttcgttcttaagcacaataatattatcacaagcaatctttcccgcgtgaattatcacaggatttatttagttgtactcctttcaagaaatcctgatattgtaaccttaagaacgaaactgcctgataatgaagtgaacaggcacgagctcttgtgattgttccttgtatgcattccgcgcccgggtcaggatttggaaaagtggtttcttctggccgacaatgtatgaagattcaaaagcattcgttagaagatgcacaagctggcagaggcaaggaggaattactgctcgtgatgcaatgcccctcacatacaacttgcaagtcgagatattcgatgtttggggtatagactttatgggacctttccctaagtcccgcaactgcgagtatattctagtggcagtcgactatgtctccaagtgggttgaggctatgccatgcagcaccgcggatgcgaagcatgccaagaagatgttcatagaaatcatcctcccaagatttggtacccctaggatggtcataagtgacggaggttctcacttcatcgacaaaaccttccgagacctcctacaagacatgggagccaaacacaatgtggccactccttactatccacagaccagcggtcaagcagaaacatcaaacaaacaaatgaagaatattgtgcagaagacggtcaacaaaatgggaacatggtgaaaggatagattgctagacgcactgtgggaagtcatgtcgactacccgtagagctcgagcacagagcatattgggccatcagaaactagaacatgaactttgaaggagcaggagaatgaagaaaaatgaaaattgctgaacttgaagaatggagagagaaggcttaccacaacgcaaagatatataaagaaaggacgaagcgctggcatgataaaaggataaacattaagaaattcaagccaggagacaaagtactgatgttcaattccagggttatgcttttcggccacggaaaattgcgcagcaaatgggaaggaccgttcgacgtcatcgacacctcttcacatggggcaatcacactccgtgatgattcaggtaatatattcaaggtaaacggtcaacgcttaaaaattttccttgtgccaaatgaaactttagatgaagaagtggatgttattgaattaatcgattatgagccataatggtctcatctattccatgctaaaaaccatgcaaagttgtcatttttgtgcttagcttaggaattagtgggcctaggaaaaaattggcggccagccggacccgccagggttcagccgaaccaaggcggcgcccgatcagtcccaattttgaatggcagtctcccccgctactgcttgatctgtttagatgcgagtttagagatagaacgatcggatcacgcccctgagctagttcttctccttcttcctcctttgcaaaagcctctccattcaattccccagtcattctcaaaacctttgatccaaacccttgtgccatccatggcttgcaaatctctcatgccttacattggttcatcctcaaacaacacctacaaccttgaaggagaacttacaccggggaatcaactcattccggtggaagaatacacaatggaaggggtaaacgttgtatgggctcaaccccttgtagttgttccaggttcccctgcgattttggagccaatcggttaggtccctggtggggttcggccgaacccttttcggccccattcggtcccccgttcggtagcgcgatccctctcccctcgccatgtcacgaggaccaaagtccgaggggattcgcctgcgcgacgaccgacaatgggcgagctcggtctcttgaaggcgcgtcgcctttttcaagatgatgagaaggccgctccgcttcccgccgagcgatatgtgggcaccctgttcaaaaaagcaggagatgaggtggtccacaagtacaccatgcccaccgctactccaaccactccaaagaaggaacggttctgcattcagggagtgcgaactcccgacgatgggtatggtaaaggcttgctccggcctttgacagcatcggagaaggagggggcagcggaatcccgtagccctccacttatgaaggtgaagcgtcatttgacgcccccctccaattgtaaggggggccggccaatttcaagaggaagaagtaaagtcgccggagccctcggttcataagctagcatcataagtgaagaagctccacaaggagaatattgagtttagggaccgcaacgcggagctacgggtagaactcgctgagcttaggaataatgttgatacccttagtcgcggtttgtgcgctaaaatcaagcatccatttgtagaaatgggtaaggagaatagagattatgcaaaatagatgtctcctctcccatgaataaagtagtaggtgcttagttttttttttccaatcatgtaagcacttgctataaataatgtggctcattggtgttaaccccaatgtttgccaaagtttttttttttgttttaggtttaataaagttcaggtgttgaataagtgtgggggagatatcccagcttctgacgtgcacatactctgaaaactgatgaaaggtctgaacacctggaagcactatacactgcagaaagttgctgagggatcaggcgccagagtggttcggccgaaccaaagctggccccaatccttctcaattttcacaggtaagcaggcgagcacgtccattatttgtatatctccaccatggtatagtactagagttgaaaattcaggaaacaattggttcaagcataagtataagataaaatttccaactaatgaaatttttcatatggttgatcttgtatattctttattctcagctgaacctgtgcttatgaacaaccatccatgtttagggacccttatacatctaagtatttgctatatgagagatgattaaagatgaaaggaattcttgcaacttttgttatgactcttgggaatttgttttcaaaataaaattgttttaaaagctcattcctccaattgacttcattctttattcctaccaaggtcgtatgcaagtatatctttgataaaccttattatgcgtatgactgcttgacattatgttaagctttaacaaatttgtgtgactcgtgctagatatctttcatactctcatgatcaaggggtcatttccatttccacatatataattaagctaagattttacactggaagttggcttcccactaaaattccattcaaataaactcctacattagactatgctttcttctgttagaagaaaaaaaaaggtcttagcaaaaaaaaatgagaaaaggagggaaaggcatggctatggaaaagaaaaaaaaaagaggaaataaagcttgctctcaaaacattgagcatgatgaaaagaaaatatagccatgccccttccatattcatgccaagaaaacaaaatggagagaaagtacatgaaaaaaggagaatcatttctttattccactattccacaaaatattttacttttctattttctaccacaaataaagacccttgatctaggagtatggctgatgatcttcttgagtccgtatttttggctttgcaatatatatgatgcaggtatgtcacagtttgtccctacggaactccacatatcagccttagagtagggataaattctagcacattttgtcttggtgaggatccaaaaataaaatattcatccttgagaaataagagagaaagtcaatatgaggaaaagagctggtttgcgaaaattcataaaaatctcatgagtctgacacagaagtaagaaggactggaatcgaggacgttccgtttatcaattactcaagatggtaagatagacactaataaagttcacaggtgcaggtatggttatgaatgatttatatgccttatttatatcttgaagaaattcattctacactaacttttactcagggacgagcaaagagctaagtgtggggggttttgttggcggctgttaaataccaattctatactgccaacatctgcataaatttcagataataaaacatccaacatagtgataggtgcttaatctcacatattctacaagtgttggtgtatatttgtatgcaggtgataaacactgaggttgggaggaaatctagactaaagtgaggacaaatatgtatccatacaaggatgggttgtgaacttcatcaaaatactagaaaatcagcctaaaacactgaggattggataggggaggaccaggataggagccaggccaaaggccaggctaggggggcccagcccaggttcggccgaacccccactgttgatcccaggttttggcgtggacgctccagatcactccttgatggcggttgcggggtagttcggacatttcctcttcgctaaccgtcatacctacctctatataaagacctcactttactcacttcaatgcacacttccaagcttgagatgaattataagaggctctgttgtactatattgtatactagaataggaagagagtagagtagaagaagtcggaagaattctggagttgtcgttaatcttctctcatttctgttattctgtttattactctgaattcaatataatattcttccttagtaatttagatttgtctagtgagagttatctcttggttagttcctaaatagcatacgggatcattgttcactatagtccatttatttatagtggttgctttagtgtggttgccagtgcctgaagtatcgtgttaggatgaaccggagaaagatctgaccaaacttggaatactctataggggaagtgctacagcggtatatctatgcgcttgtggatttcatctgtgatcgtaagaaataccaacacaaccgaggcgaacctgatctccaaatttagcccctcgcacatctctctgaattcattagagttgaactacttgccattgtcggtgatgaactctttcagcacactaaaccgacagacaatggtttttcgcaagaatttctggactgctgccgaagtgatagtatggagtggttcagcttctaaccaccgagagaagtactcaatagcaacaatggcgaaccggtagccatttcgcgccatagggaacgggccaatgatgtcatgcccccaccttgcaaacgactagacaggtgcaatgggccataattcatactgaggggctgactggcttcagccatgtcgctgacagctttcgcaccttttgatctggtcaatgcatactttgagtacggttgaccaatatacacttgccgaaactcttcggatgctacggtccttgctgcctgatgggctccacacaatccttggtggatttccttcaccacttcttcgcctccggctattgatatgcaccgaagcaaatgttcactgctaaaaaaaggagacaacactatatataggtgttagaatagctaaaactgacatttataatgcttttctcacccacacgggctcccgcgggggtgccagcggcaaaagctaggacattgctattcaaataggtgtcgattcctattaaaaaatggcactttcatacgaggtagaagtgtcggttttcaatacaaccaacacctatctcccgtcctctcatccttatctcctcggtctcttcgcttccttcttattctctttatgcttccttcttatcctttctcatccaattcgtgctcctctccctttccttcctcttccccaagccaccacctcccttacctctcctcccttctcatcttgtctcctccccaaataaccagccgtgactcaccatgccaccacctcccctctgccttcagggctaacggagtcagaaggggtagcgcggcactgatggggccgagccagcgtaggggcacctcgtgacgtcatcatcctcattgggtgggggagcggggggagtgccggcgcttgtcactgtcaatcacgcctcccgcaccacggagacattgccatcctcgcttctctaccactgccgccgtgctcttggaaggagaagcgtggcaccgacaaggttggtccgacgcaggggcaccctgcggcgccgtcgacctcatcgggtaggggagcgggaggaatgctggcgtcggtcaacgtcaaccacgtctcctgcgccacggcgccatcgccgtcctcgcccccatgccgccgctgctcattgagctgctcctgctcctctatgacgttgccacggtggaccgtctggggctcctcctcctcctcaaacttgttgattctctgatgtgaatgtttgattctcttatgtatgaacttgttcctcttatttgtactagtctcttttttgttagattttttgttttttttttgtctttgaagcatcgctgggctcgaattgagctgagctgttcttaaaccggcacctgcgagtcctcataagtgttacctctgttgtgtcggttcggaaatccagcacctttagcgcttcccaaccggcaccaatgagcaaagcccgcgacgctgtcgacctcatagggtaggggagcgaggggagtgccggcgcttgtcaccgtcaatcacacctcctgcaccacggcgtcgaggttgtcgtcctcgctcctctcaccatacgccgtcgccgctgtgccctttcaaggagaagtgtggcaccgacggtgttgaactagcgcaggggcacaggggtaccctggggcgcctttgtaacagtcctccctccagaaccgcatagccaaccaattcgacgggctggcccacttacacataccactccacttacacttttgttctcgcttcgtgtagaagggttaacccgggagtgacatggttggagggaagaggccttataagttggttccacttgtgctaaactagaggatctgacgtcctcgtcggtccaacttacctagccacttaggcatataggcaaatgtctaggaacataccccctcttagcacacactgacccgtacatgcaaccgcgagggtcggctctgataccatttgtaacagccctccctccagaaccgtgtagccagtctatccgacgggctggcccacttacagatacctctccacttacaatttcatcctcgcttcgtataaaagggttaactcggaagtgacatggttggagggaagatgccttataagttggttccaccagtgctagcaaggtggtacgaaacttgcgcacacagctcacatgggccacacgggcctcatcctaattgcgccaggatgtcacagccttccacctcgtcaagtgagggagcgggaggagtgctagcgcctgtcaacgtcaaccatgcctcctatgccatggcattgtcattgtcctcgccccctagccgccgctgctccttgagctgctcctgctcctctgtgatgttgccgcggtgttaacgccaaaattttgtaagctccgaagtcatcatcagcttagaatcaatattggcttcaacatcttcgaatcggctgatgagaattatcaagtcaccaataatcggatccttagtagatttggttaaggaaattaaactattaaaggaagtttattcagaagtgactgagttcaaggaggatgtggcttggcagtttatctattaattaggaagagtttgttagtttccttttatctctctagaaaagtgtgtttagtgtccgataaggattttatattttccttttatgattatgaaagtttctttcttgtccaataaggactagtatctatccatgggtataaatatgtacacccgaggtcattgtaaactatcacagagatctatacaattactcttggtgtatcgccaccctctttcccgaggttttatttatcatccggcagaacatggcacctaacacggggctgcattgactttcgatctccggcgaaggggtaagtcctacgtaccgccggcattggcaattgtatcggttacattggtgtgcttcaaagctgcatcgcttcaatctcttggatcgctctggttcggtttatatatttgcctacctatttgtcatatatcttagttaatatagcttagcaccttaatttgatcatatcggctgatattcattttagggtttatgctagtatcagctaaattatctgattagattagctaaggtatccaccatcctgaaaatttgtcgaagacttgatttttagactttttgcttcttagcatactttgtgatgcatcatccttagtcgtgcttaaatcataaaggctaacctgtctttgattataataagggtttcatcgggatttcagctgatgagttatttggacgttgaatcggcttataaaaattgaatacaagttggttttagccaattgcaacaaatgcttcattaattatctaatcttgtgtattctatgacaatagacctcccgctgatgtatactttaaccatcagatcacttattttatcatattattgttagttgattggtttcaactagatcatattattgttttattacattatcatcagtcgattgtctttatatcattatccacattggatatataatcgattgctcaaaaccctatcggcatcggctggtatcggcatcggctggaacttctccatcggcttgtcagctgatcggctatttgatctgttgtgtacacatatcttttctcaaaatgactggcacgcccgcatctcatcaatttttggaccaacactaaagctaagtagatctcctaggtcgttgctgttgtcgatctacttcgcgccaacacagatctagcattttcggctgagcgtggatttttcgtcaacacgcggcggactacccggggctcctcctcctcaaacatgttgattctctgatgtgaatatttgtttttttataaacttgttgtttctctgatgtgtactagttttttttgttagattttttgttttgtttttgtttttttttttgtctttgaggcatcggctgggcttgaattgagccaagctgtttttttatttcaatccatatgcctcacatgtgccggttcttaaaccggcatttttagtcctcctcatcagtgtcgcctgtggtgccagatcggaaatccggcacctatggggtttctcaaccggcaccaatgacttttttagtagtgattattgttttattattttattaatatattaatattgacaagagaatatgcttcaaaggaattagttaactaataactatattcattcggaggttgtcgacgaggatcagttttagcaaatccagctgtgtagcgaatacacagggaccccatatattcctcggaatggtagtgaactagtgatgctcatgtggtgctcagaggtagttgtacaaaaaattatatatcagtgcgtcacctttatttaatccctttagtttgtttgtattacgtggctagcaaaagcaattgtatacctagtacatccttgcatagaaatagagtaaactattaaaaatggttgatcatgatgcacttttggcatggtagcacatttggctaatgaaatgcaaagcacatgcaatataatagtaacatatatactaatgaaatggccagatcttataaatcctgggtgggtacaagcattgttaaacccaccaaggcaccaatgtatatcttgtttgctgttgttctagcatttgtagattccaaacttgatagagatatatatcggtcaggtgtacgcgcgtatagtccatcagtggcaacagtaacgccgtcgacttcaaccatcgcctggtacgtctcgttgtcgtgctgcttgtaattcatctagtttgtctacgttaaactttcttcctacttaactaggccaaatatacggtggaaccgtggaaactcaatctaacaaaaatctcatataaaccacacaaaagaagtctcacatgtagtcatgtagtactgtgtagataagatggatatcaatggtcatgtggaaactagaaaatcttatccaaattggttaagtttttctgagactaaaactaacatatctttcaagtactacctccgttttttaatagataacgccgttgctttttttttttttgtctttgaagcatccgctgagctgggctcgaactagtgatgctcatgtggtgctcagaggtagtagctgtacaaaaaattatatatcagtgcgtcacctttaatccctttagtttgtttgtattacgtggctagcacaagcaattgtatacc

SEQ ID NO: 19983 - DNA, 9749 bp, Oryza sativa
attataatttattttgttatgagttgttttatcactcatggtactttaagtgtgatttatatcttatacatttgcataaaatttttgaataagacgaatggtcaaacatgtgagaaaaagtcaacggcgtcatctattaaaaaacggagggagtagaaaatagtattggcgatttgtttgaaaattaaaattctcatttttttgtctcgccaatgaagttgaatttggacaagactttttatactgctattgaacgtcatcttatctacatgtgggatttttttccatgtagatttagataacctttactccctccgtcccaaaaaaagtcaaactgcgggtttacgtgccaacgtttgaatgtccgtcttatatgaaatttttttataattagtattttcattgttgttagatgataaaacatgatgaatactttatgcgtgacttctctttttaatttttttcataattttttcaaataagacggatggtcaaacattggacacggaaatcagggttcgtctttttttgggacggagggagtatgtcgtggtttattcgagttttcatggtttccacagtatattttcgcactcaactaacaaatgcactattagcaggggcaatgcctggatggatcattaccttcctgctcatcctacagtttatttcgtcgctccgtggattggtaatcttcagcttcgttgctcattttttcctcgtcttcttcgctggactccgccgccatcaaccaaccggcgtgcggatgttcatcctgtggggagcgaaccagtttgcccgttgggctccggtcaccgtgctgggcacgctgtcagtcggcagcacgccacagaaagagcagctggtgacgctctgggtggcgttcatgctgctgcacgccggcatgcctgacaacttcaccgcctactccttggaggacaccgttctctcgaggcggcagcaggctggcgtgtggtatcagctgcttggatcggcgtcaccattccctttcctgctgaagaacatctccttcatcatcagcaatggcggcgacgccatgctcggggtctcctcgctcgtcttgttgatggccatcggcaagtattgggagggagcattccaagcgctgatgcagggcaacctgaagagcatgcaaagctcgagaaagaagatgaagatgaagaacaacagtacaaaatcagtacgaaacagcctccagatcgctaggcgtggaggcagggagccgaatgatgagcaaatccttctggctgctcatgacatgctagacatcaccaaggacgccttcatcgattttctggaccaaaataatgcggatgaacaagaagcactctctgctacatgggatgagaagctgtacagggtggtcaacatggagctctccctcatgtacgacctcatctacaccaaggcggccgtggtgcactcatggaaaggctacatcctccgtttcgcctctccgatcgccgcgacggcggcattcgtgctgttttggctccacagcaaggaaggtcaggcgacggccgacgtcgtgatcacctatgtcctgctggccggcatggtcgtcctggacatcaaatggcttctccgagcggtggcgtcgacatggttctactcgttccttgatgagaggccacgatcgtggcttcatcatgcacttctgtgctcagggaaatggcgactgatccgtcgcctcatcgtgtctgatctgaatctgtttcggatccttgacaataataagaagccaactagatacaggatgtggtcacaaaccattggacagtacaacttgttgcacgagtgcactcgctacgagagcgaggcaaggaccaagaactggaagagcggcatgttcaagcggttagcaccggaggagaactggatggagtacgaataccagcgcatgaggggcaatcatattgattcaagagatttcagggacgagttgttcaactctatctggcaagtcttgaagaaacccttcccacaacgacgaccaccacgacaaataatagtgacggaggcctggaggcctgcaccggcggctcctccatttacacatgctcatcaggaagcagaccttgccctgaagttcactcctgatttacaagagaccattcttatcttgcacatcgccacggacatattcctcttctcagcggaatcagaaattgaagcatcgcccaagtccaaaaaggatgtggaggtgatcaaggcgttgtcagattacatgatgttcctcgtcgcggtgcggcccgggatgctaccgggcctcgtcctcagtagccgatatgaagctgtcagtgaggctcttgccggaatatggaaggagaaagaaggtagtgatccttccttgcgtactagctcaatgatgagagagaaacgtcttgccgagatcctgattgccaacgaagatgaggagggaaattacttccaggtggacgattcgaggccccaaagcggctttctgagtgttctttacgacacgagtaatgttctatcagagggagctatactagccatgtttctgctacctaggataagaggtcctaattttagaaagaatatcattgaaaaagttggagaacacggcgacggcgagcccccaatactaaagaaatttcaccggcagtttccggatttgatggaattcgctaagaatgtctcttttccatcaatcgcaatgacgacggatgccatcatcggggagtgggcacgtcagctgattaacgtgtccatccgatgtacaagggattctcatgccaagcagcttgcccgtggtggtgagctcacgaccgttgtgtggatccttgctgaacatgctcgcatacttcgcatcaaaacagaaaagaaaccagctagctacgacgcagtataggcattcatgcatgtctctctccctactgaactgagagataactacagagtctcagatggatatactgtttgatctctcctttgtgtatctgtgtgatccatcggcctgtagatggttgtagttaattactttgcagggttctcatttattctctagacttaactaacctgtgtaccctctaaattgtggtttcaagagggttataattaattaatatcgcgtgaaaagtctaccattcgagaagacattccctaccaacatttcatgctcacttggtcattcttgataacattcgagaagacatggagtactcaacatcatcgaaaaaagatcaacgttctacaagtgaatttgaattaaagtctaaataactgccataaacaagcatgaaatcaacgtaaacgaacgagttgatgttctcgaccaaagaccttggaataacaatgttgttctcgcttgaccattctcggacgagcgagaaggtgcggagtatacgactaagtttactgacctgccgtaatcgagaatttgggttgaagtcaagaattttcatctcggtaggttcaccatctcttcattccataattttcgtcgaactccaccaatcgttctcgagtaattgagtagtcgtccaatcgttctcgagtaatcgagtaattgtagaatctgcgacaaagccctgaaatatgactttcttgaaatcaatactcataacagattgttagatacaaatagatctccgagcgaacgctcaagggtaacactgtaacatacccaaattctagaccttaaaaatttcctatcaaaatagttggaagctaacttttccatttttgagagctaaaaatttccatttttaacctaagtgtggtcaatctaacttgaacctaagtacaatttgagaataaattaaaactttttcatttataacctaggacataaatgcaaacacgagtaaaagcatgcatacttgcataaaacatgttttgacttgtccatcatgtgcatttgaattttttatttgcatttcataataggtctcatgaatattaactaagatctagataaacaactaaaccattagggcctagtgttagctagaggaagttaaaattgtaggatcgaacacaagaaaccaagcctacaagagggggggtgaatggtagggaaaaccaaaaacccaaaaacttttaacggaaataaaagttaccctcgaatcgatggaaatctcgacgtaatcctgtcgccgccgccggtcggaccgctcgcacgccgccagtcgaaccgcttgcacgccgccggtcgaaccgctgtcttgtcgcctgttgaaccgttggtatgtcactggtagaccgccgaacccgatgaaacacaaatcgaagaactctcaaagtagatgacaactttattacttctctctgtgtttacaaagtgcaacaacagcacttcttacaaaaatctcgactaaactcgaaaccctaagtaaactatcaactccacgctctgaaaagcgataccgaaaagcgataccaggaatcctcacgctccccctctatttatacatgaaaaaccctcctaatcaaagtagacgtaggactcctattcacagtaggactcaatctctcaatttcctttttctccgaaaccacagccgcaccggccatggaaaatcctgctccggatcggattcctttaccgatccttcgccagctcgcactcggtctcctcgcgccgcacggcctgggccggctccaacaagccacagccaccgagccgctctcctgctgctcggccaaccaatcatgcacacatacatgcttcacatgcatgtatcgatcacacacatacatgtacagcaccgtacatgcatgcatacctgcacgtataccacacatatatgcatgctgtacacaagcacgcatacacatatgcacgctacagtacaccaccgtactgtagcaccatacataaacctcttccaattcccttcgcgaacaccgacacttgcacgcacatctcgtgaagcccgttgcgaagatctctcccacacggtgtccatccaccgtatgccatctcgtatccaacttcatcacccggtatccttgaccgtctggacctcaactcctccctgagtctcgtccagatccccaccgttgaccgaagttgacctccaagaatccagactctagtcaccttctcacgtggtatcccgaccgcaatagacctctgttcctccctgaacatagtctcagtcctcaccattgaccaaggctgacctccagtcacctgcacacaatcagacgaaacaaccgtttctgggcacagatatcacaacctgacccacattagtcacacgcattcacaccaacattcacacaaactctcaaaccaattctttaactaaatcatttgcatagccaattgttcatcacaactattaatcatgacaatgatttcacaatctcccccttgatgaacacattggcaacatcaccaaaatgcaaatttgtgtttttgaaaaataaaaacaaaaatcacaaaagtgaaaaagaaaaactctccccctttttaaaagaaagaatttctcccatcaatttgcgatcaaagcacaaaattgactatttttaaaatcgaaacaattcaattctcccccttacaagaagcatgcattttgtatatttctcctcctttgacaatgatttcatcaagaattcaaaagagaaataataacaataaagcacaaatgcaattatgtcatgattgccacttggaataaccattttttattttatattttctcttttttttcgagagctttgaaatgtaccaaaagcaattcaagatcatgttttgcaagatatgggagataaattcatcaactagttagtaagcatgcaccatagtataaacatgaatcaaagatattacaattaagcttaaatcagcaataatgattcatgatttcaaatgatttataatgcaatatattcacaagcacatagattgaaaaataaacactatacatatatacctattgcatttatcactctttctcaaattagctttagcacaaagcaaccaagagaatttttactttttcttgagcctttttgctcataattttctcttttattccgggtacgtccctgtcgtcaagactgtttccagggattcggcacccattattttgctcacatcgaatacgtccttgtcgtcaagactgtttccaaggattcggtattcattgttttcatattttttattctcttttcacaatgagcatttaaagctatttgagtaataacaattcaataatgcatatatataaagcatttataaatcaaaccatatgctagcatcaatattgcatattttcgtaattcaagtaaaagatttagtgtcatgcatcatctcacttaaaagcaatatctaagcttcatataaagattaaaatgcatacaagctaacatagcaacaaatagacctcaattattttgctagcatgcacaagaatatactagaggtataaaacaaagctcttctttttcttatttttattaattttcagaattagagcaaatgcataaaaataaacatgaatgcatgaaaaagcacaaactccccctcaaattaacctccaattctccccgaagaaaaatcaagaagaaattaaagatttcgagaaagacatccaattgccaatgatatcaccaaggttatcatgaatcgacatatatccacttgtattaagaaaaactactacctcaaacactagcatatgaaaagctaataatcgagagagtagaaccaaaaaatatgtcaatccaaaagtaaattgatgttaccatgaaaagcaatctcaacgttgaatgcacatggggagtatgccaccaaaatacctacgaacgaagatgtcgaggcctccgtgttggggttagaaataagaaattttggaatccaacactgagtcacacgaccactagaaccagtaggtacatatgcactatatgcactaacaaaatcagaaccagacttacctgaaaacttaccttgtcgcttcacaaaagtccgatttgaattacgtgcaaaattgccccggggccggtctgaccgccgctgtccctgcggtctaaccgggcctggcagccggtttagctgcggtctaaccgtgctccttgaacaaaaacccgatttttgccaccgttgtttcgcaaaagcaatttctctttcctttttctgtttgcgggcaagtcaaaaacaaaaaccaaccaaatgtccatctttttcacaaaaagagcaagtatacttctcacgacaagtttgtgaagtagatgattttgaaattgatggttttgcatcaacagaaggttttgcattcacaccatttgatttcgaagaagatgcattcaaagaagacatgatgccaacagatttaaacacagtgttcttaggctcagtttcaatcaaaatttcacctctcctagaagcacccaaaacagtaggaggatgtctagtatgatgagcataagaatcaaaacctaaaccacgattgtgtgtgctaattttagattgatcaagaatcatgttgagagtctttttaccatcggaaaatctttgcaaagaacttttcaaataagaaacctcctgagtaagaatagcacaatttttgcaagcatccaaaagatctttttattttctacaagttgaacaagaaaacacctcatcttgtttaacaatttcttccatgtgtttaacacgctctaaagcatctttcaacttcaactcattcaaaacacactttgaacaatcttgagaaatcaaaacaccattgttttgtgttgccttatttacacatgaagcattgactaaagaacttgcacaaaaagcaactttgtattttttcaaaacattctttgtcaaaatcaactcatcaacaacacgagcatgtaaagcaaatccaagagcaaaagaagactccaactttttagatttttcaatctcaaattccaatttcttgcaattaacagaattgacatctcgcaaagcattaatttcagaaaataaaacttcacaagattgacaattatcatcattatgaatcaaagattttaatctagcaatttcagcatttagaatatcaatagtgtgatccttctcatcaagctcaatagaacatgtttgaagtttcttagcaaacttataagcagcatattctaattgatcataactaagcttttcttcattatcatcatcagattcatcaacatcagaacttgcattacgagcaataaaagctagatcaacaacttgcttacctttgccctcatcttcatcttcagatccatcaataacttttatgagttcctgaactaaccactgcatacaatgcttcttcttctccttctccttcatgttcttcttcttgttcacgtcatcctctttgactcttccatcatcttccttctttcctctcccaagcttaggacaatgcgaacgaagatgatcaagtgctccacactcaaaacaacgattcagttctcctcttttcctgttcctaacatttttcatagctcgagaaaatctgttagatagcaaaaccaaatcctcctcctcgaactgttcgagttgatcatcggatatggcattaaataaagcaagaacagaaggcttcgatgaagaagcaccaacatccaaaaaagttgaagacgaaaccaaagcactagacttagaatcacctttacgagaaagaatattcatctcatgagttttcagttttgtgtaaagcgaatccaaagtcaaagaagacatgttcacagactcctgaatagatgtaactttcatctcccaaatagacatatcgagaccattcaaaaagtgacgagaaatctcagattgtggataatttgcatcataagaagaatcaacagatctaagatcactaaaaattttattaaaccgagaaagataatcatccaaagcttcttcaggtttcatctcaaatttaatatattttgaaaagatcacgatgaagttctttaatgttatttgttccctgatgaaaattactcaaagcaatccaaatctcatgagcagtttgaagatgagcaacatgatcataatcagaacgagaaataccactcaaaagaattttgcgagctttgcaattttgttcaaaagcagttttttcagcagcagtattaatagtttcaggaatcacataagcatgagaaacttttctccaaatatcataatcttcagccataatgtaagattgcatcctactataccaatgagaaaaatccgttccatcgaaaacatgaggcttagttgaaaacctagcgggagtagccatggcaaaaactctagatcggttaaaatccaaagaagaaaacaaggctctgataccacttttaggatcgaacacaagaaaccaagcctacaagaggggggtgaatggtagggaaaacaaaaaacccaaaaacctttaacggaaataaaagttaccctcaaatcgatggaaatctcgacgtaatcctgtcgccgccgccggtcggaccgctcgcacgccgccagtcgaaccgcttgcacgccgccggtcgaaccgctgtcttgtcgcctgttgaaccgttggtatgtcactggtagaccgccgaacccgatgaaacacaaatcgaagaactctcaaagtagatgacaactttattgcttatctctgtgtttacaaagtgcaacaacagcactccttacaaaaatctcgactaaactcgaaaccctaactaaactatcaactccacgctctgaaaagcgataccgaaaagcgataccaggaatcctcacgctcccctctatttat

SEQ ID NO: 19984 - DNA, 24594 bp, Oryza sativa
catacatgcttcacatgcatgtatcgatcacacacatacatgtacagcaccgtacatgcatgcatacctgcacgtataccacacatatatgcatgctgtacacaagcacgcatacacatatgcacgctacagtacaccaccgtactgtagcaccatacataaacctcttccaattcccttcgcgaacaccgacgcttgcacgcacacctcgtgaagcccgttgcgaagatctctcccacacggtgtccatccaccgtatgccatttcgtatccaacttcgtcacccggtatccttgaccgtctggacctcaactcctccctgagtctcgtcccgatccccaccgttgaccgaagttgaccttcaagaatccagactctagtcaccttctcacgtggtatcccgaccgcaatagacctctgttcctccctgaacatagtcccggtcctcaccattgaccaaggctgatctcaagtcacctgcacacaatcagacaaaacaaccgtttctggacacagatatcacaacctgacccacattagtcacacgtactcacaccaacattcacacaaactctcaaaccaattctttaactaaatcatttgcatagccaattgttcatcacaaatattaatcatgataatgatttcacaaaaatagaaaccatacaccttgaaatatatcaacatggctaatgtcaagcctcacaaaactaatttggacatccatctgaagacatgtcatgaacatgaaagtgaacaaataaattatatcatatagggtatattctatcttaatcatctctataagcattctcttaatttaatgctaaagtaaatttatgcataaataggtaaggagcttatgacatgtgtaaggtaaattgtaattctaacatatcaatatcacctcaggttaataagagtccaaatataacttttataaacatttacatgcatttaggaaagggaaacacatataagacataagtcttgcgaattatctaaaataattcgtgcaagataaaatcatgagaaaattcatgtaggctctactcaacacatacaactcactgtaattttggtataatttaataactaaatttggtacctcaaataaatcagtcaaactaataaaaactagattacctgtagttcttaatcggctaaaaccatactttgtctaaaattgcatttaactgcataaaagtgtataagtaaaataatttattaaaatactaggtaatttatcatgaataaaaataatttttccagaatttatcttctctgtttaggtctcctaaaaattcgaaatattttccaaagaacccatattcctctaatttctgtgagtaatctatccataatttttgagtgcaactaaagaatacggaatctaggtatcttcatataccttcagaaaaatccacactaaattattctacccacaaattaaataattgaattactaaagtgggagagagaaataatcctgaaaatcattcaaacgttttcttcacccacgtttctgcccaaccctctcaccctagcttagtttgccacgacctggacccacttggcagccactctggctcgtcctcaccctgtgcaaatcttccagccgaccagagacagccgagagagagagattggtgccggctgtgtacgacgcgtagccacaacgtgtcgacgccatcaaactcctattctagccttctcctcctcccagctgcatctccacacatcattctccacctctaagccgaagaaaccgagggaggaggctctcaacttctccgtcgccctcatccttgccgccggccgcgaagaagacgactattgtactctactctcctcaccatgccgaggatttatccttttaatttcatcctctatcgtgcagcggatcgacgggaacgccgtcgtgcccccggcactccggagcgcgctccaagcgccgccgcagccgacatcgtcgtcgttccgaccactgtagaccaaaccaagccgagccgtcgcgccaacgtcttctccttgaagtcttcctcaaaaaccctcaaaaatcctaggcaatggcgcagcaagtgcggagatcggctaccgtcttcttcacctccggtcgccgtcgccattgtcgattccgcctcctccggtgagccattgtccgattcttcgcgtatacaccatccctgggacctcactaaccccatgaaaacacatgcatgtcaattcgatgagtggatcgagccgttgccgtcttcccggagctctacaccatcgccggaccatcttcttcaccgctgccgctgtccagactttcccgcgcctcgttcaaggttcggtgagcacccttgagcccataggattgcattcatgcatttcattcacttagaatcgagcaccaactcaacatgcagtagcagcctaagcacagccgccgctcggactcgccgccggcgtcactccgatgtccactgaccgagaaaagtagaggaatggaatcggaatagcatgatcttcattttgtcttttggtcgcaccctcaaacgagccaccgtttgccgctggcaagcttgagatcgagctcagccatggcttgatctgcttcagctcgaacgagggacctcctcacgagaatttagattaatatagggtcctttctgcaaaagctcaagacacacagaacagtcataggactgcggtttgatttcctgaaatcctaggggccttttcgcatattggcctgagaccgacaggtggaccccatgagtttaaaatctgaaaatgtaaaagataatactaaaagcctttactttttaacagcaaaacacctaaacttgtaaaatccatataaaatcaaatataacttattttgagatgattcaaatttctgtaggttcacaaaactatgaactttaatgtggtaacattaagcttggcaccctcagcacagaccttgtctctaaaatgggtctaagataaatcatacataaagcatacacaaacttataaaatgcatataaagtacatctcaactcattttggagcaaactcagtttctacagatccaccaacttatgttctcctataaagcaaaatgaaatagtatacatactatacatcaaatgcctctaaaactattacctttaaatgactagttttagatgagctgaattttagaagttcatataaaattcatcttagatcctttttgagtaaacccaagttctgtagaatcaccaaaacatatacttccaagttataaaataaaattatatacttactgtatgataaaagcctctaaatacttatgtaagtaataaccatcatagagcaaccttaaattgtaaaatttgtagaaaattcatctttagtctaaatgaagtgaaccaaatatctatagaaccagcaaacagtgggcttcaacatagtaaaataaaatatggaaccttctgtacaggttatagctctaaagtttaaatttataggataggtgctaatcacatagtatcgattgagcaatatgtatatatataaatgtatatagaaatacgctctagctataatgaaacccaaataaaacttgttagaccagtgaatgcatagttccatcctcatccaccaaaacttaaggcacttatcttatataataatttctaggttgatataataaattgctagcatggactagagctcccctagtttataaaatatgaaccatgataataaagaccttaagcctatgaactaaggttagattagttaactaaaatactcattttatacatcactagctagactagccaccaacccgtgcaacgcacggcgtaaatttgttaatacctttcataaatattttttcccatgctgaatatgtggtatttctttataatttcttgattccaaattttatttttgtaacctgctaattattaatttcagtattaaattaattacataatggatagccactatggatacaaagttcatgtttattagttcctatcagttacgaatttaggattactgaatttttgaaaaacaaaaaaaattaagtttaccaaaatgaaataaccccattgtatatttaatggtatgtttcctttaacacaaaattgttttcatatagtattgttaacattagtaataatcacattttaatcaagcttatcactcagttttgattacagaaagaatttcaaatttgattgctaaactatattgaaacaacgaatataaattaaaacatatgttgttcaactcaatttggacaaacaatgcagcaaattagtgttgtaagatggtacagaacctgtaatttaacttaaaatataacataaaggatcaaaatccaacaatttaaatatccttaattagacaccaaacactacaccgggattagctcgagtatacaaatcaagagtagttaggtgaaagccatatcgatcaatatttcacttagatgatgtcatacgttttagagcatatacggatttatcagagtatataaattgatagaatacttacctgaatattgtagatgaggggaccaaagtgcaactttccaagcacaagtgaaattaatgaaagcaaacttgttgatttgtagatcaacatcttaatacctaatatttacatactgtcatatggcaagcatgtaaagagaactgaattggaaaatataagttcaaatatttttttcatccagaaaatagcaaaacgaagctcaccagttgctgcattcatgctaccggccgcattcgtgtaccttgtctcatttttgctttcgaccaagatttgactacctgaatacttgtgttaaaaatgactcattcaacaggcaaaagatcaggaacataatttattatttcaatcaaaatagaaatacctgagttgattgtgtatgcaactaacacaacgaatcttcctagatgcaagcgaacttgtagatttttggatcaacatctcaacaccagaaattcatcggatcaaatgatggcatagttgatcagtcctgctcgatctagttcaggtgagaaataggtcaaaaaaaaaaaccatggattaaggagttcaaaccaaatcttgattgagagaaaaaaaaaagcacggggtaatggagtttagcatcgatctatctgactacagaaagcatcaatctactgcaacatcaccttgtttcataaaacctgtgtaataaattactgccgttgtttcctcaatattaattttacctatcatctatattaatttcactataatgaattgaggatcaacataaatattcggaaacaacaggaaagagccataatactctgaaacaacggcagtactcatctatattaatttcacttgtgcttggaaagtggcactttggtcccctcatctacaatattcaggtaagaattctatcgatttatatactctgactaatccatatatgctctaaaacgaagtagatggcttataaatttcttgatcgattaagagtctgaatatttcttttgatttgcctgctttaacctggagaaagaagcaccgaaataacctggttattttagcgcaaaactatacaaaacttgaatttaaacaacagacgaactaactttgttgtttcgcattccagccctgcagaatcgggcagagtcaacgtgaaaagacaacaacaacattgtttgattagcgcctcggccatggctgatgtctgtagattctgacggaaggttggttagagatttgtattacagcatctgatctactccctccgtttcacaatgtaagtcattctagcatttcccacatttatattggtgttaatgaatctagacatatatatctatttagattcattaatatcaatatgaatgtgaaaaatgctagaatgacttatattgtggaacggagggagtacaaaactatcgatacaatactgcattgggttgcaccttgatgtgcagagcattaccgtaccacatttgattgatttgaaggaaattacggaagtataaagaacatgtaaacagagcagataattacaggattagatcgatttgtagaccagataattacagcaaaaagatgaggaccagcagtacctatcagtgaaatcattgccgtataaccagcagcatgaacatgcatctcttgatggggctagggagtaagggcctagggcacaccatgaagaacgacaggatcatctgttttttcgctagggaatttggagataggatcggctggaggtgaaaatacggtgaacgcaacacacgttagatggtttttgaaaggtggcccacaatattaggtggaattggattaaaatctacgtacggatgtgatattgcaatctactaattaacggctagatctttttaattaatgtgggagctcgtagaaagtgcccgattagtataggtatagaggtatagatagatacatagatgatgagagggagaaattggaggccagctgggcctcctttcctggtgctcattcgtcctcccccttgtcaggcatctccgccggcggatctccgcgcatctgcctcttccactcaaggaaccaacccatccagcgccgtcgcagcctgcacgcctcccgccttccctagcacattaccaaagatacaataaactaacctaaaagcatagcatgcacgtatcatgaagcgagtcggatagacaaagaaatgagaaatcgaccgaccaattacgaattttgcaggtgactgcagaatagaaaaagggacgttttttttttcttctgctaccaggcaaccgactgggagttctctctgaacttgtacaagctaaacacggctctatctccccaatcccaatttttgtaccgcttccaactgcttcttcttccaatgcaagtcgtttctctgttcgcatttcccttgtcttctttgtatcaagaaacataacatcgtgtatcagagcaatcgatctagaggttttctggcaagccacgctatcattcaggagcacagatcatgacagacgaggaggagcaacaacttcatgcgcataacaagttgatccaggtcaagtggagtcacaggaggagatcaaggtggcggtgcgggacctctttcactggcaaccggagatggacaaagcggtagtatactgagttaaaaacagatagtttaagtgccatgcacgggcacacggctagctagcttgcccaaaaattctgagtttaatactgcgagcagagtaactagtgtatgcaacatatgctagaggtttggtagacagattagctgtggtttgaatgtggaaaaattgtgaagagggttaaaatttatggtttaattcctgttttatcaactttgaccgattcaatcgacgtatcaaatgagttgacaaaattggcaaaaatttagtttttttagaactaggaaggtagcctgcgcatatgcgtgggtacgtgcgtaaaattttattacgaatgtccatgtgtggatggttttctatcaaaaatattctttcactttatcataaactaaaattgaacttatttaatttgctttgaacgctggttacttgtaaaatataaattgtgaactaaaattactttaaaccgtgctgtttctaattcatgagaaaattttgtgtcgaaacaacatatgtgtgtcatatgaatgtccaaatttttttagattctgtttgaaattttaaacatatccatttcattagtcctgctaaaatgtttgaatatttctatttacaatgggtaataaacccaacaaaaataaattttaaattagataaattttgctcaattctcatttctttttatcttcatttttttggataaatccactttatgaagcatctttgaaatgctttgatctctgtaattcgggatgaaaatataagtcggttgatcctacaacctggcatgggtaaaggcataaattataaattatctcgcttcaattaagtaagaaaatttaaaatagatgtcaaagtattttcttagcaaattaccactatactggagcgtcgtgtaataattacacgtttctagactttctatgctatatgacacaaattcatgatgtactgtacaagttttaccaaaaaagtggatatagttttttaattccgctctggaattggcttatatattgctggggccacatcatggctatttcactcttaagattccttggtgcaaccaacgtggttagcacgatcagtatgttattcaactagccatgttatatatatataatttagattctataatcatcttaagattatttatttatctccaaaaatgatcatttattgataaaagcatcaatatcaaaatgtatgggtaaatagctcctatatacaagctgagacaacaaaagttgatagaaagtcgatagatgtctaacgggatataagtactgggtctagtagtttgaaaagaaattaagctgggatattttgatttttagtgagcaattttagtatttcttttatttagggtaaaatgtgctacgggacattataaaacgtgtaatttgccgggggacaccgcaagaacgcatatctgctgtgggacaccgaaaaactggtaattggctattggaggcctgcgttattattttataatatccaatggaaatgaagagagaaacaataagaaaaatatgacttttcgcctgcctacaagtctggctcacatacaactttgacgctgcaaccggacccatcaccggtgaggtggctctctagagggggcggggggtttcgaggagggcccgtgcgcctgggcttgtggctcgctgtcgttcccacactcgtcgccgctgtagcgcgaggaccatgcaggcaccgatgctctgccacacaccgcgctcagggtgagcacaacatggaccacctcctgattcatgtcgagcaaggcgccacagagcgcaggctattgttgtcagtctcgcagccgtgccacggcacgctgccataccctcaactatccatacccacatggaaggaaggagcaaaatcatactttcgcggttgtttctctcttcatttcatttggatataacaaagtaatgccacgggtatccaacagctaattaccagttttttatggtgtcccatatcagatatatgttattgcagtgtctcttagctaattatacttttttttatgttctgtagcaaattttaccttatttgagtagatgcttcaatggatggggtccataatgtaatttttttcttagcacttaaatatagtcaatatgggcattaagttattgtttttacttataaaaataatagctggctagacctactaggtcgagatttgtttgtggtcttttctttgcccataaaaataattttaattttaattatcatagagatagaaaaaaaacagagaaaaataacgcaacacaccgcacgggaacggggatggacggttgggatgtttcttttttttagaaaaaaaattgattgatctgatgacttaaaataatgtgttgatatttaagtaaaaaaccgatggttggatgttatatttttttcacagatttattaggattttttctaattcaaatgagacaagtagcagcttagcaaaacgcccatagggatggagagtaagggaagatggtttacaatgtttttgtattaaaaaaactagatacaatatcgatgtaaagtaatgtgtaagtcgatttaagtggaaaccaatggagagatgtttctctaatttaagaatctcatcgaacgatttggaaatatttataagatatttaatgaactttaacacctatttttgagatcattttccataaatataatgttatttttaatcgtgatagggataaaaaaaaacataaaggaactagaagccttcaaattgatcagtacttgcgtggtgcacagtatggagacgtgggaggttttggtttcctaatatagatctaacaatctagaataataggtctaccgatttaaatgataatcgacggttagatttctctattttattagggtgccacgtggtgacttgagaatatttatagggtgccacgtgacggtttgggagtgtacgtttgtaggatgcttaatagacttttagtatatactacctccatattttaatgtatgacgccgttaactttttgtcccatgtttgaccattcgtcttattcaaaaaattaatataattatcatttattttattgtgacttgattcatcatcaaatgttctttaagcatgacataaatattttcatatttgcataaaaattttgaataaaacgaatggtcaaacgttctgaaaaatcaacggcgtcatacattaaaatacggagggagtaatagataaatagatcaatggtaatacgtacatttggtttttttttttgctatatataaaattatgttttatatttttcttccgattatactatgtatgttttttttacttatcacacagccatttttgtccttccgatttttctttttcttccagcgaacggacagaacgtaagctttatttttttttccgaaatatacgtactgtacatatttacgatttttgtttgccgacatacttatgatttttatttgctgatggtacgtattttcctttttatactgggaaggtatatatatatacacctaattattgtaaactaatgggtccaccaatttaaataaaaatcaaatataaatgaaaatcaaatatagatatagatataaactaatggtctaaaattacatgtccaccaattaaataaaaatcgatggtgagattagatagtgccacgtggtggcataggagtgttcgtagagtgccacatggcaccttgagagcgtttaggagtgtttaatgaatctgccacgtgccacgtgttcatagatgtcgaattttttgatccacatataagttgtatgaattattctaaggccaattttataatgcacgtcagatgcaactatatatgccatgcaagaaaatccagcaacataacaaaaaaaaaattagcacgcaaaggggaacaattatattgctgagaacagatggtttgacgtttacacgttttgggaatgttacagtaatatcctttaagattgaatatagagagaatatataacactaacaatagatattatcattgcccgacaggtacaactttttttccttttgtttttgttttgtatatgtgttcaaccattagccacacaatagtaataaactcaccaccagtgttgagcttcttggcatgagactccctgttacacctgttggcagcatagaggagaaaagctgtccacaggttaagcagcacggtcactgtatctggctccatcgattgattatctccacctttccagtttattatttccctggcaaccaaccctgcataagtaaggcgaggaattgcggtgtcaaaattgctgggcaggctcttgtaaaggattttagcgagtgcgttcgtctgcctgagcccaatagatgttgagctattattatggccaccgaacagcttcatgagcaccataaagatcacattattagcctttccaccagaagaaatgagttcatcacgatgctctttgcattttttatcaaggttctcacaggtccgctggtacaaccatttttggggaaggccggcaagcatgtctgggtgagccacaaggagaacatcaaatagttggacagtgccctgatcaagccgacacgctggacttcttctgcatcgtcttcgctggacttcttttctctcatagcgaggatgaggtctgtggcaatgtgccagatgatgatgctctcgtggaagtcgacacccccagatgatgatgctctcgtggaagtcgacaccccacagttccttcagttctttattttcttcaacacgtttcttcagttcaggatacttttccatgccagttcatcccaattatacctgagcaagcccatggtgttgagatcaaaatcggagaccattctcaatgctgtgtccttcaccagctcgggaattgtgatgtcccacgaataacaaccggtgtcccccttgtcgccataccccagcttcttaaagagcctaccgagttgcttgttggttgggttcagctgtgtggtacggaagtagagcaaattgaactatcctatggtgcccgaccagtttcttgatccaccgagaaggcctcccgtcaaggctgcgacgcgcttgcgaacagccaggaccgcccgtcggagctggtgccatcttccaacgcatagagcgatatgttgaagccaactccacctcctggcgcacaagaaggaaagagtccagcttgaccccagagcgctgaggagggacgttgtttccatcaagaaggcgccacctaacaggacataggtaacggcggtgtcgactccattctggccatccttggcctcactgccgctgaaatagaacagcagaaacgaggtggcgatagcaatgggtgacaaggctcggatgcagtagccaatccaagtgtggactacagctgccttggtatagagaatatcgtacatcagggacagttccatctccattaccttatacatccgctggggctttttactgagattattgattatttccttggtggtttccgcctcagccttctcatggtggtttccgcctcagccttctcagtatcctctgggatcacggagtctactatcccacgcttacatatgtgaaacagggagtgagcacgctgcagaaggaattcatcattagtgttgttacgatcctcattgtgcaggtacccttagtaccaatggagttggttacccggtaactcctcgagagagctcccgatgctactaaatttgctgcgattgagcgcccatgtcctctcacaatactggacccactacaagaggtatgtggttttttttacattttattatgtcataatatatgaaaattatgtcaaaaattaagatttgtgacaaacagatgacgtaatttcaaacgtcaaaaagccaccgtcataaattcatcatgtgacgtttgaacattcattgtcacaagcatatgacattgatttattgtcacaaaatcctagggcttgccacgtggcagctgacatggttcaaaaaaaaacgtcacagaatcagattcggcctgctaaagcccatgtagctcatgagccacaaatatattttttctaaggttgttgctagctggccgaacatattttttgcttgttcgtttgagtgcagcctatacaaattttcagcccacatcaattcggcccatatgatttttccaacccgcacaattcagcccatatgatttttttagcccccacagtttagcccatataattttttcagcccacaaaactcaactgaaattttttcagcccatacaattcagcccaaatacaatatttcagcacatataaaatcaaattcaaatgaattaacattccacaaatgattgcaatatcacatgcatttcacattccacaagtcttaaaatgcaatatcattacatccatccaccaattcaatacatatccaaagtctcaaatttcatcttcctgctacagcgagagcaacagcagcacatctgcaatagcatcacagcagcagcagcgcaatggccaaaagcacaacagcaacagcacaacgaccagaagcacaacaacaacaacaaaataacatcccacaagcacaatggtcgcaagttcagtgtcaccttatgttcatatgtattgctgcttcagcccgttcatctgccgcatggcaacgcgcccgacggcaacatccctaaggaggcttttcaccttcttttacaaatggttttacacacaacctcaaggttatgggctaaccatcccatcacccattgacacgtactctctttgtccaaaaaaaaatcccaatcatgagtttgaatctggacatggatttggttctttttatgataggggaagtaagtaaagagtaaggaaggaacaatcacaacatgaaattcaaagccccggtagtaacctaatatgatatatcgaaagcgcaccaccaaaacaaaactcctacttacaaaattactcatgaacaatgtgtttttgcttctttttttccttatcatagtatcagttggcctaagaaacgataatttagacatcaataaattatccgatagaccatagcatatactccctcgatatttcaaattaaagcaacttacttgcctacagttatcaaatacatcagcactccatcacctaacctaacagatgctcagcaccattagacctaacaacttgtctagaatacatatgcatgcttaaaaatcatctaactactcacacagtttggttggttcgccgaatgatgtcttcctatctgcatgtcttgctctcttgttcatactcctccttccttgactgatgcatgtatccattcctcctgtcagaaaggaaaaaaaacaatcataacacaggccatgtgttaattttccttttttcaatgggcttgtcaactcgaagcttaattcctacaagcagctgatcatcttttaaatcctagtcaaatcaacaaaagaatcataagcccagcgagggaacaatagaaaccatgaaagggtgtttagtctcaccgctcaccaatttggtaggaaatattgctaaagttctaagaataagttgccctaaatcctaacaacatcttattgcatcaaaattgctggtataatgactctgtttagcaagtttgggccttctttcaaaaatctgggtattaaatctgcctgcattctgaaacaaaaacatgctggcataatacaggttaagattagtcagaacctgcagccccccctcccccaccggttgtggatcttggagttgcacgtgttgccgagattcctgagcaggtcggctcgcacgcagaagacgttgtccccgagcgaaccctcctggcaacggtgcctgagttcccgaagcttcttgcgcatgagctccttaacgtagaggttggcgttgatggggtcccgcggtccagcatccgcgcggcgtgcgcctcgtagatgagagtgacgcgcatcatgttccgccagaacttgagccagtatgcagactacacctgcggacggacccccacgcgcctccagaaaccccgaagcaggagcccgccggcacaaacggcgtggcagcgagctccgtcgtcgagccgcccggggactgccgccgcgcgatctagccgccctaggcccgggagcgctgtcggccgcagatccaccactcccgagcctggcgccggcggagacggaggcgacgcagtaagcggtgagggaggagtaagccggcaccacgagcggcgatggaggaggaggacgccgccgcacgctttcatcgccgatacccgccgccggagaggagaggagaggagaggggaatggatgggagaagtgtggcggctgagggtggagagatagagagagagagaggaggggtggagaggagggttttatatggggctagggttaggcacggcgatcagaaccattagatcgtagatggccggtcagaaatagttgggccatttgggccaaaacaggaatgatcttatggtatttttttaatttcaatttatgagaactttaaatgtaattttaggctgattcttttgtttcaaatgcaaaaatcataaataacaaaattgtagaactaatcgagaactgtgactattgtattggttctttttacaaataagttcatttgaacaattcaaattttgaattttcaaaatttgacaacttcgaataaaaattggggttaataaatgatttcaaatggaaaagtcaccaaaaccaaagttgtagaactcatcgaggcgaaaaagttttattttggtcatttctccatatgactctatttgaactatttgaaatttgaaattcaaagtatgagaacttcaaatagaatttttttattagtgaacgacttcaactgaaaaagtcataacaacaaagttgtataatccatctggatctacaatttttattttggtcatttgttcatccgacaaagtgacagtaggattgttcacaaaatttacatatctcttctatggttttataaactataagagagatttgtaaattttatgaacaatgttactatcactttgccaaataaaagatatgaccaaaataaaagttatagatattcatgagttatacaactttgttgttgatgactttttcagttgaaatcatttagtatttgaaaatgttatttgaagttgtcataatttgaaattcaaattcaaattattgaaacaaagtcatatagcaaaatgaccaaaacaaaagttgtagatcttgataagatatacaactttgttgttgacaatttttttcatttgaaatcatttaccacaaaaaaaatatttgaatttcttatattttaaaattcaaattttatataggtcaatcaaactcaaatggagaaataaccaaaataaaattggtagatttaaataagttatacaactttgtttttcaaaattttttcacataagtttatttagtatgataaaattcgattaaaagttttaatattttgaaattaattgagaggagggaggcaaaatagacttctcgactcgctaggagtgcgctgtgggctaagtgggaaggttggaggcctgccagattagtttctttagaagatataaacgtgatatataaaataatatgcaaaatctaacaaaacattatctgtggcttagtggttggcccaatgaaaaaaaaactgatgtggcagtaaggcttgtctacatgaacaaaaatatttaaaataatataataaataatttgtgacacacgggttggcccaatgaaaaaaaaaactgtggcagtaaggcttgtctacatgaacaaaaatatttaaaataatataataaataatttgtgacacataaataggtcttatgacatagtaaatattgtcattggatgacattagactaactatatgacatttattgtgacacacaattttttattgtcattaagttgacgtgcttgaaataaaatgtcataaattagatgatatagtgatattataatctgtgtcatattaaatacgttaaaaagccacacatatcttgtagtgaccaagcccacagcgaagatcaatccagtggccactctaaggattgtggcctccctacgaacgataatatgtttgtagaccacatacacagctccgattacctggaaaacaagattcagtgcgtggcgcaaccagagtttgttgtcctctagtgcataggccgtgatgttgtctgggccaccgaggtgcagcaacaagaatggtgcccaaaatgctgccagacggtgctcatcaactgccacgctgccgaaggagaggttcctaagggcgtatattgccgtcgagtcggccagctggtaagctatccactggatgatctttggtgagtactttacgccggcgagtaccagccaggaggaggaggatgacctgcagcgcgaggctgaggagtacaaggatttgtatcccccatttgttccaaaaatccactagagacatcgtcacgccccttatgacgagttctctgttgtgaattttgagcttaggccaaccgagggcaggtcgcctcgcgtatatatgctggttgctgcggttgttagtgcaccaaccaatcgatcaatatatgcgtatatatgtctgtctatatatatgtagattgtagaattgttagacagtcccgagaaacattcatgttagtccagaaatagtgaacaaatctatacatcgttctaggcataggatccattataacggatttcattaaatccacgtacgtagttatccttcttagaattaaatttaaaaatgtactgttcattttttcttagaaatattcgggttgtaattcttttgacacaaatatactgtcatcgctatatgggagtgcgacatcgatacgacacgctgaaccattgtgtgagaatgacgatgtgggcggtctcgcggggtgggaacgtgacaccgcacggtctcacacaaccacaacgccggtctgagccgagaccatgcggtctcgcatgcaaaaaagccacagcgctttgaaaaatagttaattagtgattaattatcctaattaatgttaattggttattaataatgctaattaaaataatattaattaattaatttctaattatgctagttaatttattaatcacatgagtatggatgggaagtcggtctcgcaccctcgctctgcgagaccgtagcgactcttgcgatctctccggaccgccctgcgacagtggtataattctacaaatttctcctgtgcatgtatatttacgtaaaaccaatgaaaaaagatatatttgtaggatcgaaacactagaactaagccaaccagagaggggtgaatggttggtatgcctaaaaaccgaattttttagcggaaataaaagttatcctcaaatttgacggatcgtggtctaaccgaaagtgttgcaccggtctgaccgcctgaaagccgtcggtctgaccggttagatcgatcggtccgtccgccctgagatcgcctctgctccctgtcgctgtcgccggttagaccgccgaaacccggtgaaacacaaatcgaagaactcttaaagtggatgacgactttataaattttctctatgtttacaaagtgcaccaacagcactccttacaaaaatctcgactaaactcgaaaccctaactcaactatcaactcaattgctctcaaaagcgataccgggaagcctcacgctccccctctatttatacctgaggtagacaacctaaagtgatccgtagaaccacattcaaagcaacgatttggtccacctcttttcctgtacctaacattagtcacagctcgagaaagtcagttagataacaaaaccaagtcctcctcctcgaactgtttgagttgatcatcggcattaaacaaagcaaatgcggaagactttgatgaagaagaaccaacatccaaagaagttgaggaagaaatcaaagcactcgacttagaatcaactttacgaaaaagaatattcatctcatgtgttttcagttttgtgtaaagcgaatccaaagtcaaagtagacatatcaacggactcctgaatagatgtaactttcatctcccaaatagacatgtcaagaccattcaaaaagtggcgagaaatctcagattgtgtataattaatatcataagaagaatcaacagatctaagatcactcaaaaatttgttaaacctagaaagatagtcatccaaagcttctccaggtttcatctcaaatttaatgtactcttttttgaaaagatctcgacgaagttctttaatgttgttagttccttcatgaaaattactcaaagcaatccaaatctcatgggaagtttgaagatgagagacacgatcataatacaaacgagaaatcccactcaaaagaatattgcgagctttgcaattttgttcaaattcaatttttaaagcatcaatattaatttgttcaggaatcacataaggatgagaaacttttcttcaaatatcataaaactcagccataatgtaagattgcatcctactacaccaatgagaaaaatcagttccatcgaaaacatgaggcttagttgaaaacctaacagccatggcaaaaactcgtagatcggttaaaatccaaagaagaaaacaaggctctgataccacttataggatcgaaacactagaactaagtcaaccacaggggggtgaatggttggtatgccaaaaaacaaaaacttttagcggaaataaaacttaccctcaaattcgacggatcgtggtctgactgaaagtgttgcgccggtctgaccgcctggaagccgtcggtctgactggttagatcgatcggtccgaccaccctgagatcgcctctgctccctatcgttgtcgccggtctgaccgtcacgagcctgctggtctgaccgccggtgtgtcgccgattagaccgccgaaacccggtgaaacacaaatcgaagaactcttaaagtggatgacgactttattgattctctctgtgtttacaaagtgcaccaacaaaactccttacaataatctcaactaaactcgaaaccctaactcaactatcaactcaattgctctcagaagcgatatcgggaagcctcacgctccccctctatttatacccgaggtagacagcctaaagccacgaaccaaactcatactagaagtcctaatcaccctaggaaacctcttagtacaagaaacaaactttacataaccaatcataccaaatttggactgcttccaaattcaactccgtatcccatacgcacacaataactccatcatatgccatatggaaccttcaccttccatgtgcactgaactctaaccatagtatcccgcatgatctctgaccaccacggacgtcgcttattcccaagccgactcccggtccatcaccgcaaatactctcacggcatctcgagtcacctacacatagaataaacaaagaaaccatattccgagaccaagctatccccaacttgactcattagtagcaaacgacagtattacatatgcatagtatccatctagaagtcagaatcatgaaacaatcacggatatccaaacaaacaagccgaaaccgaaaccgacacagagtcggccggttagcagtacctgtaaatcacctgtgaaatccaatcatctccaaaaccacttcgtaaataaattccaaatatcaaaaccaataatcttcaatgccaattgttcatcacagaataataataaaaaacacatttgattttacaatattttcattttttaaatatcttacattgtcaatagggcaaggactatctagcactttgcgagttacttaaactaaacgacgtgcatcacacccttccaccatcccacaacactagcatcccaaggtcatgtttcccattcccatcctcttcgcacttctcccattgtaactctcttcaactattgtgtttatatcttatactatgtatctgaccaactctttctgccaaaaccactccagtaatttttggatcttgctgcactggatagaaactgaccgagggaagaggccgttcattttcccttcagcttcccctttacctgcgataagcataggaggagcaaatggtgaggaagaaaccatgacgtggaagggagcgtgccagagaagaaggttgcctacaccgctcagagaccggagacttccattgacctcacctttgctggttttgtctaccccgcacatacctggcttcaaatctgccacctccatagagcaaaccaatcttttccaaattggagctctcaacattgttgggacaacttgggaggagcatccttaatggcaaccccattctccctctccgcctgattaggttgagggcatttgcctccacatcaagctatccctcctcaacccatcaacgatgaagacctatcctcgtctcctccgctgtggccaccaccgccttgtgccgacaactgcacagtcccaggcatgcttaggctgccttcttccactgaaggatggatcagtcccaacactaatcccccgatgtcattgagatttctgcacatggacgtttccccaatggcaatgtgacgccggcgacctcgttcgctgccccatgacttgagctaccgatctcatccacaatgccattagttcaaagggcggtgataaggactagattatgattgcaaatccagacctagcgacgcaatgatggctagccgacagcagcagatctaactagcaaagtttgcacccggaggcaggaaaggtaattggtggcggtggtgccatagccttcgagcggagagtaggagaaatgccattaccataactctccaatcgctcctctctattgggtttagttccatggagctaaaagtcaaggcctaggtcgcatgggctatgatacaacaaaagagattgttgggcctagattgaaataagtcttcgaggccacatgggttgatgtgacggaggagattgttagggctgctggtgatggaggagattgttaatttcagtcttaaattggtaaaaccgacgatacgagagcacaactcaaaatatgagggcagtctgcacctatcatctactcatttgggttgtgtaggttcactacactggtcaaggtcacctgtgacgggcccaaaccctcatctttgacggcttcgcgcatggtcagtgatcagtggtcactggtgagtccagtcacctttgacgggtggccggccatcacaggtgacacccacctctgacgggcaagttactagaaggccgtcagaggtgttggtctccgctagcctagggcgagttaggacccgtcacaggtgactcatctctgacggccctttaaataaaggtcgtcagacgttgaggtcttcgtagttagaagctgtcacaggtgatctacctgtgacggccccaaaagtaaaggcccgtcacaggtaggtcacctctgacgggcctttatttgctagtccatcacaggttaggttacctttgacggatttttgttccgacccgtcactgatgagttaattccagaaaaaaataaatgctaaatattggctagcctcaggatttgctagccatgccctctgaaacacagatacatcacagatatattccagtcacagatccatcacagatacatcacccccccgatataacatcacagatccatctcaaacatcacagatccccaacaacacatatatgcagttcaaatgccacaattttgcacggcaaattcacaccccttgaaagccacaatttcggtcgttgctcatagaaccgcatatatacttaccaaatggattaaagccataatgtattcgacctccacaacctgtcaataaggaaaaaaaaggagaaaacagatgaatagtacaacgtaaatcgtagttgatcaaatgtgatgacaatttagtaaactaccataaatattgcacatatgaaagtaaattacattgcactccataaaaacataattttttacatcgcaagatattataaaaacatcttttttacatcacaatgaattatctagccaagttcatgagtctatttgacatgaaaacattctttcttgtccattatttctgcaagaatgaaggcgcacacttcgcctctaatagcggggggttgatgggtgagatcttgaagccagctctacctttctgtttaataaataagaggttaattagcacgttttgaatagcaatgtaggtattgaaatgagcttattcgccattagcaacaacctcagggtcgaaatctttcacctctcttagaagtgttgacatgttgtggcacacgtggaaaccacattggtctccgatctgttgtgcgcatgcaaacttggtgtcatgataaagttcgtccttgccctccttgtgcctaccacccttttccacatatgggccccaagccatatttaaggccttggtgatttcactgaaatcataatctttggacttattggagttaaggtaggtaaccctactccacttaggtacgatgactaggagaatccaatgtcgcctgcgcagtggttatgtagcgttagtactaagaaccttaacttcaaaaacaatatacacgaagggtattgtcctcttactcttggttgtgtgcgcacatgatgtactccttgtcttgatgggcccataaacaccggttgacatagtcaaccacctcagtgaagctctgtcgtaaattaacctcattcaccatggatggatcaaggaacccaacctgattaccaaggcgacgactctcgatccaacacaaccttaaaacatttacgtattagaactaatttaattaggagatatagtccaatcatatcacaagtatagaaggtatgcacttacaaggagtagcattttagaagaccagtgtccaacttctggatcctaaaaaggtcgaagaggtcatcaaagcctatagttatataggcaggcgacgataggaacggctggtggtcgtgatgtccaactatggatgactccctcattttccgcttggcattgcttagctccatgtattgcttatgtagctctcggcaagcaatacccatcacagctaacacattgtcctccaccaatagcatgcctagctcaaattgggctggcgccctcccgaccttccccgctttgctcaccggcatcgatgtcgcagccttgcccctttttggctccagcgccaactccccgaccttccccttgccagctcaaattgagatggcggtggagatggacggtggcagtcgagagagtggcggcgagaagggcggtggagaggtcaggcggcggtggagagggcggcggcgagcagggcggtggagaggttgaggcggcggtggggagggcggcggatctggatcgagagagagagagaggcgaggcggcggtcgagagagtgagtgagtgagagtgggtgccggatctggatcgatctagaagatgttcaaccctaggtcagcactagtcaaactcacctgtgac

SEQ ID NO: 19985 - DNA, 3203 bp, Oryza sativa
ccgtcacaggtgagtttgcctacagcaattttattttattttatttcacttagttcttttaatttccttaacatatttccacatacactacatatttttgttatacttaattattttatttcactaacagtagtaattgcacttcattattatactaattttattattttatttccaatggttatacttgcttagttattttatttcacttctagtgggtgcttcacttaattattttatttgactatttcataagcaatatactattgatcattgcgaacatattagagtcatacagataacagacatgtagacataaactacatacataaattacaaaaataatccttgctcatggtcgacacgtgcatattgaacttcatcttcttcttcctcctcttctagaggtatttcttgacctatgccgtggacgtgctggttgtaatcatcctcgtctgcaatattgtccaatccaacaattctccttttcccttcacgaacaacatgtagtttcttgttacacgggtcaactatgtagaacacttgaacaacttgtttggcgagaacaaacagttcatccttgtacgcgttgttagccaagttgacagtggtgaaaccttctgtcacgaccggaaataacccaacgggcgttccttacgtgcgtgtattattccttgtcccaggaggcaaggtacaccaaaagttgatacaagtcagagtctaacaagcggaagcgtaaatagttaatttattacatgggcagcgaaggcccagcacacacagagacaaacgagaaacagcgaaagactagggcgacgaccacaggcgcttgacggcaggcacgagctagacaccaaagccttcatcttctaggggctcctcttctggggttaggaaaaattgagcaagactgagtacaaccaccgtactcaacaagacacacccacaagtgcagaataaatgcaagggagtacaaaggagttatactataaagggttagggtttgcagtaaacagcaattaaaggtacttagttgctcaaagctattttgtaaacacgattctagaactataccatattatttaacaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacattttcctcacgtgtagccacgtgccacataccaccacggtatacagaaggaagacatgacatagtttccaacccatcctagccatagacaagagtaccgacccaatcccacctacggccggaacccccgggacaggcaggcaggactgagcccctagcagcaggacaccggccctgtgccatgacatctcgactaccgggccgcagctcgtgtagccttcatttgtcctagagatgtccatcgacccctgacttcttccatctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggcggtgtgaagccaattccacaataaccaaaccattccatagtgtccaggtgatatgaatattcccaacgtctagagttgaaaaaccacctaatgttacctaattaaaacgcgaagcatctacctaaaatcatactagtgataccatgagtagagtgtccactagttggggttttgtttattctagggtgaacaaggtaataataacaataacaataataataaggtcataacaaaggtaaataggcatggctagataaaacagtgataacgcgggaatttaaataaagcgataatgcaataatttaaatcaacataattttacaaactgggattcaatatgttcaaagatgatgtgacttgccttgctcgctttcccaaacgtcggcttcaacctccacgaagagcggatcttccgaagctgcagcgtctacacgaccaacggaaaagaaaaggcttttactctaataaactccatataacaagcagaaacaaagcacaaaaatgggttcttgacttctcagggaaaaattagagacttgaacggtccaattccgagttcaaatggccaagttatggccatttgaagtttatatgctctttaattgaatatttgcgaatttcttcatttaaattttaatttaaaatcggatttattgcgtcagccgaggggaggggcgcgcggaccgggtccacgggagtggggcccacgcggcagcctcacggtccacggtggactggttgcacccggctcacaccggccagcgccgtgggtcccatgcgtcagccgcacccgagggcgcgggcggctgacggccgggccccacatggcagccgcggggcgcgcctgaaagcggcctcgccggcacagccgacgggaggcggcgcgcccgcgcccctatggtcgccggcgccggccataggcatggcggagcggcggccgagagaggggagggaagggggaaacgaaatgggcggtccacggctcaccccgggtcgacggcgacgacgggaacagcgaccggagcggaggaaggcggcggcgcggcacaggttgacggggacggcggcgttccggcggttggcgaccgaaacggataggtggacgaggtcggcgaggttgcggcgaacccgaagaaggcgacgccgaagcgggagaaggtccggggcgacgacggcggcggaccggagctcggcggcgacggtggagagagagagcgacggcgcgggctcgattccgacggagagagagagcggcgagtggcggaaacggtggagggaggcacggggagcgtttatataaggttgggagggggagagagcggccgggggagggggaatcggccgcggaagatccggccgccattgatgcgccggcgaggtttagggggaaacgtttccgaacgaat

SEQ ID NO: 19986 - DNA, 1704 bp, Oryza sativa
ggggaaaagaaagactttttagggtttttctttttataaaaccattttaactttgtttatttcttcttaattattatttgtgctctgaaaattccactaaaatttgtttacgcattttaggcttttaggaaatatacaaaaatcctccaagccttattcgacttttaactttgcacattttaattgttggaggctttcacatggattttacttattctatgcataatttcgaggatgtattttagagtcgttttgggacgcgacaccttcattgtcaacttttacattgcgaagatcgacccatcgacaacgaaacaacgggactttgaacttcaagtaatctagctccaatatttgctcaactctaccatagtattgatcacgacgaccaccgtcactaccagcctcgatgcgtaacccactgttctgcactgtgcatttgctgtcttgctttaccgtgtgaaaggtgtatccatttatgtcatatccttgccaggtggtggcagtgcattcaggaccctgtgacaaccactgaagtgtttcactagacaagttttgcaacctggcaattcggttcttcagccactcgttgaatgaagacatgtgcttattcctgacccaactctctgatcggcttcggttctcttgtcggataactgcaaggtgttcgtcaacgtacggcaccacctcagtcatatgctgtagtaccgtgaaatgagcctaatcatacaccttccgatccagcctaatagtctttcttccaatagtaccaacaccatcaagcctcccttcttgatgagatcgtggtaatccaattgaagatgtttctgacatgtagtccacacaaaaatcgatgacctcttcggtggtgtaactctcgatgatactcccctcagggtgtgaacggttccgtacataacccttaaggatccccatgtacctttcgcaaggatacatctgcatcatgaatgctggaccacagtactttgtttgcctcacaaggtgcaccggaagatgttccattatgtcaaagaaagttggaggaaagtacatctcaagatgacatagggttttcacaagttctgcctgtagttcatctagtccctcgggatcaattatcttctggtcgattgcatggaagaaggaacacaaccgctggatcgtgtgtcgcaccttaggaggcaaaatattccttattgcaacgggcaacagctgtgtgataagaacgtggcaatcatgcgacttcattcctaccaacttaagatcttgcagtgaaacgagcctactgattcttgatgagtaaccagatagaacctttataccactcaaacatgttagcaaatcaatcttctcttctttcgagcgagtgtagcaggctggaggaaggtaaaccctgccggattccgtggttatgggatgtagctccgagcgaacacccatatcttccagatctcgtcgggcgttgagaccatcctttgtagtacctgggttaagcagtaatcccattaaactctcgcatacattcttctcgacatgcatcaaatctatttagtggcgaacttcaaaatccttccagtatggtagtctccaaaatattgacttctttttccacatgctcctctcttttgtcttttgtttttccacatgctcctctgttttttccttcgatgtgctcttctcttttcgctttccaactttcctctt

SEQ ID NO: 19987 - DNA, 673 bp, Oryza sativa
tcctttaatattccttgaaggctcaacattgaatatatctttgaaatcactatattcaaggacttatggtcagtttacttgatgttttataagggcatgagggatgatccttgagtagaaaaggtacagaccttggatcagtccagaatgactgatgatctagagtgggaattactagtgatgcattcatgatctttgccactgcaaccatatcacttatctgtaagaataatttcgaaggagtatgggttagctgaaaagcgttgcatgttaaaccgtttaaatagatacgtacacccattctcatctgatttagccccccgtttgcatcaacaattagataaccgacagttgcattgttagtccctgcaataagagcacccaactagagaacatgagcatggaactggagctggaacagattgaagtgaaagatatagagagggaaattactgcgctggttctttgggcgttcaatgcattggctataaccctcactgtctggcttcatccatatctcaggtatctgtcgatgttataaaggaaactcgagtaaattcaggccgcacagcacggcatttgaatggatgtcttgctttcgtgaatgaaatttcttgtctgaacataagcacaatattgctttcggacagtctctgtcagctctgtcctaaac

SEQ ID NO: 19988 - DNA, 863 bp, Oryza sativa
  unsure (1)..(863): unsure at all n locations
cttcaatatgtcatgaccaggaatatgacccatctctcaacagagaatgatgatagatcacgcctattatttttttatttatgcttaggtgttgatatctgaatgatctagtttttcttggttatacaaattatcagttatcaattaaacaaacagaaataagtagagtacaaggatacatactaaaacaaaggaagcgaagatggaagcaaatatgctctcacttagataacctttgtcttgcccaaactcctaaaaacaacggtaataattggctgttacatatgcaaattaatcgatagcaaaaaggataagtgatttacttactggaagggccataaatccaaggtcctgcagaagtggaccaggtcgatgcaagtaatgcactcctcgagcagccagcccatgaatatactaattataggcaaaatattgtatgaatctccaaagtaatccattaatcaactgacaaacacagaagaataagtaatcctatataactaaatgcagaaaaaaaaaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 19989 - DNA, 2907 bp, Oryza sativa
aaaaacatttgttcctgcaattgcatagcttagaaattcaggaaatatgagcaagctaatgaattgatagctccattttgcaggcttcctattacagagatttttcaaggatactaaggaagtacaaagtagtgaggtttactcacacagattcacgtatagtcaataatggtcttgctccttccctccaacgtctccgttgtcgtgcaaattacaaagcacttcaatataggaaggagatagaggagctcggtcgcaccctggtagatagactgagaaatggaatggatcattatattgcacttcatttaaggtattgaaaattcaaaacattcagagaccaccttacttcatttcctgcaaagaaaccgtttacagatcagcaatcttccattttgctttgttgattgatttacagatatgagaaagacatgctgtccttcactggttgcaatcacaacctgacagtacatgaggcagatgaactgacggacatgcgactcaaagtgagacactggaaggagaaggagatcaacagtgaggagaagcgactccaaggcggttgtcccatgactcctcgtgaagctgctgtcttcctcaaagctatggggtatccttccaccacaaagatatacattgtggctggtgaaatatacggcgcacatagcatggatgcattaaaacttgaatacccgaacatctacacacactacagtctagccacagcagatgaattagaacctcttgagttgtatcagaacaggctagctgctgtggattatatagtagctcttcagagtgatgtttttgtatatacatatgacggaaatatggccagagcggtgcagggtcacagaagatttgaaggattccggaaaactataaaccctgataggtatgtaccttcatacaggtcaagtttttttttctggttttcaacttacaatatatatatttttatctgtaggctgaagtttgtagagctcattgataagctggatgaaggttccatggactggaatgaattccaaagtgaagtgaagaagcatcatgaaaacagacttggaggtccatatgacagattacctggtgaaagtccaaggcaagaggaatacttctattcaaatcctatccctgggtgcctctgcagaaaggtacaaaagactaggtaaaatagattaatctcaaagggagatgattcagtcttcaaaaagacatgaattgtacagtcttcaaaggaaaatagtttcgcagctgcattaaggatggagatgacacttcctcacaagtcacagattgcatcaaagtggaagtcctagtaaactgacagagaccggtcattttgattatttatcctagactgacaacactcgtagttcagggcgtggggccaagaagtgctgcattttcaaagaaatgttcatccaaggaaggaagatgagattctgaagtagttgaagaattaaatgtatcatcgattataggaacagccagaaggaaaactcttcatggaggctgattgtagttagtccatacacacttcccctgttcttgacgttatctgattcgttgtagtgggcatcttacatctggatggattcataacagtaatggaacaaaccacactatcagtatagaatgacagacaaatatttcagtagcttaggtcagatcaataattctttgtaatctagcaatgtgccaatgtcatgcacatcagattagcttcttgtaaaagtatgttctttgttgcagtggcatctgcatctgcactatcctctaggaggaatcaatgtgagtttcagaaacaaattagaaacaaagaaatgcatgaaaacaaaaggaaaaccgtctaaggaaggtggcttcaccccatgagacgtttaccgaggcaggaggcagtgtcgaggcggaagtcgaagacggcggagaggaggcctcagacgcagaggaatcgggacgagcggaggtggtcgggggatgcgagtgtgccatgacgggcctgagcgagctcagcgagcagtcggaatccggcactgaccacggccacgacgcggcggcggggttcggacgaggcgaggaatacaaacctgccggaatcgggtaccccactcggccactccccggaagagtagcgggagagccggcggcgatccggcggcggcgcggggcgcttctccgacacacacggagaccggcagccggagaggcccttctccttccgaaagacacgggccgcgcgtcagccaaagtccagttccagcccaattaacagatttaacacagaccgcacgtcatccgcagccccattacggcccaaccaatattgggcctcatcaaacataatactctttggaataagttcatcttgggtcccttcattttacaccgaatctcaaacccagatacaaccggtccctgaactaaccggtgcaaacgagatctctcggcattttggattttggaaggcggttttgtctgacgtggcaccttcgtggttggtttgactaggtctccgttccacgtggcattgacatggcgcttacgtggcaattatatctcggaaaaataacaaaaaccatgggcccacatgtcagctacacaaaaaaaatttaaaaaattgtgaggcccacgtgggccccacatgtcatatcctcccctcactcaactttccctcttcttcctcatcgcgccgcggcgccacctcacagtcattgtctaagtcctcaccgcctccgatgacaacaacggccgaagcatgccggcggcaggccgcaggcggcagaggtggccaaagaaggaagaggcagagaaggtcgccggccagcgcggcagttgtggcgggttatctcctcccaccgccgttggtcgctcgtcgctcttattgctgaggtcgggcgaggattt

SEQ ID NO: 19990 - DNA, 2056 bp, Oryza sativa
gggatagagagaagagagaggagtaaggatgacatgtggggccgacgtgggtcccgccattttttattattttatgtgtgaaactgatatgtgggtcccacgggtttttattttttaatcaaattgccacataagcgccatgtcaatgccacgtgggacgaagatctagtcaaaggagccacgtagcacaacgtcagccagaaccgggaacaatattgtccgagggacctcgtttgtacggttttgtaagttaaaggatgcattgtacccgattttgcactgaagggacgaattttggactcggcaacaaactgagggacgtaaggtgaacttattccatatctttagttggtctctgttctgtaaattggcatatttcttgttcttttgtttgcttgatctttttttttaaaaaaattagttaatacttaattaatcatgtaataatatgagcttcgttttgtatgccggggagaagggttgccaacccctccttccgaacactacaattcctagttctgtacaatgcatatggaactcttgaggcttatttccaacgttatcgaagtgcttgctcttaattgcccatcctgaggaacattttgcacaaagttattttgactgtattttacgaattttggtcttttcctcggtgaaatttgtttgagcatacacgagccactgaccagagcggagcatgacaaatacgggcgtcgaaatgccgattgcatccttcatctggatctggattggcccattatgtctctataagcttatttgggcccataaatttcactcaaaaggaataagtccattttacctcccacatctcttgcccttcgtcgaataacatccctcaactaaataatttttttaaaaaccggtgcaaatcaactccacatgtggttctgtaagtggtttatgctgatgtggcagccaggtcatcaaagcgattgaaatagaagtgggtcccacatgtaagtgacaaatgctaaaataaaaaagtggtggggtccacttgtcagccctattttttcttatcttcttcttcccatgtcccttctatctctttctcgtagccgcacgcgcggaggctgattcggccagccgatggcggtgaacgttagtcgggggtggcctcggagggcttgaagacgtgactcatctactcctaccccccgtgtcaccagggagggggtgtaagagatggcttcatgctaaccttcctgaaggcggcgaagacgaactaggcgaggctcttgagcagcgtgcccggtggcagtggcgcccttctcatcccagcgagctcctcctctgcgctcggtgggccgcaaccacccgatgagctccccggcggctggccggccgtggcctcccgatgagctcctctcccgcgtccggccggctgcggcatcccggcgagcccctcccccgcgcctggcccgccgcgccctcccgacgagctcctccccaacacccgccgccgccgctcgagccgatggaaggcgtgaggctgtaagatatgaggagatgaaagagagatgggaggggtgataggtggccccacgtgggtcccacctattctttttattgtgaatgccatctagatgccacgtgggatgaagaattagtcaatgtgccatgtggatgccacataagctataactggactcaatactgtcttgggggtcgatttgcaccggttttcggagatgaggtagtcgttatacctggtttatctaccctatagttcaacaaatgcttttactcattcatcattcatcatgtcacacatccaatggcccaaaatcaacagaggaggtagatccgaccgcccagcgcatctctcgcatctcccaccacacagagccgcatctcctctcctcgcgctctctccgcatcctccaccatcagcgccgcatctcctcctcggcgtcctagcgctctctcgccccctcgccgccgtgcgcctccccctcgctccctcgccgccgtgcgccggatttttcattgaatcgacgcgctccttctccggactagggaggggaggcgcggc

SEQ ID NO: 19991 - DNA, 6954 bp, Oryza sativa
ggtaatgatttttccctaccttgcagacagaggaataccggacagttttttttctttctttcttctgttggggtgggttcatttcagaaatacccaatttgttaggttgaccacatgtccccattttgatctgcaaggtcacagacaattctcttgtaatgtgtatgtgcattgtttgtcagaaacctgtcgaatgggaggcaccatcataattatatgatctaataatatgaagtaaccatcaactgatctgagtgtggaggtaatttctaaccctcacctctgatgtttgatgaatttcattttctcgtatatactttgtttgaccagatttcctgctatgtaaatacacatatatgattgtgtacatactagctagatctttcctcttagagcatggacaatataatggttcaggcgactattatctacataatctagaccacacaatagaatattttaagcagatttttcataagtgccaaccactgcctatgttttgctattaatatatagtatagttcctttcgagaatttgcacaaagtctatagaaaatcagaatataagtgcgaccacggccttcctgaaagttagaaaaatcttctcaagcatatagcatatagtctgatggtcatttcataaaaatctcttgatatgattttataagtgaacataccaaattagtttgaatgtacattgttcgttttcacgggattccgacatccgttgtcagtgatcgagatcctgttttcactgggcacttttggagtgagcttttccggttggctggtgtcaaactacatatgagctcggcatttcagaacactaggacaaataacatgttgtatacattctgggatgcctgaatatatggttgcttatgatggaatcagaaaatgataagttctgcagtattttcaaatgcggaagctgatttagaatttgagaatgttggctcatgatgacaacaactctgtacatgtacattctgcagatagagaagcttttcttgattgaagcattttaagacttgtactacaccagatgtgcccccttgagaaacaaaggttagtgttctgctatcgagtttttttttagattgtagcaaatagagattttgttaatttttaatcaaatgtgaagctaaacttctcattaatctgggattgttttccataattgtcccggtgtcagagattgacaattgatttcacaaccaaatgaaaggtagtgtttttctgggaatgccatcaggggcgcagatctgagtgtagtcaaaatccttcaatttttcaaatccgtttggtaaaagttaccactttctgaattccatgcaaggactgacttatgaaaattttactgtatattattgttctataatttgtttataaaagtaatgcagtaatgctataggaatgatgggaccctaggagttagtggcatatatcatcgacacacttgcatggccaggggaattataactcaggtgctcaccgaggatcaactgtccaggatccaggatttttagcatttgttttattgaacgctggaattacttttctcctcgtgccatctaaaggtaacttcaaagctaaatggctggccatgtataatcctaggagcataaatatttttacaaactatataaatttctttgtgaaattttaatagtgattcagtgttgcaacgggaaatgctatatacatggccagccatttatattcagtgtttaagtcgatatattgaccacagatttggtttatatcagtaaatggccatgtttttttcccaagttatgtttctaaatatgtagactgtggtacgatatttataaagttcaagttgtctttgtttcccagaaaatcttaggtctagcagacttacttagtttctgtttacaaatgaataatcgggtagtgaatactatacctgtatatttgtactactctcttatttagtaatgtatctaaaataatgtagactgtactacaatatttatttagatgcatatgctcaatttttatataagtatatgctgcttttacattacttttgtttgaatgtacatgctgatatgaaatttggagagctttcttggaatgtacgctgttaagaaaatttagataaattaaatccttatgccttatattgtttcttaaacacacctataagtttgattggagaaggggacattaaccaattgcttgaaaaaggtgttttgttagctcaagatatggtggaatatttacaactgttttagtaactcccagataatctttctctacatacatgcataactaatttctctaggataatgacacatttctgattcgttaagggcaaactttgaagtacatctgttatgcgcgagatattcagtttatatttctaaacttgggtgcactttgaatcaggacgaataggctcagttggatcagttgaatataaagaagtggtgtgcgattagttttttttgtaaatagctcaagttagttttcttccttgtaggatagttacaaaaaaataaggtaaacttgcatttcttgcatgagcaaagttcattacaacctatctaagtataatttcctgaagagtgtttatagctgaagttgtttcttctaattttgctgaggttaaccctcctatggcatgcatccttctaaattttgctgaggtaaaccctcctgaaattagtagggtgcacgaaatactactgtttttttaatttttgtacagtggcattgaacatggttttgctctttgagatatgatgcttccctcatgatcaatgaagatttgcattactttaggtgatctgctcatgtttgggtgtttgggtaaggaggagaagaaatggctggggtgtcggtggtaatgaggttgttgtttcagttatacagttccgcataattgtgtgacgtcctgactaatcctgactaatctgtatgaccttttcttccatttacaaatgcttgtgtctctccagttcacctgtgagggagatatgaaatcaggtatgagtaattcttgtggttttgcttctttttctggacacacttattttcatccattttgcagcaagcaatagttaggtatgagaaagaatgtgccttacaattaactgtcagtggtacacataaaactattcatttactcttctttcctggtcatattgatacaggttagtttatgctcttactcgaaaaaaaaaacaaagtacatggtcttactatttgaccgtttgattaattatataagtttctgagaaagccctgaattcgatgtactagactcgattgttataggcaactaagtaaaaaaaacaaggtgatccaataaagtattaaaacacccatggatcatgttgctaccctgtggtgatgaaaagagacataagtgctagctactattttttgtttaatcatgaaacagaggcttcatgaaaccagatcaagcaagtcaaatgggattgcatcataggtaagatcaaagttttcccctttttgacatcaacagcgtattcttttgtctgtagagattgtatatttgttttcattcatagaggttacatcatatccaagagagtgccaaatctgtcatgtagcatttgtctttttttttttacccggcctctacatccaactggatatatgcaacctttttaaattaagaacttagccctcaaataacccaatctgaaattcgctcctatagcgatttaaattcaggaccttggggtgctactcaggttactgcaaccattaggctacatacccttttacatgttgcatttgtctagattattgcatttataagcagtaaatctttttcggagcaaatagcatttgtgcagtgaccaagggtactatcttcttgatttgcttgcagtctcccattgtttgctgagaccatcaatactcttgcatggatgatggttcaattgaataattaggaactgcaatactggacgaggcttgtttgagttttctttagttctcttcaataagttacctctttaattatatggcttcaaactttttcatattcccgagagcatgtctgtatggcaccaaactgttcacctgagcaaatggtccaataatgaattgtgctttgtcatggtacgttgctaactgtttgggccttctggtgcaattttatcattgagatattttgtgcagtgatgaaatgcatatttgtattgtacgatacttttatattatcaatagtaatttactttaattattttttcaattttaaaagttgacctgttaaatgaggtttcacaggtgcattaaaatttattgtgttacaatgaaacctgttgctacaacaatcctaggatatcaatgtgttacctaggtgcacttcttgggtgatgagttgtgggagttgtccatatcctcctggaaaatgtgttgacaggttatgcgaggttctaggacagagacatggggatatagttctaggacggaaatatggggagagatatgtatatcgttaggcgtgaagttctgatggtaaatttatggagaaaaatttgatattgaccgaatgtatctgtgtgcaaattgtagataaaagaatgtcaaatgttctgttttggagaagacatgaaacaattcgtgttataatattggtgcatataccttttatgcaaatatttaattaatttatattctgtgcatatataagatgcgattaattgctccatctaaatttactactccctttcacaaaaattaaaacatatgattttttgaattattttaatttactactctctttcacaaaaattaaaacatgcgatttttgaattattttatcttggggttttgcgtttgactacaattttatatttcaacaactttataaaatacaataaatttgtgataaaggggagttattattttaatgataaatatgggcagatcatttagcattcggataaagacatgtatatcttgcttggatatttgtattttagacatgttttgaatatgtttcttcaaaagttattttgatttgtattgttaaatattaccgtagcgttagcacgggcagattactagttcgacgaaggcaagagatgagggaggtaaaatagacttattcccactcaaaaagcttaaaatgacataagcccgatactaaactaaaggcccattattagtataaaacactgctggcccaccgcgttcttccgcctttactgtaggagtgttaggtttagggcttccgccgccgcctcctcctccaaaacctcgtcggcgcgccgccgcggccaagccgctgtgctgtacaagaaccggttcggcgacaacgtaagttccgtgcccgacgaggtatttgttcgctgccccctcctcctcctcttcagtgttccttttttttctccgagagcatcggtgatgttacatccatctaaactcatccttgcactatgaggtcaccggtgaagaaaaaattgggggaatatgtagtctgagatgctctgttgatcctctccttggatcattcttttctactgagctgatgacgcggctggagatttcagctgctgtttgttttcgttttctgaagcctgagagcaccagtgatgtttacatccacactcatccttgcactatgaggttattaccagtgaagaaatcattgggggaatatgtagtctgagttgctcctgcttttcctttctcgcgattctgctttaatttgtggatttatggttgattttttttggctttgcctttatgcttcttgattcctctcgtggatttgtggttgatttttggctttgcctttatgcttcttgggttcctctcgtgaatactgatttcagcttctttctgtggcttgatagccaccaggtagatggggaaggcaaagcgtgcgtcgatttttatcaggcttgtttcagcagctggaaccgggtttttctatgtgaagcgcaagaatcctcgtcggatcacagagaagcttgaatttaggaagtatgatccacgagttaacaagcatgttctctttacagaagcaaagatgaagtgagatggtgctgggcaaatcttctccacaatgtgcaaagctgaataacctgcaaaaaaaactcgtgtcaggattcaggaacctgtctactgttaagaatgctatgatcagtttatcaccctgttctggttccagcgttttatgcagacaatttcaacaagtatgagtttgatcttgattagcactggaattctgatgttatgcatgttggttttgttttttggaatgggctgtaagcctgcaaactaggaatgctttgattgttttaccatatccccgttaaagcaaaattctatcatggcaacttgtagataggattcaccatactgaatttgactgtatgtattcctttaaacatgtttgtcaatacctggaagttatcttgaatttgggccatgatctgcattgagacaaatgattcagtgtaccttctttttttaaacattggtttggaaaacactacaaaattcctttggaaacattgtaaaattctccgatccaaatggagcctaaacatgtgtgatttgtaagattggcaggacctggtattcttcttgaatatgctgcaacctgtactgtaagttgtaacagaagtagtttagactctacaatctgaacttgtttgacaagaactcaagataaaggacttcagctgctccacaagttttacctgacctggcgatatctgctgttaagcaacactgggacttctccgggcttctcttcatcacacggatcactggacctggcttgctcattgctgcattttgatcatggattttatcgtcgatggttgctgaaagcgtttcagtgttgcaaatttacatttctttctcgtgcttacgacctttcagaattgtaatattgtaatttttctcctgctgctatcgaaaaaagggctgcaggaa

SEQ ID NO: 19992 - DNA, 1261 bp, Oryza sativa
gaaggagaaaggagggaaagcggaggaggaggttgggattctcgcgggttcgcgacgagacgacggtgggagggagggagggaaatgattgggttcttcttcttctcgctccggtgcgtggtgggattattaaaaaaacgggggtccgcgtcaccagaagaatcggtggagggatgtggagcgccggagcgcggcgccttttaaaaaaaaaacgggggccctcgtcgcctcgccttccagaagccgccgtaatttttaggtgtcgttgggctgtatggcctttgccggtgggaggaggagcagcagcgcagccagcgtgtgtttgcgtcggggaaaagagaggatagggattggcagaggatttttgctctatccatcggccaccgggcggggtggggattgatgtcgatctagtataacccgagaggctcgcggaggggccgggattggtcaggggggtcaggacctggtaccgatttggttagggaacaggaggagatttgtcctataattcttgccttttgttgtggtgttctcttttttctttcgatgataaggatgacgcaggacataactaatcgctatctaccgacaccgagagtctgttttcacaagttttaggccacatttgaatcgcaggattaaaaaatagagaaataaaaaaaacatatgatatagaatgtacacttaagatccctttgaaacacaggattgagaaaacagataaatgagaaaaacgtaggaatagaatgccacacgggcccctttgaaacataggattgagaaaacacaggaaaaagaaaaacataggaatagagggcctgttcactttggtgtcattttcaatcatactatttttttgggtaaagttgctaaaaaatgtctacgttattctgttgccaaatttagtcaatacataagaaatcataccaaaattttgataatagtaccatcttaccaaaattttggcattgccaaaacttgataaggtttattttagctatagtatgaacatgcccagaatgtcatacttattagaatcctataggattttgaaatacaggaaagtccccaaactgtcgtttgattagcaaaaaaaacacataaattttgagacacatgaagaggaaaacatgaggtgagagacctcatgcttattttcctccaaaattgctcaagcaaggtccattccataggaatttcaaatgaatggtaggaaacaatcttttgtttcaaagggctctagagcattatttttcat

SEQ ID NO: 19993 - DNA, 1485 bp, Oryza sativa
gatggattgaatccggcctccagaagtcgcgccacctcctcgcggatgaaggcttgacgttccggggcctgccgccgcactttctgccggaccggccttgcgcccggccgcacggcgagacggtgctcaatcacctccctggggaccccgggcatgtccaccggtctccaggcgaagacgtcggcgtttgcccgcaggaaggagacgagcgcgtcttcctatttgtcgtccagaagaccaccgattcgtgtggtcttggacgggccgtggcccagggcaacctccttgaccgagacctcgtcgcacgtgaccatccgctgccttggggcggccgggacggaggtggcgagcctcttgtcaccacccgcgggcttggacgccgcggcgaggtggtccgcgcgctgctccatacaagcaagcgcgactttgaggtcgccatggacggtaatggggccagcggggcccggcatcttcatctggagataggcgtagtggaccgccgccatgaacttcaccaacgcgggcctccccaggaccgcgttgtagggcagactgaggtccgccacatcgaagtccacccgctccgtgcggaagttggcggaacctccgaaggtgaccgggaggtcgatatgacccagcggccaggtgtgccccggcgtcacaccgatgatcggctgggacggccggagcaccatccccgtggccttgatggcgtcaaaggctgcgggggaaaggatgttgagggctgcacccccgtctatgaggacacgccccaacttcacattgcaaacggtgggggaaaccaccatcgcgatctgtcctccccgggcaacgcacggcgggtggtcagtctggtcgaaggtgagggcaacctccgaccaccgcgcccgccgcgtcgcctcatgggtaggggccgcggccagaagctctcgcttcatggccttgaggctccggcgagaagcgtgagcgcacgctcccccatcgacggtggcgacggtggcctcaggctcctggaaccccaggtcatcgtcgccatcgtcgatgtcctcggcggtggccttctgcttggcctcacctcaccggttgccggcgggagccgccggggtcttgccctcacggcgctcctgcctcttctcctcctcccacttcctcgtccgttcagccaaacttttgaccgcgcggcagtccgcgaggtcgtggagggaggtgttgtgcacggtacaccacttgccggttgggcgctccctgctgggagcgccggcctccttctttttgtcgctcgcaggcctcccctttcggggggcccgcgaagcgccctcgacggcgagaacatgaccctcatcgtcggaacgggccgaccccttcttcctcctcctgtcctgccgccctgaccgagcggcggacccgggggcggccggagctgccactccagaaccggaggagttccaggtccaggcctcctccttgcgagccacacggtccgcg

SEQ ID NO: 19994 - DNA, 1157 bp, Oryza sativa
cgaacggcgggtaacggccgccgctcgccgcgccctccgcctcgacgacatggagccggcggcggctgcgccagaggcctcggtggcggaggaccgcccgccggcgcctaggcgctgctgcgccgtcatgaccaagtcggccacgtcatccagccaacgtcgggctggagtctctggatcggggacgacgggcgggtgacgcaggagcgcgcccgcagcctggagcgtgccctggggcgtgccgccatcgccgtagacgaggcggcgacgcgccccatctcgccgtcctcccccgtcgcccgcggacggcgaagtcgcggatctttcgacctccccgagcgcctccccccgcccaagatttcggcgagaggggaacggtggggtgcgagcccgacggcgcgggttctgctccccgtcgtcaccgctagcgttcggagagaggctgtgcgccactgcccgttcggccattgggctgagcgggagaagcttggcgcacacgaaagaggacgagggcttagaaaaacacgcgcgccccctacctggcgcgccagattacggagcgtggggctcctcaccgggagaccgcgcaggcccccctttgccggttcggccgggggcgctaagtgaggttcttcgccctcgatctgaggaacgtcagcgagagaggaaatgcgcaagacacgggcgacgtagacaggttcgggccgctaagaagcgtaataccctactcctgtgttctggtggatctgtgcgtgaaggaatacagagaggccgagagcgaaagagagttcaggctgtagaaacccttcgccagagtccccactccccttctttcctctctctcctttttttctaggcctgggcctcctttttatctggtcaggggtcaccacatgggcctctagctgcctaagaagggaaacatgctttttacaatcagggctagttacagccggaagtgacctctgacaagcagagcacacgcctcctgccctgctcacctgctttcccggtggacgcccatttcaaccttcatttaatggccagcgacttccttgccatacttgcgctgaagcctagaatggatctgaccgggactgacataccaactccaggagttagcacgccagctccggctagggacgagagccaggaag

SEQ ID NO: 19995 - DNA, 4240 bp, Oryza sativa
acggttgtgacatgatttccatcgtttgcgtggtgctaatgttgcttttagcgatgattactgacgatgacaacggatgatattattacctcaatgtatatttactaagtgggtagtaagatgagacccacaaaactggatagtaggtgttttgattctcacaatgtataggtaagctgggtcccacatttaagaggagtggatgggtgaggtagagagaaagaatgagagataatagagttttaatatttgtttattacttgttacatgatagtagtgctactacccagatgatactattgctcactttattacatgcctcataatagtaaactaggtagtaggatttcttactacctactttttagcacattgtagatgccctactctatacgagcgaaatgaaaacatgaacctgcagtgatgcaagcccggggtgtcctgtgtcggatcccgattgggtgagcccgctatttcgtgacgtgcccggagagcgacgtgatcctttttattcaagagcggccgatgagttgctgattacggtagcggtagtagtacttgcacttaggacacccacaatggttatctataggctctctacaagagatccatgtcagcatatttttctacttgaaagatattaaatgaagagagagagcaaaactatctactaacttagagatagtctatagagaaaaacgaggcaatacatgagagagctatagatactgttgtagacatactattgaggtggtttactattaatctagtctattgctgagatgtacatgttttatagagagcaccttactttaccattgcgggtgctcttatagcatttacaatagcatgctataagttagctgtaaacatattttaagaagataaatgaagagagagaagagcagtgggctacagatttatagccagctatagcacggactccaagacacaatgtgtgtatgacaggtggaaccagttattaataatgtagtatgcactgtaattattatatgaattagctattagatttggctgtagatgaattagagccagtagttagcttatactattagacttgcttacaactacaagttctttgcttttttttccttttgaatcggatgggcgtcatgcacggttgccttcttttttgaaaaacgaaatgttggtgtgtgcattggatgctctctgctgcgagaaagacgcaactttttccaaaagcgatcttgtttcgagtggaggaagagagcagcgaggggcccgagtgttcttcccgaccgattcaagcgagcacagttcataaaagatggacatcagtagtagtactagtactataaccatacattactccctccgtctcaaaaaaaaaaagacaaatctggtttccgtgtccaatatttgaccatccgtcttatttaaaaaaattataaaaaaaattaaaaagataagtcacgcataaagtattaatcatgttttattatctaacaacaataaaaatactaattataaaaaaatttcatataagacggacagttaaacattagcatggaaatctaaggtttgtctttttttaggacggagggagtactctctaaccctgtctctacattgccaagacatgcaagaacaccaaccaggagacaggcgaaaaaacaacgataaagaacgcgcaaacaaagactcgacggtttgacgagcattttgaacctcagtagctcgagtagtagagtgttttttttcctcttcttgttttggcgtttgtctccagaccggcctgcacgctcccacagcacgcggcacggcagcgcagcgcagccgtagctcctcccctttctgggagtcgctccggccaacctttcgccactcgcctgcgccgccgcagcgacacgcccgtcgcaacagcgcaccgcttcggtgaaagaaacgcactctgcctctgctgctgctgctactgcctggctgcctggctcgtgagtagtagtagctgttgcgtctacactgcatcgcatgcgcgtgccgtgcgaacaggtcagaaaatgcagctgcagcggcgcccgctagcgtccatggatcgatataattttcacgtagctacagtgtaatgaagtacagtactcctgctagtagtgtgtttttattagacggataattagtgccggactgccggtggtcgtaccaaatggacgttgttaagaggggttttaccgaagaaaacagagctccaaagctggcgaagtttggtgataggacgatcagaggagacggagaccgtacggttttcaagataaccgagagcatttcttggcttggagcttgtgaccgaattgaccgaggcagcagtcagtgaaagatcgattatttgtatttagagcgaggtcaatagtgcaacacactacttgctccaaatcatctatagtcaatgtaatagttaattcatacaatagttgtttactatactattaatacctgatctcacctatcatacacatattacgtcttgaagtccgtgctgcagctggctagcccactgttcttctctctctttctttatctttttaaaatatatttatagatggcttatagcctgctatcgtacctgctcttatggccagggcctgcgcctgcctgggtggcgtctgcaactcgtgtcactgcggctcgcgtttgctgcggtcgcagggccagctgttcccggtcaaacccagtttggcgcctctgtagctggctttcccgccatttgtggacaggccggagctttcccgcgcaaatagaggcgcctgctcgccgctcccggttgcaggggcacgggctaacatggacatggcgcgtattgtcgtgtttttgtttgacttttggcaagtttgaaaagagtatactaatattatctactatatatactaaaagtctattaaacatcttataaacacccttaagataccgcgtgatgttctaataaattaggaaaaatctaacgaaacttataagaaaaaaaataaaaatatatagccattaatttacacttaaatcagtggatacattattagtaatatcgttcctacactcttataaactcttctaagatggcatatgacgttgtaatatattagagaaaatctaagaaaaattataagaaaaaaaaacacctaaccattgatttacacttaaactgatgatctattattttaattattagattatatctatcaagtaatcattcattgttaaaaaccggctaatccctccgtttgtatgtaagtacagaaagatatgtcaaaaagaaaagaagaagaagaagaagaagaagaagaagaagaagaagaagtagtgtgtgtacgcgatcaatcccatcgaatagttctctctctttctttgaaagctctacgcttttttctcgaattgtgcatatatagcaactattcctgatgatgttgtcaaagaagccacatcaacaatgcttcaaaccatcccgccaattctcttgaaagtattttttttactagtgatataaaagacaatcacaagtgatcatataaacgcgtgcacactcgtcatataagtacacatatgcacacctaccctatgagagaaaagtatgtcccaggaagaggtaaaattatgtacgtatggaacactactattcgccaaaaaacatacatgtgtacaataaaaaatatcacataaaccacattatatcttttaattgtgtcataatcatctagatagtgtttataattagcataaataattttaacaatattgtcagggttacggataaggtatacctcctatcctacgacttatggaatatctcgataaggtatatcttaacatatacggattgtacccataaatatcacgtggaaaccgtttcggatggaacgaaatatctctacgagtcaagtaattcggaagtcctactcgcaagagatagaatttctgttataccgtaccaggtcctatcccctcaaacctttcttgagggtcaagaagatccatggtataaaagggaccccctaggaggggtttcgggaatcgaattccatctccgacacacccaccaaagtttacgaagccggagtacgcggagccaagtcgccgggagatctcgtcgagtccatcgactatgatctcgtcggtatcgtctgtttcgactactctctttgtaatctgttctcatcatcatcaatcccatataaactggactggggctattacttgataaggggcctgaaccaga

SEQ ID NO: 19996 - DNA, 9055 bp, Oryza sativa
gatttttgtttatgtcaaaagctatggtatatttatgatataatttttttcttgtatgattataagataatctattgttcttatagtaaatatggtgagatatgactagttttctttttacaaacaataataaattgctcgcatagatgcgtgggttttgttcctagttttatgtagagttacccaatagctttggaaaaaatatataagcaatactgacgaagtaagtttttggactaatatttttacaagctgaaatgtaaaaataagctcaatattccataacggatttcctataaaattttcgcaagttttttgcctccaaaacttccagatctgtgaccatcagatcaccttaagatttgtgcatgaagagaaaaacattgctagaaagaatttttttcacacgcatcaggcgtaagatcctagtgctacctaatcaaagcattgttgaatgcaagttttaataaattatattgtagtcagtagttataatacaattacaatgtagttacaatgcagctataatataattataaatcaattatactgtagatacatcttaatgttttagaaaaaaaaacttactacggtttttttattctctcattccataatttggttttagctaaagaaaaacatacccttacgttattgttatggtttatggttcaccagtccgaatcaggggcggagatagagtatattagagggtgcccaggaacccggtcaagaaaattttttagctatacctcgtctatttttaccatatatgcacccccttaatacgaatttaggcacccacatcagcttaaatttgatctacaatagagtgaattaagtaagtgacaccaccctctatttcggtccagctccgtcccactccgaatggatagccctgataattaattgagagcaatgagaactttcaacttgtacgttcaagggtgacgagtactaaatagaaacaaagggaatacaacttttttgagaaaaagacatgaacccagtattgatcaaatgggtataacacccaaggtgatgtgtatgatacttttcaccaacaaacaagggctgcgtaatgcagttatttgcagtagatttggccaatatgcaatttgctgttccaaatgtcgtagacttgtaaatacgctgagtgttcgtattgaggtagtattgtactatagcgatagttctgccatacggtagctagctcacgctacttgcgactaaattgaagttgaatgtaagaacaggttgaaatgtgcatcatccttgtttccaacaaagggccgtatatcaccttctaaaatacgagtactgctcttatctactccaactatttgttgacctacaactcctaatttcgtacggaagactctcatgaacattacgaatcagtgcggatctgcgatgccatcaatctccatgtataatcaatactacatccatttcatgttacaagatgttttggctttgttaaagttaaattgctttaagtttgataaagtttatttaaaaaaatagtaatattttcgtagaactactattgggagcgttgcgcgctcccatattccaagcgcacgtgtatcagccaggcccacctcaccccacgttccatcatcccgctcccaccgttatcggagtaaacgattaacttcgataaaaacaacttactggttacgatcccaccccacgtcctatcatcccactcctactgttatcggagtaaacgatttacttcgataataaaaacaacttccctttcgatcccacccgacttcctgtatcgtgctccaaccatttttgatttactccgataaaaacaacttctctacttctggtatatattctatttttcccgtacccaaccaaccactctcgccccctactttattttttcttttttttcggatctgaatcgatccaccatcccagcccacagatcggcgacgcaccatggaggaggacgacaacaccgtggcggttgatggcggtgaccggcaagcggtggccggcggcgcttgaggcgaaggcattgcttcaggactcgccgccgcagcatctgcttcagatcaatgttgaagagacgtctggcccatggcgaacgaggtggacgtcatggggacggttagttctctcagcaattcctaatgagattcttgatttcttgcaagaattgtatacaatctatgattaattaaattctttatctttcttgattctatgcagtctaacttcgattgggttgagcgctcatcttgacgtgcttctctattatcccttgcatggcggagatcatgtttgtgatggtcaatcgatttggtaacatcggcaagaaactgtgatttgtttcatcacctctgtcgttgcccagtttatgacagtgaggcggtgaaaacagcgatggcgacctctatctttggctccgtcgccggatccggctcctactgaggtcgcagcggccagacttggtgttgcattggctccagcctgcatctccaccactttgtcttcttgctctctctagcaggacagaaacttcatttagccgtcacgaggaactggcgatggcgtgtattgttgtatttgtgtgtaaaatttttattcttgtgcttttaccatgatgtgcatgtaaaatctttattttttgtcccatgatttaggatggagtgattcaatatataaggaaaaaaaaattcacgtattatttggggtaaactaattagaccccagtaattccctccttatttattttttcccttttttcttgcttgatgcactcactataagaaatcatcaaccaaggctggcaataatgcaattactacaagttaatgcaccatcaattttcatttacatcgatagtaatacgaatactacaagatttgatcaaccaatgttgttcataatccaactactacaagcacatgtaccatctattttcatttaggtcgacaataactcgattactacaagattttacttagcatggttgtcgttaatccaattactacaggcacatgcaccatcaattttcatttacattgatagtaatttgattactacaagatttggtctcagtttattgcacaccatatcgtaactacctcgattggaaatagagataaaccaattacaatgattattttcaaccgaccaccgattttacgaatctgtaattgatttaccccgaattcaaatagaactaatctagacagatcgaacatgggcaaccgaacaccagtttttgcggactctaggcgcgatgtgtggtgctcggaataatattccgcgctctagcgctcggaatagcgctaccgatattttcgacccaagataaatttattataaaaatatatttagttattaatttaataaaactaattcggtaatgtaaatattactatatttgtctataaacttagttaaactttaagcagtttgattttgaccaaagtcaaaacatcttataacctgaaacagatggattataacctgaaacagatggagtatttgtttgtcgttgtcaacattagacataaggaattttgtcaatataatcacagggtcatcagaatcttttatatcataagatgaagatagtagtataaatcccagagatgatgattggaggtaggccgaccaaccccaaagctaatttcatcactgttgtgaatgaaaacaggaccaataaatagacttgcaatacaatggaatgaagtgtacataaaaaataaaaggtcaactactgcatatatagagaaaagatagcatgataaataactgcagagtgtagaaaaatggatcctagagaagaagattaactactataaggccctctttggactttggtttagctagtgatgtaagattttttttttagagttgggtattttcacctccacaaatctatgcaaataaataattttgttcctattttagatgatatttaattttttttaaccgctacagttttgcatataaactttaaatttaccgtggatgtggtatctagaattgtgctaaacagtatctaaatatttggtagcatgaggaatttgtaagtgacgtctttgtgaaaaattggaggtctcgtgtacttttccttgaagagaaacttgtagtataatcaatttaacaagttatcaattggtagaaattactcctaattggttagtcgaagcaaagtgggaattcaccagggttttatatgaaaatattcaactgttcaactaaaaaaaatcaatatttcaattaaaattcaaaaacctttcacctgttgaacgtggcatccactctccacaacctctctcaccaaaagagtgccaacctacatacttacatagaaaagctttttccccttttactattagcacgtttttcaaaccgctaaatgtcgtgtttttcttttaaaatacatatatcaaagtttctttgaaaagttgaataaaaagtaggttgtgttcattttagcaattaggttgggctacttcgtcgttttccataagcacactaaccgatatgctaaacgacacatttcgtgcaaaagttttctatatagaaatttctttaaaaagtcaaataaatatgtttttcaagcttgtgataattagtactagattaagcatgcgctaattcttgtcttcttctatgggccatcgaatacttcagccgatgtacacttagaacgcagttgaattgaagggataagatcgctcaaatgggaaaagataagggaaggttctccttattttaccaaaagaatatgagtgacacctacatgatagcaagctcaaacaggaaaaacgaaaaaacataaggaaggggcaaggttctttctattttgcctgaaaatataactctcgaagcctttaacactactcaagaatcgatttttcgaacaacactcctctaggttgcaggcgaactataattgcctccctatacagaaatcgctccctcgaggacaattcaagacccgcatgcaaaaaatcatttttgttaggcgagcctattaacagaccacatgtaaaaagaaacctattttcgcaggcaggcctgctaaaagacccgcctgccaccaacccaccattgcctgctatcatcctaaaatatctaatttcccctctcctctcctcccccggcgcccctctcctatcccctccacacccgaggccgacggcagggagcggcggcaaactgcgactccgatagcggcgggcgaggaggctagcggaggaggcacgcatcgacggtgacaacggcttagcctcataggcttcctctctctctcttcctcctcggattcctttctcccccttcctcctacgacgatgacaagaagaggtggcgacggcgttagatgtgacatatctagcgcgccggcctcaggagcggttggccgcgcctctccccctcatgcgcgaattcagcggcaaggatgatggaggtgcctcgatgcgcagatttggtgttggcagcaacgtggtgggaaaggagcaacgatggagtcactggatctggcgcgccggccatcgaaagaagtcaacccccctcgcctcttcccctcgttcacagatccgacgatgacggaagtggaggcatcccgactggcggattcggtggtggtggaggggtgacaacgatgatgacgacaatgggaggggtggggtgtccacaatgatgacggcgaggaggggtttccacaacgatgaatggtgacctgaaggacggcaggtccagcggcggaagcctttcaacgatggtggactacggcggcaacgatgttaggtgttggttttggggatttttcttttcacatgtgtggggcttaactaaccaaccgcaaaagttgatttttcttttttatacagttgtgctactggcatgcaaaaatagttgatttttacatatatctccggacagacggtagtccaaccgcatgaaaaaaaaaatcagtttttatggcgagaaaagatattttctctagtattctacagaaaatattatccttcgtacacttttgtgtacactgtacctagctagttcgcttcaggccttctgctagtcaaccactcctacgaaaggcactgtggttttctcgcggcatgtcaaactaccaatcaaacgccaacaccggccgtccgaataataatccgtaggcactagccacgagcccaccaacgacgtcaaccacatgaattgtcccttgaagctcgtacaacctcgcgaggccgcgaaattctcgagtgtcaaaggcctcaatttgcaagcatgatcgacgcgcgccgtcggcgtcgtacgccgaactctcgtgctcgcaagcgaccacacggacgtggcaggtatagagaggccaatagaccatgcgtgctacatagtttgcccccaggtgcgtgtacgagcgttgtttgctaataacgtaacgacgattgctagcaattactgcatgcgtatgattgtgttttgcgtattccattgggcagatgatggaggcatggattgttcctcgattactctcaactgaagtgatcgggctacaggaacggcaatccagtgtgcttgattaaatcatcacatatataattgtaggtacatgcatgatgcatgccgatattacaagtcttacgtgctaaaagcacgagcagatgctctggtcagctagattttaattgttgagtagaagcgaagagtttttaggatggaggtgattggagatgaatgggtcactacatttaattgttcatcttcggagacgtgtgcagttactagtacggatgtcttcgcgcttcccgaccatgtgcaatgtacggtgccaacttacgaggaatgggaaccaaaatctgttaaagtgtaattaaacaagctgaacataagcatcaagccatcaacttgacctaaaacatgagcacccatggagaaattagagaaactctgaaactggcgtggtggcattgttgggaaattttatttctcggcatggaaatctagagaattcccgcacagcaatttttcacccgttgtctacaggattaacatgatttaatttgtgattatttccataattacatgactatgcgcattgatcggtagcaccaaacatttccatgttttcaattgcccccgatctccctcagcgccatattaatagcggagaccggtgtcgtggaaagatgacaatctctccacgatcgtcttctccctgagaaaaccaaaaccgactgttccaggagtgtaggtggcgaccggaaggccaccgctaccctgctagtgatcattggcaaccccttcgggatcaaaccggcgtcctcactgctacgactacttcccctacgccgatgctcaccggagcagttcgaggacgtcctctacttccactcaggttgacgacattgcagagggaacaaggagaaccacatcattggcttcaaacaacggtcagtaactctaaaaattccgcattaggatgatcatgtttacgctaagcactcatgttagtagatcacaaaatctacagtcatgtgtagattgcgcgactattatattgcaaatttctctagtaatagttaaatttcatatgtgacatcaatacagtgccactcattcactagtcataggataattctacctttagacatgaacgagtaaccgtgcacgtgcaatgcacgtagtaacaaatgtaaattaaaactattgtgggagaaaaataagaataacaccaagcaagttatacatgcatggtagcaccaaagaatccatcaccagaataaatatatactgtatataaataagtgaaagtgctaagcctccgcattaatttgcattggatttatactcttatgcccgttaactgggtctttgcgaggaacatggacagaggatcagggcatgtacaatggtctttattagcggtctctctttattgtcatgtaagtatatttggtgatgtggaagagagagaaagaagaaaagagaaagatggttgctacgcatgacaacagcatagaatcgactgttagcatttattaggaaattttttattgcattgagtctaataaaggaaagatgactagtaagaaagtattttggtacattaatgattagagaccgtattgtcttaactattgtaacgtgatagcctctaattaacgtagagaccatatcggtctctacctttgtacttgccctcatacccgcctccgctagacccgatggccaatggggactttccccctccattttagttccatgtgaagaaccaactacaaccgtcatcatctcctaatggtagagtttcctgcgggaaaagagagaatgggaccattatattgacatatctactattgcttctttgccggtactcttcggccacacaactctttttatgcatttccatattgttagaataagtatcgaatatactagttctatttgattatagttagatttggagttgtaaattacaaaatcatgtggttatcatttgccataaccttcttagtttttaaaaccatgataaacctcgcagtaaccgcacggttttcacggtaaccacgtggttatcgcgataaccgacttaccacagggtggcggtaccacgcccaaaatgatttggtgaaccatagtcgtataataggtggtagggggtagagttagattcggccactgtaacccggtgttaacaccaaaatttggtaggtctctttggtggatttggttaaggaaagaaatcgattagtagatgaaagtttatctagataaggccaagttcaaggatgaatcatgaataccatgacaagacatttttatattttcttagtatatcttttaaataggcaggattagtcatttttattttcttgttatgaatttttatctcgtattcgatttgaacttgcacaaattcaaaggtataaatatgtacactcgatatctttgtaatcatctccttatatcaatacaataatattttggcgcatcatcacccttgtagtttcgacatgttcttgccctcaagcggggttgtatcggttaagttcaatttttggcgaag

SEQ ID NO: 19997 - DNA, 5185 bp, Oryza sativa
cttccaatttatcttgttagttgtaagatccaattaattaacatgcctgaacctcgtcaaaattaaggatatgcactagagttaaatagatctctcatgccttcgtatgttagaaaaattttatagcaacacctggtaaccctttaaatacagaggggacacaccacacaatgtaactatggtgattgcaatatagcgtagatacacaggaagataatggcaacaagatcattgactcgtagcaattaggttgtatatacgttgattggggaggagcgtccataatcaaagccccgaaaattaggttaggattgaacttcattaacaaagatcgtgtgctcatacgttgtcatctggcatgtatttgagtgatcaatgacataaacaatcgggaaggctagtcgtcgttccactatattaactatcttttataacacacattttataagttttttttttctgaaatggttcccaataaacctttgtgtaccgcaggtccaagaatgatccctacatatgtgttactgtaggaacatgctactggcaaatgtgcacagccgagaaaatcaccaaccgcagccaatccgtatatatttgtgcgccgaatgtatttgcatggtctagcactagtagtagtagggttttttttttcatcagttactgtgctagctactgcggatctaaagcaaagatacgcggagatatggccatgccgggacggacaagatcttgcattcaaggtgggtcggaaccactgcggatggatgaactctacgttaccccgtcgcccgtgcacgcctgttactgtcacgcgcctgcgcctgcgtgcatatgcacgcgcgaccctctagtgacaagtgagtaatgggtcggaagggacggcacgccgtcggccagtcgcgcacagcgccatatctcttgagggtcgtaaaggtgatcagtctccctccacagattttcctccgtgcaaaggcccccttttgttcgaccacttttgtgcgaccccttttgtgcgatcggtttcgctcgtttctacttcgtactcggcttgaacaggagatggaactactcgccgtcagtccgcggagaagctagtactacttctgtttctcttgtcatcgactggcttgcacaattgcaccaccgacccagtgtcgggcagtgaatgagcaattgagcgtgtgtggctacaatttactgccaccggttcgactaaaaattcactccgcacagcatatgtccccgcgtcactccagcctcaggggcgacgcggggcctggccgccgccgtcctccacctcctccccttcgcctcgctgccacccgaccagcccatggcaaacggctgcctacaaggacggtggcgacggggcttcttccaccggtggcatcgtggttagagtacctatgtgtcgaggtgaagatgtttcagatttggatcaagcgaggagaagttgggaggcgctgcgccaaccatgataggaggttgcgaggcaataggagcggctggacgacaggcggcgaaggagaccgtggctagccatagctgccaagatcggatccttccaaatttgcacggtgggtgcctggcggttgcggggatggcgtctagatccggcgtgctcctgaccaaagctgcggtggggtggtcggcgtcaaggcggcgtgacgactggcgatggcatgcggccagggaggatacagtgaccgcctacatttggcgtcccctagtgaggtggctctcgacaaacgggcgatggcggcggtgccgtggtctatgcagaaggggagagaggccatgtgatggcaactttcttcctctgcagcaataggctacagcacagctggcgcggtgctggcgctttggctagagtttcagtggcggcaggagacaataggacaaggtggcggcgatgcggatgggcagcctatggcgacatggtagtctggccaaggcagcgatgacggggtcctgatccaaacgcctgtcctattttgatggcaccttacctccacaagatgactacgttggcatgctagtgtgggggagaggggatgcattcttctctctcaccctctccctcttcaacttaaccatatgcatggattaatttggagtgcattggatgtcgagctcctacttaatggccgtccggcgacgagacaccggtgcggtgattgtgcatcaaaggggtgtggttggtggtggtctctatgtccagcaggagacctcgacacaagagtgcaggaagattatgagtgaaagcctagcatctttgtctctttgggccagcaatggcgacgcatgtctgcgccatttttctccttgggggtgttgttgagtgatttctcttatcccctgatggattcctctaggtgaaaaccatgtcctgcaccctatgatagacggcggtggcacactcgaatgaaggcgtcgtttagatgattctttttcttcaggatgtcatgtttctatttttttagcgagtttctggttaagacacgtggtgtggttatcttttcttttcctgcttatagcattttagagctgtagtcttatttttttttctgttcaatcgatatacacaacgtcgcactcttatgtgctatgaaaaaaaagtcgctccgtttctcgtttccgaacctctcaaagccttgagctcgacgaaaacatcgcacgcttgcgcagcacgaggcggaatggtgcaatgctagcttattcacggtgaaatattgctgccgagccggcccccgaccgaccacgcgacggatggcgacagcgagggggcggcgcaacaccacaaccacaaactggacggcgccgtgcgtgcgtgcgtgtcgcgtcgcgtcggcgggtgaaagttcgatcgaccggacgcgcaccgaactatcgatcgcaacgagagataataggggattcgcttggtattactgctgctactagcccactatgcgttccattatcgatctccttttgcattagaggacgagagcgaacgaagccgaggggtgtttttgcctttccggcgttggtttttccgggggctcgaaacgattgtaaccacaagctcaaggtaaggctgggatcacgctgtgtgactcggaccatgggtgggcactagccgaaatagcctacctgacctgtcgatcgtactcgtgattgcctctggctgcacaccctcgttcgcaaagtcggtccctttcttgggctgttgctactagtacagtagtacggtcacggtagcaacaagtgctctgatgtgaatgtgaatatgtgatgcgaccctttcggaaagccggattagaaaaggaacaaattcgtgccagttacttccggattacgttcggcaaccacgaaggattaatcaaggaggagagacggttaagacggcaatgcttttccgtcacctctattttcccaaagtgcgatccaactccaagtcttgcgcggctgtcacgttcgttctgacggcactatcactcacgaacgaacccaaaaaaaggtgaaaaacgacgagccccgatcggtcgccgtcgcatgaactcagagacgtcgttttccacccgcgtcacaccgcagcgataaataatttggcccgttgcgtctgttgtttgctccgcggttgcatgttaggtgagtgaatccgagacgggaactgctcagctcaaccacgaaacgaaacctgtttcatcattcgataaagcacctcgtcttgccggatcagctggggtggcaggaaaaccgaaacgtgttcgttgatttttcccatcggctttggctttgtccatccgctgctagagaggggaaaccgttgctgcagtgtgctcgacgccactatcatctgaactttgcctgtacaagaaatcaagattgaagaatgcataggggggcatcactgtcaggtataattgctacgcagccatggacgtgtactagtatgtagtgaagctttcgcggcgtgtttacgtgttggggaaaggtgtcgtggctgcgggtgcgaatgttcactgacagcgagacggctgttcccggatcagctgttccagtcgtgcaggtaggcaggcaggcaggcaggtgtggctggtgagagctcgctcgctgcgacctaacgctgatgccaagcgcgagctcaaatagtcgggagattcagatccccgccgacacggtggtggcagcgacggcggccggaaatattcgtagtatatttcttgacactcccaggtcccaactgcgcggtctataaagctcgtggttcaggtatctgaatctttcggactgcttcagtgttctgaagatttgcaggttaaaagcaaaactgcccgggcgatggccgacaagtcaaaaatcgtgaacacgattgcgcggcttcagagtttaagatatttggggctggtttggtttgagaactaaattaggtttatcaatatttggcaatttcaatagtgtttagtgtctatttagtttgaagccaaattttggcatacctaataaaataggccatttcaatagtgaacttaggctattttggtttcaatccaaacacaactttgccttatcaaaattagtcatgccaaaacttgtcaaaatttggtaaggcctatttaggccacaaaccaaaccaaaccttggttccatctgcccgtatctttgtaggggtcatggctggttaaagatcattacttgcaagttaaatcactagcgagaatttggatattcgatacgaggaacgggtgggaaacatctggaataataatggagtttattcagcaaaggcgtatatgatctcaactgcttgcgcattgtgaagtttgtggttcagatatctattaatagagaagggataagggcagtggatgaccgacaagtctgaactttggacacaacttaaagcatgtactactagcttcagcgttcagattctccaagctaaagctatgaccgacaagtctaaatttttggacacaggtgcgttgtgccgattcgcgtgtacttccttcagagttcagactatatggttccacgcgcagtagttcagaatgaattttggagggttttgtcctcctttcttctgttttaggtgtgtttagttcctgaaaaaagatagaaagtttgaagaaagttgggaatttggaaaaaaaaaagttagaagtttatatataggaaagtttttgatgtgatatgatgt

SEQ ID NO: 19998 - DNA, 3540 bp, Oryza sativa
tctaatgcaagttcaatagatataggccaagtttagttccaaaaatatttcttcaagacttccaacttttctatcacatcaaaattttcctacacacataaacttttaacttttaccgttacatcgttccaatttcaaccaaactttcaattttagcgtgaactaaacacacccatacgcgggcaacatcccttcttacattgcattaagaatcattcagagaaaggcaggcgagcacgcgagatggtttggaatttacagaagaggattcagggagtaggatacacatggccacagatgcaaggatatatgtacatatgatacatctctgtccggctataacggtatgacttttgctcgctacagaagctgctcttgcttacaagagtagttcctgcgcagcattgttgctgctgcctgctgcgtcctttgcagcttcagtgtgatgagccatgagctaacaaacctaactgggtacttcactagctcacagttcctatagctgtaagaatgatcttgaactacatacatgacttaacagatgacaatcataactacagtggcatgtacaacgtatatacacatggaaccagggagttgaggttttcacaaggagcccaccaggagtttacgtgagagcttcattccaatttttccagttaaagaaacctgcaaaacaccatgcaaatcaatgcttaaattattggcttgtgaactatgctcaaacgagtactcagtaagtgggctgggattgcattaacatgttatgtgaactgcatccataaatagcgaaacgtgcaatatgctcaatggtaagactagaagttaatgtaaactcaagagtgacaagtatatgcaagatttaaatatgaacaatagcagattgaaacaggcacctagtattattcctaccaaaataatatcctcatcagttccaaaggacttgcgggcctgatctaagctcttcattgacaccctttcacgctgtctgaaagaatcaacaaacaactgtaactaagttaaatcttgtcaatagggacatgctgtcatgcacataaagttaagcggaaaacttttttcttctagcgaaggaaattaagcagaaaaccgtacagcgataggtttctcagtcaaatcttgttccgggggggtgataatcatacatagctataaatggaccctgacatgtagcatataaatatgttcaaagcagaaggtgaatgttctcggttactggtcgtaacaagaaactaaatgatccttgcttctagtgagtgttatgcccatatcagcatgacgctattaaagaagcacagtttatccatctgaaaactcaagtgtccgctattaaaagatgtcattaacaaaaggtgaatattaggtacctcgaactggcagggtcccttatctcaaattcgcaagcatcagcatcatacccacatattacaacataatgccctgcaatggaagacagtattaaccatcagaatgaatccttttttatgggcacttttgcagacagcaaatggattcatggaaaaccaatccatcaacgagcttggccactcacccatgtaatctgaatcctcactgaactgttgcatatcttgtagatcattgctccatgaggaactgcattccaaaaatcaagttactgacacactattattgcccatttcaaatgatatgcagccacttcaaaaatgaaatcaaggaacaatggttattgtttgtagaaaaattatgcatataaaaatccatggatacatccatgaaccattttgttccgaactgtaatcttctccgagatattctctcaattaccaagtaactttgggaacagaaagggtagtgccaactgtatattactcaactgcttcatcaacattatcagtttgttactacataatgttggcacggttgcaaaatattaaactaataatcaccttatgatcgttaaatcaaaagaatttgagatattaaaatgagacaagtacagcaagtaacattgtccacccattgcatttaccattggacaacttgcttatgaggcgatgtctgaatgccgaagacaaatgtaagactgtcttaaaggagtaaaagtattgacagaaatacagaacaaagtatacttcatctcacttgctatgaccaaaaaaatcccttacttcaattttgttttgtccactagtgcgatagcaatgcagtgcccagataacagtagaaaagctatatcatacgcactgatggatctgcactgagaataaccacaaattgaaaaattaaaaaaaattgaaagtgagaagtacatcaaatagacaatttttatgatgtgcgctgtgatcttacttgaatactaattccagcttcaagggctctgccaaagagctcatccactcgatcaatgtcttcttgcaattgctcctatcgacattgttatttttgaaactgttactacagtgaacttcagaggaatcggtaacattaaattacaattcataccctataaaaggtttcagcagaatattgcggatttgctcctagagtcacagtgaagaaggaaaaacaaactgaaaacctgtttaacagatatgccaagtcaactgtccatatgctgcacaacccagaaatgtcagattgttaatacaccagacgtgctattaaaatttttaataggccaaaattaaagagaattaaatattatgtccagctcatctagggaatgattgtattgcaatataatatatccacgaatatttctcacgtctaagctactttatgtcctcataaataattgtcatattacaattgaaatgcacaattttttattctcttccaaattaattttcacctaagatggaattatttgcaaagagcattttaactacaccggataaaagtgattatgcagtgcaaaatgtgggaacaatcaagtggtcaaagtagtaacaagcattcatgaactgacagagtaatcactgttcgttatccacgcaatctcataaagaaaagaagaataattatccatgaataaacaaatgattcggggtatcaatttttttcattaactaaggagaattgcgccccccgtgtttagttgtaaactcaaatttgaagtaataatctagtccaagagaggaacctcgtggtgcggcagagcttctcgagatcggcaatgccgtcgcagcaatccatcccgagtgtcctgagcaccatgagcacgcaagcgaggccgcagtcccacgtgaaggcctgctggacatgcggaacctagcaagcatccatcaccagcgccacgaacccaaaaaaattcgtcagatttaacagcagcagtaaacacgacgattattacacagccacacgacaccgccgcggaaacacaggatcagcaaccgacaccaccccgagagacaataattgatcgcaaccatagagcgagcgcgcgagcgcgcgcgagagagagagatagggaaggagggaggaactgacatcgacgtagtacgagcggcgggctagagggacacggccgtcaggggccgg

SEQ ID NO: 19999 - DNA, 3666 bp, Oryza sativa
aattcctatgatgttttctttatttcaaagggggccgaactatgggattttgaaacacaggaaagtttccaaactatcgtttgattagcacacaggaaaaatacatgaatcctgtttggggagcttaatattctgataaacagctggttggtagccagcttctgagaatctggaaaagctgggtttaccagtttctggcttctgagaatctggaaaagctgggtttaccagtaaaatacattccataggaatttcaaatgaactcataagaaacaatcctttgtttcaaaggattataggattatttcccataggataaaatcctctagaattcctatgatttttcctttgattcaaatggggcctagtagctgcatcttcatacataatttccaattcctcgaaacagttcaaatttaggttagcactctaagggccactttgaatcacagggttgaaaaaataaaggaataagaaaacacaggattccgacaggaattgaagtgtaaaatagaggattgcgatacacaggaaaaatacaggaatgatcgtttgattggaccgcaggaaaaaacgtaggaatcggatgagagagatagactcaaaggaaattttttaaaaggttggaggtctttctaagtttcctccaaaatccgcatgcaatgtgtcattccataggaatcataggatttgaaaaacttcaatcctttgaatcaaatggccaaatagaaaattttcctataggattttaatcctatgaaattcctcataaatcctttgattcaaaggggcccaggttgaatatgtagttgtataagcaataaaattttgctatctatttatcaacaaattttctaaaaaaatcgacagatgtaaatatagtataattacttcgtaatttgcatgtaactaaaatataacttaacttgtatgtaaccttaaaaaaatttgtgataacatgtttttttcgtgaagcggaggttacaacaccaaatcctctcacttctgtgtgcgttgtgttgttttcttcctcgcttacatgaatcttaaagcaaatttaatggtttcataattacatgaaagttacgtaccagttacaatgtaattacactactattgtattatatttacatttacaattttttaggagaaaatttgtggataaatttgtagatagtcccgaagcaataagttaggaaagtcatatctcaaaaactaaataccaaccaatagatttttagaatcttaatcccccaaaacctcttcagatgtgcataatctcccccaacctcttcagatgtggatcgtgtgtttgtcgaattggatagggcattaggacgagtatccttttctttaggtattgtacaaggtggcgttactatgcaccggcatttatttaaaccttatctggtttgtggtttttatcaaaatttagtattttttctaaaaagaaaagtattggtatggttgagacatgcttggtctcaagccttactgaatcttggtggtgttagaatggaacacgtattattttggttgctcatgacacgtataaccgtttataagtcagattaaaaaaatagggaaaaaatagccaccatctatgtatatggcgtgtagatttgtgtaataactagaaaaaaatgttcgcgtgttgtaacaggtaaaaatgtttttccagtgatgcaatagctattaggagctgagcagtaaattaaaacattcgaatagctatacgttataatttgaaaagattaatgaaaaatattccttggttttcagttgaaagcctttttttttcttcattttcaacatcagcccagaccgctatctccccgtgctcggcctatctcttcagcccagcccacaagttgagccacatgcccaacttgtatagtagactatcgtcttcaacctccggaagatagtctcgttactgcatgccgaagcgaccctcccaatcaaatttggcagaatctttctcgatctcctaaaattgattgaaggcttttgatccacttgatctcctctttatgtttttcctaaaatccgagcgaatatgcaaaactcggataaaaacagccgaggaagctcaccggctggccatcatcagcgactgagattaaatccagcgaattaaaactgaaatgaaaggtaaatcatgacgaaaatgatgagggaagagtgataattgatttttgctattaattggaggagaaaacacatgggtaaacatatcgatgtggcagcggtactagggtttgggccagtggtagtgggaggcaaaaaaaatgaagattgaacatctagtgctaccttgcgcatttttaattaggtatagatacatctaatgttaccttgacatgtcaaggcgacgggtccaataggataaagtcttgtgttaatttattctcgtgaacaagtagtatcatatatgatgcatcgatggaccatcttatatatataaataccacaacgcgaccttgctcttctatgtgtatcccacttcactgctacgttacatatagtttctaataatagaatcacataagagcgtgtatgataaggtgatataaatgggttataatggttgccaccttaagtgttgagttagaggagagaggggacgagcgaagagaagttgtatccacatctataaccacatgcacatggttgtttttaacaaactttatgagaatgagatgagttaggtattaacatagtaacatgttgggagagccaacgtcaggatcatgtccccattgcctacacaatatgtattccttctattcaactccccctcccggaaagaaaaacccctcctgcacgctaacctcccacataaggcatgcacccttcttgaactgtgatccctcttttgcgccgcaccatctatattgaatcatcctggcacaccatgtcttttactaagctgcaatctgactatctaggttaagtgaaataagaaagaggatatggagtaatatatatctaatgaaggtatcgggttgatatcttcggataccgcaactccttcatgtattatgatttgatgatactttctgacattattttttttaggaacacagtatatgtgctcagaacacacgtatactcatccttacgagcgtagacatgcacaccatatccctttgaatatcttccgaataccggatcgacatatcacgattatcttttaagtatcatgaaggtattataaatgtatcatgtatcatcgtattttaaggtgtcacgtaggtttcagataataataccacttgattttattattattcttactctaacagcgatgcatagacacgcatcctcttttgcattctgccgttgtcgtttggtggtgcatgttggtcaaaacgtccgactcgagacgtacgtagaagctgtgatggataaggccggagttcttatttttgtcgtgatgccacatttcagcgttcggtgtgacccactttaggtgcgtccaccacaccatgtgacaggctaaagtggcccaaacatggcccagtccaaagagctcgatctgggtggaagagttgaaagcgacccggcagatattttgctcttgatattttcacagcagatactttgctttttgggtaggagcagatacatttttcttgtgttcaaagaaaaaaaaaggaaaat

SEQ ID NO: 20000 - DNA, 12620 bp, Oryza sativa
  unsure (1)..(12620): unsure at all n locations
ctattttccgcctctcctctttgggctgacatatgtatagctaaaataagtctattttccgtccctcctctttgggctgacatatgtatagataaaataagtatattttacatccctattctttcgtccatggcatataatatgtgtatttttactcccctatttttttttgtgtgtatcaggcctgactgccggcccatcgtgccatgccggtccggtcgtgctggcccagcccaacgtgccggtggagggcccaggcataacctggtggttgggccgggccggcacgggcccgacctccgtcgggccgtaccatgcttgggccgggccaaaatatcgtgccatggtccggaccgtcgggccttgggccttttggccatctatacgggagaggagcgatcgacgcgttcttctctctctccctcccggcgatccttcctcgccggcgagcgcacacggagagagaaaaaggttgcggccggcgaggagggcagagacggtcgctgtccaccgcccgctgcgcgcctcttcctccgcccccaacttgcgattctcgaagcagcagaacatgatctgcaaggaacaaaacaagaaagaaaaaggaaataaatcaaaggatgcacacgcacgccaattagttagcaagaatgatcaaccaagcaaccaaaactaatcaaacaattagttggagtagatggcggagccgagccggcaaatgaaaggcaggattaattgaaaaaggaattttgtttgggttagctagtactacacacctggtgaggaactcggtgatggggtgggaggagatgatgttcgagcggtcgccgttggcggtgcgctcgatctccgggcggaggtcctcgtaggtgacgatggggacgcgcgccttgaacacctcccggtcggtgcgtccttccatgccgtggcggcggaggtactcggtgccgttgttccgcgccaggatcgccgccagcacccgctcctggaccgcgtagaaccccctcgtcatctcctcgatgaactccagcttctccgcgtcacgctcccacgccgccacaacatcccccccccctcctgccaccttcgaccccgcctccgccgcagccaccgcagccggagccatgaagcactcagacggcgcacggatccaatccgaacaccaacggagggcggcgaccaacggatccgccgcctttttccctctccgtgcgctctcgccggcgaggaaggatggccgggagggagagagaaggacgcgccggtcgctcctctcccgtcgtccgtggatagggaggatggtgggtcccactattttttccttttgtctaactgacatgtgggccccacattttgtttttattttttatttttatatttttcttccagtgccacatcaccaccacgtaggacgaggaccaagtcaaaccggtcacgtaggcgccacatcagccaaaaccaccatcaaaaccgttaagggacctgcttttgctgatgcgaaaaacacgaggcgtgagagatctgcttaactccagtgctggtccaaaaatcttgcctttaggttcgtgagcgtgccagttgatttgatcctgccatcaacaagaaataaaaacagaaaagtagtagttaaatccacaaacgatagtcgatcggttagctgccgatgacgtttcatttatctttgagccgatgtcatatatgaatcgatcggcaatcataaataagcataaaagaattaaatctattcgatcggctgtagatatcaatggtatataatacttctgtcgatatatacttaaatcaagtgattgggatagatcggtcgccatgccgagacagtataaatcacttagatcaaaatatatattaacaaaaagattataaacatttatagcatagccgatcagataaatctagcatgtatcggctaatactccgatactactctatattaagatattaaagcaagtaaaatatatatcaaacagaagcctaatatactttgttgtagtaagatcttaacataaagggcagatctagcatatcaattaagcacgtaagatttaaagctaaatcaggtaagatcggctgaaaccccaacactaccctaatcggcaaccaaaagcaggctagagattgagattctaagcacgacttaatagatcaaactcaactgatgcagcattaagtatgaaaaaaagaacaatatcttgacaatcaagctgttggatgtttcatagagtggtggataccctatataatctaagtcaacgttggtatttaacctgatcggctgccttctagcgataaatgttagccgactaagggttaaataacaatattgccagagattatataggatatatgataactcgacaaattacataaacaagattagagtatcataaaaatgaaagcactaatcccgagaacgcaagccgccataacaagttttacctctagttgaagatcgaaatcgatgcagctcaacccgaaagaaagaactcgtcgaaacaaaacgaaagtaaagggtggcgatgcgccaagattgtattgaacgtgtgttaaattgattatatggggctcggggtctatttatactcgagattacaaaatatgtcaatgtcgaacacgactcttatctctaacaaactctaagataccataagtctttgcggctgacttttactcaaacctatctctaaggaaattacataaaatatcctaattaatagatacaattgtcttttcaggactcaatctgtgcatggcaatctatatgaagcactttaacctaacccgatgtcgtgtaacgagtcatattgtcggaatcggcttaatcggctaaccttgtccgactcgcactctgccgatcctgatcgcggccgattcggactttagccgattcttgctctgtttccgaaacgatctccatcttggattccgcttcagttttaccttaacctccgatagttgaattaccaaatttggttattaagagctttgcaccggttttagtagttgagggacccgttatatctggttttccagttgaaggacgaaaatcggattcgttgataagttaagggacctcaattgaacttattccgtacttagcagccagatcgatgggagagcagtgtgcagtgcatgggcctggcctttcagagatgttgaaagccctcgacacatgctttacactccatggatcaggtgatcaggtcctgtagttgtctgaaacgctgcaggctgcggctgacacaccctacccgtgcaggcacgtggctgagaaaaaaaaaaggttatcgcaaagcttttgacaatgccgacttgtccagtgcttgttgcgtggtgcgtagcgactggagtagcgatggcactcggtgctacgagtaaacgaaaagatggcactcgtccatctgttacagcactacagtaacgtacgtggtttgagtgtaagcaacctcagcctattgaataagcacactgagaaggtgcgcttatctcgttctgctctaaagcaagcaagcaatgtccatcgagccaacatcacatgaccagaaaggaaaccgagagaaatccgggagacccgccagggcaagagaacgttctcccgcacgcgaacccgaaacagctaaaccttttcccacgcctcacgcggaaacctcgtggatatcgacgtcgtcgtcgtggcgactctaccgcgaccggctgcgactcccgcggtgcaaatcctaagtccaaaccaacgcgcccatccacagaccaaaccccacccaccgatccgccgcgccgcaccgtgccgcggcgtcacgcacagcgtgcgaagattcgcctcgcgctgctgtgcacgctgctcccccacggcgcgcaggcgcagcggcttgggcgcgacacgcctccctgatgagtcgtgagtcgtgacgccaccccgcgtctcgtgccccgcgccccgccctttccctttttataccacgctgatcgtctactccaatgtctccatctcgccacattcgccgcgcgcgtcacacgagcaagggagcaagcgaggagagaggagaggcttagcgagagaggtgaggagaggagaggatttggaacttttgatctttgggatcgcgagacgacggagatggccggtggcggcagggccgatgacgagcgaaggatcggggtggcgatggactactcggcgagcagcaagagggcgctggactgggccatcgccaacctgctccgccggggcgaccacctcgtcgtcctccacgtcctgcatcacggcggggaggaggccaagcacgccctgtggggcaagtccggatcccgtaagatccgcgaaccaaatctcctccccctttctgcttcttgcttttgctcgatcgatctcggctcaaactaatgtagtggattccattcctccagcgctgatccctctctccgagttccgggatccgacggcgatgcagcagtacggcgtgcactgcgacgccgaggtgctcgacatgctcgacacggcggcgcgccagttggaggtacgtgcgctctcgtgtagtactagtagcgtcacggttttggggctggatcggagacgaaaatgaccgctgttttgttgctgttctgatcagcttaccgtagtggcgaagctgtactggggcgacgccagggagaagctctgcgacgccgtcgaggagcagaagatcgacacgctcgtcatgggcagccgcggcctcggctcgatccagaggtataactcctacttctgtttgcaatgttgttgcctcatcaatcaagaatcaaaattgcaggcattgaccatagaacttgcctttgggccagttgctaatattcctgttcagatagacaagctctgtcgagaacgatgcactgcttaaatcgataattaaactacatactgtgtccagttccgtggtacggtagtttttaatctcaacacataattgcattgcactggaaatttgggggccaaatgcgtatctgacttggccttgcaacttgaatcattacagccaatgagattggattatcgagcatttcagttgcacttgttttttctgtgggaccgccaaggcatcaacttgttgccttcacgattaataaattgtaagagcaagtacaatagctggctataaaccagctgtaaatatattttaagaagataaatgaggagagagaagggtagtgggctacagatttgtagccaactatagcacgaactccaagacgcagtgtgtgtatgacaggcgggaccaaatattaatagtgtagtatgtaattattgtataaatgagctattagattggctatagatgaattggagctagtagttggctatactattaaacttgctctaaagtcgcatgttcatccttgagacatgtatatcctgattcttggtcggcgcgttgttttatgttctcatgtgaaactccttttcatattcaaatgtttcccatgtacagtttgagcataagaatgatgtatatatatagagttagttcaacaactagaatgcttgtgctatttcaatatccaaatacagaagtttatatacaggaacgtgattatcttggttttagcctcttaggttagtgtccacgtccaaagactataactatttagtctataacatattgagtggatgatatgcattgttagcttgaaacttactattgtcatcttgattcagaacagaaaattgtgaagtttgaagatgcgatgtctaatgaacgtttgggagtatacgctttgcgcatatggcagtatttgtttagggctggtttggttcgatgcctaaattagtcttaccaatatttggcaatttcaatagtgtttagtgtctatttggtttgaagccaaattttgttatgcctaagaaaataggtcatttcaataatgaacttattagactattttggcttcaatctaaacacaactttgtcttaccaaaattagtcataccaaaaattaccaaattttggtactgatagaatttggtaaggcctatttagaccacaaaccaaaccaactctttagtgattctctagcttctgaattgaatccagcacaccatataatagtctcatcgactttttagctcgttatgatttcatctgcaactttcctgtctgccaacattttacaggattcttctggggagtgtgacaaactacgtgctgtcaaacgcatcatgccctgtaacagtcgtcaaggggaagtgatcgatgattcgacttgagtggatatactgttactgttgctactgtatctgaataaagcgtgtatggaacttcttttgtgtttgtaatgttgcagccttcccaggttcttctagacagttcactttgcaaacagtccatgcttgtgtgctcaaccatgtgaatcactttatatatatagaccgaatttgaggttttactttcatatgcctagttttgttggacctaactctgtgaagtccaaattctgtacaagtaaaagaaaaataaacatacaagggatgtttaaattgtagccaagataaactttaccaaattttggcaatgcctaatttttggcaatttagcaatattgctaaaattttgataggatttcttatgtgtttgttaaagtttgactaaaaaattaaatggatgcacatatttgataactctaaaaaaaaaggaatatttaaaatgacatcaatctgagcaaagcccacataccacaacggctgcaagtttgcaacaaagaaccaactacttaccagaacaaaaacagaaaagatcaacaagtgcacagagagagtgctgaaacaaaattgagaggttttttttatgggaaaatttactgaacttgccgtagtattggagtattggtccgttccatttagcggcacaccgtacaaaaccatccagctatttagcaaaaaaaaaaaggaaggataattcattgcttatggcaaatcaatccgttgggcctggaaaagaagaattggggaaatgaataagtccactatacatccctcatcttttagccgagtttaactcatatccctgaacgtaataacggaaatctctaacccctcaacttacaaacctgggttaaattagatctcatgatagtatcaatagttagttttgtcagcgtgccaccctagtcagcaaaactaaaataaaaagaaagcgtgtgggtcccaccttttttactccttgctagctaggatgtcacgtcagtaaaatcaaccatttatactgttatgacctaatttaaactagtcgtgcatgtgtgtgtgtgttggggggaggtgttcaaaatttctgataatgatagaaagacatgagacaacaaaaccgttcacttaaggttcttaggtggttttcaccccggttttgtctgacgtggtggctaagtcagcgtgggacccatgtgtcagggtgtccacgtcacccctctatctctctttcccctcttctctccttcctctctcattttttcccctgggtggcggcgtcttcgatgcggcggggaggagggccggcgtggccggcggtgggggaggagcgcagcgaagaggagggccgatgtgacgggcagcgccgccgatggctgtcgtcgcgcggtggccgcggcggtcgtccctttcaaccgtcggccttaacgtagcccagcaatccaagccaaatcaaaaatcggtgctcgtcgtgatactcgacctcgcgctcccgttcgtgctcctctccgcgtacctccgcgccagggacgcgtcgttcgtggaggccgtcgtcgcgcaggtgtgggttttcgacttccggtcgtcgctcgtcgacctcctcgccgtctccgtcgcgcgcttctgatactctgcgtaggaggaagagagaggaaagtgggcggatgatgacgtggccaccctagcatgtggggcccacgtgggtcccacgctaattcagccgcctcagaggataaaatcggagtcgaaaccactgagaaacattatttgcactggttttataagttaggggatgcgttgtatccggttttgcggttcaagatcgattttgtaactcgatgataagttgagggtccttcggtgtactttttccaaaaaaaaatatcactagacataccagcccaaaaggcctactagatataacgcctcctacggtcctaccaattaacccaacccatcccgagcatggctccacctcactggcccatcgaccaactttggcccatcgagcatggttccccaatttttttttcgaaaacttcacatcgaatctttggacatatgcattgagcattaaatatatagattataaaaactaattatatagttaggtgggaaatcacgagacaaaccttttgagtctaattagtccatgattagccatatgtgctacagtaattcacatatgctaatgacggattaattatgctcaagagattcatctcgtgctttccaggcgagttatgaaattagttttttttcgtgtccgaaaaccccttccgatattcggttaaacatctgatgtgacacccaaaaaatttcttttcgtgaactaaacaggccctttcacgagcatcggcactacctcctccaccgctcccagctagtcgtagctaggaaaaagtacacggaaatctttcaccgaattacaaaactgttatttgaaccataaaattggatataatgcatccgtcaacttataaaatcagtgaaaaaaaatccctcaggagaataatccccggttttcattggtctatgtggctcttttaactaggtgttcgtcccatgttgacattaatgtggcactaacgtgataattcgataaaaaaaataaaaaacaaaacgcctagtactccctccgtcccagaatatagcaacctaggatgggataaggtcaggacaacgaatctggacatagtctcaccccatcctaagttgctactaaatccgtcctaaaatagaacaacttttagctatatagttgttcaaattcatagctaaaaatgcttatattttggaatggagggagtattagaaatgagggagcctatatgggacctacatgtcatcctcattctcatcttttctcctatctacttttcccgtcggagccagtcacgcccgaccgggtgtcgggcggggccccgttaccaacccgccaccttccacctcccctcccttcagccgtacactcccgcctcccaaatttcctcgaaaatttttcccgcgcggccgcaccaaaaattccccttccactccgccccgcaccgccccctagcacggcggcgccccccgtccaccgccagccgcgcgtgcccgccgcccgcttctcgtgcttctccccgccgtggcagatccggccctgcgctttagcgccattccgtcgaacacctcgagcgcgtcggaggctggaggaggatgtacgggcggcgcgcgtcgcagctgctgaaggaggtcgactcctgcgaggccggacagctcgtgccgttcaacgtaagtttctacccccccccccccctaagcgctcgcgtttcttagctctggggatctgagtggccggtgattaggtttcgtttgtggctatttttagggcggaattatggttggtctagctgcatagttgaaattgagttcataaatgtgcattttcaatcctacggggggaatgttatctgcatggtgtataactatcaggcgacagtttaaatttaaacgatttggcttttcggtctggtttgcaaaattgtatgtaatttgtgagctttcatttgtctatcttgatgatgaaatctagttctgaaatatactgagcttgcaaattgcaatcacatgaaagcacataaagtctggggctggtggtctggtgggggttaatgtaagttaagattaccgttcctgtgatgtgactgtggcagcatagtttaattagttcggttagttattatgcttggtccctaacttctttttcttatggatgtgcagagcgatgtgtttgatcaggttattagagagtgcaatgaacacaatacacagtttcagtcattgataaggtaaattgcttcctatcagaaaattgatcatcttcatctagttctgcaataagagttatgatcaattaatcaatttctaggatgtatttcacaggaaaaacagcacagaactatatcaaactaataaaactcttacttgacttcttcaccattacagtttacttaattttgattgcctgatttgcattgtgtttatgacaggaaaatggtggagcagaacttagacattgaaacaaccagaaatgacgaccactatggggcagccgtccatcatctttcgctgcttcgtaacaaaagatgtctcatggcttacatgtacaagactgaaatctcacagctgaacaaactttttactttctatgttttatgctgattttacatgcacgcactaattttgagtatggaactgaaagcactgagttcaatcaggtataaccgagcagaggttattcagagctttagatggaaaatcggcccagtgcttcctcatgaaatacaagaaaagctccatttttctgagaaagagtacttcaagaaccactcagcagccattaaatcatatatgtcagagatggatatagatttaacagtggtacagcatttttctgttttatttactttcttttggatgaaatacagttagcagattttctgtaccacttctataggacatggtgcctcccaaggatccctacatccaggttcgggtgcttgaggacattggtgaagtatctcttggtgaccattccatatcattgacaaagaactcacttcatttcctaaggcgcactgatactgaacaatttatatcacaggtttgctatcttacttttgtgatattctcagtgtgtttattccatctgctaataatgttctatcaaacttacaatagggtcttatggaagagtttctggagtagagatcacatatggtgtacaataggtattactcactaccttacaatatatgtacacgtttcatgatgacagttgacagatgaccagagctagcatgtcctatatcagaaaaggctttgatggtcaattggttactgatgaatatttttcattttacacatataaatagttaaatatcacatttttttaagaaagaaaattcaactatcaccacaacatgcatatattgaatttaccagttctaatagacacctattctgaaacactgtttgtgtttttgatctgatttctcaaaccatacatctctggcctgcagattgtaactgaggatatgactctactacagcatttattcgtcattgctatccaatggattaaacactactgaaattctgacagagcctatgtgaaaatcaaagaacatatgctgtctcagctgtgaaggtatgatgcaacatatatgagggatttgtgtaccggggtgctcctaacttatccatttcagtgatgtctagctttagatgaatgaatttaagtntgttctacactgtgaccattctttgcatgttgtattatttggtgataaaatcgaaacttcgtacactgtacaaaaatcttcctaaatttactggagtaggaaggtaacaagctctgttttagtgtttactggtgatgaagacctggagaagcctcatgcgttctgataaatgcagtttgattgactgctgtgttcgttttgctaaaactacagttctggatctcggatatggaattagtcagaaaacataaccaagctgattccaagcaagaatggtgaacacggttcctgctttcatgcaaaggcgtagtacaccatacatcacctagttaagtttggtatcttcttttactcactacaagtttcttgagatgctcttcttcttgctaacttaacttgcacactggcattactttcatcagactaactgagctctaaaagttgcagtcttttacgtctataatatctgcatgacaccttgaaggttcacttgtttataatgcagcgctagccgctagctgtctagctcctgttgaacatattacatattcatgttagttgtgtcattctatgattcgaaatcattatattcatgagggcatggttaatgctaactacctcacaggaccataaatcattccaaatctaaccggtacccaattcttcttaaaaatgaaaatgcccaaacgtgtttcactgctatctctttatctaatcttcgcatggatgatgctttgtacaattactttgtcgagtggttttatggcgactaataaattaatgctggtgacttgagaagctaatccctagttgtgtggtccatgaacattatcactacttcatttcaaccttgaaaatccaccaaccaagtaccctgtacccaacgccaaaatcctacatatacgctcaaacaagcaatcaactttactccgtgttcttttctctctgttgttttggtattcttgggcacaactaacttgtggtcttgtgggccatgatacttatgtatctgttgtcccagttgtagacgaacctaaggttggtcaccggctaccaaatgacatgacatgatgtctacatagttttgacactactgcggtagtgctaaa

SEQ ID NO: 20001 - DNA, 12634 bp, Oryza sativa
cttttcctacccttgttaggtccacggactcctgaatcattagaaaaccagtacgttaaaaaatatcacgctcagaaaaaaaaaagagcttggttatcttacttctagaactaatcagtaatcatcagctcttatttccaaagatcacattaatcatattgcagcttggcaactactactacttgagttcaaaactttatattttggggacaagccattgcttcgacggatagcaaccgatcctgtgaaaaattccccataaaacccaaatcaagaaattttcaactgctatgattttattttttaaatcactattgatgatgaatagtgattgtgggatcatgtcgaattcaactgctatagtaccctgtttgacaacagatcgagaccttgtgagacaaccaattatggtgagtagctacgcgtattaatcctgttctggcccttcggtgtacgaatttgctaaaagatgtccacggtttttctaatcgatctcagttgatttgtcatcctattgcttattgatgtcttccaccaaatggatcttttggcaagtctatctccttgtgttgtatccatctactctgctctatcgacaaatattactaagcttctactcgtgtgtcagtttgcactttacccttttatcttcttttgaaaaatcaaagatatgtaaaaattatagtgcaagtatatgtaatttacaatgttaaaatatttaactggtttttatgaaaaatatggcgtaaaaaatatagttagtttctttaaaactactggcacatacatacaatggcacgtacttatgaaatatttactcccaactaacatcacatgagatccaatgtaagaaatcatagtgaacttcactatactgttctgtagaatattctcgcagaatttcttcacgtataccatttcactacaataaataactccggacttccatttaattttaaccccagaagatctactgacatctcaaatcctcgtattgcacatttgcacgtacgtaccgtcctcgagcaagcaagcagggactaccgcatttgcaccgtggtactcacccagtcacccacttcacccaggcggcagtgccccatgtgcaacgccacggccatgtgaaccgaagtaccaggtgaccgggagatatttaactatttgccggtagattcaaatattatagacacataagaactcatatgtcatatattatgagtggcaagttcttaattgccatatcttaaaagtgacaaaaaaaagttaaatgcctaggtgacaagagccatcttttcactaattagttaccagtctcttcgtttaacttacaatttattatagaccttaatatttatgaacaataaaaaggtaatttataagtaaaacttttgacttttgcatataacttaaaaatcaatgttgaaaaataaaccacaattaagagtttattcactgtattactaaaatcaacttaccaatatttaccaatattaatttttggtacatattttgatgttactgtattttagtggtgttaaatatgtttagtttttaaacctttttaaaattttggtgatgtttttataagagaattttcggaacttccaaacaacatatttagtttgtcatcctataaaaattaataacaacaaaatttactagagttcaaaatggcagtaaagcaaacaaccagaaaaacatcaaaagagacagtaaagtaatattagaaattcaaattttagttatcagattttggaaggagacagtaaagtaaaagataaaaaaaaaatcaaaatcaactctaaagttaatatttaaattttaactacggctggtaattcctcgaaggcgccgttaatgaccgatgcgccagcgccgcggaaacggacggcatttcgccggaccacggcgtgtcagagagcttcatgtcactgccacggagtacttactgttgtttgaagtacattctgttcaaaaatacagggtacaaaggagcagtggtgagcaccgttattactaggagtagtgagcactcatgcgacagcacttgttattgtgcactacagtagtactcttcttgctcgaaaaaaaaaaaaatctctttcgagttgacaggacaggaagtcctattcacttaactatacatttggatctagctgccgagttagtaggcaggcttggaccatctcccgtttactgaaccaaagctactccttgattgtcttgtttaattaagcaaagaggttttgaccctgatgagtgatgaccatccatcccatccgtgagatgtacggagttttcgaagtgacccatagcccattcaagaccggtaaaggtgagttatacgagtgtacgacatgtgaccgtgtggctggacagcgccgtgctgtcacgctacacactgtccttgcttgaacaagaaaaacacttttaaacactcatccagccattgctctcgctggtgtttatgaggcgcctaaaattttgtcattcacggcctcaggggaccggctacgtacgcaattctggaccagcaatagtgtgctaggacaggagcactataactcttgttttggtctcatccaatcatccgtggatggaaaattccagcatcctagatggcctgtgcaggtaatctggcagtacgccaattgggcgatgcggatcttgtgtcgcacagggctactttacagaagtttcacagtcgctgcaaattttgagaagcttcggcgcatcagcaaaaggacacccaccaccaaccggtagtactactagtaggagtagctaggtaaagctggaggaggttgcatccatgatccatagatcatcaaacgaggccacgaggggggatggggtggcccccgttccccatcattccggccagttgctggctggctcgctcgaatgctcgatgcctcgatccatcgattgcttcccaaccaaacaccttccgatcgaccttgcccaaaccccggggggtgatcgttccttcttaatgagcactaatcacgatcagtcactgcaacattagcgaactcatcttttcgtttatgtgtatgcttattaattaaaatttgaattttcaaccttaacgattttagggtttcttttattgtggtttatttatcagtatttgcttttagttcgttaaaaacatatatataaaagttttattcacaaattatttttcgtttgtaaatatgccgctaaacgatgggagcagtagatttgaaagtattcaacttaaaaagcttatgaccgttttttaatagtccttttactaatgtttatgtggctcctttatatgaagatatcttatatttaggtttatgttacatttgaaagtttttaaataaaaaaactcacggcgccgtcttttacagtctacttttttagaagttttacgtgccttctctgtatatatggagatctcttgttattaacactagcagtacggcaatacgtagtatttatcaaaatgctacaggactacttgggaaagagtagaatgccggaaagaactggaccagcacggccgcagtagcaagttttgatgattttataacggggtaggtgcgacgagtgccatatggtccatatcaccagatggctcccctttcaatacgcgctcgatcggctcgcatgcgctcgttgcatgcatacgagcaactcggcgacgtgggcgcgttttttcgtgggtggggggacgacgacgacgtgtggagtagggtggacgaggcggcagctagcgtccgacgcgggatgcatttttcatggcgccgcaaaaggtggtggatagtgtagtgtcgtcgccttcggaagttcggatcctcgccgagcgcggcttccgagtcaaaactcgcctttttcgcttccaccctcgccgtttctctgacagtggatgcgtcctgatccgcagatggtatcccccttcaaagttcaaccgtgcgcccccacaccattctgctttcttcctctcccggatttcaaaactcagctttcgaagtcactaccagcagcgtaaatggagcgttttgcctagagagaacattaggcatggatgcatggtcaatataagctataacgagaaaaagagagaagacgttgctaacgaaaccacgttataagggcatccacaatgtgagacactcctaaagtgtcctcactaactgaggacactcgtagaaaactcagctcgcaatgggaggtatccttggatgggctcctcaaaatttgaagcaatccgatgagggtactacagcccataatgggtgtcttggcccaaagtaaccccagatgaaaaaatccccaaatacccctcccccagtccattcttcctttttccttctcttttcttccgccccctcttctcgcgtcttctcgcttcttcttctcgccctcctggtcgcccattcgccgcccccgcctcccagcctgccgccgccacctccctcctctctcccctgccgctcgccgccgtcacttccctcctcgccctccccagccaccgctgccgcctccctcctcgccctctctagcagccgccttcctcctccctccgccagccgcgtcccgccgtcgtcgccgaagtggttccagcgccggcggtggccggaggaggcggatccggcgccgaggcgggcagatctggtgggcgggcgcggcggcgtcgaggtggcgggcgcagttgtcgccgggtcatcgtcgtcctctccgtcgcggaagccgagcccgtcgccagctggtggccgccggctgccgcggcggtggccggatctggtcgtcgccgttgtggatccttatcgccgtcgcctctctcttctctctctctctctctctctctctctcgttgtcatgccgccggtgaggggcaagaaggggaaacgccaggagagaaggtagaggacgaggcaccgagtcgctgcaacgcgtagcctcgagggagtgtctctggaaaaagcaagctggggagctagaggggcgcgttccccgcgtggggatcgcgcctccctccagagacatgccgcgcggacgaacggcggacggcgtgagcggggggacgacccagggacaccgattgtggatggcctaacattctccacacaatataagtcttagccacgtgctattttttttacccctcggttggttacatttttatgtataaatccttagattgtttctattcatatataagtccaacattttatagttagaatcttatataagaacataggaaaaaaaattgaattaccccctaaactattgtggtagtacaaattaccacccattcaatttaaaaaacagacattcttcaccctctacattttaattggatgaattacccccttgacagacactatagcggttttgttcctatgtggcacacatgtgatagtctaatcaacataaaaaaaaggggtaatgcccacatgtggtgatctagggaagaggcaaaaccggtaagtgggcctcaccatttttatatattttttaatgctaactggattaccacgtgtgtgccacgtaggaacaaaaccgctccgaagtcgggcatggaggtaattcgttcggtatgaaaagttaaggatgaagaatatctgggtttgaattgaggggagtaattagtactgccactatagttcagaaggcgcaattcaaattttttttccaaaaacctacccttacccttttatcatctccgcccttctaccttttctgagtgcctcgcaacctctaccctctctccttctcggcattgtcgtctatccactaccccttctccttggcgccattgctaagatcccctccctcctccttggctcgaactccccaccccctctcccgtgccagcggtctcgccggattagattggtccttcctaatacggttccagttgtgcttcgctggctgacgaacttctaggcggcgtgaatcgaggcgaagacaaccatatggggttggtgcgtcctcgtgctcttcgacggggccttggtggcggatctatcgtggatgtggtcgaggcaatagagtagtcaacaccactgcaaatcaatgatgatgagtctgggtaggcccttcctctccccagccaccccctcgccatctttgttgttgttgtcaggtccgacctcgagcttgccaaagctacatggcgacaacgaccttgaccttgttcgcgggggcaacaatgcgggagttagttggcagctacccgacacgaggcattggcatagggtgagacctctccccaacgtgtttctccacccatttcttgcacagaaaccacgcataccttaatttgttggggttcacacactccttcgggggtacgggtccctcctagctggcatgaatattttccttgggcggggggtggcggggagtgagaccaagctccagcttgaagcgttagccatggcctcagtactacctttaccccgaaataacatttattttttctctatctgacacataccaacaataaaaaaaagactagaatagccaccacttatattcaatgttaatgcagttgtctcttgttttatcttgttctaattaatatatttgtcctctgctttcataattttttatatagtggtagcttaaagatgaaattattttaagataaataagatgaggataaaaatgatcttattttaggattgagggattacgctgcagcaagagcagcatggtgagcacgatcctctgccgtggttcgagacgttcggcgccggacattagaacacgtacgtctagatcgtccaatccgcatccaacggaccgtatcatcacttggcacgtcaatttaagtgccactccgacaaactgtgcaaaaaataacgtagctgcagtgcttccgtactgttacatgtagtcggttactgtagctgcacgcttgtctgcggtatatgagtatgtagtgcagtgcaagagatctctgtatccgccaagaggatactagtacgtaccactacagcagcatatatcactgtaatgaataaactactgtcatacagattacagactactacctcctctgttctgaaataaaattatctttatccctgctatttgttctattataagcttatttgtagttactattgtatcaaaatttgtgaaagcaaaagatgaatgcatttgagtaggggtggaaacgggcgggtatttcctgcccgcccgcccggccacattatttcaggacaaattcggttacccggggcttttcatggatccgaatacgggtcttttttgcggatatgagatcgggttcgggaacgtagtatccgacgtatacggattatccggtaaaaaaatcggatattacccatattatgtttttgtgaggaaatttttggtactatgtattggttctattacgatgtattgtttcctatttatttcctaaggtactaatggactaatataaccgtattatagataaatagaattgttaaatggttattgcccatgtgatatataagattgtttcttcgacttgatatccaaataaaaatttgtaaccaatagtgtacatatctattttggtacgtattcgctatgtatttttgcccgacattatccgagtttatatccgtattcgacactatccatgtccgacccgattctgattataaaatgtgggttaggatatgagaagggtgagatccgatcgaacccgacccgttttcacccttacatttgagtagataaaataaataaataaatacatttagatttgataaagtaaaggtattttatatttttaatattgtattggtatatagggatggtgaaaaaataaaccaaatttattttatgacggaaacaatactactacccccactagagaaattgaccgtttggtcacgttcaacgccactaaattaagccaacgaggaatcaacggcccctctagcgtacagatgctgcaaccgttttgtttgtttctcccccatcgacctatccctacacggttgcacatgccgatacaacggccgcagcaaaatgaccacgagaagtgactcgcctgaccgaccgaaccatccgaaaggtccgagccgtagctgccacgccgccgacctactctgtcacacacacgcttcccgaactccactgaccgttgccgctaaaaaggaaaagggaacaaacactacagtagcagtaagagcaggtacaatagtaggctataagccagctagcaacatattttaataagataatagagaagagaggagagcagcgggctacagatctgtagccagctgcagtacggactctaagatatagtgtgtatgacaggtggaaccagatattaatagtatagtaagcaactattgtatgaattggctattagattgactatagatgaattggagctagtaatggtcaatactattgaacttgctctaaggagtagaagcccaccaaaaaaactcaaaatccaacggtcactcgcctcgcctttcacctcttttaagcctttactcctcgcgctcgccgcgccatgcatataccaccaccacctcccccgtcctcctctcctccaccgcaaccgcaaccacggccagccacgggccaagcgagtcacgactggcacaacgaggcaaaaacaccattgctacccccgaggcgtccctctcagctagccctggcacccgcaccacctagcggcggcgccgtcgtgttcgtgtcggccaagtcgtcaagaagctagctagtcattgccagtgggcgcattgtgctaggggatggcgagaggaggaggaggaggagaggaggcggcggaggaggagagggaggtgagcgaggcgctgacggcggactcgtcggccgacgaggagtgccgccgcgggagcagcagctccagcgcaagctccggggacgcctccagcgagtcctactgcccgcccgacgagtggcagaaggtggccatcaagacctgcgtgtcgtccgacctcgtcgtcgtctcggccgagccggccaaggagaagaagccgccgccgccgccgtcgtcgccgcgcgtcgacgccgccccggcggacaagcaccaccggccctcaggtacgtgcgccgccgccgcaaatccccagttcactcctcccttccaacacacgcggttaaattaattgaattggctgcagagatggagatgatgaaggagaggttcgcgaagctgctgctcggcgaggacatgtccggcggcggcaagggcgtctgcaccgcgctcgccatctccaacgccatcaccaacctctgcggtaagtgggaggtttcgaattgcacattgcgattaatgcggcggtttcatggacacggacatggaggctgagctgagttgcgttgctgcagcgacgatatttgggcagctgtggaggctggagccgctgctgccggagaaaaagacgatgtggcggcgcgagatggactggctgctctgcgtcagcgaccacatcgtcgagctagtccccacatggcagacattccccgacgggagtaagcttgaggtatactagtacttcacttcccctgacgaaatttactctgcacttctgcagtagttaagctaggagtgatacaggaattactaggatcatcagtgcgggccgttcgtgagcactgagtagcagatgcaagatttaatttggcgtcctacggatgaaccatgaagcgagtgcaaaattcgatttgaattttacatgaacatatggaccacaaaaagaaattatatatagtcattaaatacgtggttagccgtttggtacttagtaatcccgtttatattgaaacagttgggcgcgcgacgccgtatttctgaggcccaaaagagttaaggccacatcaatgtgctgtccgtttagttgtgtccgatttgtttgtcctcaaattatccggtccaaacgtgatccattactactctagatcaaatggagatccatcatttcccacttgctgcatctgtttacaccaatctttcttctgtagtgtccaactttattcgacaatgcaatgttcaggtctttttttggcaaggaaatgttcagtttcttttttttatgaactcttacacagacacattatataacttgtggtgagaacaatgataaactgactgttactctacatgtggattactacttcagatcatgacaagcaggccacggtctgatctctacatcaatctgcccgcactccgaaagctagaccacatgctcctcgtaagtctgacgaactctatctcggatcaacgatctgtccatccatccgaaaataaaagatgaactagtgctgtaataatgtgcatctcctgacgaaacgagcacatcttctgccaggaaattctggagagcttcagggacccggaattctggtacgtcgaccaggggatttgcccgccggaccgcgacggcagcgcccccttcatgctaacgttccaccgccgcgacgagaagtggtggctgcccgtgccccgcgtccctcccggcggcgtcggcgagaccacgaggaggcagctcgagcacaagcgcgactgcgccagccagatcctcaaggccgccatggccatcaacagcaacgccctcgccgaaatggacgtccccgactcttacctcgactcgttacccaaggtccaaatcaattctactacctgtagagaataggagacggattctaatcaaccgcaactaaatggttatgaattttttttaaaaaaataacaagatagattaatatgtaatatattactccacaaacatacaatttcgaatttaacttttacaagttataaaaaataacaaatttaattgcaaatatacgtatactaatttaagttttatttgttgtttttgttacaatttttagaagttgaaatttaacttacatgtttgtggagtgatatattacatattgttctatctttttaattatttttaaaaaagttttataattatttagatgacatgcattcacttgggtgattaaaagagttttccgtagagaatactgtaaaaattatcagaaaaaagaaaactacactaatgctcatcatacatgaacgtttgctgtttcttgattctgacattgatgtttgattgtcagaacgggcgtgcgacgctgggcgacatcatatacaggtacatcacgtcggaccagttctcgccggactgcctgctcgactgcctcgacctgtcgtcggagtaccaggcgctggagatcgccaaccgcgtcgaggcctccatctacgtgtggcgccggaggggcacgtcgggcgccgcgagccgcgccggaaacaagtcgtcatggggcatcgtcaaggacatgatcatggacacggagaagagagacgacctcctcgccgaccgcgccgagggcctcctcatgtgcctcaagcagaggttccccggactgacgcagaccagcctggacacgagcaagattcagtacaacaaggttggtgaatccatcatttgcagtttgcaaatctcgctatccgtgttgatggtgatcgggtttggatgaactgatcgtgagatgactctctcttcaggatgtggggaaatcgattctggagagctactcgagggttctggagagcctggcgtcgaacatcatcgcgcggatcgacgacctgctgtacgtcgacgagcggagcaggcaggcggagctgcttccaaccgcgggcgccgggagcggcaagatctcttgcatgccggccatgtcggcgtcgtcggtgccggcgtacccggtggtgtccacctcgggcaccccgccgccgtacgcgacggcgtacgccacgccgagcttctcgccggcgcagctgtcgagcccatccaacatcgggagggcactgctggtcgaccggcggtcgcacgacggccgagcgttcgacggcagcatggagttcatggggatggcggtcagcaacgccgtgttcgacctaccgggcctgtgaatcgatcgatcacgggccccgtgtctagtgctttacttaccctcgcctgtgtgcagtagttgtaatgttgtatggcgtgatttcttctcgggagggcggcctgtttttgccgtttcgccgtttcgccgccctccagttttatgatgtgttttgacagtgcctttgttaacttgctagtgttgtaagagtgcttaagttcgatgttggtcggatggcaaaagagaaccatcgcgtttgtgcaaaccacagagttttcttggctgtttttgagcaggttccgataaccagaacgtaacaacttttataattttaccgttaaccggcaaccgtacagacaaaattgaaatttaaattgagttcaaattcctagtctttctaaaaggatggtttcctcggaacgtacgtccaaactccaaaaggcctcggctgacggcctgcgctgcatcccacactccagggcttggaataagttcactttgggtccctctatttgtcgcccagtccgattttcatcccttgaccgtaaaaccaggtacgacccgtcccccaacttacgaaaaccgggcaaacgaggtccctcgacagttttaatagcggttatggctgacgtggcgcctacgtggctaatttgacccggtcttcatctgacatggcactgacgtgaggcttacgtgacaa

SEQ ID NO: 20002 - DNA, 6753 bp, Oryza sativa
tgtctcccctcctctctccggcctacaggcgccatggcccgcgaggtcacggggaggttatcggcgttgttgttgggatggaagggcgcgagggtggggagctcgggtcggcgtacaaggccgccatgcgcaacagcgtcaccatcaccgtgaagcggatgcgcgacatgaaccgcgtcaagttcgaggagcacatccagatgctcggcgacctccgccaccccaacgtcctctcccccgtcggctaccattaccgcagggaagaaaagctcatcgtctccgagttcatgccacgtggcagcctcctctacgtcctccacggtaataataatcacagcaaatactagtagttcttaatcaactactaatctcgattatagtttgctaattacgatgtgtttgtttgttggttcaggtgaccagcgcccggacagggtggtgctggattggccggcgaggatgaggatcgccgtcggcgtggtgcgaggcatggcatacctccacgagaagctggggatcccggcgatgaggctggtgagcatggacggcgccgacttcgacgccatccactcctgccgccgtggacgtctcacaccactcgccgtctgaggtctgcaccgcctccacatcgagctgccaaccgacgagctcggcatcgaggacggcgtgctcctcaagtggaaggctgacttcggcgtacaaggccgccatgcgcaacttccatcccaacagcaacgccaatcggggggagtaggtggagctcgtcggggcgggcggctgtcgcgtcgccggccgccaccgccggacctccccgtgtccccgtgggccatggcacctggaggctggagagaggaggggagagagatggagagaggggatatggagagggaggaggaagaagatgaggggtgagtatgacatgtggggcccatgtgggtcccaccatttttttactccctctgttctaagaaaaaatacaaaccctggtttccgtgtccaacgtttgatcgtccgtcttatttgaaaaaattatgaaaaaaattaaaaagacaagtcacgtataaaatattaatcatgttttatcatctaacaacaataaaaatacaaattataaaaaaatttcatataagacggacagttaaagttggacacggaaacccagagtttgcattttttttggacggagggagtattattttgtgtgtgaaagtgacatgtgggtcccacggactttattatttttccggatcgaattgccacgtaagcggcacgtcagtgccatgtcagatgaagaccgggtcaaattagacacgtaggtgccatgtcagccaaaaccaccgagggaccttttttgtccggttttcgtatgttgggggacgggttgtacccggttttgtggtcaagggacgaaaatcggactgggcgataaatagagggaccctaagtgaacttagttccccagtgctttcatgatgcccagtgggcttgggataaccaaattggccgacgggccagtgcttttgtgatgcccgcgaaagaaaaggtccacttttactcccttaaatttaggtccaatctaaggaaaaagtacaccgaagatccctcaatttgtcgttgagatacaaaatcgtcccccaaccacacaaaatcagataccgggcatccctcaactaacaaaaccgttactttagatctttcgatggttttgaccccgttttatccgacgtgacggctgagtcagcatgggacctgcgtgggccccacatgtcagcggggccacgttggcctcctctgtcttttcccctcttctctccctccctcatctctctctcacttctctgctctgcgttctgcaatgcgggagaggaggcggcggcgacgatggcgtcgcacgaggcggatgggtgcgcggaggagggaggggacgagacccacgaggcggcgacgggggagggctacgcgcgggcggcggggcagccgctgctggtgccgctcaagtgcgggtgcccctcccgctcgcccaatgcatactcgcctatgcagtaccagatcaacgccggcgacaccttttggatcgtctccaccaccaagctgcagaacttgaagcagtaccaggccgtcgagcgggtgaaccccacgctggtacccaccaacctcggcattggccagatcgacatgttccccgccgcttgttcccctccgttccccgctgcgtgttcccctccgtttgtcgccgcagcctggtcgcctccctccgaacgctgccgctgcctggtcgcgggagggcgtcggcagcaacaccagacctacccaataaattatttttgattttcaccatcaattcactagcaatggccaagctagcccgagcaaaacaaaaaaaaaaaagtcatgtacagacatacagaccagatccttccttggaactggatgacgtcgtgacgatgaggagagagatcacgacggcggcgacgcgggtgccacgaactagagtgcctgcgtgagcgcctccatggcgccttcgccttgctcggcagtggcggccgcgagcgcgcggtaggtggcgggggcgcggtgaggcgcacgtggcggagcgcgcgtgtgcgggcacggtaggcatcgggggcacggcgaggcgcacgcggcggagagcgcgtgtgcggcacgcgcgcgcgggaggcgaggctaggatggcacggttccaccgcgatcgccctcacgcccagctcctcccccgccgccgccgcccagttctttcccgtcgggcgccggccgcgcccagcctctccgtcccgcgcacgtccgtcgcccgtggaaagaggattggaaagggcagtagagaggggaaggaataagatgctgacatgtgggatccacatgggccccacgctaactcagctgtcacgtaggataaaaccgggtctaaatcaccgaaggacctattgagaccggttttaattaattaagggacgccagatatttggttttgtggttgggggacgattttgtaactcgatgataagttgagggaccttcggtgtacgttttcaccaatctaattcatataactcaacccaaatacaggatatttagaccctcgaactactaaaacagtgtaatttgatttccaaagagtatttgctgacgtggctcgttgacctgttcgaaacggctaatgtgtggggcccacatggttagtgtcgccttctctttctctctccttttctcttcctttctctcatctcctttccccacagttgcacgtggcgaatgcctcgagcgacacgatgcccccaagggaagggtggggggctcaagtgtcagtgcttcggtggccaaaaagacggcgatggcggtgttaggatgtgtaccacgatatgactcgtccaattaaaggtcccagcgcttgacatattggatgatgacgacggtggagagaggaagatggccaagcgagattcaatgccgaacatgcccaagttagtgcgtcaaaacgcgttctcagaggaggggaactcgtttctcttgaacttgttgatggaggtagactaggagtggctgacagcatcaagcatggcagcgagcagaagaatggccacgacggccaatcatggcggcacagagaaagtgcaagatagggaaaaaccttataaatcttgatgccctcgctgttgccagccaaccccaccccaccccacccctcccctcccgcgcgcgcctcgatggggaaagccttctggagctcgagctgtaggtctatcaagttattgtcgtggtcgttagctaatggtttgatgcatggtttcggtcacattgttgtgtgcagttacggcccactagcgaggaagggacccctattttcttacacaatgaggcatgcacacacgtggatttagaggaaaaatcatgattagttttatttttacttccgttaatcattaactaacctttccttttctcaaggagtttttttcccttttttactagaaatttaaaaatctatacgtgaggtttgaacctttcaactaaaattttgaaaactttcaacttaaatttggaaacattcaacctaaatttttgaaaactttcaactcaaatttgaaatcttacaactcaaattttgaaagctttaactcgaattttggaagcttcaaacacgaaatttaaactttcaagtcaaatttttgaaaacatttgactcagatttgaagattttcaagtaaagatttgaaaatattcaaatcaaatttcaaaacattcagccgaaatttcaatatttgcgaattgcaacccaatttcaaaacttcaactcaaaagtttgaacttccaaatcaaattttagaaaaacaaaaaaaaagcgtcgatgctttgcgtggcgaattttttggcgcgacgtgaaataggtcacgtggcaacattttttgtcgcgaagcgtagggaaaggggaaaacgccgctaccctagctcggtcaacgtgcgaatgacttgattggttggcgcacacgcatgccatataggagcccccagccgttgaaccactcctcacgacaatgatggccttggcgaatgatcgccccaatgcatccatgccatgggcaagatcgatgacccactcaagctcggtgaggagttcctggaagtaggctcacatggtagcagcaaagatttgtccgtcacaggagaccttggggggtgcagtaggctgcgtcaccgttgctccgcctcgaggctgctatgtcagctgcggaagcggctccgtcgaccgctgttcgagcctgtcaccgtgtggcattgtggtgaaatgagaggggagcaaggaagagaaaagatgggagaagaaaaatgtggtgttggcatatggttctcataatgattcagctggtcgaaccaagtgaacaagccatgtaacaaatacaactatgaataatgccttggaagtcaaattagatcgcttttaataattggagggggtaagatacctagtattgtgattgagggatacaaattatattaaacctatatttaaggaaatgaagtggactactatgaataatgccttggaagtcaaattagatcgcttttaataattggaggaggggggaagatacctggtattgtgattgagggatacaaattatattaaacctatatttaaggaaataaagtggacttattctgctcgtaaattactgtggttgagagatacaaattagattaaacctatatttgagggaaacgaagtggacgacttattccacccgtaaattacagcggcacgaaggtcacttgttctcctacaactccactaagtgtgaaacgcatgtacagtcaacagctttaggagtcattgggggcaacaagggtaaatggtgcgcacaattaggcctggtttagttccctaaaaacatcacatcgaatctttggacacatacatggagcattaaatatagatttaaaaaaacaatatagataaaaaaaactaattgtacagttggagggaaatcgcgagacgaatcttttgagcctaattagtctatgattagccgtaagtactacagtaactcatatgtgctaatgacaacttaattaggctcaaaagatttgtcttgcggtttccagacgagttacgcaattagttttttcatccgtgtccgaaaacttcttccgatatccagtcaaacatccgatgtgacaccctaaaattttcttttcgcgaattaaacagacccttagtaatgttgccagtagcaaccttttcttttattgaaggctacctgttgctgccctaccatctcatcacatttcatcaggtgaaaacagcaaaacaaagggctacctgttgctgccctaccatttcattatacttcatcaggtaaaaacagcaaaacaaagggcaagaggaaaaaaaaaggaaaacaacacacacatgcacagtaacacacacaaccacatctgctcaggtgaaatgacgcatccaaatactgcctccaccggtagaacagatgtatagttccactatgacttgcaaaccggcttggaccactccttttatttctggtacaaaacaatcgaataagatgcacagaaattgctatcgcaatgatgaaagcattgtatggatttttatatagaacagtctgattacaaaaccttaaaaacttaataggataatctgaaaagcttaagttcctactgcaagtcactgggaattggctgcatacatcctcatcctgtttggatgtagaggctctgttttaatccattttctaaaagaaaaagtcactaagctcctatcaaatgttttcgtcatatgccaacaaaaggagaaatgacaccaaatatgcatggattgcttaacaataataagtttataagggaaaacctgacaaactatggttgtgagtcattgtggcctacaaattaaaatgccttggggagtaactaaactgtaaaatgttaaacaggtttcttgggttaagaaacgcgtaaaatgaacatcttcatcagatgttcatatcattctaaacatgaggcgaaattgctctaagcatcacccatgtcagatgtatgtactttttagaaactactaacaagataaacttttacttcaagacatttgaccaattttgcagtagagccatcattgtcaacctccactactatccaatgattgtgcgcagatatgacaagtaaaattattggcaccagaactatgaggacggcactaatgtaaacaaggatattttcctaagt

SEQ ID NO: 20003 - DNA, 1720 bp, Oryza sativa
tgacagataggtcatataacacaaacaatcgaatactatctgatgctgccgccagcactatcatgctcaaactaaagatagataatgcttacagagactttttaaaataaagttgctgctatagtataccttgtttgacaaaaggagagccctctgcaaagtacttagtaatagagtgaacctgccagtagattatagtcagtacacaacttcacatgtatttcgtcatgtataaattataaacaatatccaaataatacataccttgccaccaatcacctctggtagccagggagccatctggattctgctcctgctccttttgctggattggacatacaaagagaacataaaagtgtcagtgatacaagcaaccagaagctgataattaagagtgtcaatttctacgcacatttcctggtgatgcatcaccctgctttggtggagtgttgccataaaactcccgagcaccgtaatgcacagaagagccaaaatatggcgactccgatgactcgtttggatatgattgtttaccatccttgtatgcaccacgagctttagtagggctgtgcgatttgccatctgcatgacgaaagattgcagttaagcggctgctgtatcacatagaaatggagaatctcctctccaaatcaagatgatgcattaaacatggttgaaaaatttataagaggtagcaaaattactacaaagatcaatgtgctttgatgttggatcaaatgcaacagcgtgtgtgcgactgtgcgtgcatgatcgttgacgttagacataacctgaaatcctaaatccatttctcaggacaactaatgacatgaaagatgattatcctactctgttcacaagtttagccgcaattaaatactagtgtcaaataaaaaggatatcacacaaactacctgcaaagccaccgccattctgccctttggagttctgcttgttcagcatcgcgtacaggtccgcctgcttcgcgtctttcgtatttgcctttcatgtaaaaacaagggcagcaacatcagagggatacccaaataagatttcctagaaaccaagaactcatccaacacaaatgaacccgcccgaaacaattcccgaattcccgaattcagaacaacaaaaaatccaccaaaggaggagccaacctctcgcgcgacaatcgcataacagaaacagagaacaatccttaaaaatctcacgaatcgaaccaactacgagtctacgagggcgcgagaggagagagacgcggtataccgtgggcgacgcggagaagacggtgctgaagtacccgttcgccgccgccggcgcggccccggcggcggtggagggcggcgatttcttcctggagtccatacacgtcggtggtttgggtttcttggcgctcgaggagaggagaggagaggagagatgaacctagacttccgtggaaggagaagaagaagaggaggacgagctcgtgagcgaggaggcggagaaagatagggcacgtgaagtggtcgttataggcggcggcgcggctcggggtcggaggtgggaagcgacacttctctgctcgcctcgtggcgccctgctccggcctccatctgtgcccgcggccccctccttataaagggctcgagtcgaggaggggcgggcgaaccccctgttctgaattctgatgtttgtattccgtagatctgcaggggctgaattgccaaagtgcgatcga

SEQ ID NO: 20004 - DNA, 14002 bp, Oryza sativa
cctgcagcccaggccaaaacattaaaacataccacccccggggtaaatggcaccacgatctggctaataaccggtagttagccagatcatcagtggcatatatcggagacatggctgacgatggcatgtagctgctggagatagtgatgggaccgacgatgacctacaaaccatcaccatccactcctacagtctctcatgacaatggagacatcgtcgttgtctctgttgtcacacaaacttagccaagtctacgccaccaccgcttcaactgcctaccattgttgcccctatccgccaccgtcgttggcctgctgctgtcttgctgtgggcttctgccttttactaccttatcgctgcctctgttttctcacagataagagaagatagaagatagaggaaagaaatggtggtcagagagagaaaggaggggagtgaataagaccaagaataaaatgagagaaaggagggttgttgagcgcaaggcgcacaatatttttcttcctatcggtgtccgaaccaaagcattttcggataaattgacaataaattttgctttagaggtcgtaaacttctgaaggagaaaagaggacgccactacaaattgaatgtacgatcttttttaaaaattgattaatgtttcatcacacgtagagaaatatttcatagttagcccaaaaatatttcacacacatgcaatatctcctaaaattagttgaaataattttctacatgaaacaacaaagataagttgaaacatgaaaaaaatcacaaacatttacacgcccgtaaacatcaatacacattgactgaagcatcaaaatttcaataagataccaatacacgctgctctctcctcttcggtggccaaattttcggctcctttttctgagccgaccactcaacagtgacaagagttggcacctccctcccccgttaacgcagagaggcacaatgccatctagaactcgtgccattgcgactgaggcaaggccacggtgacactaagtgcattggctgctacaacctgcttggtccgcaccaacccatctttgacaagctcccaccccagccactagctgcagtcccttctttgcgacctccgcgcatggcactaggtacatcatggagttcatgggtatgaaggttagaaacggcatgttcgacctaccagacttgagaatcgatcaattacgattcactaactacgaggttgcattgcacgcaatcatgaagtggccaatgacctccctcacctcctacatcgaggcgaaggcagccacacaacggtaatgatagcagtagatagcactgttggtagcacgggataggggagagagaagagggcctacgtagattggagtacctgataaaataaggggcgacatcaggcgaccgaatgcaagcatttttagagaacgtggtttaaatttgctaattaatttactacacatgacaacgttcgccatgtcgtaacaacagtactcgatgccactttgatatctcaaataataatgtagcattcgatctatatattcattttagatcaaacggtataaaatgccaaccaatgcacactattgtgaacccatagaggatcccaatagctgagaagtcgtcatcagtaggtgtgcgtggcggatggatgataacaactgaagatgctgggtttcccttcttgtgtggagtgtagtgcaaaaggaggaaaggggggaaaagtttctgagaaaatttgtttttccggagaaacaaagaacttgccgtttctataaacctccaatctcatcactccctttgtcccttataggaagtcaaataaatgcacatgcttctgtccttatttcagttctttcagtttgatgacgtgccattttttcccccaaaatgatcgtaagaattatcgcgttccagttcttttcccatgcttgacaatctcacatttaaaaccggtacctatctagctctatagtccatgctagaccaaattgacaaattccttccacggtttcatcagcagcatcggctgctgcacacgtgaaaggtagacaaagcacgtgtaggctgcataggatgataggaacatggtacatggatatcggatagcacgctagcatccgtcacttggcttcctacaccctataattaatcgtgtgcactctcctactacatgcacacagaccaaaagcagaggctggttcagcgaacagatcagcacgcaagatgctgccaattcctttcacctacgaccacgagcaagtggatgatccatcaggggtagggtgctggttatccatctgagaactttttgactaaccgatcgagctcttcttctactgtgctggtctcaacgtatcactcatcggcatcatccctccaaatccaaatcttaacgatcccgctcgatcggagagatcggcatcgatgcgggcggcgaatctttgcccccggtctgaaaagctactacttcacaacaataattcagtgaacaggaaagaaggttctgagctcggtttctagatattatcacgcaattcacaacaagtggtgtggggttctcccagctgtagatatctcgctcatctcacccagacatccacgagagagagagtgtgtgtgtgtgtgctcactcgtcacagatgcgagcaagcaccaataattagctcatccttatctcacagaaatttctcatgcttttctccatcgggctgaccagcattgataggtagcagcagggggccagaggccttccctttttatcctcttgccgtccaaaagcggctgcacgatgatgcaccggattagcttagcatccagtctttacctatcgcgctctctctctctctctctctctcacttgctgcatgcgtttggtggtgtggttccctgaaccagtgagagacgttcagatttgggttcaggttcgaaaccggaaaagcgtcgacgaccccaccaccaaatccggagcggcgaggaggacggaactcgccgtggttatcgcgatagccgactagccgaagccgatacgatcatcctaccgggcgcgcgcgggcggggatatgatacgcgtgacgcgcggtcggtcccgggggataatctagtttattgcgcggcgcgcggtggtttttatcctgatctgcacgtatcttccgcttcgacgcgtcggaggagcggaggtcgtcgccgcgccgccgacggttggggcttgatgggccaccaccaccccggttgacgacgcgtgcgaacgcgtcgctttcgcgagcgagctagcaagcgcgccatggggtgcttgctggatagatgaggcagtgtggcgcgccgaaaagttggcagtgtgcgtgcgccgctcacacgcgagcgagcgatctcgcggctggcctcgttgtcgccgcgacgtgagcggcgtttgtgtgtcccttggcgctgcggagggacgcggctaagctcgtcgaaaaaaagagatggtccgtcatgggtcagcgtcacacggcgtggggtgcatggttgcgtcgctcgtcgcgatggagactgtgtgggaggtaacgggttgatattcgtacgtgtcgaagattttaggctcgttcggagaggagctctgagccatagagactactacctacggtacagaggattatttttgttctgtgagaggagatgaatggaatctgagaagtttctcattacggcatggggtgtgtttacttcacgctaaaattagaagtttggttgaaattgaaacgatataacagagaagttggaagtttgtatgtaggcccatcacgtcaaaactttcctacacacacaaacttctaacttttctgtcacatcgttccaatttcaaccaaacttcgggtgtgtttagttccaaagtttttttttccagactttcaactttccatcacatcaaacctttcatacacacaacttttcagtcacatcgtctccaatttcaaccaaattctaaactttgggccaatctaaacataaccttcgttccaatttcaaccaaacttctaattttagcatgaactaaacacacccgtagaagagggcaaaaattatatgtgagtgctgaaggtcgaagactgcgacaaatgtgtcgtgtgaacagcatgaacaggtaaccgtgaacgcctcttggttagacggtggaattgcgaacactactacagataagtaggcgtagtttagttttgatgactgtcactacgtatagataagtaggcgtcaattggtacacagtataaaatactatgaagtttatgaatttaattttattcttcgtcagtttatgtatgtattgttgagaatatagacatataatgatttaatatattttataaataaatcatgatattatagatgtatactagcattaatgtatcattagatctacacatgtaaactaagcagtaaaacatgaatagatgaaatatacgcaacatgtcgaacacgtaccgaggtggcggaaagaccggttgctcggcaggaactactcgcggttgcgagcgtcgacgaaggcgcgcagcacgcgagcggagaggaaggcgagccgtcgcggatgaacagggagcagtcgcgcgaagcgcttcccaaaaaccttattgccgccttctcccggtgcaggacgtcgaaggcagaggttccgtaaacctgctctcccgatcgcaggtgcacgccgcgagcgggatggagtagtctacgagcgacggcgcaacacagagaaagaggcaaaccctagattgatttcgtgtgttttgcgtgaagggggcgcctcggtttatatagagataggtcgcttgatcagtgtgcccgcacgatctccactccgcgtaaccgaaccggataagtcacgcgtaacttatccggactccacgccattttttcacacaccggatttttcggaatgtttccaaaacaaaacaaatccgaattttcctgcagcaaaataaaactacaaaaggaggctgcatctgcgcaagggtgaggagccaattttgcggaccattcgacgcgtgcgtcgtgcacgcgcgccgcctgccctgccctgccaggccaggcgaggcgagcgagcgtgcgcgtgtgttccccctcttctctccaccacacatgtttcaagtggctaggagggcatcctcccttttaaggaggccccctctcctagaataagtaaggtggtactaaacttcacatgcatgccataccatgaggtgggcttttgtgattttccaaagaattaattttcgaatgggccttagcccatctattaattccaacaatcccccaccaaatctcaaaatcccactgagatttgctttttccaatgtacttttatataccacggttcgatggagaccgatcaaggttgaacatccgcctagaactctaagctacacttactcacaacttgaacaatggactacgccttgaattgcaagtcttgtgcaagcaagtttcattcagagtcttatctggtactagaccgtctgtagactacccctcgggtggagcgtataagtcatactcctaggtctttagtaagattcctagaagattcacccaaaatcttcatagactgcgaccaacagtcaagcttacaaaggtgagttctttcaagaatgctctgcaggatagcatcttcgctaattaaagtcaacagaactcattaaggcatagccaacctgccttgcagctcacgagagtacatgcatcttcacttagagagggtatagattggtactctcctctagtttactaatggtttgttcttcccaggttctaattcacgggatctccaatcacatagactgggttaccaccatagtatactcacataggtctcaaacccatctccttcgatgcattatctatcacatttcgtgaaagtcccttcgtgaaaggatctgccaggtttctagctgtttggatgtaatccaatgttataactccggagtttatcgatttcctgacagacttcaatcgtcttttcacatgtctagacgatttcatattatccttagaactattcactttggcaattaccgtttgattgtcacagttcataaggatagccggcaccggtttttcaacaataggcagatccattaatagatcacgcagccattctgcctcaacagtagcagtatctagtgccatcagttctgcttccatggttgacctcgtcaaaatagtctgtttgcaagacctccacgaaacagcagcaccacctagtgtgaagacatatccactagtggctttgatctcatccacatcagagatccagttaaaatcactatatccctccagtaccgcagaatacccagaatagtgaagccccaattccatagtacctttcagatagcgcattactcgctcaagcgcacgctagtgatcatctcccggattagaggtaaaccagctcaacttgctcacaacaaaggagatatcaggcctagttgcactagccagttacatcagcgagccaatgatttgggagtattccagttgattcctagtaattctcttgttcttgcgaagcaacaagctaggatcataaggtgttggagaaggcttactatcaatgtagccaaagcgattcaagatcttctccacataatgggactgcaagagtgtaatcacattctcacctctaattagcttaatgtttaagataacatcagctactcccaaatccttcatatcaaaattttgagacaagaatgatttaacctcatttatcacctcaaggtttgtcccaaatatcagtatgtcatcaacatacaagcacagaataactccctcaccccaccatggcgatagtacacacatttatctgcctcattgactgtaaagcctgcagatgtcaatgttttgtcaaatttctcatgcctttgcttaggaacttgtttcagaccatacaaagacttcaacaatttgcacactttgccttcttgaccttcaactacaaacccatcaggttgatccatatagatctcctcatccagctctccattaagaaaagctgtcttaacgtccatttgatgaacgagaagaccatgtgaggctgctagggaaagtagcacacgaattatggtcaatctagcaacaggtgagtaagtgtcaaagaaatcttcgccttctttctgagtatagcccttagcgacaagccgagccttgtacttttcaatagtaccgtcaggcctgagcttcttcttgaacacccacttgcaccccacaggcttacacccatagggtcgctctgtcacctcccaagtcccgttagcgataatggaattcatttcactacggacagcctccttccagtagtctgcatcaggagatgcgtatgcttctgaaattgacttaggagtttcatccacgaggtacacagtgaaatcatcaccaaaagacttagtcgtcctttgtcttttgctcctttgaggagcttcactgtcatcctcctcagtaacatgttcatgtgtatattcagtttgttctggtggtgtgattgaactgggaattatttcagagggttggctagaactactatgtgtatcattcattgggaaaaagctctcaaagaaggtaggatcacgagactccataattgtaccaacatgcatgtcaggtacctcagatttaactattaaaaatctatcggcaatgctgtggtgagcatatcccagaaagacatagtccatagtctttggtctaagtttgcgcttcttcgttattggtacattgactttcgccaagcacccccatgtgcgcaagtaagaaagtgatgattttctccctatccatatctcatatggtgttttgtccttatttctgttaggaactctgtttaacacatgattcgaggtcaacaatgcctccccccaccatgccttaggtaatcccgcggtgtccaacatggcattcaccaagttggtcagtgtgcggttcttcctttcagcaatcccattagactcgggcgaatagggaggcgcactctcatgtataatgccatgttcctcacagaataagtcaaactcgtttgagaaaaactctccaccacgatcagacctaagtctttttatctttctatcaagttgattttcaacttctgccttataaattttaaaatagtctagagcctcgtctttcattttcaacaagtacacatagcaaaatctagtagcatcatcaatcaacgtcatgaaatatcgttttccacccttcgtcaacaccccaatcatttcacagagatctgagtgtaggaattctagaggtgccaagtttctctcctcagcagccttgtgaggcttgcgaggttgctttgattgcacacaactatggcacttagaacctttgacaatggaaaacctaggaattaaatacatgctggaaagccgagacatcaagccaaaattaatatgacataaacgtgagtgccatacattagcctcatcatccacactgccacaaatatggttcacagacttattgcagaaatcagaaagggaaaagcggaacaggcctccgcactcataacctttaccaataaaatatccatgtttagacatgactactttattagactcgaaaaccaacttaaatccgtctctagtcagacgggagccactaacaagattcctgtcgatagaagggacatgctgcacgttcttcagctgcacgatctttcccaagtaaactttagatctaccgtgccaacaccatgaacagaagcatgtgacccattccccattaggacggtggaaccccgtgtgacctgataagaagaaaacaatgagatgtcagcacaaacatgtacattggcccctgtatcaacccaccaattagtagactgattaactgaaaaaacagtaggtaaattaccatacccgcttccatctccagtgttgccaatggtcacattagcagacttagaggtctgccctgcaagtgccttcatcctcttgcgttgtggacacttcctggccagatggtcaggttgatcacacacaaagcaagtcctctcatcctgattagaattgttgttgttgttcttcttcttgaagttggtggtctgctgagctttgtatttccccttgctcttgttttgggccttgtgcacaacattggctgtggactgcccaccatcgcccttagacgcggcatctttttcctgagctttctcctcaatatcaagagacgctatccacccctcaacggagtattcctgtctcttgtgtttgagtgcagtaccgaaacctctccaagatggaggtagtttcgcaataatgcacccggccagaaatttgtcgggtaagacacacttaaggagttcgagttccttagccatggtttgtatctcatgagcctgttcgactacagaacggttgtcagccatcttgtagttatgaaactactccatgatatacagatcattgctagcatcaatagcaccgaatttagtattcagtgcatcccacaactccttagcgtcggtcatatgcatatacacctcgaccagatgatcgccaagcacgctaagaatgcatcccacaaagagagtagtggcctcatcgaattctttctggtgattagcattaagaacgcccataggcttgccagtactcacaaagaagcatttcatagttgtcagccacagagtgaccctgatctgccatctcttaaagtacacaccggtaaatttatccggcctcagtgcatcggcaaaaccagccatagtaaaatcacagcgcctataataaggtttttggattgttgagaatatagacatataatgatttaatatattcaataaataaatcatgacattacagatgtatactagcataaacgcatcattagatctacacatgtaaactaagcagtaaaatatgaacagatcaaatatgcgcaacatgtcgaacacgtaccgaggtggtggaaagaccgtttgctcggcaggaactactcgcggttgcgagcgtcgacgaaggcgcgcagcacgcgagcgaagaggaaggcgagccgtcgcggacgaacagggagcagtcgcgtggagcgcttcccaaaaaccttattgccgtcttctcccggtgcaggacgtcgaaggcagaggttccggagacctgctctcccgatcgcaggtgcacgccggcgagcgggatggagtagtctacgagcgacagcgcagcacagaggaggaggcaaaccctagattgatttcgtgtgttttgcgtgaaggcggcgcctcggtttatatagagataggacgcttgatcaaggcgcccgcacgatctccactccgcgtaaccgaaccggataagtcgcgcgtaacttatccggactccacaccgttttcacgtaccggatttttcggaatgtttccaaaacaaaacaaatccgaattttccagcagcaaaacaaaactgcaaaaggaggctgcatctgcgcaatggtgaggatccaattttgcggaccattcgacgcgtacgtcgtgcacgcacgccgcctgccaggcgaggcgagcgagcgcgcgtgtgtgttccccctcttctctccaccacacatgcttcaagtggctaggagggcatcctcccttttaaggaggtccccctctcctagaataagcaaggtggtactaaactccagatgcatgccatcccatgaggtgggcttttgtgatcagcattaagaacgcccatagcaacagatacaattcgatgacgcgcaataatggcggcggcgacgtcccgccgtgtcgtcaggtcgccggcggcgaccagacgatgtccttgaccaccggccggagctcctcgctacagaccaaccggtactccatggcgtcgccgccatccttcttgacgtccaccacgagcaacgatggcgccacgctgaagacgtcggccgccacggcgagccgcaccccgcgcgcaccgctcctcgtcacgcgcgtgggcgtggcgccgcccgtagcaagcgcctccagccgcgcgaccacgccgcttgccgcctcccgcgtcgcgaacctgtggttcatccttgtcgtcgccggcattgccatgcgtgtccaccggcgtcggcacggggtcggcgctggggcgcgggacgggcgccgtcttccggatccacggtgtctcgagaaggccgaggacggtgatgcgggttcccgggttggggtcgagcagcatcttgatgagcttccgctgtagcgtccgctgccggacctccccgaacctgccttcacgcggaccggcggcgctccgattggggggcagcgccgaccacgcccgccgccgccgtcggaactcgcctgctccgccgcccacccgcgccgtcctctgcccgggaaggagagagagaggggaaagggaagaatagagagaagggagagggaagaagagaggagtgaggctgacatatggggcccacgtgggccccaccattttaaatttttttttgtgcagctgacatgtggggtcacgctttttattatttttccgagatataattgccatgtaagcgtcacgtcaatgccacatgggacgaagacctagtcaaacaagccacgtaggcgccacgtcagctaaaccgcctttgtaggatcaaggaggccgactagagggggggtgaataggcggttttaaaacttaatggcacttaaacaaaactaacctaagttgctaggcaaggtaaggtgtaaggttaactaagcaactaagttaagttttgcaaacctagatgatatgggctcaaatatgtctctatgaatgtaaatagcacaaatgtaaatgcaacaaataaatgaggcaagagacaaggaatttttcaccgaggttcagaaactcgccggtttcctaatccccgttgaggcgagcccaactccaccgctcaaccacgaagccaccgcacgcccccttcatcaaggggtgggcaaggcgggagccggcccacggagaggactacccaagcctcgatcactcggggtagttcttccttcactctgaaggtggtgaactccaaaccactcacaaacggcgccgggcctcctccacaatctcctcggagaggtcaccgggcaacacctacacaagccgtctaggaggcggcaacctccaagagtaacaagtctaggatgcttgccgagaatgatcaagtgtcacactagctaaaaaaatgaagcaatgcagttggattggcttaactcactctctaacacctcactagataaactgtcgcgaccgagaaaattgccttttcccgaacgctagtgtattaatccccgtcccaggaaaagccggggtacaccacacaaacatgatacaaaaggcacatctttattatatcgagaatatttacattattacagaggcgcttcaggcctggcaatcaaaaataaacagcagcggactagcgggcctacggctccatcttcacaggcgctcaactggggaataagccaggactccacctaagacatcttctccaaagcttctcttactgaatgggggaaaagattgagcaagaatgagtacaaccacagtactcagcaagccacaccggagatgcgtaattaatgcaagggagtacaaggggataataatataggggttaagttttgcagtaaacagcatttaaaagtcacttagttgcccaaagccattttaaaaagacgatcctagagctacacagtattattaatcagggtcgtgaacccacacgagcctgccttaacccaaggcctacgatgattcagaccgaactggcaacccgaccctgggtcccagctcgtcccaagccaacccaggccaaccattccacattttagttgttgagcaaattttaagaattaaaacactaacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaaccccacctacggccggaacctccgggacaggcaggcaggactgagcccctagcagcagggcaccaaccctgtgccatgacatctcgactaccgggccgcagctcgtgtagccttcatttgtcctagagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccggaaaacagattttaggggctttgaaagaggaagagaggggtatgtccaattccaccataagccaaccattccatagtgtccaaatgatatgagaattcccaaagtctaaagttataaaaccacctaatgttgcctaattaaccagcgaagcatctacctaaattcataccagtggaaccatgaatagagtacccactagttggggttttattttcctagggtgaacaaggtaataataacaatagcaataataatgtcttaacaaaggtaaataggcatggctaaataaaacagtgataacgcgggaatttaaataaagcggtaatgcattaatttaaatcaaaataattttataaactgggattcaatatgctcaaggatgatgtgacttgccttgctcgctttcccaaacgccggcttcaacttccatgaagagaggatcttccgaagctgcagcgtctacacgaccaacggaaaagaaaaggcttttactctactaaactccatataacaagcagaaacaaagcacaaaaatgggttcttgacttcttaaggaaaaattagagacttgaacggtccaattccgagttcaaatggccaagttatggccatttgaaatttatatgct

SEQ ID NO: 20005 - DNA, 7131 bp, Oryza sativa
gaagtttgcgggaggatttccaaacgaatccgagagagagagagagggaaaagtggggggaaagagggagggaatcacggggagtgatttccccctctttatggcgcgcggggacggcgggatgcggcggattcggcggcggcggcggcgctagggcacgggcgggcggcgggagcggcggaaggtaggggatgacgggtgggccccacccgtcagcgagggtggcgggcgggcccgcccgtcagcgacgcgcgcgcgggggaaggccgatgggccgcgggggagaggagagagagggagggagctgggccgagccggcccaagagaggaaggggaaaaaggactttttagagcttttctttttataaaatcattttaactttgtttatttcttaataattattatttgtgctctgaaaattccactaaaatttgagggctccttttagaccaaggagaatttaacaaaaattctccgggccacatttgagtttttcttgtacgtattttagtgtttgccaatttcttttcgaattttaattaattctattattccttttagcgaatgatttttaattcgggatgaatttatcaggacgtgacataaactaagtgcacaagggtgtgagagctcttgaaagggttcaagataatgcaatggagtgccaaaaccttacccttgctgctggggagtgggtatatatacccccaaccaccaaaactagccgttggaaacgaaatccccaactttgtgctctgccggtcagaccgtcgttgtgaggccggtcaaaccggactactttgtaacggctagaaaactagccgttacagggcaatcattgagcccactcaacctggccggtctgaccacagtgtagtggccgatcagaccgtccacggctcggtcagaccgccatcggcttggtggggccggtcagaccggccttaccacgccggtcagaccggcctaaggcccacggtcagaccgcaggtcacttttcagctcaaacgaccattagtaaaacgacgatatctcttaactcgggtctcagaatttggcgttcttggactttatggaaagcttattcaaagggctatccaacccatgaacaatccatccaagaaacacaacttttctcagggagaaagggctcacactccaaaggatactccaccggacataaccacatgaggctacccaaacctataggatttgcccacatctctctttgtttaggacttgagaaaactcaacacacttggctagacaagcccaccaaatacacctatatgcatatgaactaatatggcacaagatcatccacaagctcgcttcatagacccctcttgatagtacggcgtctatctagcaaatccggtctacaccaaacaccaagaccgggaaaagactaagaaaacattcttagctacattatacctttgccttgcgccatccatcttggggtcaagcttgagtcgagatcaacacttgtgaccatttgattcaaccatgtttataccaaggtatttaccatcatttgtcaagactttcttctcatcacaagcttgatttcattcttgccaacatggcgatgtccttggcatggtgaccattaacccatggtgtcatccattagcctcatcatagtgggacctattccttttcacatctcaaaggagaacattagtctcaacaaatcggttgtcatccttcacttgatgaccaaccggttgcatatgaaagatatgtatatgtttgttgagtattcattaacatcacaagtgtcatatactcgtatgcaagctcaagtgcaaagatccgatataaataataggtgaacaacatggatctaaaacatgtacaataaatgtataggatttgctccccctaagtatatgcatacaaagaaatatacaacagagacaagtgtatgcataagtaaagaagaaccaatgggggtttatcctatacacatagagaaggcatatgtagtaatgatgaagataaacaaaaaaacacataccttcatgatctccatgttctcaatgtaaaggagactaaataagataagactcaagtaaacattagtctcacacttatataacaataacatggaaatcatatatatgaacctatcaaaaagtcggagataagaagtgatacatatcgctttatctccatgaatttcatccttgtcatgattaaggtccatcaccaaagaatgcatatctaccacatctcattatcgggaaataaccttgttgaaaacttatgtaaaagagaggttaatcccataaacatcggtttatcatctatcaccaacgtaacaattacacaaattgtttaatccaagatctttcaatcttttctctcttttgtgataaataataatccgatataaacaatacaaagaaatgagatgaaagataatttcaaatcaaggtagagatcttataatgaacaaaatatagaataagctccccctcaagatgtgcatacatatggatatgaaggaatgcatatgcacataatcaatcaagatcaatgagggagctcacactatattttggatccacaagagagacaaagttagaatatgtgaagtttaatacatacctcccatcatttttactttcatatccaaataagactagtcaaagaaagactcataaaaacgttagtctcgtataattagatttgtcattaatcaccgaaaccaaattaaggcacttgaacttacagccttcaaaaccaccgagggaccatatttacccggttttcgtaagttgaaggacggatcatacccggttttgcggtcgagggacgaaaatcagactgagcgacaaataaagggacctaaagtgaacttattccgacacactatgtatatggaccagacatcggaagtacattcggctaagcatttgtagttttgggcttcatctacacctcaccaatgggctcttgttgggctatcaggatgaagtcttcattgtttgctgaaaattccagggcaccttttgtttgctcaaactaaggttaatatagtgtgaagacgtcttctactcttttatactccctccaacctataaaaaaacataacttagaataagatgtgatattttttatgtttagattcattgtaccaaaaaagttacattccatcatagggtagttttttaatgagaccatcagagtacgtgcttgaaaaaagtactactgaagtttcaagttacagtagtgttttttccgaataagacgaatatcttctaagtattccttaagaaacaataaatattaatttacaaatcttagtaatagtacttctacacacagattgtggaagatcgaagaaaaaaaaaacaagcatagaagacggatcctaggcaatccgcatgcctgcatgatgcacatcaggaaaatttcacgactgccgccgcgcatcgggatctgaaaacgcacgactcctcccgtgacaaaacgtccatcccttcgacgccgcacgccgctgttcccgttgaaaatcaccaggacgaggtcggcggcgggcgtgcggcgcacagctgccacggcacggcggcctcgtcgcgcggttggtagagacaggccggcacgtccgtcgtgtgaatcgcgcggatgccgcgcgggtcaccatcgcgatcgaccgataacatcggcgcgacaggagatggatcgccacaacaccaccacagcggatttgatctcacatcacgtgacactacccgtcacccgccatcggattaacgacctctactcgacaccaaactagagctcctgctcccgtccgctcgatcgcgtcgtcctggcgatgtaacggatcggtcgatttgcctccccaacgcgacgctgacatgggaagattccgtgccctaccatatgccgacttcaatttttactcggtctatctttgacacaagcgatctacgaatctcatcatgcacaagtacagaagctagccggtccgtgcatgcatgctgcaatatcactgacgttgcgaagagaggccggaggtgggtactaccgtactagaatcttatcgtgacgtgaatgtggagttttccttcacaatggcttttacctgtgcaggttagacaaagggttgtaccaaaccaggtcgtcggatggtcgctattattttttttcccgtttttcagaaccacttttgtgacagcaactggcagctttgcatgcgttggaggcggtaggccggccgcgagagcgagagaatcccttctccccgacgcagccactacgtgtgcaacgcattggccgcacaactagcttaagccggtcggcccggctgttgcctgttgatggcgccgtgtagactaatcgatctatcagcaaaccacccgttgctgtcattggccagggtcgaaattaggtacagtactccgtacgtccccggcactgctgctcgacgtcacaatgataaatgaccagcgtttcgccgagacattctggtcgtgcgtgcgtgcgaggggcatgggccaccatgcgcctcgtagttatcggcaggaacaggcatgtgacgtgacacggccttgcccggaggaggcagcgctttgatgggtcgaaagatatgggcagcgtccacggacgatgtaacgacgcccttgaccgtgcgtgacgcggtactacaccgtaatagtaccgtaatatcaactatagccgcctcacctgtccggttgattacgccgcgcgacggctgtttcttgccgcgtcggcaggtccgcgcgccgcgactgacgtgatgatccgatattgcaggtgtgtcatttggggtgcgtccttgcattgcatgcaccacatgaccgtgtctagtgagcaagatcaggagtaatcaatggctaggctgtttgtttggaggggctaattcataagtccctctactttagtcccttttagcccctaaaatactaaaaaaggagggactaaaagaggctaaaactacctagttccataagttcctgtgggaggtgctaatagctcacctactattgaatggatgaagcatataagtgccggatgaaatgctcctagataggtcatttaatgatgtttcagtcccttttagtctctccaaacaaagtttaacctctctttcaaaaatataagtccctcccctagagacttatggttttgtgagtttagcccttctctcccaaacaccctctaagtaggactaaagaggacttatgttttagtcttagaactaaattttaaccctaggacttatgtaaacaatcggggcctaaaagttgctgcaactgatagcagctgatctagctttcctttcccatcagactagcgataccacagtatagtctcgttagagaattatgaatttcgcaaaattagttaggagtagtctcgatggttaattcaaaagcttactccaattactaaacgtaccactgtatctgctagtctaacatgaaaattagtttactactgcctctatcccacaatatatgtcgttttaactttttcatgcaacgtttgatcattcgttttatttaaaaaattagtataaatataaaaaaggataagtcatacttaaagtacttttgataatgaagcaaatcacaaagaaaataaataataattctattttttttaaataagacgaatgatcaaacattacaaacaaaaactcaaagcgacaagcaatatgggacggagttagtaagtcccataaaatcaaatctattatacgatatactccctccgtcccaaaatataagaacctaggaccggatgtgacattttctagtactacgaatctctgtcccatccagtcttagattcttatattttgggacgaagagagtagcacattctaagggcatccacaatatagtctaaaactagtccataagcaataaaatattccattcagccacctaacaacattgtggaactagtccatagcaagaaaatagcaaaagccacccataagcatatgggctgaccatatagaataatatatgttatttctctctatttcctctctcctcctaatactagttgctatctatatagattgtgaagataacaatagttatggtccatatgtgtgggtcccatctatatggactatttttgctatatacattgttgttgccctaatactactacatatctaatattagaatatatcacattgaagtaataaatcgtaatagttgattaaccggggctctggctagctcagtcgttggaagctttaatactccctccatctcaaaatgtacggatttttaggattgaaacgggtattaataaagtaggtagaactaaataggtgaagattgtgactggttgagaagtgaaggtaggtgagaaaattgaatggtacggtggaggattgtgattggttgagaagagaatgttggtgaagtggttatattttgggacaaatcttaaagagctaaaagttgttatattttgagatggagggagtagaagatataagtattttgcagataaactaagacatatggcaatgttttttaccctgtgtgttgagtacgaaatactatctctgccgccatcaaaattttgcccttctgtttttttcactgttccgttaatatttgtgtctcttttgacactgtcgttgattaacgaccatggcatttacttctactagtgtacgtgatttgtcacacgtaattcaattctacaatataagtaacttattttgtgaaacatttgagaaccaaatcccatggtgcaatttcaaaaattatccaattgtacaccttttttcccaatctattatctttgaagcggccataatttagttttgttgataactttatggtatttgttagaagtacgtgtcgagtgctgcattatttttgcacgtttacagggtataatggtcttttagaggcaaacgtaatggtgaaacgtctttgaagctgtggtgccctggtttagaaaacgtacgtacggcaaatgaaaaagttacagatgtggaagagagaatacagtcacaacaaatggcaaaaatagaaaaactttcccgctggaaaaataatagagtaaggccctgtttagtttccacgcaaaatttttttatcctgtcacatcgaatgttt

SEQ ID NO: 20006 - DNA, 1129 bp, Oryza sativa
taattaagcttaaaagattcgtctcgtaatttacatgtaaactgtgtgattgtttttttatttatatttaatgctctataaatatgtttaaatatctggtgcgacgaaatttttagaagtttgaatgtaatgtctaaatctggaggctgtaatgatgaagagaagacggcgagagtttacgaaccgtcttgtgcttgtaggagtacgtcaagtcttcaactcttcaagtcacctactgctactgcatgcatgtcaaactctcacatcggcgtacaccatacaaatgtaaccctgttctaaatttttttttcgaaacttcaagctttccatcacatcaaacctctcatacatacataatttttcaatcacatcgttccaatttcaccaaaaaggttatttgggaactagttactaaactttagtccctctcacaaaaacataagcccctcctctagagacttatggttttgagtttagcccctctctcccaaataccccctttcaaacttcagtgtgaactaagagggtgtttagatggggctaaaactttttagctaatgtcacattaaatgtttatatgctaatttagaatattaaatataaactaataaaaaaactaattttataaatgagagcttatccgatgcgacacagcttgccgggaagtttacgtgctgagtttactccaagtaccacccttgcgctttgattaccactgcagttcagagaaccatgcatgagagaaaggcacctcagattagacagcgaaatgattgccgtcagctgtctacacgagggaggaaatgagtgaaggttgcacacactcctacaggcagcagtggtttcttgtagcgccaggcaaaagaaagacaggtctctctcagggagtcagagatgacagaatcatttctttctcctgataatcacagttaaaccagctagtagtagtagaaaactctgcctcggtacttccgctttttccacggagtgaaggagtatagtagaaaactccttcgaattatacgtacaaaagtactcctactatactcgttagttgttcttattagtactaaacaatttttgagattttcggatgccgtttccggtttgcgcccatagttttagccgg

SEQ ID NO: 20007 - DNA, 6454 bp, Oryza sativa
agatcaacatttcaattccgtttcaaaaaaaatataaaaatgaaaatagtagagggttttccgaccgttttcatccctagttcctactcacgctgatgtgaatatacagtagtaggagtgttatagtgagctgtgtttagtttgtgtgccaattttttttaaaagtatatggacacacatttgaagtattaaacttagactagtaacaaaacaaattatatatttcacctgtaaactgcgagacgagtttattaagcctaaataatccgttgttagcaaatgtttactctagcaccagattgtcaaatcatggcgtaattagactcaaaagattcgtctcgcgatttacatagaaactatgcaattagttttttttgtccacatttaatactccatggatgtgtccaaacatttgatgtgacggaaaagttgtaagtttgaagaaaaaattttaaatctaaacacagcctgagttacgcaatgtaggtttgtgaagtggtactactggtcagttgcgcagcgcgagaaaacgttgctcatatagctgttgatatcgaccacgtaaggaactgaccaaatgaaaaacaagtactaatattatgtagtgagattacccatactataaatttgaacatcgtaatattatatagtattacatacctttaaaattttttatattttgaaacgggaagtatagactagggttgagagaaatagtagttagtagtaaggtactaggagtactactctttttatcctaaaaataatccaattctaaagattgcagcttctgtcgcctgttaagcgagctcgtccgcgctcaatctgaatatggtttatgttcaaattaaattgtagaattaaagatttttatgggaggaagaaggcccggtttagatgctgaaaattttcgggtctgagcgaaaagttttggcatggtccagttttcgcgttttgggaactaaacggtgaaagatttcggggtactgtttatgggtggacgagtagtacccctcaccctgcatgcaagcaacaacaacacctaggagagcattaaataggggcaaatcaggcagcattaaataggtccccaaaattttatgccaaaactttggctgtttagttcccagaatgccaaaaccccaaaattttttcctccgcccaaaaattttggccaacttttatgatgcctgagctcactgagtcacgttcaccggctcactgcctcccagtcttccagcgatgcatcggcgaccatcaatggcctcatcgtcctccttgcgccgcatgccgacgccacgaacgtacgccgcgcgcatgcatgcggggtttctcgtgacacgcaggccccacaggcagacacggcaaggacaaagccccatgggcttgcatgcacagtggccgtccctgtgcgagacctcgccccttgggggtcgtgtcatgcgatcgacgggaaactcgggcgcctctgcactctctctctctctctctctctctctctcaatgatcttggtcgagtcgaagcaaaagatcgcgtgtctgtcgagtgtcgacaagccaagctatccaaaggagtccgaacgtgtgggggtggccgtggccagtctcccgtgcatggcagtgtctctgccccctgactgctcgccactaccaggccgggccattctctctctctccctccgctagaagagattttaaatgggtgtgacacattttaatactataaatttaaatatattgtggctgtgtttagatccagttgtaaaattttagcgtatcacattaaatatacggacacgtatttaaagtattaaatatagtttaataacaaaataaattacagaatccgcttataaaccacgagatgaatttattaagcctaattaatccgtcattaacaaatgtctactatagcaccacattatcaaatcatggtgcaattacgcttaaaaaaatttgtctcgcaatttacacgcaatctgtgtaattagttattttttcgtctatatttaatactacatagatgtgtccaaacattcgatgtgaatggtgtaaaatttatcaagggatctaaacaggtcctgatctatgtccagatttattgtattagaatgtgtcacatatatttaaaatcagttatattatgcgatgcagggtgtatctccttgccgcgcgagatgacgggtttctgccaggtgggcaagaaaacaaagcaagaccgggcgggcgctacgtgtgctagcttagccccccggctacactacagtcactcacccccgccggcccgcccccggccgggcgtccttgttgtgatcgatcagcggcacacggtggcgcccacggtgcgtttcccccggcccgtgaccggtcgcaggggcgggcacactggcgcggtcaccgcagcaaatgcagcggtaggacgcgtagtttatgtgcgcaaaactgatcggaaccgacggacgtaagcaaaatataaagagaacattgcaaccacaacaacgtcaaacgtgaaagttttttcagacaaggcataaaaatactaattcctttcgtttcagattataagagtttataatattatccatattcatatgagactgcctatacatcatgtgataggcacacatatatatctagatgttaatgaatatagacacatatatgtataaattcattaatatatatatgaatatgaataatgctataaagtcttataatataaaacggaggaagtatcgaactataaaaattttctacagaataagaatctacaatactatatttgtctcacttattacctcctatttaaattttctgcaaataccaattttattcaggggcaaagtcaagacccggtcactatggacaagtgcccaggctccgcccgctgcaaaagtacgtaccagctgcttgattaatcgatctaacatgttatgttagatttagtctactatattacatctgggttatgtcatttttcttctataaatcgaaatactccctccgtattataataaattcatttttaagcctttccatttatctcaatataagtttatttttttaagtaatcattgtatcaggagtttatgaaagtatatacaaatgtattgggatttgataaaatagaggtattatagttatttgggttttgattggtatgtttgggataagtaaaaaaataaacatattttaggactgatggagtatataattttatgaattttacatatgcttagggcatgtacaaaggtaaaatttaatatgagctctttatattaattaatatcactagatattgtactcctataatagataagatctctaaacctttaatgcactaaataattttttttatacttcttttcttttctccaccctcatgcaataatttttccattaataaatgctaatagtcgactatgagtcgtcgtcatgcatagcaacgatgtttctcttttcttccttttctttcttcaacgtcaccaaatttatctgcattacaatgaagagaccccgttattagacaatgaagagaccccgttattagacaccctgcatatgccctatctcgtttgttcaggctcaaaatacgtcattgttcttaccgtcaatcactgtcaccattttgccatgtttatcctcacttattaaaggcataatagatgtcttccttttggacggcgttgtaaccattaacggatttgctatcggagcttttggtttgtgggccatcatacgagtgtcaagatatgtgctaggtatggaaaaaaattcattgcacatgcaaaatgctagctattattatattctgtaacggaggaaatagtcacctgttttttcttgtttatgttatgacaagttacatataaatatatttcagttatactataattatacttatactatatttaccttccaaagttttggactaaaagaaaaactgtcgaaagtctttagatagtctcaacaattaattaagcacttcaatgtaatgtaccgctacttgcgaacgtccgaattgtgacggatcggatcggtttatgcttttgacagtttttcacccgtgctagctgctgcgcgcggtgtcgtgtagtcgtggcggagacctggagtaaatggtcggcgttctacgtgcgtcagccatagcttgaccgggctgcgcaggcagtacctccttgacgccatcgacgattatccaacagtgccgcctcagtgcacctgccaggtggggcccacctgtccacgtgatacggcactgttgccttgttgtacacacactgttgctcagtgctgctttgagtagctgggtaggcatagctgtacaggacgcttagcaatgaagtgggctaggagtagggtagagtacatcggtgctacagaaaaggctacagttgcagcaaaagcccacccacggaggactagttcattcacccagtccagtccagtgccactagtactaaaacacctcctctccgtatctccggttctgtctgcaaagcttctaattgctgtagtttcttttaaaatcaaagttctcctagatagtttagcttttgattcagattaaaaaaaactgtaattataaaattcaagtagtaataaatttaaagccagaagtcagaaaacctagtatttctagattatcggaaatagctacaacgtgttatttttcagaattttaaactctccaaacgtgcctctctctctcgggtgacgggtggatgcgacgttaaatggcaacagcggccacgtcacctccgacgcctacaccgccgtagtactcccaaacctgattttcgtgtccttgaccgtccgtcttatttaaaaaaatacaaaaaaaattaaaaagataagtcacgcataaagtattaatcatattttatcatctaataaaaataaaaatactaattataaaaaatttttatataagacggacagtcaaatattgccacgaaaatctagggtttgcctttttttggacggagggattagacctcaaggtatctctcatgatcccctttcccaatactactgcgtactcctaccgtattttgcgtactccctccgttttcaaaataaaataaacgtagctataaatttctctgtgtccaattttaatcgttcattttatttaatttttttttaaaaaataaaaaaacataaagcacgtataaaatattatttatattttataatctaataataataaaatactaatcataaaaacttaaaataaaacaaacaattaaaattgaatacgaaaatttatatttgtgtttattttagaaacgagggaggtctggactactactagcggcgtagcctagccctgggctggtgatgatgatgcaacggcgccggggatttgacaccccggagacgtgacgaccgtagtgcaatcccggggaatctgcgtaacaatccccctgctgctgctgtcctgctagcctaaccgggggtggagtagactagtagtagtactaccagtagcagtgtaccacacgtagatcgggccccgtgtgacagggagagcgacgccggaggggggagatgggccgtgcaaccgctgcttatgtggtgtcgagtcgatggtgggggctaccggtcgggaggggtctcgctctcgcccaccccaccggcccgtcgtggtgtacagtgtactcctacgcggtggccaatggagagtgtgttttagggcagcgttaatggccaccgtacgtgtggtttgccgatcaaatcaaaaaccttgcgctggaattttgtggactaaaatctgtgttggcgactgcgaggggtggaagatgacgacgaacgaacgaacgaacgctacgggctcactcggtcaagtcaagggcatgccgtgctcgttttggaagttttcgatgttcatttcagggactccggagggacactcgtattgggtttacgaataggagatggcctaccgttccgggcttaaatgaaatgatggttttcacgaaatccggtagaaaatcagtagattcaataaattttataaaccaaaatttgaatacaaattccctgagtttatcgataagctcgtgaaaaccggtcggcttgatgaaattctgagcgaaatcatcgaaatttcaatcggtaactagtaaaggaggtaaactgatttttttcctttttaaattcgttattcttttctttactactgtaaatttcagtaaatacacggaatatattaatttttttgaaaatttatattccaataggttctataaatatcgttaacttctcccgtcccaaaatatagctacctagtacaggatgtgatattacctagtactactctcggtgacatggggccgggggtatcgtgactagaggcttgggtagccgcggtcacccacgtggcctgacccccttgggggggtcgggcccgagggtgacgtggccacccctccctctgtctccccgaggg

SEQ ID NO: 20008 - DNA, 418 bp, Oryza sativa
cgcccacgcaacggagggcgcttcctcgtccggagcgccacttcggtccgggcacgggggccggccccccgtgtccccggttggcggtaccggctgtcgaacctttgtggcgagccttcggaacgtccgttggcccccaaggttccggcccaccatcaccgaaaaatacgacggaagcgtcaaccccgccgagtttctccagatctacacgaccgggatcgaggccgccgggggtgacgacagggtcatggcgaatttcttccccatggccctgaagggtcaggcgcggggttggctaatgaacttgccacccgcgtcggtccactcttgggaggatttgtgccagcagttcaccacgaacttccagggcatatatccgcgcccaggcgaagaagcggacttgcatgcggggctgcag

SEQ ID NO: 20009 - DNA, 809 bp, Oryza sativa
aaagagcttcataggaaattttcctataggattgaacctccaaaatttctatgtttttcctcctaataaaaagggtccttacttttgcagagtagaattctgaatgaattttgagatatttgttcttcaaaattcgtgtgaagttatccatgatccaaacatataaaagggttatgactgcttagcaacaagaggtaccaaaagataccaagaactctacactatcttctcttttttttccttcgagaaactctacactagttaactataggaagtatcaaagagttactgaaagctaagggcccctttgaatcttaggattgagaaaacataggattttgatagaaatgtaagtgtaaaacagaggattgcaaaacgcagaaaaaacacaggaatgaccgtttgattgaaccgcaggaaaagcacatgaattgaatgagacagaaagactcaaaaggaaagttaccaagaggttgagggcccctttgaatcgtagaaatgaaaaaacggaggaatatgaaaaacataggattagtgacaggaatgtaagtgtaaaacagaggattgcaaaacacagaaaaaacacaagaataattgccaaggagtgaacctctctagcgggaggacgtgagaaccccctttgtgagttcggccaggggaataaggcgcgatgatcaagagcgtatcttcgccgtgggattacgctaacgtggtggatggcgatcgagaaggagacagaggatttatccaggttcgggccgctgagaagcgtaacaccctacttctgtatgtggattcaagcttatgct

SEQ ID NO: 20010 - DNA, 4156 bp, Oryza sativa
aaaggcgaagtagtggattaattagtagtgtgtaggaatcgggaaggttgagatcattggagaggataaaggtaggattcgttctttcaatctgcttttctcacagattctccgtggcatctgattgttcctctggagtgttgtgttgaccaagtttgtttgttgatagattgacatggtctgatactatgatgcgccagtctatgtgacatgcctttttttttccttcgatttgatggtgcgagggaggtgtgattgtgtcatcttccattctgaaagtgtttgtttcaacacaattgtagttaggtgatccactgagtctcagtcacaaccataatgtgctccacttagccttgatccacttaataaaattgttgttaagagaatcaaccatagtgtgctccacatagtctcagactctgaagtgataaccgcttccagcgtaggaaaatggcctattatagacaggggatggttatagacaaaattggttttaaattttaataatcatggcttagttgctagtcagtgtaaaaaaggtgttgggcaatacaaactagtctgcaagtctaatttttttagtggttggtgttttctttctcataaaaatcggtagcgcaaaccgacacacaagtacctgttttgttcttgatattattttttactttatttttgcttatatattgttgccacagcttgatcactgtaagatttgctcaaactactaacaagaacatttgctgactaatgcagtttaggctaatgagattagttcaacaatataattacactaaagtttgaaccacagatattgtaattggaaactgtgaaccacggcaactcttactttataaaattatttcgattctatttctagagccaaatttctcaaataagtctgaaatttcagaccttggtggtaataatgatttacttatgtgacatcagcttcagcaatattcattgcaccgattattgttttcacactatgagatgtaatagtgagccctgaaattcctatgctgctcccatgctgagaagaatagactgaattctgatcactgtgtttgtctgcacttggatctttttggacaattagtaatttttaagttttagctcctaccttttttccgtttgcagtacaaggctataggaaaacactgcggtaattcttgcaaatatatctatatttactgaggcttttatccttactcgcccaataatcaatgttagagtatatggtggttagagcaataatgttgttagattgatttatatcgtagtcttccttttctgtagatccctccttatctccacaccttttgtactcttaacaatcaaaattgcatcaatcatacttgtactgcttaaatcatttttttacactgcttaaatcatacttgataagttgatatccccaacattttacactcatttaatgacataacctgtcaatcaccttatcaaatttcagtaaaatagaattgaatggccctcaataatttcaatcttacttcaagtgcgaaggtgataggttttgagtacatttaaactaaatgatctatccttctgtttgccaggatatgtgaaatctgtagctctaccgcatgcaatgtggtaggcattggtgattcagaatccgttgagcaatggaatgaatcgaacagcacagcacctgcacaagcaccaccagctgaaactcagagattttggcaagggcatcggttcctgaactttcttcttgcttgcatggttttcgcctttgttatctcatggctctttcatttcaaagtcccgggctaagttttgaaacacatggtcctcaataaaagctccaatgccattactacacacctgtgggttggatttagtaaatctgaagaacaggctgaggtgaaggaaagttatgaagtggtacaaaaatgttgggtggggcatgttgatcttaactgtgtcaatggcaattgcctcctttcacaacgaccaagattccattagacaagaagctggaaggacaatttcctcctgtttcccttgtctggatggagatgaaaacaaagaatggagaatgtgtttgttccgtcaatagtgctgtcatggttttcaggaagagattgtgctgtatccattccctatcttctcaggcaatttatcatttattctgctgatttggtgtaagtgttatcttccaggagaaaaatgtgctgagttcggaagcatgtcgccagaaagaataaacaatattgtgaagttcctgggcatatcgccgcacatgaaattgtcgattttgtggagataatcctgtaatggtcctttcgacgtttgtgactccgtgttcggttgtttgttggatggagtacatgatgaaatgtcactctttgttggacgttagtactctttgttggatggagtactacagaatagtactagtagaatttttttatccatgctcattctaaacaatatatcatttcatcagtctttttcgtggtactaatgtggatatgtttgaccacgaagagaactgttgagttgaagaaattactgacttgtggcccaactctctctgtccttaaaaaagccggcctcgtactgtacgtgatacatatattatttctagattcgttatactaaaatatatcacattttaatacaggattggtttcttatattttaatacaaggttggtttcttttgggagagacagagggagtagcgggggaaacccatttggtccatgtcgaagcttgtactgctctttttgtcttaaaatataaggatctggatttgtatcacatccatctaaaatcccttatatctgggacggatggagtacaaagtacacgtggtacaatcttgcgactagagattggaactcctgtgagtgttcgattcagtgcgtgtctggcataaacacgcaataaattgcacgatacttggtggacgtatatctggagtacatactaccaccaccaccgtcttttagtttacacacttagaccttgtttagttgcggaaaatttttgggtttgattgtcatatcggatatactaacacacatttgaagtattaaacgtagtctaataacaaaacaaattacagattccgccagaaaaccatgagacaaatttattaagcctaattaatctgttattagcaaatgtttactgtagcaccatattgtcaaatcatgcgtaattaggcctaaaagattcgtctcacaatttacacgcaatctgtataattagttttttttcctacatttaatactctatgcatgtgtccaaatattcgatgtgacagtgtaaaaatttttattttggaaactaaactaggcttacaccgtgctgcagccaggcccagatataaatgcaaattggttgctggaaggccacggtgccaagacacggctacaggttgatgttgaattgttgatgcaggttgaaagtatggacgcgtatgatgagatcgcgtgctgtgccaccctgcggcggtgaagaaatttcacttttttcagtagactgtatcgtccactcgtttaaaacaccgaaaaaacagatggtccctcctgcagttacttccaagttcatccatccatctctgatctcactctacccgtgtcactccacgatcatcaccagtggctctatccaagccggtgatgtgaacaaagcctaatcacacacgcaggggcggatttagcatatagctgatggggtctaggactttagtcaatctttacctatgagatgtggagtatattcttatgtgtatgacctgagtccccacattatctggaaagaaggcctccactctcagtttttgttactattcttgcaatctctgtttgtgcatcgaggcgttactaccaagactcaaaccaatcactcccaatcccctcgatctaattggcaatcaacagaaaatcaagatgaggaacaaaatttgatgcattctacgctcgccgaaaaattcttgcgcttccacagcccgcaatgtgtccaacaagtagccacctagatgccggatgagtcgccactcatgaacgctggcggcctgtggtacttccttccactactctccgtctaacagcaatgtactttcctattcaccgggtgacgtcgcatgttgtggccgatctctgcgccacgccctg

SEQ ID NO: 20011 - DNA, 9908 bp, Oryza sativa
agtttggtgtgaactaaatagggctttagttattaagttgtgattcgatgtaatcccgtgccccgatcaatttttatcctccatccgcctctgcacacaggctctctgtcgtgcgattgttgcctccacctcgacgcggatagccgagctgcgcacaccatcgctctgcgctcccctacgtcgccgttcgcgcgacgcgctggcacgtggtctcccgctccgctcacccacgctgtcgccgtgcgcgtccgtgccacatcgcgtgagcgacacgctccaggcgaaaagcatgtggggtgggcaaccaaaaccgtcggtgagtgtgccaatacacgaatgaacaaacaattgatcagaaagattaagctggccactatgtacagcgacagctagtgactccgaagaacgtactacggcggccaagatcctgattcctgaatagcgtctaccgcccgattgattagagcaccaaatcatccattcatttcattcgttttatctgcgatcatgctatagtaccaggatggtggatgagcagaaatcgacaaggaaaccatgtgtaatgctgcctctgccgctggaatcttgttcaggatgtgcatgcactatgcagatggaccgggcggttgttctcaatccgcccccagaggattctcctcggggtcgacgcgagaagacaaactcccggtggaaagcagatgccgcggctcatgtaccaccattgacagcagcgtcggagagcgtgctgtgggcgtgattgatgtcttcatcgtgcctcccgttcatctgcgcgcgctgtcgctgaattgatagaaacagacacgtcagaaaaaaaaagtgcaatgtgacagtttgttccagtatgcctagtagatggctcctccaatcaagatcgaggtttttgttgtaatccctctcccaaaatataatactaacctaaaaccagattgaacgtatatatccagattctcatagtactagaatacaatccgatactaaactactccctccgacccaaaaaaaagacaaaccctggtttccgtgtccaacgtttgaccgtccgtcttatttgaaaaaattatgaaaaaaattaaaaagacaagtcacgcataaaatattaatcatattttatcatctaacaacaatgaaaatacgaattataaaaaaatttcatataagacggacaatcaaagttggacacggaaacccaagatttgccttttttgggacgaagggagtaagctgctactaggttacgtcaaatccagattatctaagtatattctaggaagtacttcctccgtcccaaaatgtaagcattttttaggttggcacgggtattaagaaagtaggtgagaatgattgaataaggtgtgtaattggttgaaaagagaaagtaggtgaaaaaaaatggttgtgattggttgagaggagaaggtaggtagaaaaatagcttcattttgggataaagtactgtgctagaaatagctacattttgggacggaggtagtatattattaggatggagggagtaattaaactagcaagggttgtaaacaaatttagtagtactcgctccgtctcaataaacaaatcatgagatgtgacgtattctagtataatgatctgagcaggttatcgcatctcataatatgtttgtttattttgggacggagaaagtaggatccagcatagtataaagtataggcaagttcatctaatagacaggctgactgtactaagctaggcttgttcagggagtatatagggagaagacttctacaatacccgatcagtaggatccccatggtttccgtttaatagcttatggaactcttccttcagtctgctgtctttctcctccttcaacctgccatccttttccctggtactcaatggaagcaaaggtactccatttgtacgatccggcatttctgtaaatatctcaacaaagcttgttacaaagtgtttgccatacaaatccctgtaaaggcgtaaggcaacaaatgtgacaaaaatataacctgggagtttgttgtccacgaagaatacgactaaattaacggtatacctgcatgggaaaagtatgtgaaaagagaggtagtggccacattatgacaataacaagcaaggagctaaacttatcataccaagcaacaacaacatccacagagtagtgtttgcgagaagcaattataagaagactctgaactatggccatgaaccaagcaagaagcttaacaaacctgtaacaaaaggtccaccagttaaattttagtgttcaggaatacactcaggcaaagttaatattcaggggtctcagaacttggtaatgttcaaaccagaaaacattggtaagaacatacctttttgaaccatatttgtggtatgttcgaacaaaaacaagagtaaaaatcatgtgagatgaaaatatcagatcaccgcagccaaaaagtactccacgaggaactgaaaaagaaaaatgaacttgtgtgatcaggaaaaattccttgcgcagctgtcaaaccacaatagaaacttacagttaatcaggagcacttcaaatacattgttgggtggtggaagagtagccaactttgagccctataaaggtaaaagcttcggatgagtgctaaaatgagtaattgacaggtttacaagttttcacatgtccaaaagcagagcaagagtgcatgtaaaattcttggctaaaatgaaaaaggcacctcacgacaatggtagtttgggcccggaagctgggtggaatagaacgtaatgattcttaaaacctgcgaagcctgaagaagaaatattcagttacttttcagtggcatgcataaactatatcaatggaaaaataggaagaatgcactcacaactaaaaaggctagcacccggcgccagattaggacagtgtagaatcttttgctatgataaataaaaggatgaaaagtccactgcacataaatatacttgtgagacccagcttgataagttgcagtataaaaaggaatcacataaatgcatgaaaggaactataatcttcaatatgtcatgaccaggaatatgacccatctctcaacagagaatgatgatagatcacgcctattatttttttatttatgcttaggtgttgatatctgaatgatctagtttttcttggttatacaaattatcagttatcaattaaacaaacagaaataagtagagtacaaggatacatactaaaacaaaggaagcgaagatggaagcaaatatgctctcacttagataacctttgtcttgcccaaactcctaaaaacaacggtaataattggctgttacatatgcaaattaatcgatagcaaaaaggataagtgatttacttactggaagggccataaatccaaggtcctgcagaagtggaccaggtcgatgcaagtaatgcactcctcgagcagccagcccatgaatatactaattataggcaaaatattgtatgaatctccaaagtaatccattaatcaactgacaaacacagaagaataagtaatcctatataactaaatgcagaaaaaaaaaagagaactgaacacagaaaatttccatcacgccaaaaagaaaaggaaacaacaaacaatattgatctgtcagaactatggtcttccaatgaaagttaggaattgcgatctaaaactgcatgaacttattgaccaagattttcaaccgttatgctgtgaatgtgcaagtcacatgacttgagtgcacacacagaaatattctgtttagtgttcagagagacagcacacttatatcccaaatgtcaaaataatataggaatcagagattggatcagtgagtggtgggtcagaactcagaagacactgtctactatcagcaagactgtatcacagacaaaataagttggattgagtagcatttaaaaatagttctcatgaacttttattgtggatttatgagaaagtaatagtagttacaagaatacatctaggaaaattcacaacatgcatagtaactattatttccatgcatgacatgatagttcaggcgatatactgttaaaagaaacataaacctatattaatttttaaaacaaggcaatgaggatagatttaacatgtctcagaaaggaaaacagaagacagatgaatacaagagtatcaattgacacagatggcgacaattcacctctacaatggcatataccatgtaagagcgcggcactagctagacaaacatttgaacaaagtgtttacccgctcaattttcttatactgctcacggccaatgaatttttcatgccatgcatacagcaggactgttccttattatgacattccattgcaatttcaaaaccgaaaaggcaatctgtgcccagggcatcattcattcattccttgaaagagcagcactgaatccctaatctacacagactacaaagaatgcactccaatatacaacacagaacacttgtaaatgttactgactacagatttagtatagctatttaaggtctcgcctagcaaccaaaaaaaccccaaaggctaatcacatggctactaaaaaaccccaaaacggcaacattatcaacgataacaaagtgcaaatcgcgttgcaacaggggggggcaaatttggcaacctctcatcaactcggcattaaaattctgtaacgcactccaccactagcaataaccacatcacgcgcgaaatcagtaattccacgcacacgaccgaaaactagtactactagtaacaaactgacgagctcacctgaaacacaattccggcgaggagcaatccccacttctcgcgcagcagcgagagctccaccgacgtctccgtggtcaccttcctccatacctacacaacaagaggtgaaaaaaataaaaatcgcaaattcacacgacgcgatcgacaaagaaatccacactaaaaaaagcacaagatcgaaaaaaaaaacagagagaaaaccttggaagcctcccgcgctatgtaaatcgtcatggccgcaccccgccgcgcgacccctgctcccaccccgaccgctgcagctcctaccgtgcgacgcgatcaagtccatgctccgatccacacatcacgccacagcccgccgcatccccgcgtcgggatcgccgccccaggagtaaaagacaccgccgagaaaccagagaagcgggcggaaaactcgtttcccaacaatctggctccgcctccggcgccggcagacgaaggccgctagctccctcacctgcgcgggggcgggccacgcggtgtacggacggggggcggcggtggccggcggcggcgtgagcaccgagagagacttggactttggagagagctggagggggggggggagttgtggagagatcgagaaaacgagagaggagagcgatggatggtggaaatatgggagagatgagggggttttatgaaaaaaaggggggtgttgaggatggagcacgaaggtcgtggggggttttaactgaaccttttgggaggaggccgtttgatctggatggacgacgtggagtggagcaaaacacatgacttcgtgctctaaaagttttactaccctcaaatccatccggacatccttatgtgtctcgttaagattcttaatttagggttggtttggtttgtggtctaaataggccttaccaatttttatcaatgccaaattttggtaagttttggcatgtctaatttttttgttaagataaagttgtgtttggattgaatccaaaatagcttaatttcactattgaaatgacatatttttttaggcatgccaaaatttggcttcaaaccaaatacacactaaacactattgaaaataccaaatattggtaagcctaatttaggccttaaaccgaagcccttactgaatttctctgctctgctcttctcttctactgttactctaaaaacgcaatcgttctatacttccattctcttctcatgccgtataccgtatttttgtgcatttataatggtgctactagaacttattcagtccacgtaacaaacaccgtgattgaattatgacgaaacacaagccacaaaccacaaaaacttttcgttagaccggcctttcgaaatgtagtagaagattcagatgcaactctcctggtctagtggagtcggctgttgcacgaggccccacggcgttttgttgatagaggtccagatcaaataccctgtcctagttgcggataccgacccgagcgacgggtggccggatcatgctgctacatgacaagtcagtgctaaccttctcgcaaagagacagattcgtgcttgcgtattttaatactaccgtatagtagtatctgccacatgcagtgatgcagagcaaaaaggccatcgatactgtatctcctagcagctgtagcagactgaataatgatcagtcatgcctcaattaccgattcctccctaaaaaaacctattttatctctttttattatttttctaaacaaaataaacataattgtaatctccatacatataatacttagtaaaaggttttatctttttattactactcaattgaatttttaatcggaaccgaacagacatcttaaacccacttcgaatcaaaggaaattcacatgaattttagaggattttattcctattggaattgaaaggaatcttaggccccctttttattcataggaattcataggaatactcatgggttgtctgcttgaatgtatttcttttttctttttgtctttgttacatgttgtatcgctagtatgagttaatttcttcttccttctagtaaaaaaaatagtacattcatcttagtttgatcatttttaggtcttttcaaaataatcgtcctctctaacaagtgtctcttcgtttattatttgtgcaacgagtaaatgtgttgcatggaattaaccaatattagtttttgttggtgcaacttcatgtaatatttaaaatgtaatgcaattcacaaggcataaaagcgacgtagcaccttgattgatgatgattaattttcgaatgatgaaggtcttgttgtccttagtccctaccttttttttagacgatgattatattgggatggaggaagtatgccctaaacttgcgtatagatgaattactatacattgaaaaatgattaccaataagtcttgaaaagttgaaattattggtgatttggtactggtcgttttttttttttttgctatggaggcacagggcttatttagtctggacggaagtgatgtgttgcttgcagtacatataaatgaaacgtgcatttgttgactttaagcaatggttcacttgagcgcatgatctgctagttgcgcaacacgcagatgcaaggctatgggctatgtggcgtgagagtacatgttcgatggttgcaacggcttatgccgggtgtgatgggcaatttgcacgccacgatgagatgcttgtattcgacggtttaatgaaggattatacagcaaatggagaggtgtgtattgattaattacttcgtggcttggggtataaagagcactaggaatcttggatctctcgcaagaacaagtgacatgttaggttgttctgtgacatgttagcgtccagtgggaatttagctgtgacagttaggatagaggtaggttggtcaaaattctaaatgccagagttacccatgtgatgttgaaataggaaaatattgatgccacggcaaaaggtcagctttgactggtgccatgccaacaaaacctggtggcctggccctcccaatctcctatgttgccaatgccaattgctactacaaggacaaaactgcaataatgaattttcttgagcttgtttgtgcaagaatcccagtatgtttttttttttctatcgaagtcaacaggtttttagctttgacctatcagaggataccgtgtccagtgtatttgcattatgaattttcttgagcttgtttgtgcaagaatcccagtatttgtttcagcattggtaaagggtgagatcacaagacacaggactataagccggagttgatttcaatctataaggggatgtcccatcgttatctacatgtcacttaaatagttataaattttttaaaaaaaataagtatcaaaaatgtattaacatgtgatatatcactccacaaacatgcaagtttaaattcaacttccacatctcgtaacgaaaaaaatcaaatttgactctgaatatatgccacctagcaaaagtttaatttgttttttcgttgcaagaacgtagaagttgaatttgaacttgcatgtttgtggagtgatatatcacattttaatacatcttctcaattttttttattttattttttcataaccatttgagtgacatgtaaataacgaggggatatcccctcccctcgagtaatcaaaatagtttcccgactataagcatatgcgtttgggtcatggatgaggcagggtgagacgaggcgtgctcacctttgagggtgtttggttcagcgaccggttgaatgagtttatatctgaggttacgtttggttaatcctttctacaagaggatctgaaagagatttattctaaacctattatagtctaagattattcaccctcaatctactccattcccttttactgccaattgaccaaacaagacctaaaagagaatactcctttaatctaggttggtcttgtctcttacaaactcatggatcgattcaaattagttttctcttactgacatatgggtcatctcttaaaaacaagactatctcatacgaaaaggataaatggttacatccaattaaaaacatatatgagtactctaacctgtttcccttcgtctccaaatcgaacacatgctaggagaaaacacagtgcaaaatgcccaaccaacatctacactgcttcaaacagaataagtatcatgttttttttatgtgtttttttagtgtattggttagtaatatgctgataacatgtgtaacaaattgaagcatgagaaaaggtataacaaaatagttcttgatgtcacgatgacaaagtagtgttattggatagaggggaaaaatgggaaaatacaaagaaacaaaaggtcagctcacgaaattgtctgcctaattctgacagtccttatcagcatccaacattgcccggtcagctaagagtaacagatagcaaaagccaacgttccaacaaatggcatgttctctcgcatgataaggtggttaacgcccaatggacaaccgagtttttgctagcacaaatcctatcatgccctgtctgtaactgtaagtggaacaagtatacgctgacgggacgatttcaccggatccagattttgctgctggtgtcttagttttcaatttttctggccggtacgacggtacgctcgccacatttctgttgtttttatactttcgtaagttacaaccttattactgctttagaaaaaggagttggtgccgctggtataccgtcctctccaatctccatggctcacgtttaaccctcacgtttggccttgaaatatgctcacttcatctccaaataaacaaacaacatatcctcggctgcgttggaggtggcggcggttttgcatcggcggctgctggcgtcggtggctgatgacagcagcagcggcaacggcggccggcttgcggcggccatgactgaggaggcggcggcgacatcggcagatgcggcagtggaggcagggaaggagtcgggtgtgaggtgacggcggcgacagtgaggtggtggtgaccatgacggtggtgggaggaggcatggcggcctcggacggcttgccgagggcgtcgcagacggctacatcggaccggcgcagcatcgtttggaggaggggtcggagaccaccttgacgcagagtggcgcaaccgatggcagtggaggccgactc

SEQ ID NO: 20012 - DNA, 6603 bp, Oryza sativa
cgacctcggtgcgtggtggagctactggtgggtgtggcacggtcttcggcgtacgaaggttggccagcggggggggggggcatcggtgcaggggccccacatgtcggcagagtttgagtggtggtggagcattggtgcgtcagccgtggattcgcaggtggggagcggcgggtgaaaacccagcccggcctttgccggaccgacaacgatggttaattccccctcctgaaggtgttgtcgtgctgtctcacccctcaagggtggttgccgggtgaaagcccagtcttggctcctttgagccctgacggacggtggcagcggttttccgtcgcttcttttcttgaagacgccgttttggcacccccttgctgtagggcgatctcgtatgtgttcatttgttggtctagcggcggccggtcacgcttagcagcggccggtctagtgctaaccttctcctgtcgtgtgtgttggcgctgccggtgcgtgggtggtggtatattttttttctttttcctggttacgaccctccagggttgtaatcttgtaatctttttcctgctctatcaatagaatatcgcaccgtctcgtgcgggttgttaaagaaaaatttaagcttgttctttcgtatcactatgtatcacatctcgttctagttttatttattttagaacggatagagtacgtgtgaatgtgttcaaaaatcaaaacccgtatttgtgtaagcatctgtatcttacgaacaagaaaactgacgttagtttagaatcaggttaatgcattataaaatgcacaaaaaagactgtgggttggtttggtttgtggcataaataggccttaccaatttttgtcaatgtcaaattttagcaagttttggtatgtttaattttgataaggtaaagttgtgtttggattgaagccaaaatagcctaaattcactattgaaatgacctattttcttaggcatgccaaaatttggcttcaaaccaaatacacactaaacactattgaaaataccaaatattagtaagcctaatttaggccttaaaccaaaccagtcctgtgtttcggaaacaacgtaaccttagttttttaagacaaattaccaggccagttatgtccgtgagacagtaattggtccgaacaaaattctcttatccataaaacctcatcttccgtaggccttgtgcttgggtagcagttctaaaaagaataagcccctccctccatataggtttaatcttgtttgtatttccacaataccagatattataacaccctaactattagaactagaactggtgtaatttaactccctcagcggtttacgctaacgtggcttgttgactagtccaatcaacagagtcagcatacgagcccccctcctccattctttctttctttccaccctcgccgatcatcgccgttatctccccggtccgctcctcgcgttactctctgggtgaagttctcgagctccagatggcgcccttgatctggcatgtcaaggagaagcagaagtagccaccacgggcaaggagtggtagcaccagaaacatcccgagcagcaaggagcagcagctcgcgcggagcaggtcccaccatcacgatggtgggtggagtagggagctagcagtagcgagcatcgacttctccctcgatctcaccccagcaagagctcaagccgtgaggttgacggctccttcctggcggcgcgtggggcaagcagagctcgaccttggagcagcttagagaaaggaggggccgtcgagggttggcttctgcttctccatggctcgatcaggtgggcttcccaaagcttttggaaggttctcgcccaatcgattggagacgagggagcagcaaatggctgccacggtgctcaccagcctcgccaccacgtcctgtggtgttgtccgtcggtggacaccgcacaggccgtcccttcttcctcctaccacagggcaatgctcctcgctgaccacatcctccaccgctgctgcagcagatccctccctctcctccgctggcggtgatgtcagggtgaggctgcccgcccaattcttcctcataccacaggcagcgctccctacggaccgacgcctgactagcgcgtttccaccgccgcaacggatccctctccctcctccggcggtggcgatgccataacaagaccatcggggccaaacctgagttgtgtagttgcgccgagcatgaaggagaaactagattgactagggaaaaggagagagggggaagagcgttgataagtgggttctgtggttttttaatttttttttcttgtcacttacatgtggtccacacttatagtttgtatctagactattgcgtcagtacagatggaccaagtcaatgtgatatgttagcaagcgatcccggactagttggatcggctggtgtttgatcaatgtctggttgtggctggtgttctttttagcaaaaatggaaagaaatgtgtgtatttagtaatcgatgcatgagtgcatgattagcgagttcagagtgccatgccctaatcaggctatcgcaggacttgtgaatagaagggaataatatcatacatgtatatatgtgaaccgcggttcaaccgcctaggccaccagtcaatcgggtcacccaccagttcatttttttttactatgaataatggcggcatcggtgacgacggaacggagacacagcatgaggaagagtcactgatgatggcactagtatctgggaggggggagacacggcgtgtggaagagccgctaatgctggcatcgtggagggggagaaggaagggtgtgacaaagggcttgggaaggcttgggaaggaggcattgtcgcgtcgacatcctcgaggtaaggaggaagggcagggggctgcgagcgacagtgaccccaacatctgtctaaaaaaatgtggcctcctgagtccacactagttttaccagcggaatgggcccaaaacggaggtatatttggcctacggaccatccattcaccatttctacatttaccctcgaaaatgatttgggttggtattttacatctgtattaggcaaaaaacagagcttccaagcagactctgaggaagtcaaattagttcggttttaataggctaaggatgaagatatccggtattgcagatcaagaatacggatgagattgcaactatattggagggagtcaaggtggacttattctgttctagaatcactttacaggcccagcttaccgtacattcactcatcagagcaacacgacagccgtccaagtcgcggccatgcgtagcagagggccagagcccagacgccagccagacaggcagcgtcgtagtgcgttacggagctttgccacgaactctcgtagtcccgtgtactcccggaccggagcagtaggggttcgggagcagtatgccgtgccgtgcccgacggggaatgcatgacctgacagtaacagtacaacccactactagcttcaaattatctatagccaatgtaatagtcaattcatacaatagttgattactacactattaatacatggtcccacatatcatacacatattacgtcttggagttcgtgctacagctggctatagatatgtagtccgctactattttctctctttttttatctctttaaaatatgtttataactggcttatagcctgttattgtagtgaagacgtgctgtgggcccgcacaccatgagccatgacaccgactactgccgtttggtgttttaccgttctgggttttcgctcgcatggtgcccacgtagagacgatagacgaaaagaatttgaaaatgtacttttatttatcatattttgcatttatatacctgtataagattattttataaaaatatatctaatccgtgcggaatggttgcgcgggagcgagggcgaaccgcagactcgagccggtcaagcggaaccgggatgcgcgactgagccggtctcgcatggctacactgcgggatcaagtcggtaccatggcgccgaagcgcgggagcgatggcgtcgggggagcgtggcggtactgcataacggcggcgcggcaccggcgcggtcccgcggttccagcgcgtggtatcgagccagtctccggctccgtgtgttattccgtgttaatcccccaattttttccaactcatctccttcattttccgcgcgcacgcttttcaaactgctaaacggtgtaatttttgcaaaaagtatctatactaaagttgctcagaaaaatcatattaatctattttttaaaaaaattaactaataattaattaatcacgtgctaatgtactgctccgttttccgtgcggacatgtattcacgagttgggaaagggcgtgcgtatggcagcggtagtccgcgcatccgccatgtgggagagaggccggtcccacgcatccaatatgcaggagcgctccggatccgtgtgttattcccctaatatttccaacccatctccttccttttccgcgcgcacgtttttcaaactactaaacggtgtattttttgcaacaaattactcacatattatggaaacgctctattaagagaatccgtttcaatttttgttgtactcatgatgttacactacgtatagatcaaatgttgcagtgaattaaaacatctcgctatttgcttaaacattttttatatatggtaaaacaatacccgattttttgaaaaccatttgtttcatacattgtagcaaaatgttccatgaggtgatttggttgtatttcatttttttaaacgattgaacattttcgatctacttagtgaaataattccgatctacttggtggaatagagcccgattaatcgggcgtccgattcgtagtcgcctcggaaaaactcttatacgtgcaatgcgccggctcttcaacatcagatccgaaaatgcacccttcccgaaaacttttcggcgaaagggggtaactatatttatagcgccatatttttcaccaacaaatagtcagcatgtatttacattgtaagtccctaaattacatatgtaattttagtgtatttacaatgtaaattctaaaattacatatgtaagtctctaaattacatatgtaattttagtatatttacaatgtaagttctaaaattacatatgtaagtcctaaaattatatatgtagtagtttttttcatgaaaacacatgctgacgagatgagaaatttgaattgattggcttcacgatgcaacacgaaacacgtaaagacgttccatgcacatgtgtagcgcccgttccgtcgtggcgcctagcgggaaaattaaattctaaaaaccatatttgcgaaagtcgtttctttgcttgttgtctatgtgcgtgccaatctctgatctcgaatccccgatccatcgtcgaattcaaatttcaagtccaaatctctcctaaattccatccctctgaaaaagtctagtttgcctccctcaggttcagtgggccgatttccctctcggcccatctctctctctgtctctctccctcagctttcccctcgctctgcccgtgcgcagcacgcgtgtgcgcgtgagccgacgccgagtcgagccgagcaccatctcctctctctcgttctctcgctctccctctccccgtctctctccccggcgaccccccgcccgtgaatttcgaacccgcgcaccgttgcttcgcgcgcgcgtgcccgcgcgttcgccgccgtcgtcagccgcctgctgcccgtgcctgcgccgtccggccctgcgccctgccacgctgcgcctgcgccgcgccctgccccgcgagccagcacgcgtgcccgagccgcgccgctcgcatccgtccaaaacccgaagacggagctcccgctcccatccctctcccttcccaaattggcatggcgcgcccctcctttctcccctccgtttttccctggaccctctcggcccggcccctgcttcctccggtcggttcccgcgccatggacacagaggagcagccgcccaagccgttgcccgcgtttgaccgcgcccgtgaagcctatcccttcccctcgaagctccctcgcaccctagtgtcgcccaagatcggtttccgaaccgacattgccgcctataaacccgagcccctccccaaaccaatctcccccgttttcaccctcgccattgccgctctcttgccctgtttcgtcgtcgccatccgttgttgagcgtgccggaggagccggcgcgttcgtggacgcgtgacgtggactccgggcgctcgtcttcttcctcttcctcatcccgaggccgaaacgatcacgtttcgcgccgtcggccatcgtcactacgccccttcaccccgtcgcggtagtgcactccccgttctccctcctcgttccctctcctccccttagactcgagtagtagcacgactagaccccccgtagctagctggcgtcgccctaagccttgccgccgcccgctatgtgctcgccgccgtcgccgcccgagctcggtagcgcctctcatcgccggcctccctcggtgccttttctcctaatccagcgcaaggaacggactccggtggccgcgtagatccgctggtccggagaaatcgaactcccgtca

SEQ ID NO: 20013 - DNA, 4709 bp, Oryza sativa
ttcaacctcctgccggctagcgtggcagccatgtaggcgccacgtcggcgccacctcggccgcgaccaggtcaagctaaccctggtccgccgctcccctccgccccgccctcgcgcgcggtccaccgtgatccgtaaggctgcgcgtgggcccgccgcatccgcacccaccgcgagccgcgcgcgtgcaccgcgtccctcccccaaaccctagcgcgcgccgcgtgctccctccgcgcgatgaaccgtgtcaccaacaagcgggtcccactcgggaccacgcgaggtgagcccggtccaccggttccctctctcacctcccgcgcaccctactgggccgagtcctctcgggccggccggcccattagctcggccgagccgcgcctcttctctcgggccgcgccctagccgcccgagggaagtctactcgtcctccctctttcttttcttttcaaaaggatttaaataaatcatttttcctttagatcaaaaatccaataatcttagaaattcaatatcttcttaaccgtacatccgattgactccgttcaacttccaaaaatcctcaattctcgagatctatccaatggcacgcatagaggtcaataatagagctttattttcgccgtttgttgagttgtcccgtttcgtgtgtagtttcggagcccgaagacccgcagtgcgaggatttcgaggatcaagctcaagatctcaagcaaggcaagtcacctttgatcatcttgcacctataatttaaatctaattatttcttttccgcaaatattgcatgaatatgtttaacacaagtatttcggccacggcttgcgagatagcctgccggcctcaaccctaattgctgcaattaccctccttgaattattgaacacttaaacctcctttgtcgactgttgtgcttcgatgcacgggccttcgggcacgcgcatcggaacacctcccctcaaatttaaaatatccaacgatgggtaaaacttggggttttacaaaagacttggaaaacccgacacctgggtcggtgcttgcgaactaaatgaatttccaaaatcgcggaccggggaacgtaccgggagtacggtttcccactcttgcacttaaggatcgtttccttggaatttcatccgaacataagacaagtgcgaccacatgggtgtaatgggacacccctggttgagtaattagctaatcgggggaaccatgatgccaaaagacatgtggattcaacggggtggtgccggggagaacccccggatttcctggcacagtatggtgtgggacctaacctggtgttggtctgggacccctctcgttggcatatggtgaacctgtgtcggctttcaaaatgccttgtcatgaaagcctcaaggtctctagacgtggccgttatgcatgggctgggtgatccgggttagtaatgtcgtgtgggtaaagtgtaccccctctgcagaggttattaaactgttcgaacagccgtgcccatggtcatgggcggatgtgaggtgattcctagcgtagttttgtatgactactgctttgtgaaattgttgctgtgaaatgggttcgatgtttggaaaatctgcggctgatggggtcagccaggcccgggtggccatttgaaagctgttggccgggtgccaaccttgaatcaattcaaagattgatacattgcacatactccgaccagacgagacacactgtcacatccgtgtcgtttgagaagtactcacttagttgttttaaaaaggagtttaaataaaatcaattgcaaaaacaacagcctttcctttgaagcctgcattaaacacttaattcccacggcttgctgagtactcctgtactcacccttactctataaaaataatccccccggttgctgaagaagatgaagtggatcccgctgacgaggagttcttccaggagcaagtcggctacgatgagttttagggtttcggtctagttcccaagtcgcgcctgtgatgattggtccaagtcttggcttccgttttcccttttgtaatgcagttatgagctcgggatctgtccgcaacccaacatgactgtactcctactctgtaataaagagacctctgttgttgtgatattctgttttcctgtgataccaacaatgttttctgggactggtatcgattaacaggttaatttggagcgtcacgagctagttccgtcggggactagttcggggcgtgacaacatggtattgcaatcgtacacgaatctcaagggagatcaattgaacaagaaatctactgtgattactcacaaaatgtgtcgatataattatagcaacaccgcggcgaaaagcgacgtcgccttctatcgatcgtaatgtacgcacgacgcttccagcaaattaacaacgggacaagccaatccatgcagcacgccatactcgatcgatcacaacttcgcagggaatcgaggatagccgaggcgtgaagcagacgcgacccgggccgcatccatccatctgcccccgcgcgccgattcctcgtgctcgtgcgcgcgacatgcggggcgcgtgtcctctgccacccgtcccgtcccgtccgtgcgcgcgcgcgatttcttaaagccggcgacatgccgtcggcgggtgcacgacagcgaccgccgaccggggccaatccgtggcttgtactcttgcgccaccgttggccccgccggccggcatggccgcgagaggaggccatttatcagttgcgtcttggcaatatatggtgtgttttcttgctttctgcattaatgagagcaagtttaatagtatagccaactactagctccaattcatctatagtcaatctaatagctcattcatataatagttatatactgcactattaatatctggtctcacctatcatatatacattgcgtcttggagtccgtgctacagctggctataaatctgtagcccgctgctattctctctccttatttatcttcttaaaatatgtttgtagctgacttatagcctactattgtacctgctctgatgatcaatccagcaccgaaatggaagccatctttaaataagcagattgctggatggagcccatccgtgcaccgtgccatggtccatgcgtcgcgttgattagcgctagctgctggtcgagccgacttgtgttgcttgcagcgtccgtcgacggcagcttagcgcgcgctggcacgtagagttgccttattaatgtcgggggtggctcgccatgttctgcgacagcagatcgaaatgagaagttaagaaacccatgttcggaaaatggattgccgcgtgctcgagatcacactggccgacaggtgggcctctcagttgcattcctcagctatgctctggacagcagtgcctgccaattgtgtcaaacggtcaaaccccatcctgaagaaagcttaaaacaaaccctttttgcacagtagaccatacataggcacatagctacagtctgtgagtagattagatcattagagtactttgttactgcactagtgaccactgtcctagcttaagaaatcaccctccctctagtacgcacagctgtctttcttgacaatatctgtactactatgtgttaaaaatacagagagaacatgaacacttgtccttaacatagagtaacccatttcggcaagttcggtaatatatccaaccactctacataaatccgtttggttacatgtgttactctatctcatatctgatgctttcttaggtggttaagctatcaacaagctacctgctcacttgaatcaacagttcctcgacgccaatgagtaggcggttgtgaagagccaattttatcatgtttttcagccacacatgaagtagaatccaccgattcataatcatctataatcgtttttacgcgctttgcaactagacaaaaatcggtattggagagcaatgcaattccccttacattctcgtccaataatctaatttgacgatccaaaagaaaccaaatccatggggaggagatataaaacatagttcacccccataatgcaatgcccctcctgtagatattttttggtcaccaaagacaatagtgtggacccctgcagggtcctcaaagggaaaggcaccagagttaattaactggttgtcttactagatcctagctgttcctctgctgacagtggttgtgtttgtgtatctcggtcccctctgcatccttcctcggtttagtcctgacgaggaggggaaaaaaaataacccagccactacacacctgctggtccaacagctagaaacagctaaccgctgccccagcaagccggtgaactgtcatcacgcccagatccagggacattctcttttcgctttgtcggcgtctactccatcgatctaccacaccctgttcatacgcatttgtctcggttgccgccatccgccaccaacgtgatacctgaaaattttcattcatacgatgaacagagccatctgccatctactaatctagttgctgaacaaagtctaaggccagtcacaatggctagtgtcattgcacggctacccaaaatattataccatcttctctcaaatgaaatcttttatgaaacaatccccacagtggagggggttcactttgacgtttccaagactaagcaaagcatttaattgatacaagttgctgggatcatttgtacccaaaatccggcgcggcgcgggagaatgcggag

SEQ ID NO: 20014 - DNA, 4688 bp, Oryza sativa
agttgccgacaaaattattaaggattagttacgacttcttagaggaggtacaatagcatgctataagccagctgcaaacatatttaaagcagataaatgaggagagagaaaagcagcgggctacagatttatagccagctgtagcacggactccaagacgcaatgtgtgtatgacaggtggggccatgtattaatagtgtagtatgtaactattatatgaataagctattagattgactataaatgaattggagctagtagttggctatactattaaacttgctcttaccggtgtgtgcaaccatatactccacttatcatatatatatatgcgcgtcggagcgaaattttgcagggtggttgtgatctctccggtgtttgttgttatacagacgtatgtatgttcatacataatgttgccaaacggcaaccgaatttcacacatgctttcaagtttcagcagatgttggttatcgagggattggtgggtgaacaacacagagcagaagagagctgtacgttccaacaaaccattgaacaagtcactgtatgtatctgaacaacgccatactatgggggtgtttagatggggctaaacctttttagcctatgtcacatcggatgtttagacgctaacttggagtattaaatatagactaataaaaaaactaatttcataaatgagagctaatccacgagacgaattttttaagcctaattaatccataattatcaaaagtttattgtagcattacattgtcaaaattatagcgtaattagactcaaaagatttgtctcacgaattagtccaaggttatgaaaataggttttgtaattagtgtatgtttaatacttcaaattagtatccaaacattcaataagacagtgacttattctaagtctctcgaaacgaaataggccctatacattttctttttctgcaaaagaaaatgaaaacgtaggccggttgcgagtgcgtgctgaggcaatcaatcatacattcgagttcattcaactgagcacaatcagtggcaaagcttgctgcaaaacgggggtcccagtcgtactaccttcctatgatttgttaaggccctaattatagaatctagtaagagacagcggagaccaaaagagtgcaggctgagcactctgccctccatttgctagcagaggcaaggctctgtgtagatgattactccttttaacaattcgattatacagattactgaaacttcaccttcgatttaacaattcgatggttgccacagctatattcatccatgtgacgacctaggcttagagcagatagataatgaacgcccaccatcagcctgaccaacggagcagcactatacattcgtgatacggagaactactcctttatttatgtgcccctatagccggaacatttgattacgtccgcacaaagcacggttcatgtacatgaaaattgcaggataaattgcaccggacggcagcgacatgtatcctcctctcatgtcaattcgctctggaagctcgccaattggatttgggcccctacgtgagtctccgaaagtttttacttccactcgttcaaggagtgtgtagttcgcatccgatgtccatagtgaaggtgcaacaaggcgtagggatactaataatctgtgattactcaacttgtggtttgagatgtagaatatgtgcaagtgaccagtatgcaagtagtactagcaccatacaggctagtaatacgctcgagagaataggagtacatcttaagctaggcaggcagcaagcatttctaaactgattggtcggagctgattaaaacggattacagggtggtggccccacaacactagtccagtttaggttgccaacccagtatcgccattggttcattggctagtactagtagcaagccgagaccggccggtggtggtggccctcctcaccagcgcctcacctcggctctttttgcccctccccccgccgtctcgtccccaacgtgacggccacatgggtgccggttgccccccacaccgatcgatcgatcgatcaatccaccagctcactcctcacccccatcaggtgcgcgcaaccacctttccaccgatcacgacgctcccccatccccgtctgctcggctcggcgcagcgcacccacacccacgccgtcgtgcgcgccacccgagcccgcaaggcggaggtaaaaactgggatgggataccgtgcggtttaccccagcgggaaaaagggacaagatcatcgtaacacggcccgaggcgaggaagagagggggtctactttcgggggtcgagtcggtggaacccgagggcgctttctcttggaaacacgcctggtgcgccatgcgacgcaacgcaatggtgagagacggacggacggacggaaacatcgagcaaaaagagaggagggctttgggcctttgaccgggtcaagagaggagaggacgcatgcaaaacacagagagcagaatataaaccggccgaactcatgcgcccatgaatacgcatgccagggccagtccaagaggaagacgggggatgatgacatgatccaatccaaaattgcttttatggcgggcattggagcggagcggagcggagcaagcagaggctctcccgccaaaactcttcaaggccattaaaatcggcagaggcagagagctactatgacggaacggacggacggatggtgatggctccagcggctgagccacccattccagctagacccacgctggatcctgcgatcgagctagccgagccaagcctgggactctctttggggatgcgtcgttttctcggcgagcacgcaggggactaccggagatctagtcagatgctgacccacagccaggcagattcctaggcggttagtcgccggacaaactgttcatcctccattgtgcaagtgtactacaccatccactctataatcatgtatttattgtcaactagtaagaaatactcaccatcattcatatattaaggctttgatggtacaaatacaactgttgtttaacaacacccagcccaactttgctgctgctgcggctaagcaccgaactactacacccctaaataagaatcttattgtaccgaaccaaaacagaaggttagggcacctataagctagtacaagaaaaatggcaattaaattcatagtttccttttcttttttttccttaagaaaggaacgcccttattcacggagcccacggcaagcttcttttgcaagtaaaagactgcaaaaaggagggaggagggagagagaccttatagctgggtgtgcgctggtacttcacttcttggcaagcacccaaagcaagcaaagccatggatgatgtagaaatgggtttatttttggctcccccaagatgacccatccataaaccactttgatgataccttgtcacttcttgcttgcaagctgcacaagccgctaacatttctctctcgccctccaaaagaaccacttattattattccttccaaaccactctgccaaaccaccaaaccgaagacatggatttcctctactgcacgtcgtctccgtctccatctccgccgctttccgtccacaccaaaaaaccaatatatcaccaatcaaacaaacaaacctaacgctgatgatactactgcctcctactaccctctttggctaatactaccacctaacagacgaagtactgttactaactttaattaatatgattaaacttgacgcaaagccagaagggggccgccggaatcttggtgcatcatccttcgtctgctccggccgacacaaaaaagttcacgaactgtggcagagcgcaggcgccggcgccggcgacggcacggctggagacgcgcgccgcttctggctggccagcatggcgttgctccggttaatcaaagcgtctgcataaaaaaaaacaactcgacataagcttttgcttgccatttccgtcgagaaaagaggatttcgccgcatgtggtggttaccgtgatcgagaacgaaaccgccggggtagcgaggctgggcgccgaggtcgtcgaggttgagattgagcgcttgcacgacacgggcggggacaagaacagtcgagcagcctgcagggtcgcggaaaacaccaaaggggaagaatattgagccaaaagaacaggggaatacgccggcaaaagcaaacggccaaaaatggcggacactgcacctgtctttctcttgggctccgccggtgcgccggccgggcgagggaggaagacgccggtgccgttgcgctcgcgcttggcgccgggcggggtgaggaacacggcgcgcatgccgccgccgccgccacccccgactccgggtgccggcgcgtgctgctgcttctgcaagggaggccacgccgcagggttcatgtcgacaggcgacgcggcgactccgcacccggcggtcttcgccgctgccgtctgcctcgcgccccacgcggcggccgcggcgagatgccgatccctctgcaacttcagcagctgctgctgcttgaggagatgaaacttgaacaggagaaaaatgtcggggagaaaaaaccgcggaaaacgacggtgcaactgaagaatctctgcatgaaccaagtacctgtgcggcttgaatctggcgctgtgtaagcaactgggcgagcggatggtagtaggcggcgggagcgacctttgttgccgg

SEQ ID NO: 20015 - DNA, 1048 bp, Oryza sativa
cgtcgcgctcgccgtcgtcaccaagaagcccggcgaggcggcgggagaggccggccaagcaatcctcctcgtcgctgctatcgctcctcgcggccacggcggccttctcctcctcggagaagaagtcgtcgtcgaggaactcatccggcagcaagaactcctcgccaccgtcggaccactccgtcgccatttccctccaattccccaccacaacaatcctgacctccttcccccccgagagttatggcgtgccggtttggtgggcgagaacctctgcccgcccgaggacgacgagaagaactagtgacagcttcgaaccgtacggacagcggccacaaccagctatccggccggtcccccccacacacaaaggaggcggagaacgaagggcgcgaagccgagcgcgacgcaagcggcggcgagtagagaggttcttgtcgccgaaaagaagcgggcggagaaggagatggggggcgtgagaatgtcgctggacggcggcaccgcgagtcaaaatgctgctcggcctcgccgcgacgggggctataaaagaggcgagcgagaggagagagaaagggaagccggattatcatctctcagtgttttttttttgcgtaaattaagcggtttaaatcaaatgtttttttctttttttttttggagtggtgagcaagtgggagttgagtgacggccggtgaaccgtagcgcccccaaatgcctctcccctgttcagcgtcagcgagggggatttcgagtactcttgcgcgtattttttgggccgtgcaatgcaagaccgagggagttattatggggtcagtacgtagttgtggtacgaattcatctcggatctactcctatatttttgccggatgtttgtgtgcgtggggcgatcatgtcaagcgcatttcacccactacaccgtttgctaaatggtggttcaaccgattttagagaagatcacaccacccaaatggacccaaaatggagcagaagcaaaagcttaatttctttttacatcggcgatacaacacccactctaccctgggcgctg

SEQ ID NO: 20016 - DNA, 501 bp, Oryza sativa
gtgggccgtgcctgggcgggaggttcagcccatgggtcgacacggcccggcacgaagtgccgatcgggccgtgccagcccgatggctggtgggccgtgcctgggccaggccatgccggtcgggccttttggccatctatactcccgtcgtctgtggatagagaggatggtgggtcccattgtttttttccttttgtctgattaacatgtgggtcccacatttttgtttttattttttatttttatattttgcttgcagtgcctcatcaccgccacgtaggacgaggaccaagttaaaccggccatgtaggcaccacatcagccaaaactaccatcaaaaccgttgagggacatactttgcactggttttgatagttgagggattcgttatatctgtgttttttcagttgaagaacgaaaatcggattcgttgacaagttaagggaccctaaatgaacttattccactaagtccagaatctagtacggcccaacatgttggg

SEQ ID NO: 20017 - DNA, 849 bp, Oryza sativa
atatggccctatttacatacatttattctgcgtgattatattgaatcctctatcctgcaaagcctacctatatatcagccatggcattaactcgacctgattcttttcacgctttagtaatgacaatgctgctgctacgacatccacagtgtgcctttgcatcaatacgtgcttgtacacatgtagtactgtcatcgccactaaatgtgctgcaagtacgtacttgctagaaaatctctagccattatagactgtaatatcggttgctagtacacacctcgcctctctccgttaatttatagccttccattggttgctgtctgaatttatggagacgcaagctagctagagttcctacttcctcttataattcggaagattcttctgctctgcacactgatattacatatatggacacaattgttcatacatgcatgtcattgttttccttttgccatcttgcttggctgctttccattaataattggttgcaaagctccagtaattgtctgctatcttatcttttacaatacatatcaagtgcaacaaatgtctgaggaaagtgtggtagaggtcaccaaccaaaccatctttagttactgcacccaaatcactactagcattcactatacatatatgcttctgttggactgattatttgtttgctgtgcatgcagcaggagtgtttcaatactcagtgggagtagaaagactgagcatgcagctaacagcctaggaccaagagagtaggtatcaagcctggctccaaaggcacttgttagctaaaaatgacttaacaattaggccctgtttagtttccagaaagtttttttcaaaaacataccatcg

SEQ ID NO: 20018 - DNA, 1022 bp, Oryza sativa
ttgcaagacttctcaaaccctagggagatggtcggctaactttctcctaaggttcaagcttccaagagtcgttgttttgctcggtgggcaaggtcctccttttatagttcaaggggttaccacatgcaccgtctctacacatatcgtccttggaggggggcccacatcaacccgggctgagtagccaaccatgccttaggccggaagtaaggtggcagcttgtcctcaggtgggtcccagcgctatccttcgtctgacacgagggacatcccccgtcattccctcttaaattcatggagactttggcgaatgcatgcacaggagaggcaccaattgtacattggtctccgagcgttgatgggacggggcatacctgcccccacgctgcctgacacaaggcggggcgtgggtgcgctgccgcccatcccatccacctgcggccggtcttagcccggtcaaggacgattgacgcacgtcaatcgattggacgtcgcacgaccagccacgctgtattaaatgcggcggtggtggttgggacgccgcccatcaatgcgcttggcagcgccccttcctccacccactcagctgcgacgtggcagccgagcgtgggccccggggcgacgcagcccctcgggcccgaggggtgcaacgggataccccgagacccctaggcggttacgggcgcctttcggctacttactacctgcgcgcccgacccccccccctctcgatggggcccaggccgcgcagccacgtggctaggggaaaggaccctttccccttagcatgggtacccccgggcccatatcatcgataatgatcgtttgattagactacagaaaaaacataggaatcggatgagagaaatagactcaaaggattcttaccaagaggttggacctcttgctaattttcctccaaaaccaatatgcaataagccattccataggaaatttataggatttggaaaacttcaatcctttaaatcttagggctacatagggaaaatttcctataggatt

SEQ ID NO: 20019 - DNA, 30172 bp, Oryza sativa
aatcatatggcacaacatttgttagaatatagttttttcttttttacatgatgcaatcctttgagttataatttacatgatctggaccagctattaaatccatgcacatcctttttcattcatgtcttctttggaagagtatttggttgactccaaattaccaggaataatacttggtttactataaattgcattattgttttctacagacgtactaagcactagcaaattctacttttcagcttttagccatctacgagcaccggattgcagtccagggtttcctatggggaataaactcatttgaccagtggggagtggaactgggcaaggttagtgcttgaatatttatacatatatttccattttgtttgaaggtctagtttttggcttcaattctagcatgtgtgactctcaactttccccaggcatatgtttgtcttattttcttcatctgaagactgaactgtgttgtctgtatttttttttcgtgtcagtctcttgcctctcaagtgagaaaatctctacatgcatcccgcgttgaaggaaagcctgtcctggggtttaacagcagtactacaagtttgctgacacgatatcttgctgtacgttctttgatagttcatcataatttattatccatgttatataattaaatttagtttcctaagtgttcttgacagctcataccctagaactgagggatttatgttgtaatttaatctgttttgtaggttgagccatccactccttacaacactaccacactgccgaaagtttgacacgacacgtttggcacgctattgtcttgagttaaacaagattactagagtcttcatatcttgtaataagtttaagttcgttttggagttgttacaggcttacagccagttctacagtactgtagtttcgttgttttcctttactccgacctccaggaaacgaaatggaaaagaaaaaaaaaggaaactgttgttgaataaataaatcaagtcgtgtcagcatgaggaagctgtcattaaataaattaggtgaaaccccgcgcattgctgcgagaatttagtatgaagatatacattaaaacattatgtaaattatgttggatgataatttaatatgtttgtgtttgaaaagctcttaaattataaaaactataaagatatagcatgtttgcatgatgtttaaatgtgatgattgttagtggatgatgatgtgacatctttgcatgaagatatacattgaaatattatgtgaattatgttggatgataatttaacatgtttgtatttgaaaagctcttaaattataaacactataaagatatagcatgtttgcatgatgtttaaatgtaatgattgttagtggatgatgatgtgacatcttgttaattagtggatgatgatgtggcatcttgttagtggatgatgatgtagcatctttgtatgttaagtttaaggagttcgtagaggataacttttatagtaagataggatactactactgtttggcttgaaaagcttgtttgtgtgtttacacattttggttgggagaaattttacagtttggagagtaaccaaattttaaactggtaccttctcgatgaccgtattatctgtgtatgctgccacttacacttattttgctactgctatattcaggcgaatgtctcgagaatttgaccatcacacactgtcagtcatttgaacaacctgaaacaaaattcagttctgtattctgttagcccttcactagggctgagtttagttctaaaatttttcttcaaactttcaacttttccatcacatcaaaattttactacacacacaaacttctaacttttctgtcacatcgttctaatttctaccaaacttttaattttgacgtgaactaaacacaccctagattttgtttctcattcaaaatctgcaagcagatttatcgattctttcatttaatggaacaatcaaaccatttcctcctctttctatatccaacaatatttccaataaaaattgggcacactttgtgttagttgacttcccacaccacacatggccaccccaagtgatacccagcaactcagaagctgctgctacctgctcacccggtgcggaggctgcttccactccgcgctcatctcgccggagaaagacacatcgtctcgccggccggactccagcctcgccgccgtcgcctcctgaatgatccggtccatgtcgaacgtgtacgacccggaagcctcgctgatgctgcccccggtctccgccgtgccgaacaccatgctctgccccggccgcatcccctcgttcaggtcctccagcgacatgtccccctccagcgccctcacgatctgcaccgattttcatctccggtgagccctgcacggctggcggcggcgccgccggcgccggagacgatggtcatgacacatggcattgacatacctggctcatcttggggcgcttcttcgccgagtggcggacggacgcggcggcgctggcgacgacgcgcgccatctccaccgcgtcgtagctgccctccagcctcgggtcggcgacgccgccgtagtcgccgtcggccagcgcgcgcgccatggccggccgcgcccactcgacgaggctgtcgtcctccatgaaggaggcgggccaggggtggtcggcggcgccggcgtcgatgggccgccgccccgtcacgagctccagcagcatcacgccgtaggagaacacgtccgacttctccgtcagcttcccgctcgacgcgtactccggcgccaggtacccgaacgtccccatcacgcgcgtcgacacgtgcgtgttgttgtctgacgtcagcttcgccagcccgaaatccgccacctgaaatgacacaaaccatcagataatcggatgccgcaatttgaaatgcagcaatttttttttaaaagaaaggaaaatctgcagcaatttgaaatgttacctttgcttcgaagttgttgtcgaggaggatgttggcggatttgatgtcgcggtggatgatccgaggatggccttcatggtcaaaatggcaaatgcaatttcaattcagatatgaaaaatcgtagacatttttaaacatcaaatttattggagcaatggtgctcacagtcttcgtgtaggtaggcgagccccttcgccgacccgagcgcaatgcgcagcctcgtcggccatggcatcaccggcaagcctttccctgaaccaacaagaattggatgtttcttgatcttgcggcgaggtgagggaggcagcaatggcgtggtaagctagagtgatcgagtgactgaccatggaggtggaactcgagggtcttgtttgggacgaactcgtagacgagcacgcggcgcgcgccggcgatgcagtagccgacgagggagacgaggtggcggtggtgcacccggctgatgatgtccacctcggcctggaactcgcgctccccctggccgctgccggacttgagctgcttcacggccaccgccttgccgccggcgagcacccccttgtgcacgtacccgaacccgccctgcccgaccaggttctcctccgcgaagccccccgtcgccgccgcgagctgctcgtaggtgaacgtccccttgctcatccccgccgcgtcgctcgtcgacggcgccgcgcggggctcggccagccatggcggcggtggcggcggcttcggcccgctggtgtcgcggccgccgccgcctttggatcccgaggtgtccgcgtcgaaatgcgtgacggggttgtgaggcttcttcttcctcttcctcctcggcgccgtcttcctcgagcagcaaaggcaggcggcgacgaggagcacgaggagcgcggcgggcccgacggcggcgaagacgatctcgaccatggcgttgtaccccccgcggcgcgcggaggcgagcgccgacctggcgacgtcctccgagccggagccgccaccggaggagcgagacggcggggaggggaccctgtccggcgacggcgggggtgcgccgccgccgccgccatgtggattcgacggcgccggtggaggcgagacggatggcgccggggaggaggacgaggacgaattggtgggcgacggcgaagcggccataagaggagggctgcttttcggcggcgggacgatcgacatggccccgcgatcacaaatccgtctcgccgggcgttgatatcgtgctccgccgcaccgccataggctcaccggcgaggaggaggaggaggaagggaggggtaggtactcagcggccgcgttcctgggtggcggtggcggcgcccggcgctgtcgtttccatgcggccgccattgggggggggggggggggggagtgtctctggttggtgtttggttacctcatccgcactgatcagcccgtgactttgacttgtgaggctgccatcgcaggaatgccaccgtggacatcccaatacctctccctccgtaaatcgtactactagtggagtatctcgcatgccatggcgtaaatatttcgcacgtgatggaatgctcagcctcagctccatgcttgttacttactactctctccatcatagttatattttatcttggcacacagaacaagaataagtaattctacttatcatccatttaaacatactactagtcattcctcgtaaacaagcgattcattgatatttatcatccatttaaacatactactagtcattcctcgtaaacaagcgattcattgatatttacgtttcttgatacctatgtagccaatcttgtgtggaagaatggaaagttatgcattaaatccgagaaagtcattaagatgataggttgttgaagtgaaatatgcctatcaaaaataaaattttcagatttgaaaatatgactatcaaaagtagatggagggagtaacttttttttaggttgttttcaatatttttaatgaaaatattaggagctctctaggattgtttttaaatacttctttctattaatgaaaattaggagaagatcaagattacttactattttgttagagaaactagaggattgcccccgcgcagtttctcttagctcctattttttgagactttagatttaaaaagacgcaaatattaaggaataacctaactttgaatttaaaaagatgcgaatattagggaaagacctaatatcaaataattaaaaggggtaagacttcgaacccatatcgtctagcccaccaccttgtggagctaaccaaaagacccgtggccggaaaaccaccttgtggatttcatgtataactcttaaattatatttctataatccttggattttatatacaactcttagtttctattcctataataccgagatttcatatacaactctcaatttatatttctataaatataattgtattttatacaactatatcaatcaatttataccgttataatctcaaattacaatagttcaatggttaagacctttttttatttttccccaattaatgtggaatttatagcctccacaaaaacatggtgcgtgctatattaataatacaatagataagttaattttaaaagaagttaggtgtatgactttctacttaaagtacggtgtatgactttctacggatatgtgttttttacattaatggacgttttgcggttgtgtttttatctttcttttttctgttcattataaggttaaaaaaattacctccatcccatgaaaaataattttttaggatattaaggacatatattaggaggatagacaaataaccacaataactttatttaatgaaaacaatacatgcacacatttcatatataaacttaattaaaaggaaggttgagacaacgtattagagatgagatggaagaaagggaaattacaaggaaacatatttaatgtaatcaatttgccaggtgctacattaataaaaatacaatttttatgagataaagattcaaaggtagaaattaacttttaggacgaaggaaggtagaaatttaacttttataggacggtagtactttatattgttgatatcacgataaagtcaatcaccctgatttgatactaagttataacatcacggtatctacatttgaaacaattaagaagcccctgatttgatcgaggaaagactcacaccatcgtaagcgcatgaaaaaaaaattgaatatgcattttgctattagcacaagtaataaagcatatacggaaagatgaaccatatataatcgtaaatctgatgatccaattccttaacgacgagacaatactaccgaatacaaaatcataatcataaacataatagttcaaaacttcaaatcgactactgatatgaaagtgctgaaatccaattatccaaactaattaaataactgccaatagtaatacgattgtttcgatcgagccaataactagctagactagtagaaatacgaagcaagaagaaacgagtagaggatcatgcacgaggaggagaacaggtaggctatggcgaagtccgccatgtccgccgcgctcggctccgagccacgccgtcgctccgtggccaccttggttcgagcttctgcggcggcgttggtggtagcaggcggcggctgggtgcgagcctcgagggcggcggactgccccgagccatggcggcgatcggccggcggcggctgggatggagcttctgcggcggtggcggctttgatggtggcgtggaacgcctcggcgcgcctgcgagcttcgtaggcggcatggtgtgatgcttcttcctcctccccgacctcccgaatcaccatgcacctgctaccgccgccgtgcgccgtgtccttcttcccgccggagtcgctcgccgttgctttcatcgctgctgctgctgctgctgctgctgctgctgcagcagctgctgcagtaagcacatggacaggctcgtcgttgatcaccaccacggacttgtcgacttcgccggacgttcttgcatcgagcggcggcggagaagtcgccgccggtgaaaccatcactgcggggggagtcggtggcgcgtcgccagatttgctcttgtgctcgtcgatgaccggtctgtacctccagggcagtctcggcgcccgggaggtccttcgtcgcggcggcggcggattagtagccctcgatgcagccacaactgcaggagtaggaggcgatctgatgctgctctcatgctcgccgtcgacttcgctcgtagtcggcggcggcggcggagcggctgatactgtcgtcaatggtggcacttcaacgacggagatgacatcagcggccgcgccgccgtcgtcgacatgcgacctggccgtgtggtcgaccacgtcggtgacatcaacgacggcgatgccatcgtcggtgctcgtgctgccgtcgtcgacgtgcgccgtggccgtgtggtcgaccacgtcagtgacttcaacgacggcgatgccatcgtcagtgctcgcgctgccgtcgtcgacatcggccgtgtgctcggccacgtcggtgacttcaacgacggagttgtcatcagtagccgcgccgccgtcgtcgacatgcgccatgtccgcgttgtcgaccacgtcggtgacttcaacgacggagatgtcatcagtggtcgcgccgccgccatcgacatccgccgtgtgctcgcccacgtcggtgacatcaacgacggagtcgtcatcagtagtcgcgccgccgtcgtcaacatgcgccatgtccgtgttgtcgaccacgtctgtgacttcaacgacggagttgtcatcagtggtcgcgccgccatcgtctacatccgccgattgctcggccacgtcggtgacatcaacgacggagatgtcatcggtagtcgcgccgccgccgtcgacgtccgccgtgtgctcgaccacgtcgccgtcgcagatcacaacgccggcgttaccgatctcgcagctggtgtcctcttggctcgcggcgtcgatggagcgctcagttgttgcctcgatctccgaagctgccggcctctgcttgatctcatcccctcctccgatcgagagcgcctcgccataggagtacctaacctccttcacgaacttcggaggcgctggtggcgccgccgccgccgccgccgccacgacggctcctagaggcccgtcatagaatagcggcggtggcggcgcgccgccatcgacgccgccgccgccgccgaagtgggagacgagggggcgtgacctggccatgtagttgtagacatcggaggcggcggtgtcgatatcgtcggaggaggcggtgccgtcgctgtcgtagctgccgtcgaggaccaccgccgccgtgttgctctcgccgtcgctgaggatgacccactcgtccatggcggcggctggcctcttcgccatctagggttcgtgccggctctctttgctgctgatgatcaggagaacatgtataagcccttcacgagtcctctcttgttacgttccttgattcttgcgtttagttagcgtaagttgcgatcttatctaccaaatcccctacaaatcgcgcatttaaacttgtgcataactctgattgggatgtgggccacgtttggctgggcccagtttcagtgagttgggtttttactggcgccgtattgcctcgttgatatcaccgtatgtaaactatttttctttctttttaaacgttattattaatatagtagtattacattgccaatgattctatttttgctttttataaactttcattgccaaaataagactagtaaatataatggaatatcaacccctgttttcatcgattgaatctcgaccaaatttattccgactaaacccaattggaggattttgttcgtacttactacatatatacaacttgagaaatttcaagaaaaaaacaggcaaattaggagtaacaaacatataccatcagtcaatcacgatcgatcatatgattcatatcatatcgtatataccatatataataaaagaacatgataaaatactatacattgatatttgcagtactaaaccacaaactttattagcatcactccctaataaatccctaattctaattcaatgcgcagattcgcagaagaaggtacacgacaccaaagagcaggtagaagactgcaagcgaaaccaccccgtcttggcgtgcgagcgtatcagggaggaaggccgccgcagtcgccgccgccgcgttgctcgcgctaacgtcaacgccaacggcgaagctgggcgcggccgccatggcgcgcaggctcgtggctccctgcgacagcgcctccacgtcgtgcgccgccagcccgccggcggcggcccgcatgtacgaatcgatcacgtcggccgccctcaccatcgcctctgcagcctggtcccgcgccgccgcttgttgcatcgcctgccggaactgcgacggcgtggacgccggctcggccgtcgccgccgcgctattctcgcctgccatgtcggcgctgttgccgtgcgcctcgccatcgccggcgtcgggagcagtgtcgtggtcgctctcaccggcgtcagagggctcctccccgtcaacgccgcttgcgtcgccaccgatctcctctccgagctgcgtggcatcgaactcgtctccggtgagctgatagaactcctcgccgtcgatgagctccatgcagcggccacagacgcatacgtgctcgcactcctcgtcgctggagctttcagtttcatcgtcgtagagcgtgtcgccatagaagaaatccaggaactcatcgctcaagccatggaagaaatccatgacctcatcgtccaagacgctttcctcctcaccaaagttttcattgtcaatgccaccatcggcgagaacctgcaggtactcctcgaagtcgtcgccgttaaggctttcgtagtcgatgtcatcgtagccgccaccggcgaactcctcgggctcctcctcatcatcactctgctcgtcggagacgctctcctcctcatacaagctctcactgtcaatgtcgtcgtacttgccgccgtcgatctccatgtcagagtcggtgtcgatgtcgtcgtaacttacagggacaccggtgaactccggccactcctcttcagcatagctctgctccatgcagacgctctcctcctcaccgaagctttcgttgtcaatggcgtcgtacttattaccaccgggctcctcctcctcctcctcatcgatctcctcgtcacaatcgctctcctcctcgtcgtcaatctcctcgtcagaatagctgtcctcctcgtcgtcgctctcctcctcgtcagagcttccggtgtccacgtattcatcgtcgaagatttcatcgtccaggttctccgcgcagattatgtcctcttcatcaaagcattcagagccatcgtcgtcgaggctctcatcatcatcatcatctaggtcctcctcgtcatgggaagattcagtgtcatcgtcaccgaacaggccactagcgaaacccatgagctcatcatccaggttaatgtcctcctcaacagattcatcgtcaatctcctcatcatcgatctcctcctcgtaatcgctctcctcgtcagtgctttcagtatcttcgtcagaatcgctctccaagtcagtggtatcctcctcctcgtaatcgctctcctcgtccgtgctttctgtatactcatcggaatcggtctccaagtcagagcttccagtgtcgtcctcctcgggatcgctctcctcctcatcgtcgtcgaagatttcgtcatcggggttctcctcgcagattccgtcgtcctcatcaaaacattcaatgtcaccgtcggtctcatcatccaagtcctcctcgccggagaaggtcgtgtcctcggcggcggcgatgttggagtcgacgtggtcattgttgctctctgccacgtcagatatctcggcgttctcgtgctcacctccggcgatcgccggagacacctcggtaatgtcctcctcgtcctcttcggctgcgtcgagcaccggagcgtgagaagaagctgcgacgagctcggaagctattcccgagaacgcctggcggtacgagacggtcttaaagaaccccggcggcgaaggcgaaggttgcagtggcacggcctccacggcgatcgtcgtgtgcggcagcgccgccggcgtgtcggcgccgacgaccgcagcggcacggccgcggacctacacgaccgcgaagccgctctcgctgtcggagccgccgacgtcgctgccgtcgtggagctccacgctgtcgccgtcgctgtcgctgagaacgacccagtcctccatggccggcgctgcgctctcctcctcctcagcggcggctgctgcgtgcgtgagcctgagttctcggctgcggcgctcgtgcgtagatcgaagtatcgaaccgatcgtggtgaactctggttggtggggtggtgatcaggtttcgctgtgaggttcaaggcggcgaggagcgctgcgtatatagggggtggatacgggtgtaggattcgaactcgatcggcgctgtgtgcagatgtccgtttcagtttcagaagaaagaatccgagttgatacggaatttcgtcgttgggaacaccgcaacaacatgagccgtgagcgtgagtcggagttgggatcgttttcctgtgaggctgtgaccgtgactgacatctccttttccttgagtattactccagtttaaggacttgtaacttgtttgtgttttggggatattcgtttcgtgttgaccgtgactgcaagttgtgggaagcgcaggatttttatttaaaaatataagtttagttttccatcattaatttgccttttaagcttatgaccgaagctaagtttattaaaataaattacccaagtaacctataccactattgcttcaggtacagaaactgaagaactgagtcttggttagcagttctgattgtgtttgcttatgatattactgtgttaaaaaatacaataaacattccagttttggagacggcggcgatgccaccgtctagcacctggtcggaggcaacatggacgggcaagggctagcaggattgaccacagtcatgcattaatctcatgaggacatggaacgaagaggaagaagagactatttgcactgagattcgtactggacatgtgtcacggaaagaagcgcggtctttcagatgagtaaaggactggagtcctgtgcaaaggctagcttgggaataccatgccccaatggttgtatcatggtgagcccacagttacctttattttctcccctcccctttactttttctcggcaattgtcggctaatggcagttaagataagtgcaatgacacggcagcattacttgcagggaaagctctggtaaaagcatagacttatacacactcggtacacatccatattgtcgtttcgagtttgaactaaatcatgcaatttaacgagcatccacaagacaaaggccgaattaagttctaaacctttttcttcaaactttcaactttttcatcacatcaaaactttcctacacacacaaactttcaacttttgcgtcacatcgttccattgaacgtcacattgtttcaatttcaatcaaactttaaattttgacgtcaactaacacacccaaaaacaaagaaaaaaaagtgacaaagtagctattcattctcccactgttaaagtatagatcaactcaactggcaagtacctcacccaaaaactatttgaaaaacatatattgaactggggaaaaagctcatctgatgattaatatacacaatttattgcagcttgcgagttaaatttctcaaaatggaacttcacatccacaaacttactcttagatcgagtgattgatcgccatgcattgcagtaagattcgctaagatgacgatgccattgccacttcatggatcagccggcggcttcgcgagcggcggctcggccgcgagagcggcgggcgcgatcagcgcgagggtgttgatgtgcgcagcgtgctccgcgccgtcccatgccgcgtcgacctcgtccggcacggcgacctcgcgccgccgccgcgtccgcgcgtcgaacgccaccaggcgcctccctgccagcaccaccacctccacctccgcgccctggaaacccagcagccgcaccccgtcgtccagccggagtggtgcattcgccgcggcgacaacagcgcgcgagccctcctcctcctccgcgccggactcgtcgtgctgctgggacgccacgatctccgtggacgtcgtcgcccttgccggcggcggcggctgagatggttgcagtatctctgcgacggcgaccctggtggtcacctcccagattccgtgctcgtgcagccggaacaccaccacgtcgccgccgtcgatcacggcgcagtggagcatgcccgcggccaatccgatctcccactggtcactgtcgccggggcaggtcacgaggtcgacgcgccccgtgacaggggtgtaccccaccgcggtgccgatgctcgtccgccaccacgccgtggcgccggccgccacgcccgacgcggcgacgagcccttcggctggcgacatcgcgtcggtgacccaccacgcgccggtcccggacgtgaacacctggaagcagtaggcgccggaagaacccggctccgactcgaaggggcagacgagcgtgaagtcgccgcggaagttgtaggcgctcgtgtcgaagaggacgacgatcgccgggcgcggccaggaccgccacggcggggacgggacggccgtccacgacgccgtagccgggttgcacacggcgtacgcgtcgtcggcgggggagaagcagcaggcgaccccgcgcgacgacgacagcacgacgagctccgacgaggccggcacgaacgagagcgacggggacggcacggcgtcgtcgtcgccgtcgaaggggaggaaccccgctgatgggacgaacaccccggagacccgcctcggggcggccgcgtgcgcgacggcgaagagcggggacgacatgtggctcgcccacgacgggtgcacgacgcggaggcgcgccgccgccgccggcgggaggtgcacgagcgagttctccctgaccacgtcggcgagcggcaccccgacgaatcgctcgaccgccgcagcccgctcccgccgccgccgctgccgcgacgcctcgcgggactctgcttcgccggacatggcctcctcgacccgctcggacgctggtggtcgtgggggaagtggacggcttgatgtgggaattgcacggtggtttcgtggtatcgttgtcgtcgtggtcgtcgtcgtggtcgaggcgtgtaagctatcgatgggttcgcgagtgggggcacggccggtgcgcgacttcgtcgtccacgcccgcttgactcgtgcgagaggtcaatctctaaacctgcacgtacgtactacgtaaattccggtgtgttttaggttgatgaagcgccggtttgcgcggccggcccggcactgagccacccgtgattttagatgtaaacagcgataaattttggaaatttaggtgatcgatatatacgatacgtgcaccgtctggtttctttattcacgaaattatctcataaggaaacagccgttcgagagtatctcgcatcgcacacggccgctagataaatccccgatctcgtgtaataatggtataggctgtgtttagatctatgtgaaaagatttggtgtgccatatctgatttacggacacacatttgaagtattatatgtagactaacaacaaaacaaattacagatttctcctgtaaactgcgagatgaatttattaagcttaattaatccatcattagcaaattaatgtttacttagcgcctcattgttagatcatgaagcaattaggctttaaaaattcgtctcgtaatttacacgtaatctgtataattagttttttttgctatactagaaaaaaaatatccgtgcgttgcgacaggtaaagactatttcaatcttattattattgttatatgagttagttagggtgaattcactctgttaaattcgcttggatatatattttgttagaaaataatgagctgcaactaaaagtttgattgttttaagttagtatgcgagtttttcttaaagagatttcttatagattccttctatatttccaaaaaagaataaacttaaaaatcgacacaaatacggatttgtatttccaaaagcgaacgaacttaaaaaccgattcatacacgaatgatgtaccaaaataccggcaaaaacatcttcaattttcaatttttataatagtagagatagagatttaatgtttcatgcatatgtctaagagagatgctctggtgcaatatacttgaattattctgcttcgagtagaattaatcttaagggaaaaatttttgctaggatctaaacaggcccatagacttctttatatttgttaccttcaaactcttttcctaataatcactactagtacaaacaggtaacctgtcagcctgcagtcgatcagcaatcgtgtaccacgctcgatcacacggatggcgtcgacgatcctcccggacgatctcatgcctgagatcgccgtacgctcagacattgtgtccatagttcgttgcgccgccacctgcaagtcgctccgcggccgcatcctggaggaggaattctgccgccggcacaacaacgccgcgaccagtctcctccgcggcgtctcctacaggttccgctgtgatcttaacacctttgtgggcgtaacacaggccgcgtcgtcaccatcgtcctcgcctctcccccgcttcgacgccggtatcctcaacactttcgagcccatggtgtcgcgcgacggcctcgtcgtcgtcctcgaggactacgtctacgccggccccgaccgtttcaacatgtgcgtctgcaacaccatcaccggcgacgtcacctctctccctgccatggatcctgccatgaaagtcaagagaaggttgatctacccgccggcgttgctcgacgtcggcgacgccggccgctcgttcgagctgctcgtcgcggacaacgagctgcacacacagacattcacattctcgtccaaggacggcggcggcggatggggcgccgcccgtacgatccgcatggacgccggccaccggaagccctccatcccgatgccgtttcaccacgttcccggccgtcgtcgggcgcgccgtgcactggctcgccggcacggagcggtactgggagctccaagcccacggcgtggtcatcttctccctgcgcgtcgacgcggcgtgcgccgcgacgatggagctaccgccgggctccgccgacaagatgctgggctgcaggaaggacagccatcagctcatgctcgccgcgtcgcggggcggcacggcgttgagcctggtcgtggcggagcgcgagctgatctcggtgtggacgttggaggaagaatcatcggcggcggcgacgacaacggcggcgaggtggagccggcaggtggtgatcacgaggctggcgatcgaccggagcgcggaagccgcgagaatgtacagcacgtcttcttcgaggggttcggggagaggagcggtgtcgtgctcttgcgcttgcatcgttttgggctcgtgcagctcaacctggcgacgaaagaggcgctcgttgtgcgccgcgttagcacgaggtggtcgggctccatctccagggcacgcttgcacgaggtggatctgtactctttgctccgagccatgaaacacttcgatcttgcgcctggcagagaatgaattcaactcttttctgaacatcctagtagcaaaataatatgaatttttaaagaaattttctgattagttattaattatcgcttgttcggaaatcaggacagcactatcaagtatacaactcttttataaacctcctagcaaaagaatgatttttatttctttttatataagtagaatttgaacttgcatacttaaatggtatataacatattaatctattatattatttttttaaaaaaaatatagactgtttaggccctgttcagatcctccaaaatagcaaaagttttgccattttatagcactttttgccattttggatataaacactagtagcaaaagttgacaatttggcatttggcatttgctagtacatagtagcaaattgtgccaaaaagtgctttgggaccgctccctctctctttttctctctcactttagtgctagaatggcaaaactttaacatgcatctaaacaccaactaggacttttacaatgccaaaatttttaccaccaaaacttttgccatttaccattctaaatggatctaaacagacccttagatgatacatgaaaatgagagaatattcgctcgagagaggaatagactttccctagctagatatacttttataggttggtcaaaagatcttacagccacaaaaatcgctgacatgttgaaaaaaagggatcgactgacaaatagcaaaactgtactctgtttttttaattaattataacgttcttgatatttttaaagatatgtttaatcattcgtcttatttaaaatattatttaattattatttatcttattatgatttgatttattatcaaatatttttaagcatgatttaaataattttgtatttgtaaaaagttttgaataaaacggactgtcatataataattgtagaaaagtcaatgatgtcactattaaaagacgaatgctgtagtatttattgtttttgaaattccttggacttaacgaaaccatcgttcggtatagtgtaagctgtatttatcagcctttacaaaccatagaccaaattatgtttcattgcttgattattttggcctagtcaaactcatgtgtatatctgttctgaagttatgaaacaaagagacttacttttggatcctatactagactttcagtaatttagcagtgcagtaaagaattcgtaccatatatagttatccttctattttatgatttctaactcactttcatattataagtcctgttgatatttttcttaatcaagttttttttaagttcgagcaagttttaaaaagaattagcaatatctaccgcactaaattagtttcattaaaactaacgtttaatttattttaataatatgcttgttttgggttgagaatgtttctatattattctataaactttgtcaaactttttagaaaaaaaatcaaaacagtttttaatacgaaacggttgctactctctccgttccatattacatacaagtcgttaggactttttcttcaaactaagtcaaattttgatcgaagttatagaaaaattaatatcgtaacattttaaaccctaaataaatatactatcaaaatatatttaatggtacattaaatttactagtttggtgttataaaagttattatatttttatataaacttgatcaaaatttgatcaagaaaaaaatcaagtgttttgtaatacgaaacgaaaaaggtgttaatctgttttcctattcaccaaatccgcgatttataccaactgacaaaaaaaacaaccattctctatgaagtatcgcgtcacggccgggaaagcaattcccgagcttgttaccttcacgactcatttaatttcctcatactaatacaaatgcgtcatataaaacggctggatttccatcttcttctttgtttcttcaccatcaacaattgtgtcttctggtgaaggaccatccacctgaaatactccctccgttttttaataaatgacgccgttaactttttctcacatgtttgaccattcgtcttattaaaaaaatttacgtaattataatttattttgttatgagttgttttatcactcacaatactttaagtgtgatttatatcttatacatttgaaaaaaaattttgaataagacgaatggtcaaacatgtgagaaaaagtcaacaacgtcatctattaaaaaacggaggtagtacaatcttgtcgcaatggttcactgggctgctgtagccgtgggttatgcttcaacaactcccggatttgtcacaaacatcgccggcgttgctccgagagacaggttgatcaatctgatctaacactaatattgataaagtagctaattgatgcggcctcctaagaaaattataggattgatctcatctctccggggatgtatcaagcaacgttagtctaaggctctaatatatctatctctactattataaaaattaaaaatgtttttaccggtactttggtacgtcatctgtgtatgagtcggtttttaagttcattcgcatttagaaatacagaaagaatcgtataagaaaccttttgaaaaaactcgcatgctaatttgagaggatcatatttctaattaaaacttatgattttctagaaaaatatatattcaaacgaattatcaaagtgaatttcaccttaacttataataataacaagattaaaataatctttacccatttcaacgcacggatattttttctagtaatgtaaaaagatatattattctattatattgtattaaccctctcaatagatatatacagagtacaatacaagttatgatagaatttatctctacaactatatcttatctttatctctagaactccatttatttttaattttgtaattcaactattacgtctaaacgtacatatatttacttctaacgcacgtactactggcagacgctcgtatcttaaaatccagttaagctagcgtgtatggattcgagttcaacgctcccggacgatgtgctgctcgagatcttcgtgcgctccgacgctgcatccatagtccgctccgccgccacctgcaagtcgctccgccgccgcatccttcaccagcaattccgccaccggcaccgcgccggcaacggcaacgccagcctcctcctcggcgtctcctacaggctccgcaccgatcttaataccttcgtgggcgttacgtcgtcgtcctcgccgctccgcttcaatgccagcctcctggagtcgttcgagcccatggcctcgcgcgacggcctcctcgtcctcaagcagcgcgtcgccaacaatgccggcgacggcggcgagcaccgcagcaacggcttctttttcaaggggaggagctacagtttcaatgtgtgcgtctgcagcatcttcaccggcggcggcgacgtcaccacgttcctccctcccatggatcctgccatgcatgtcaacatggagagccacaagaacatctacccgccggcgttgctcgccgtgggcgccgccggcggcggcggcggccggtcgtcgttcgagctgcttgtcatggactgcaacctgcgaacccagacgttctcgtcggagaaaggaggatggaacgccgtccgcgcggctcacctggcacccggccaccaccagcggcggccgcggatgccggtgcccaactcgctccccgccatcgtcgggcgcgccgtgcactggctcggtgtcgcgagcgactactggcaagacggcgcctactgttgagtttgttatttcagctgtggccccaacgtgttcctggtgattgcagttgcaacggttgaaggaataagtctgtgtttgttagcagatgcaaatgatgcggtgatcgagtcagaagaagaccgcgtcggtagcgttcgtgtgcgtgagtttagcgcgggtgcgtgagtcgtcgaattcagagaaaagcggatcgtgggatggcacgatttgagcctcggattctttcttttgtgtggaatttaagtaggagttttttgtactgttattctagttgcatgttactctgttcagtgaatgaaaaccacagaaaattagccccacaaatttcctatctgctattgttttctgaaacttctcaatttcctgtgttcttgttctgctctgtattcctctgaatctcgttcgttgccgtgctggattgctgcagtacgcacgcaaggtgttcgatcgagggtctagcgctaacaagtggtatcagagcaatcaggtttgagggctaatttgacaccatggcgttggttctggcaacatcggatccggcgagggggagctcggggagcgctttcctgtatccacaactcacagccaccaactacactagttgggtgatccgtgtccaggcgatgatggaggaccagggtgtgtgggaggcgattgaaccggcggccggggcggccgtcgaccctcggaaggacaagaaagcgaagtcgcacctactgcagtcgctgccagaggatctcctcatgcaggtggcgaagaaacggtcggcgaaggaagtatgggattgtctcaagacaagattcgtgggtgctgattgagtgcgtgacgcgcggctgcagacgctgaagggcaaatttggcgccatggtgatggagccgggggaaaccctggatcagtacgcaggccgcatcaccgcgatgagcgtgcgccactcggtgttgggctcgacgttgaccgatgccgcgatggtgaagaagttgttcgacacggtgccagagaaattcgtcagccttgtcgcaggtattgagcagttttataatgttgatgacatgccatttgaggaggctgtgggccggcttaaggcttacgaggagcgggtgcgtaagaagaaggcagcagccggcggagtcaccgcgacgggcaggttcttctcactcaggctgagtgggaggcgcggtttaagaaggatggcggggagtcatcgtcgcctcagaaagggaaagcttccggcgagggagctaaaggcggccagagcggtcgcgaacgcgggcgaggccgtggtgcgggtgggcgcggtggcgctgctcgcggcaactctgcaagtggctcaggcggcggtggccgtgacaagagccacatcaaatgcttcaactgcgaggagtatggtcactattccaaccagtgtccgcacccgaagaagaagaaaggagaagcacacttggcccaggccgaggacgctggcgccgtgctgttgcttcgggtgaccgaggacgcgccggcgcgagcgacacaggagatggttgtgccccaaggatggtgtgtggcccaaagttgctgctggctgatagtggcgcaatggctggaaacgtctggtatttggacaatggcgctagcaaccacatgaccggagatcgcaagaaatttagggagctggatgaatcaatccccggcagcgtcaggtttggggatgcatcatcggtgcagataaaagggaagggatctattctcttttcttgcaagaatggtgaccagtggcttctccaggatgtgtactacattcctagcctctgttgcaacatggtgagcttggggcaactcactgaaacagggcatcgagtggtgatggacgaggatgtcctcgaggtgttcgacaagtgtccttggcgactggtgatgaaggtgaggcgtacgtcgaatcgtctctaccggatcgagctcaaccttgcccatccggtgtccctgctgtccagccttgatgatccggcgtggctgtggcatgcacgtttggggcatgtgaatttccaagcgatgaagctgttggtggataaagacatggcagtgggcgtacaggccatcgtccacccgaattagctttgtcaggcgtgcttggtggcgaagcaaatcagggcgtccttccttgtggtggtgaactacagggcggaggaaccactggagctcattcacattgatctgtgcgggccgatctcgccggcgacgatggctggtaacaagtattttgttttaatcgttgatgacttcacacggtggatgtgggtgtttgtgattaaatccaaggatcaagcagtggaggccttcacaaagttcaaacccttggccgagaatgtggccgggcggcgcatcaagacgctgaggtcggatcgcggcggcaagttcctgtccggcgagtttgcacaagtgtgcgaatcggctggcatccagcggcatctcactgcgccgtactcgccgcagcagaacggggtggtggagcgccggaacagatcagtgatggtgatggcgcgctccctcttgaaggggatgagtgtaccaggcagactttggggggaggcggtgcgccacgcggtgtacatcctcaatcggctgccaaccaaggcgatgggcaatcgtactccgtacgaggcatggacggggaagaagccacatttggcacacttgcgtgtgttcgggtgtactgcacatgcgaagatcacaacgccacatcttaagaagctggacgaccggagtgcaccgtatgtgtacttgggggtggaagaaggaagcaaggcgcaccggctgttcgatccacgtcgcggtcgcatccacgtaagtcgtgatgtcatatttgaagaaaatgctgtttggcagtggcttggagatgcaggcgagcaagtctccgttgaatttgatgttgaagaaatcgttgagtcaccagccggctcggcgacatcgttgccaggcgcggtaccgaggtaccaggcgccatcacccggcaggcgtctaggcaaggagccggtggtggtagaagaggaagcttcctctccggcaggcacggcggaggcgtcaccgtcactgccgaccactcctgccacgcctatcggtgaacagagcacaccacactctgctggcgaaattgacaccgacggtgctcctgttcggtacaggcacattgctgatattttgagagatgcgcccagggtggatttggttgatgatgaacaagatggtgaggcattgcttgcagagacggaggagccgtcagcttaccgtgaagcagccggtcactcggcgtgggaggacgccatggctatggagatggatgccattgagcggaacgggacgtgggagctcaccacgttgccagctggccacagggcaattgggcttaagtgggtttataaactcaagaagaacactgcgggagaagtgatcaaacacaaggctcggttggtggcaaaaggatatgtgcagagacagggagtcgatttcgatgaagtctttgcaccggtggcaagacttgatacagtaagagttagggaaactattttaatagctcgagtggacgtccatccgtttattgcatgtcatctaaatggttatgaaaaaaattaaaaaaaatataaataagatagatcaacatgttatatatcagtccacaaacatgcaagttgaaattcaacttctacaagttgtaacaagaaataacaaacaaaacttaaattactatatgtaaatttacaattaaatttgttatttttgttacaacttgtagaagttgaatttgaacttgcatgtttgtggagtgatatattatatattgatatatcttgttaatttttttgaaaatttttcgtaaccatctagttgacatgcaataaacgggtggacatccactcgagctattagaatccatctccgtaagagttgttcttgctctagcagctgatcgccggtggcaggtccaccaccttgatgtcaagtcagcctttctgaatggcgagctagaagaggaggtatatgttgcacaaccagaaggttttgtcaagcaaggtagagagcatctcgtgctcaggttgaacaaggcattatatggactctggcaggcgccgcgagcctagaacattcgcctagatagatgtctgaaacagctcggttttgagcggtgcacgcaggagcaggctgtgtatacttggggcataggcagtggtggtgtcatcgttggcgtctatgtcgacgatctgattgtgactggtgaaaatcctgttgaattgaagatgttcaaggaacagatgatgggggagttcgagatgagtgatctcggtctgctctcgttctacctcgggattgaagttgatcagggagaaaatggaaccacgctcaagcaaactgcctatgccagaaaagtgctttctcagttcgggatgctggagtgtaattcaacctcaattccgattgatccaaggatgcagctgaacaaagatgcagatggtcacccggtgggatgtaactgagtatcggcgagtgatcggctgtcttcgatatctgttacacacaaggccagatctttcctttgctgttggagtggcaagcagatttatggagcggccaactcttatgcacttcaaagcagtgacacaaattctcagatatctgaaaggtacaattgattgcggccttgtgtatgcagcttgaaatggtgatatgcagattactgggtatacagacagcgacccgctggggatgttgatgaccgccggagcacgggtggtatggcgttctacatcaatggcagtttggttgcttggagctcgcagaaacaaaagaccgtggcactgtcgtcgtgtgaagctgagtttatggcggccacgacagcagcttgtcatgcgctttggctaagagcactgctggttgagattgttggaggaccggcgaaggtggttaagctatttgtggataacaaattagcgattgctcttatgaagaatccagtgtttcatgggagaagcaagcatattgatacacgatatcacttcattcgtgagtgtgttgatggagggaaagtggttattgagtttgtccggactgaggaacagcaggcagacgctctgacaaaaggtttgccggcggcgaagctggcaacggctcggcaccttcttggtgttcgttttcttgggccacagcagaattaagggggagattgttgagtttgttatttcagctgtggccccaacgtgttcctggtgattgcagttgcaacggttgaaggaataagtctgcgtttgttagcagatgcaaatgatgcggtgatcgagtcagaagaagaccgcgtcggtagcgttcgtgtgcgtgagtttagcgcgggtgcgtgagtcgtcgaattcagagaaaagcggatcgtgggatggcacgatttgagcctcggattctttcttttgtgtggaatttaagtaggagtttttgtactgttattctagttgcatgttactctgttcagtgaatgaaaaccacagaaaattagccccacaaatttcctatctgctattgttttctgaaacttctcaatttcctgtgttcttgttctgctctgtattcctctgaatctcgttcgttgccgtgccggattgctgcagtacgcacgcaaggtgttcgatcgagggtctagcactaacacctacggcgtgcgcgtcgtcgccctgcacgccgacacggcggcggccaggacgatcgatctgccaccggggtgcgtcgacaggatgctgggctgcagcaacgccaagagcatgagcgagctcatgctggtcatgtcgcggggcggggcggtgttgagccttgtcatggcggagcgcgaggtgatctcggtgtggacgttgaagagaaagcagcggcggtggagaggtggagccgccaggtggtgatcgcgagggtggcgattgatcggagtgtggaagcacggagattgtaccagaccgtcttcttcgaggggttcggggagagaagcggcaccgtgctgatgaggatcgtcaacgtcgggctcgtgcagctcgccgtagcaacgaagaaggcgatcgttgtgcgggacagcggcgccggtaaatggtggggcaggtccatgtccagggcgtgcttgcacgagatgaatttgtactctttgctccaaagcatgaaacccttttgatctactatttaggttagaatactttttagcattgtccatatttattaacatatatatgaatgtgggcaatactaagaaagtcttatgatatgaaacgaaggaagtagcttgagcgcctaagagaaaaaaaagaatgaattcgattctgttattcgccttaagaatgattttttttaatttctgattagttattaataccgctccttcggaaatcccttgaacattactcgtcaaaaatattcctacatgttctggtggtagactggtaagtggtaaccaccaagtagagaggtacttactatacttttgtctcgtgtgatcttttatctgcgattgggttgttagattctgaaacttcaactataaaagctgatcaaacctaacaagaaatttccagttcaaagttaaacaaacctccaacttcctaatacaaactttccaaattaaaaagtaggagaagaatggaattccacctcgactgggagtctggggctcttccatagatggggattgctagttggcacgcgtcagctgctcccgggccttcggcccatcagcccatttttcctttttttttcacgatttgttttttctttatcttttgcgatttttttcggttttttctgattacctttttttaatctttagcacacttattttttttttcaaaatgttttgagttgaaagtttaaatcttaacttgaaaatttttaaatctgatttgaaagtattcaaatctcgagttgaaagttttcgaatctgagtccaaatttttcgaatctgagtcgaaagttttcaaatctcaagttgaaagtttttaaatctgagtcgaaagttttcatattttttcaaatctgtacttgaaagttttcaaatattgagttgaaagttttcaaatctgagttgaaaatttttaaatatgagttgaaagttttcaaaatttgtcttacacatttaaatttcgagttgaaaattttcaaattgagttttgaaagtttttaaaatttgacttcaaaagttttcaaatctaacttgaaagtttttaatcggttagtagaaaaaatctttcagaaaaaagaaaattatatcttaattaccgtcattatatatctactaatcacttagttaattagactaaactattggaaacgctcgccgccaacgaaacgcgttagcttttccgcccatagattcccttttcccggcccaattccagcagattggttctcatattgggccacatgggcctccacctccgcatgcacgagaggcggcccacgagtagtcgatccagccctctccagaagcatctcctgcgctgaaaaaaaaaatacaaaaataaaatcaagaaacgaattcgtcctcgactcgtcttcgtcttcgcctcgtcgtccccttcttcaagaagaaggcaacgaaaccgacctcgcgccgcctcccaccttcccgtttcttctttcttgcgccgcaagaacgcgaatagctttatctaccgccgctctcttccactccggctcgccgcgcgtcgcctgcctcgctcccaccgtttccgtctcgccggaatcctcccccctccgcccgcggatacagttgtccccggtcggtgtcgatatggtacgcctcctcctcctcctcctcctcctcctcctcttctctccctcatcatccgaggaatttccagcctcggtgtcccgcacggtctggtccccgggccgggtgttcatcaatgcgaggcacaaagttttccagacctgtcaccagtgtagaatcgagaggcgctgtacaatacgatgatattagttagtagcgtgtgttcgagaatcgagaggaggtgctgtacaatacgatgataaaaacgttgggggattttttttttctgccatggttgtctccgcgcgtccttttgcgatgtggagaggtctctgacttggggagctaggaggaatcgggcattaagtcccgggtggtgtttgtgtggtcaggggaagagcagcagacgccggactgcactgccttgcacctgcggtttatattcttttattggttcatgtgctgaaatctccaattgagttgttcacctttgttgtaatgtcgttgattagtcaggaagtcatgtctagttgctcctttttttggttgaaccaaactgtcctttttatacagaaaagtaaactatgttagtgtggttagtgatcttcaaatgcaaagatgttaaattgttcagatcagatttttagtacgttttgtttgattaaacctgcatcagcagcttatcgttaaagtaaagtttaagaatacgagtctcatgaccggtttcagggtgattgtgggtaacataatgaattccactgtaggggtttggttatattcaatcgtgcttcctaaaaaagtagtcatgtcgcaaattgctcatttagattgttgtgcgactgtaagggatatgatctgagaactgtatcgccttgctcatatagtttgttgttatgtaaggtgttcagtctgagaactgcatcgccttgcatctccagaacaaaaaaagaggtgcatgtttgtcctagcaatatgagcttcagttttttcaattctgcaaattgaagtccgtaccaaatattactgtgacttgagtattgcatctgatcaccatcttggaacattatgtgttgccaacaggctactcccttggtagctgggttgtcagtagctgctgctgcaatgggaagcagatatatgctccaggcatggcaagccttccggacccgtgcagcaatgccacgagtgcggcggttctaccctggtggattcgagagagaaatgacaagaagagaggcggcactgatccttggcgtaaggtgggttttcttctcaattctttgcacctgtagactgtatcctgtgtgatgttttttaaatctcttgttaagcttaatgatcttcagttgttttggtgttaaagagtgttttgccactgtctttggtacttatagaaaccattttcttgtatcagagaacgtgctgcattcgataagatcaaggaggctcacaagagggtaatggtagccaatcaccctgatgctggtgggagccattacatcgcttcgaagataaatgaggcaaaggacatgctgatggggaaaggaaaatctggttccatgttttaatctgtctaaaaggaaacagaattttgtttttgccatgaccatgatgacttgtagtggttcatgttaatcgaccttaacatgctgtgctgattgtaccatagatctgaaccaaaaaacaaatgcaagttactggattgagtaactcaatatcctgctaaagtatattgttcagagcctccagtctgcgttttttttaagcttaggttgaagccattttgaattctttcttgctagatgatggaattgtaacttaggctgtatgtgtttagttccacgtcaaaattgaaagtttaaagaaattggaatgatgtgacggaaaagttggaagtttgtgtgtgtaggaaagtttgatgtgacaaaaaagttggaagtttgaagaaaaaagttggaatctaaacagggccttacttaatgatggcctg

SEQ ID NO: 20020 - DNA, 1324 bp, Oryza sativa
acacacaaacttccaactttttcgtcgcatcgttcaaatttcaatcaaactttcaattttggcgtgaactaaacacacccaatgttatactatggcctggttcagttcccaactttttcttcaaacttctaattttttcatcacatcaaaactttcctacacacacaaactttcaacttttccgttacatcgttccaatttcaatcaaactttcaattttagtgtgaactaaacacacccttatgtgaggatgcacaaagatgagtaagggggtgtttagatccaggggtgtaaagttttggcgtgttacatcggatattgtatagggtgtcgcatggggtgttcgggcattaataaaaaaactaattacagaatccgtcagtaaacagcgaacgaatttattaagcctaattaatccatcattaacaaatatttactgtagtaccacattgtcaaatcatggaccaattaggcttaaaagattcgtttcgcaaattagtcgcaatctgtgtaattagttattttttagcctatactaatcttttatgcaggtgttcaaatgttcgatgtgacaaggtgtaaaatttttgtgtgggacctaacagggcctaataagattgatcagtgccatgtcatctggcctattgtggaggcttggtggagtattaaaaatgggatgaggagggttcccagaatgtctcagttttcaccatgtggtgttaaatgctgttgaattctcaactgagaattattgacattgttggagtgtcaattcttcccttaaatatagcattgtatactttgtttgtcaagaagcttgcgttgatgatttaggagtcgtttaagatcagcaagaaggaaccgagaaggagcgtgtgatacacattcagctccacatttatagccgaagcttctgcaggactgcaacatcgctcttgccatgatgataatagtagcagataacatcagaacagcacaaaacaattgctgtcaagtcgcgattagtttgtcacaggtcaaaatgctgttgctaatgcagttgatcatctaacaatgtgctaattatgagttctgaccactctacgatgtgacagtgtggttgaccttggattgccagaggttgatgagtgatggatttatgagtttatcctattactacaagtcagttttgctgaggtgaaagtgaaacaatctgaatgaagaagggacaggttacagtacttggcaacttagctatgctcagagtaattgtatcatcatcttgatgtaattaaagctcaataaaaaaattctattatataaaaaaacagtacttggcgacctc

SEQ ID NO: 20021 - DNA, 23020 bp, Oryza sativa
  unsure (1)..(23020): unsure at all n locations
ggttcagttcctgagctagtaagggtgtgtttagttcacgccaaaattagaagtttggttaaaattagaacaatgtgacggaaaagttgaaagtttatgtgtgtaggaaagttttgatgtgatggaaaagttgaaagtttgaagaaaaaaattgtaactaaactcggcctaagtttgtactatctgaagaacacttgggtgtgtttagttcacgccaaaattgaaagtttggctgaaattggaacgatgtgacggaaaagttgaaagtttgtgtgtgtagaaaaattttgatgtgatggaaaagttggaagtttgaagaaaaagtttagaactaaaaaagggcaagatttctaatagagagcacgaaatctctgcgtgtcattcattaagacggactgacggaaaggaaacggtctaactgaagattgcaagacggcaaagcaaccaacatttgctgtcatatgttcattcaaaggaagtatattgcacacagtttctgctttatttattctgatttttttcagaatattctgtacatactaagataaacctgggtaattaaccactgaattatgggattctagtcttatcatattccctagggatgatcaggcatgacagcatgtgatagataattagacatgcaagcaagtgaatcaattttaatcattggtcaaaagtcgggaccagatcatggtcttatcaggttgaattgttgactaactggtatgtctatccgtctgaagaaatagacctttcatctagctctgagcaaatgtcagtaatttgttccaggtcaaatggtcagttttgacaatccatgcgtagggtgatttcagagctagagcatcttagaatgcttcacctcatcaagtctaaacctgcaagtccaagttgacaacagataaccttttgttccaagttcatctgcaaaacttcaacattgccaatttttccagtcaaaagcagaactgttggaaggtcgtctgcaattgatgctcctaaattacaagcttacaatctgtctctgggaccagcagaagaaaaatgacaggagagaggcccttcatcttggactgtatttattatgcaattgtacttgcatggctgcgaaagagatgcaagaaacaaggacagaaaatgcatgcacaatgtgactgaaaatgaacagaaaaattagctctaggctgtagcagacctgaaaacagtcacagaataaactgcatcctcctggctttttgttgcaccaaactgctcatggaaagatacaactaactaaggcaccgttttgagttcactgaagatgaagattaagtacgagcatgcaaaatgagaaagccattagttcatgattaattgagttttaattatttcaaacatgaaattttgatttatctgatattttaaagtaacttctatatataaatttttcgcacgaaatacaccgtttagcattatggaaaactgtactaatggaaaccgaggtaaaatctgtatcgatcttaataaaaaagaacggggcctcttgagatgagtgattccatctctggaattacgaatacgatggctcgaattaagtgtggctgcataacttttttcatcctctattgctacaaaatttcagcaactcggcgtttggtcatgtttcttagatattttttcctgtacaggattgattttgagatgatagatatgctttatgttactgtggccgtgtcttgcagcatttggtttcttatgacgcagtaatgagattctctctggaagaaaatcatgaaataatctttcataaatgtttgcatataagtcttgcataagtctgggatttcataaatgttgggctgctgcaacagtaaagataatcgtcgtatctgcttgtgcacacatgagatgtccaatcaagaatgctgttgttaagactttgatcatgaggaatccgtaggcacaaaagtaggtttttgtctctgtcggtattgagttctttgtccggatttatgactggtttgctacgtactgctggacagaaaggttctgaagatttaatacactgtaggagtattgatttaggaccaagttacagggagctttctaaatgacgtattgaagagcaattcaaacttctgctgctgtacgggacagagctcagatagtatgctcatatttctgacgaaaatcagaagatcagtttcatggaatgatatggaattccatgagtattggaacattatttggcaaatttatttatttttgaacgaaatcggcaagtcgccaattttcattgaatagaggagaagcgaattgtacaaaaattaacatttacaagttttgaggccacggccctagagaccagagaaaagattacactgtcagcattatttggcaaagtaactttcaagatatttgcaagatcttttatttcgtaattggcgtatgaatagtactaggttaggagttaggacactctttcctgcagctagaattgagcttctataattatttgtcattttgtccagataaattaatcttcactgaatatctctgacagtgtaaatttcaaagtttaccaaacgcttgttggtggcagaatggcggctaataatcaaagagctataaaattttgtccgtgcttccattttcgaaacacttggattcatgttgggggttaagtctgcaatctactgccaaaattccaaagcacaacatcaaaagaagttgacacctgcctgtcagacagcaaaacaaacaaaaaatgctcctatcctgactttttctctcacttggaatcaagatttcatacgtttctcaggtataatcatgttgatattccaaaataactagatataaaacagctgtatgcatttgaggtaacattgaatcttaaggctgaattcagcaattagccgccatagcgggaaattctgaaatgcctctgtgtacaaagtatgcaatattgaagaaacctcacatttatccatcatttgtcaaaagaaaatatggttaaaaacacagtacaattttgctntcctggggagcggaggtggggggngctncttccattttacactagcaatgatcaacagaagacgaattaatcgaacaagatttcttcttatcagggggcatgcatacacatgagagattcaaccaatcttctccaagtattcagaaaaaaaatctccattgcttgtttcttttgaaggcacaaggagctcgcgaaattacattcgacagatgttagcatcaagcatgccgaagcaaaaattgtactcagagacttataaccatgcataaacctgagacttgtgtccactcaaaacatatatggatcaccataagtctgccttttctcctgtgctattttcttaatttctcttgggaagtagagagcatccaatgtcatttcttgactataggaaacaagaggcattcaaagtcgcatttaggtgcaatatttcctccaaaggttcaaaaggatgaggcctctgaagacagaaagaagaaagatcagaggacgaagaaaggtcttttcttcagtcatgttgcaacaaagcgatttattctgtcttcaaaaaaaaaaaactttttttattcctgatgctacattggctaatggttactagcagcatggtgataaggacatgaagccaatctttgcatagctagtgtgtagtttgtactagtacatgggaacgtagagatcccaaagtctcgttttttgtgttgcaccttccaagaagcaaacggatattaagcaattgtcggctactccctccgtcaaaaaaaaaaaaaaaaagcaaaccctgaattttcgtgtccaactttgactgtccatcttatataaaatttttttataattcgtattttcattgttgttagatgataaaacatgattaatattttatgcgtgacttgtcttgttaattttttcatatttttttcaaataagacggacggtcaaatgttggacacggaaaacagggtttgtctttttttggaacggagggagtagtactatagggtattacgcacatcatgtgttcgtgcgtgcgtgtatataagtcaatcatgggattttctttgtggtttttactgaccttgattgtacggttttactcgggggagtgttagaggagaagagtgagattgagaagatatataagagtgagtcattagcgtaggattatttgagtattaattattttaaatttgaaaatagattaatatattttttaaaagcaatttctatttatttttgtttacaaacaacggattgttaataattcgagaagcgtgcgcattgagaatgagataaatattctctcgatctaatgattcgtaaacttatcttttctacttatcacgtatggtgatgatggtcgacttggaaatccctaaccacatctatcacataaaaaagttctagaccattatggaatcgtatgtctttatcatgtatccgcaatccgccactctttatgtgtatgacacttccgtaacaacgatattctttatgtcgtggagcactaatacatttgattttattggcacctctaagtgccggttcactaaagaaaatatgttcgattttattgaaaaaaaatatctgaagtgaatggacatctaagatctagtacaattgatttataaaggttataacgaaaaactttgaggacaacccaaaaaatatgccgctggcgctggtaaaaactttaccaaagaaatttcacgctatcatgtatcgagtatctatatcatgtaccacacgattcaccactcctcagacctattatttatgtatgccaccctcacagttccttttgtgtgtcacacaacactaacatggttgcttttgttgaccaagaatatccaaagggaagaagaacattggagaccaaatagttattaattagagatttttttaaattttactatgaaaactttggggaaaacgggaaaagagcaaactgtaaaagctttaatctagataaaatataaacatatccaaaaattgtcaaagtggcctctgctagtcaagttgcacgagtagtgtatatatctctatttcaacattcgcatggttaagataatgggataaagtgggccagaagatggaatggttcctagttaataaatgctaaacttattcagatccataatttcaactagaaaatattgatatgatgttacaaagtaacttatttatatatgcatgcttcggtaccatgaaagtccatttccactgcaacacatatggtttacaattctccagattttgctaaaaaccattctatagtttgtaccaggcctcaattttttttctctttgacatctgaaatcatgtttattcatgacagtaccataagaattaaactatggtgagtttaggaagacagtaagctgttttggagcgaccaagaatttatttgcaacaaccaacaagttattactatgtagcaaggtcatattacagtgcatttgagattttttgagccggtagattttccacggaatttatgagtactataaacatgcattgatggtttatactgttttggtgtgcacaatgtatagtaatagtataaaccaataaactagagtgtggtccccctaattaagcacacaagaatacacctaattatatatatatatacatattttaaaaaagatactatattgatcacaagttatttatgtggtgaaatactagtattctttttattttttttccgtggataaaagctggtacattatctagtacttggttataggtaagaactaaatattatatattatgaacttgaacaagagattcaaggaatctagtagagcaatttcttttaagaaatcttgtttttaagaagtacgaaggaaataatcagcgaaaataatccaataaataagcagaaaagaatgaggttctatcaatatcgtctaacgtgaatttttcacctctattatatggctgatggatagacttgtatatgatgtgtgcacatgagcacatcacacttaccttatcgtcgaaacaagatttcggcaataataaaagggggtggctatcaagctaggaaagtggacgggtttggagacaaggaattttatacaggttcaggccttctcattcaagaagtaataccctactcctgtccggggatgattccgccgagtatattattgattgtataaactggaaaaaagaatcgccccccagaggcacacggaccctccttatataggggaaggagtccgctttacaaaatacagtccatatcctaacggaatatggaattatagataaaatacaatcgtaaccgactaagatcccgggtatttccttgacatacaagtttagaacctaacccgagtcttcatagagatattccatctatatttggtaccgtatatccgactaaattacaaccgtcatgtagatatggggtatccataatctccacagtagcccccgagaccttcgcagttgacaaaatagccttctcgaaacaaaaaacagtagtccgagtgcttcaattcaacttgctccagcttgccgagtactaaaaatcaaaaactgtgaagggcgaaaataaaacatggtgcatcgagtagatgcacctaattaggtgtagcccccgactatgtgattagttgaaaaactaaacatatagtcaagaaccgagtggttttatagcgaagcacgtatggtacttagtaagatacccagccgactgcttctcaacttgagtatatcaaggacaaaaaatacaagaagggccgagtgataaacactcaaaaggtccaaaaatagacatgtttgataggaatccgagtaaaaaatctcataaaataacccaccaaacaggatagaaaatcatggtaattaatgagtccaatagcctaggctgtgacccttaccataaccaaaataagcatataacatgctaaaagaatgactattaataaaccagtcatctcaaatcaacccagacagcctttgcagcctaataaagctttcaaaaacggtataacacctttctgtcgggcaccttttgtttgcatcgtgttaattcttaaagaattatcaaaccacactaaaaaggattttaacagcattgagccacatcattgtgaacacaaattgccaaagcaaaaagtgcctaagtccctaaggatcacaacgggccacgctggaaataagactgggctaaagtactgtacaggcccaggcccattagtactcccgataccctaataacaccgaagtgaaaaaccgtctcttcgtcttccctgctgagactctcgccattttccccatttcttgctacagtgcaaaactgcgccgggcaaactagggttcaccagtccgctccaatccaccctcaaaaacttcacgaaatttatccctgcatccaccgctccgattccccatcttttcccagccgtatctcgaactaaatcagaccatccagttcacattcatggcggaagaaagagaaagcttcgagagtcagtgggcgccctccgatgtgacggaagataatttgaaggagatggtggcgcacggcgttcttccagcaaaagaaatcatcgggtggcgaccggcatttggtgaggcattcccgacccccgacacacacgaaatcgtggtatttgctcatttcttctatggcggattttctcttccaacctcaagatttttccggggcattctgaacttctacgggattagcttgcatcatctgaatccaaactccatagtgcacattgccaattttattcatgcctgcgaagcttttctaggcattaggcctcatttcgccttgttccgccgcatcttcttcctcaagccccagccaaacaaaagcaaaccgtgcgttgttgggggtgctggtttccaactcaggggaacactaagccaaaaatacttctccatgcccttcaaaacctcaaacaaaggctggcatgcaagctggttctatgttcaaaatcctgagcccgcactccccgagtactgctatcttcctccggtttaccaggacacatggaactcattgcctatgggagatgaagctactcaggcagtggaattgatggagaggatgataaagctgaaagaacagggccttcaaggagaacaaatcacccggcactttatcaagtgtcggttagctccaatcaaagaaagatctcgcacagccttcgaatttgacggcaagcatgacccaaaccgtgaagatccagattctcttgacttcaaggtcatgaaggagagaatgtataagatcttctcaaacgccatcgttgtcagctactcacacgtgctgccagtcgtaccgttcaatgcattcaatcctcctccaccggtacgtattcatacacttcaacctttctcaaaatatgatcttgttttcttgttgaaccagttaacaatgaaggatattacacccaggaatttgctttaatgaagtcggatcccccaatcgctcaacgccgatctccccgccaccaaactgggcaagggagcggaggaccaagaattcggtctaaaactcaaccaagtgcttctgatccagtcggccatccagattctcgaaagaggaagctggttctaagtgacgacgaagccgatgataccaccaggaggcctggagaccgagagacaaccaagaaactaccaaaacaagctactccaaggaagaaaacatctagtcgccctgtgccaaagatcaggaagtcttccaggtgcaactcatataatgatcttccttgcattgatgcgcacccattgcggtaataatactgataatcaaatttgcaggaaaccatctgatatagatccgtctgggaaagactctgacccgaccaacatagacacaagctcttccaaagaaaccgggccatctgttgaggatcatccgagtgacaagcagtcggcaaccaacaatgtagaacccagcaacgaacccccgactgggaaccagtcggccgaagctgaagtcggcgctaaccaggagcccccgactggaaaccagtcggatgcagggccaagccaaaaggttcccgaggttgaagctcaaacgaacagtcctctcgggaaggatgctgacagtgaatcagaacccagatctcctgtgaagacaccaaagtccactcgtccccgaccgggaatcatcacaggtagacacgctatctgaaatcattttgatccaatagactttatttagctgcttcatcttcattcatggatacactagggccaataattggtgatgaagaagaaatcctccggatacaagcagctgaggattcacgccctccgattctggtcaagtggtgggatgacaacatgcagcctcaagggatcgtgataaataagcaaaaagaggacgaagagttatgcctactgaagaaggcacttggtcaggcaacccgtattgtaaatgtaagccctctggtacctgatctcaaccatcttgtttgccatttaattcatgcgctaattaaactgtcttgcagaggattcatcttaggaacgaagccaaaacggtaaccttagagaggttagtccctcatctcggaaccctcgaagccaccaggaatcaactgcacgaagcgaaagaacttgccaggaagaatgaacatgatctgagggatcggatcgctgagctgcaggaatcaaattttgaactgagtggctcatcaaaaggtacgcacaaactctgctcaactgactcatactgttatctttgcaatcttgattaaccgtaatcaatgtagtgcaagctgccaagatatctcagttggagaagcagattcaaattctggaaaatgacaaggcagaactggcgagacaaagagaaatggctttaaaggaagttgaaggtatcaacaatcaatacctcaanagccattatcctccatatactgacttattaatgtgaatctgttgatgcagaccgcaagatcaaatctcaagctcaatttgacatcctagttggcaagatcaaaaaacttgaaggagcccgggatgaggttgctaacgctgttgccccaattgttcaagcgatgtttttcaataacgctggttcgagtacacttgatgctgccgaaatcttcgacaagctgagagtcactccagatacttatttcaagaacatcaaagaagctggaagtatgggagcaagtctggcgttggcgatgaccaaatccctttatccaagagttgatattgatgccattgatggctttgcagacgggacgagcgaagatgctgctcttgacctcatcagtgatgcgcagaaagcggctgacaaaattgctgctgatgtagttgagagattccaagatgtcgaccttcggccgactgggtctgataagtctgatgatgaaaaaacttatactgattaatgtaccaatgattttgatgattaatgatgatggaggcacaatttgtacaatactgatgaatttatgctgtgcttgatatcttaacttagctcctgatttcttataagtttttgtcaaaccttgttgagcctaaaacccacaaaagttgttaaaaaactttcagtcctcattgactaagccaagaaatcaaacagggcaatgatacatcaagtaagcaaattgaattgataaaaatcacactccattattatcataatagccccctgactgaaaacttcaaggaaaaacttgaagttagcagtcaaataggaaagatacaagcaagatgcctaagcataaaatcgacgaaggtgttcaatattccaagaattgttgatgagagtaccgtcttcgcgcttgagtcgataagaaccaggctgagtaacttcagcaattatgaacggtccttcccataagggagataatttatgccgatcctgtgttgtttgaattttcctcagaaccaggtcgccgactaaaaaggctcgcgatcgaacattccgattatgataacggcgcaacccttgcaaatatcgagtcgactgaattaaagctgcttctcgggcttcttctagtcggttgatgtcgtctactcggccctcttcatagccctcctcgttgaagttccgaaatcgtagtgattcaaattccacttcactcggcaacattgcttctgcgccgtaaaccaaaaagaacggcgactggccggtagcccgactaggagtagtgcgtaaagaccaaagcacggacggcagctgatctacccacttaccagcatagggacgtagtcggtcaaaaactcggctttgatcccttgaagtatcatgccgttagcgtgctcgacttgtccgttactcatagggtgtgccacggaggcgtaacaaattttaatgcagaagtcttcacaaaagtctttaaatgctccgccagtgaattgagtgccattatcagtgatgatccgattaggtaccccaaaccgatgcacaatgttgatgaaaaaatctctagctttatctgctgtgatcgtgatgaccggtttagcctcaatccacttggagaatttgtcgatagccacaaagagatgcgtgtaaccgccgactgccccttttaaacgggccgaccatgtcaagcccccagaccgcaaacggcctggacaacgggatggtttgcaactcttgggctggcaaatgagtttgtctggcaaaaaattgacaaccttcgcatgtccgcacaatcttgtccgcatcagacacagctgtaggccagaaaaaaccttgccggtaagctttgccgacaatggtccgtgcagcagcatgattaccacaaataccagaatgtatatccttcagcaattgtctcccatcctccaaagatacacagcgctgtagtattcctgatggacttctcttgtatagttcagcttcatgaataatgtaaagtctgctgcgcctggagatccgctcggcttcatttttgtcttgagggagttcttgtttagtaaaaaattttatgagaggttctctctagtcggcttcaatcatgcttacgccttgagtatccatggcttcaattgtttcttttctgggcacggttggttcataaagatgctcaacgaacacatcagaaggggctgcttcctgttttgaaccaaaattggccaggtctatcggccgcctcattgttatgtcgaaggacatgggtgagctcgagtctgtcgaatttatcttcgaacttgcgtacctcttatcggtaagcggtcatattatcatctagacctgaccactctttcatgacttgattaacaaccaactaagagtctccacggacgattaaacggcaaatgcctaaagagattgcaatctttaatccatggagtagcgcctcatattccgccacgttatgggacgcagaaaaatgtatccacaatacgtagctcaatctttctccagtccgggaaattaagacgaccccagctccagtgcctgtaatcctcttcgacccatcaaaatgcatagtccaatattccatcttttcctcttgcatgtcttcctggcactcggtccactcggcaaggaaatcagctaaagcttgtgacttgatcgaagttcgtggcttgaacgatatgtccaaagacatcaattctaaggcccacttcgcaatccgtccgttcgcttcgcggttatgaagtatatccccaagtggaaacgatgtgaccaccgtgaccgagtgactttgaaagtagtgagataatttcctgacggtaattaagacaccatataataacttttgaacctgaggatatcttgtcttggagtcggccaaaacctcgctaacaaagtaaattggtcgttggactttttggatatggccttcctcttctcgctcaacaaccaggaccatgctcacaacctgggaggtcgccgacacatacaacagcagcggctcttgcggatgtggcgaggccaaaactggcggagtggtgagaagtttcttgaagtcttcaaaggctttctgtgcttcgggtccccactggaaattgtcagtcttcttcagcagcttgaagaaaggcatcccccgctcgccgagttgtgaaacgaaccggctgagcgccgccatgcaaccagtcagcttttggacgtctttttgggagcttggcggtttcatgttgaggattgcgttgattttctccgggttggcctgtatgcctctttgagataccataaatccgagcaatttccctgacggtactccgtagatgcacttttcagggtttagtttcatcctgaaagcacgaatgcttgcaaaagtttcttccaaatccgcgatcaggtcatccttatgcttggtcttgacgactacatcatcaacataagcttcaacattacgaccgatctgagttgaaaaacatctttgaatcatgcgttgataggttgctcctgcattcttcaatccaaagggcatggtgatgtagcagtaggccccaaagggcgtgataaacgaggtcttcaagcagtcggattcttttagtcggatctgatgatatcccgaataacagtccaagaagctgagtaactcgcagccagccgttgagtcaaccacctggtcaatgcgaggtaacccaaaagggtctttgggacaagatttgttgaggtcggtataatcgacacacatgcgccattgctccgtctttttccgaaccaggactgggttagccagccagtcgggatgaaggacttccttaatgaagcctactgctaacagcttggttaattcctccttgatcgcatccttcctgttctgcgcaaaacggcggagtcgttgcttgatgggtttggcgtcttccttgacatgtaaagagtgctcaatcacctctctggggataccaggcatatcggatggtttccacgcaaaaatatctttattattctgaagaaaggtgatgagcgcgctttcctatttacaatctaactcagcgcctattacagcagtcttatcaggatcggagggatctaaggtaatctttttcgtcttggcatcactttcatcggtcttcgtcagcttggttgcaggcacttctccctcgcttgccgtggtcgcagccagttggatctcttcacgggcgagagtaatctcgtgggtttgggccatctcgcaactttctttgtcacatgtgacggcctgcttgatgtcactctgtagtgatatgactcctcgaggaccaggcatcttcatcatcatgtaggtgtagtgtgggacagccataaattcagctaaagccggtcgtccaagtatagcatgatatgctgtctcgaaatcagcgacttcgaaacagacattttctgtgcgaaaattctcctgagtgccaaaggtgactggaagcgtgatctggccgagtggtgtagctgacaatcctgggatgacaccgtggaagggtgcattactcggctttaattccgtgcgaggaatctgcatatcgtccagggtattagcgaaaaggatgttgagtgcactgccaccatcgatgagagtccgtcggagcttgacattgcgaaccactgggtctagtaccagggggtaccgccccgggtggaccactcggtcgggatgatccgagcggtcgaacttgattgcagtctctgaccaccgaagatattggggcgtgttaggctgaaccgcattgatctcccgttctgttagcttctgttttctcttagactcataagccaggggtccgccgaagatgtgattaagttctttgcgatgatcttgaaaaccagtcggggcatcgtcttcatcatcgttcttatttgatgtgccttgatctccgtctgagggcttacgcgcgttcttgacatattgctccgcaaactgtttgtagacgaagcaatctttggccacgtggttggagttgggatgatgcggacattgggagttcattatcttgtcgaaggtgttgacgcgggaacgttgtcgggaaggtggagaggtggtcgccacaagttcttcaggcttacgcttgcgatccttgtggttgttacttccactccctcctgcggtcggcgtgtccttctttggcttccaagtggtgcccgactgtttggacgcggtaatagcatcttcggctttggcatactcgttggcttttttgaacatctgcttaaccgtcctgggaggtttacgtccgaacttgccaactaggtcctcgtggcgaatgcctttagttaaggcggcgatgatgacgtcgtcggtgatgtcggagatcttgttgcgtagttcagagaagcgtcggatgtaatctcgaagggattctccagacttctgaacgacgttgtagagatcgaactgtgtgccggggcgttcaaaggtgccctggaagttggcgatgaagtgatcacgaagttccgcccatgatccgatcgtgccacgaggtagtccgtggagccaggatcgggcggagtccgctagggccacaggtagatagtttgccatggctttgctgtctcctcctgctgcgcggattgcgagtccgtagacggtgagccaagactccggattagtggtgctgtcatacttctcgattccagtcgacttaaagccggctggccaatctactcgacgcaggtcattagtgaaggcagctactccatccacgtcgtcgtcgtagagatttggtgaatggcggtgacctcgtgctgcacggcgctagttgatcgtgtcgcgaaggtcgacgggacgctggtgaggtggagagcgaggccgttcgactcggcgctccctgtgacgttcgagaggcgagtgaacagatcgttcgtcgtgacccctgctcctgcgactagatcctgtgccgatgatgctgaggcttggctgatgataatcatgagatcggaagtgagggactcggctaccagtcggggtgcgggtgcttgcggagttggctggaaccgaggcagcgatcatggtcttcatctggttcaagatgttgacaacatgatcggcttggttgagtgcgtcttccttgaggagggtatcgaggagagtgattgctgcaaccgcgttctgctggggggtgcgaaagaccgctgttccatcgacgtcttgttgcccaatgagctctctcgctcggcgcccagattccaaggcgcgttcccgtcgatcttcagcctcctttgcaatccgttcgcggtcttgttgttcacgctgtagtcgttctcgctcctgtcactgtcgctcttcctccagtcggcgacgttcagcttcttgccgtgcgcgatcttggtccgcttctcgggcttgacgctgttcctccgtttcgttgtcagccatgaatacgccaaagaagaggggtgtgtagttatcctcatagctgtcgtcgaagttgtcgaggtcgccgtggttgtagtggtagcctaaatcgtcgtagtcgaggatctcggttggtcgagaactgacgccgggggagctgaggtagccatccaaatcttccgtcgagactgtcccaagaggttggagtataacgccaacctctctggatctagattggattggggccgaagccggagctcgcctagatcttcaagtgggagatgtcttggcgatgaagacagcggccaaatcatcaggaagtttcatcaggattgagggataggacccgtcgtcttgatccggccgcggaagagtagattggatctcgtccgagtggtttggagccgactcgggagagatgatcttagagtaggcctcggccgagttcagaataccgaatggcacggggacctggtttctccccgactggtttgagtccgagtcatggagagagatcttgccgaagtcgttggtgatgaagttgaggctgccgaaccggaacgcctgcccgggagggaaggcgaagtcgtcgatgccagaaacagaacccatcgcacttagtcggcaaaaacttgacgctacccctacctggcgcgccaactgtcgaaacaagatttcggcaataataaaagggggtggctatcaagctaggaaagtggatgggtttggagacaaggaattttatacaggttcaggccttctcgttcaagaagtaatacactactcctgtccggggatgattccgccgagtatgttattgattgtataaactggaaaaaagaatcgccccccaagaggcacacggaccctccttatataggggaaggagtccgctttacaaaatacagtccatatcctaacggaatatggaattatagataaaatacaatcgtaaccgactaagatcccgggtatttccttgacatacaagtttagaacctaacccgagtcttcatagagatattccatctatatttggtactgtatatccgactaaattacaaccgtcatgtagatatggggtatccataatctccacacttatcaagaagataataataataataataataataataataataataataataataataataataataataataataataataataataataataataataataataataataataataataataataataataataataataataataataataataataataataataataataataataataataataataataataataataataataataataataatagaagtactattgatatcacctcggctagttatgtcatcaaattttccaacaataaagtcactttgaacttgttaaaaaaaaacttgaaataactatgagcccaacactagcttccaggaaggaaggctagctagggatttgcaaggatgtgattcagtggctacaacacccagagtcttccgcacgtgcattgaaggttgaaactaggaagaactgtgcatacgtggcagtggggcccaccacaatgaggaggcggacagtgcggcggttgacctggcccgatgggccatagaaaaatatgaggttcatacttttttttttttgaaattcataatggtagtccctttcaaaggcttgaaaaggagtccctttcaaaaacactgaacattcttcaacacagcctacagcctatggttggtgttttggtcccttcttgtctgttttctctcctgtagacaaagccagattttgctagctactggttatacttataggtgattttaaactgatttagaaattaaagaaggtgaattcatgttattaattgttattatttgaatgactctatgcaatgcaaccagaaaaaaaaaattacatgagttatgtctctgattgtctaagtagtgaccaattttctatttaaaataggggaagactacataagagtggtgtagaggccatttcttttttagttttgtctctcctaaaaaccaaatatattactttaatagaaaccaatataatatatagtagagtaaaaacaaatttaaagagttgtgtaacagtaccacggttttttactgtgtcttcaacaaatgccacattctttaatactctctccgtttcaggttataagacgctttgagtttggccaaagtcaaattactttaagattgactaattttgtagaaaaaagtagtaatatttttaacccaagactagtatattatgaaaatttactcaattatagatttaatgaaactatgctggggttgtgtactattttttctatagagttagtcaaacttagagtagtttgattttgaccaaagtcaaaacgtcttataacctgaaacggagggagtgccttttagtaaattgtgtctccacttgtcaacataagattatcaaagttctgatcgtaggattgagatcctttggcgtgaagttaaaggaatgtgatcactgatatgtgagtatcaccacccataagcctagtgctatatttttttttagataatggaatataatattccggcctttgcttaaaaagaactacagcctattattacaaagatccactccagaagagagtgtagttcaagacaagttgaacacaccaaacaagagaagagaggacccaaattgaaaaatgcaaaacaaaatgtggagctagaaggcctcgtccaggcctatgactaaagttcgaagccaatgcataaaccaatgacaatatccttgcacgaagaggtttctccaaagcggtgcccccaaggaggatgcgacgtggatcgccgccaccgctcgttcggaaccgaagcaaggttttcacccggagaatatggtagggaaaggaaaggggtatgctaaaacaacgcctccaaggaggggaacgacgccaaacggcgtcgccgttgtcagccggccaaatggctcggcaaggctttcgcccgcgattccctgtccaaacccacaccaccaatccgcacaagaaggatcgtcgtcggtcaacaacattgtcccttcagcgattcggccaaggccaccgcccataattgttcccaccgtcgacggcgcgtccgcacctggactcctccttccccgccgccatagagagtgtcaaaatagttgctatatggaagatcaaatgccatagagagtgtcaaaatagttgctgctgaagaaaatgctataaaacattgaacttatttttactcattattgcaattgaattttttatactagcggtattaactaaaatttgtgctctagctgcggctatggtgctgatcattttcaagctgacgccaaacctttagatatacaagagttgaatcttttattggcacatttatatctgatcaaaacctaaattcaactaaaatacctttaaaaatattttagttttgaatggccaaattatttagtgagccgattgctcccttgaaaacgatataacataaccacattcaggaaagtaccattcgtgtgatggtagagtctttgattggcacatgacttaactcaccaagtataaattctgatgctcataaatagagctatatatatgtattgtgaaaataatcaaatgggttatgcaggagtatattacagtcctacggtctgtataggctccgatgagtacagtgcagatggaacaaacacatgaaaaaactacatattggtcctgtcttttcaagggccgtagtgcaagaacatccacagtacactatagacaattagaacatatggttcatgatgccccgtttcatattcatctgctaataatcaagggcttctcgaagaattatgcgtgctttctgattattggtcgcttgctctactgtcaacgatgacaatgcagctgcctgctatactccataatgtttttttatctggcaacaatagcgactcaccacattagtgtgcaatattaattacaatgtcgtcacttaagaggtttctttttttctccggttacacacttttctggttcttaattactaactcgatgttttgcagattaaaacaaataagtcaattacagtactgactgtccttaaccttgtaaattaataatcgcttctgtcattacaaaaaaagaagtcgttagtcgtccattacatacgaattccctcccctaactcaaaggacaaaattgaatgaaaaaaattcagccttatttaatatatctgaaagtgccttaaactacatctcaaaataacaaaaggtatcttaaccaaaaaattcagaccaaaaacacatcgaattccacaataatttgtttttaggagtgtctatacacttcaggcgactgaatttttcaaaaatttccatcactttttctaccacttggatgatgaaaatccaatggttatcattactcaccaactacttattacttatcactctcaatgattgaacaataaaccgttctaacatacaaaaatttacaaaactacatgaaaaacattaacccataaaagtgtacaaagttacgtgcaaaaaattcaaattatgtaaaattaaaataaaaccaacaacaaaattgcggttaaaatacgactaaaattataattttttagccgcctgaaaactagcaaatcccttgtctttttagggggaaaaaactcctttcccctgaacagtatctcagtcaaaagaagagatatcatcgatcggctctttgatttcttggcacccttacacccaacgacatggacgtggcatgatcaccaggtagtcaggcaccagcggatggccactgttgaggtgacatgtagcttaattagctagatgcaagtacaactttgagctgctttttctcgcagacaaattaaaaggcataaaaggatagcgtatagtaacaaactatagcttagctttgtacaaattaaaaggcatgatgttgctctgaagattcgtcaagacagcaagaggattcaaaccccatcgatcgatcagtgcatgacttggaccaagctctcatgcatttataaagccatagaagaatacccttttaattgctccatggactccttcacactcatatatatatagctagctttgctccttgcaaagaaaggccaatatctcaagagagctagctagagctccatttacaaccattacaagattgcatcagagaagatatcttcatagataattgttggagcaagaacacaagaaaacacgtaggttcaattataatcgatcgtggagatggtgaccagcaaggagtttgcaagggatcaggcggccatggatcagaagatcaagagcgacgtcggcgaggtggtgctcgccggagacgaggaagaagacggggacgtggtgctcccggggttcaggttccacccgaccgacgaggagctcgtcacgttctacctccggcggaaggtggcgaggaagtctctcagtatagagatcatcaaggagatggacatctacaagcacgatccatgggatctccccagtaagtgcatccccaattaatttgacaaataacctcaaacacaaatcattttcaaaataattgagctaaattctgtgtttgtgtttgaatgaatggaatgattttgtgcagatgcgagcacggtaggtggagagaaggagtggtacttcttctgcctgagagggaggaagtacaggaacagcatcaggcccaacagggtgacgggatccgggttctggaaggcgacggggatcgaccggccgatctactccgccgccgtcaacagcaactccggcgagtcgatcgggctgaagaagtcgctcgtctactaccgcggcagcgccggcaagggcaccaagaccgactggatgatgcacgagttccgcctcccgccggcgatcgccgccgccgacgcctccccgtgcatgcaagaagctgtaagcacgcactcccatgctctcatgctcgttcgttctccttctccatcgtcgtcaaggcctcgtgtactcgatcccatgtacgtaagaagtgcattcgtaatgggagaattacccaaactcagcctggagagagatggagaattacccagactcaacctggacgagagagatgggtcagactagagggatacgagcaaccaaacacaccatatccatatccggttctcctcatctgtgacagatcacaactacgtacaatttgatagtgtggagtacaatatcatctgcaatactttacatcaccaaatcgtcttaatattttttttcaagctaagttcagcagttctttcgagattacaggcctccttttgaacgaagaaattttgcgaaaattctacaaaaattgaactaatccatgtgaaagtcctactgaaattcccacgttttaaaggagtactggacatcctctcacgttctgacgtgtttctagtattctaccgattgccatttctaaccgataagagtacagcctcctaatagcattgacctctaacttgtgcacttctgactgaaaaaaatgcaggaggtctggaccatctgcagaatcttcaagagaagcatcacctacaggaagcagcagcagcagcaggcctggaggccgccggcgacggtgaccgtcaaggccccaccgccgggggactcgagctccaacaccggcagcttcgagtcggacggcggcggcgacgagttcatgaactgcggcctgactccggccatctcccagcagcagcagcacggcggccgtcatcagatgatgagcacgatgagctgcaacg

SEQ ID NO: 20022 - DNA, 20888 bp, Oryza sativa
ttttttggggtgttcatgacgaatgatgttattgcaacagcaatgtgcacccccctttgtaacttacccatctcactcaggtgtacataggcaactactgtcaatggttaaataaaagttggctaaggagaatagctgtaactctggtaacatactcaagaatcaattcaaaggtaataacataagtgctttgtcactgagatttgattaaattcacacaagtcattcaaagctgcacacgtatgcgcagacataaccatctgcaacttgcgtgcgacgtagacatttgatctggtgtaaagatttgtcatcagtggacaaaatgttgttataagttgtagaattgcacataaacaaatcatggatcattttcagaatttcttgtgctgactcctaatttgactcttccagcaccctagaggggatcaactggattactatcaagctggtgtccaggtgattcaattcaatgtatctgaatcacctgatgagtgacagggggtgaaactgtaaaaaattccataagaaatccttttcaggtcacctctatgaacagttgtgcgaaaaagatgtgtacaaccattctggatgctgaatgtgacttcccggaaaattatatcaccatcttgaagctaaaatggcactaagagccataccacatgaacagaaaacatccagccatacgaaatatttatgtgtgatatttaatgtgttaggataaccatggaagcggacaaccagaatttgtggcttctctgaccaaggaaactagagttgtgtttagatgtaaagttaataaaatggtttgagctagcagtgatagactagaaacagtccaaaacagaaccaacagaattggtgacacaatggtaaaaagacaaatttgtattgagcaaaggcaccatcgaatatactccctccgtttcaaaatgtttgacaccgttgattttctaacacatgtttgaccgttcgtcttattcaaaaaaatttgtgaaatatgtaaaactatatgtgtacatgaaagtatatttaacaatgaatcaaatgatatgaaaagaataaataattacttaaattttttgaataagacgaatggtcaaacacatactaaaaaatcaacagtgtcaaacattttgaaacgaatggagtagtacacagcaggataaaaaagttgtttgattctgtttgcatctattctgaagacaaacaggtatgtgtgttcatttatctatgatgtgccgcatatgacaaataatcagctggaataaaacatgaatatataacaggaaatatcagaaaccaccccgcaatttacactaaaaagaaccactgcaaaaggagagaaatatgattcagcagtagcagcatagttcagaatgtcacacctcagctatatttgaaatcagcaatgctgatttttcttaaaatacaattgtcttaatacaaagaaattgacagaaacatcatttctggggactacctagtaggctagtacctgctggaggacagcagagggaagcaggactgtgcaaaacacaccaattaggaagatggcagcggaaaaccataccataccagaagcttaagtacctcttggtggatgaatatatcatgtaatagcagcgacacataggtagttagaagtagatgcggcagtatcattttcctctccttccagcccagaaagctgagatgtgtttccactagagcattttctgccaaaatcatcaaatgagaaagaaaatcgcaccacacaaccatgtggataaaatagtacgatcaccatgtaatttaatataaaacgaaaggaaattcgaacctttgtgaaagcaatttctcatcagataaagccttctcaagcctctcctcgaatggtgttgcgtgccaactcaccttttgatcctaattatgtaacaaactatagataagctatttttatatgtacatatgagaaagtaagagaagcagaagcagactttacttctttgtatttgtttgttgagttgggaatgccatttccatcccaccatttaggagtgaaagtatctggttctgtgtctctccagtgagcagcgaccaatccaataataggcctatcttcttctgaactcttagcagaatgagatctgtcacttgtcaagggctcatccctgaacacctttggatttggaggctttaaccactgtgacaagcttgggaattcaacctcagaatcatttcctttgagcaccttctttctgctggaatgaactagcggctcacttttaagacatttctccacagattctgtgcttgaattctctcttctcttattacaggatgatactgaaccctcagaactctggaatagggaacattcattagatattgaaagttcaacagaaaccaaactgtcattctttgcatacttgaaatcctcatctgatatattgggctgacaggattctagtctcaatttttcacagcttccagaggcctcaacagaactcacagcttcatatgtatgctctgaacaagtcctagtattgttctcatttctcagctcttcctggtcaggtgcatgagttgtagctggtgtctgtatctcagcagtcgcttctgaaggagttgaaatgggtaaagatttggattcaaccaggttgatatcatccctacatgtgaaagacggtgaatctaaggcggttaacttgttcccacagttgattgcactgtcatcattgcccacaacctcaacttctatgctcttgcacacagcttcagaatcattctggtttgatgcatcgcactctttccaagaagaactgtcatagttaagcagaaccatcgaaatattaaattaatctattcagtcattgcagcaaaaaggaagccaccagcctcatcagaagttggtaacaggatgaaggcattggcattagtagcgaatagcacaaggttggcatacctcatagcatcaggtaaaatggagctctgatgagaccctgatggagtttggcaagcctcagccttcagcccttccatgaattgtaagtcatcagaaatggcaggaagacatgtcaaatgtgtttgactttggtcagtattttctggcccttttatgatttcatttgtagtttccaccaatgcatcacggtgtatgagcaaacggacctgttgacaccggtgaaagtcagtctgtctaccaaaatcaaacctactggaaaaggaataacaaataaaaaaatcgttattacacctccactctgtaatctgtattgcctaatgtacagcaacaaattcaaattctcatgtagataggttgggtatgacctatgaacagcatcgtacattcaagaccaatggaacaggttgttattccaatttagaaacacaactggtcgcacaattctaacagataaacaacagccacaagggtcaagggatatattagttctttttgaggttagagtaacatgtaagtatctaccacctagagaacaatgctccttcatcattgttgttttatagaaaaatgacgaatataatatagttaaccgatcaaaaggtccttggttgactacgaatcacagtggggatactagttgtcagtcatccaaattctggctcaagtggcatgatacttgagtgagattttcaaaagggcgaagaactagtcatgataaataatgggaagaaattagcggtgaatcggtatgcggaatcggaatacctcgttcttgtgctcctgatccaccttcgtcctctcagtgatcccgttcgctcccaagctcgtactatgctcaaccctcgacccctcatcttcacccaacaaaaaaaatccaaacaaacccaaaaaaagaaaaaagatcagcacgaataaatgacaaaatcgctacatcacaatccagaaatgatcgcgataataagttcaaagagaggcgcaaaaagggaaaaaaaaactctccagaaatgtaccttctcgcaagaatacagcggagagcgcgttcttggacggcggcctcttcctctccccgacctgcctcaccacgaaacacaacacaaacaatcaacccaaaatccgaaatcgaagcaccccgcaacacaccccccaccaacagcttccccgccgccgccgcataccttgggagcgtccaccggcggcgaaacggagggagacgaaaccagctggtcgcgttcacgttcgcgtcgcccctcgccgctgtacccggccacccggaagcagccgagcagccaccccatcatcctccccctcctcctcaccgcgatgccgccgccgccgccgccctcccccgagaagccgagccgtgggcgcggggcgaagctttcatccgcctcgaggaggaggaggagcagcaactgcgccccaagtggcaggcaggaggaggaggcgaaggtttaagcaggaggaggtggtggggatttgaaatttaaaatcgaggcggaggaggcggcggcgagggaaaagaaaaacgaggcctgcggagtttgcgacgaccgcgtgagcctttttcaggggctttttctttaaaattggaaatgaatgattaacacaagatggggtttatcactttatctctctcttttttctctctctctctctctcactggatgggagcgattttagggggtaataaagtgttgcttgtgaaatggattattatgaaattatgattggtgttaattttgccaatatagtggctcaaatacgatatagggggaaataattgggaatgaactgtgtgtggaaggttctagatgttctcaaaagtatcagcgcgagttgcgaaatctcaagatgaaatttagtttgattggaattttttttgttctttttacttcttgtattgtgttttatacttttattgctctctgtatgcttgcttgggtcccaatcacagactagactactccctccatccaaaaaaaaaagacaaaccctgatttccgtacccaacgtttgaccgtccgttttatttaaaaaattatgaaaaaaattaaaaagacaagtcacgcataaaatattaatcatgttttatcatctaacaacaatgaaaatacgaattataaaaaaatttcatataagacggaccgtcaaagttgaacacggaaactcagggtttgacctttttttttggacggagggagtacactttttcaggtttcagtagataaatgcctttgtttggactagtgtcaaactctactagtacttcctttcaaaaaaaaaaaaaaaactctactagtactagtctttttccatctaggaatatgcagcagttcattctagaattgcgttggaattgacctgaaaatttcgataagggtgcaggaaaggtactacagtttaaatttaccccaagattggatgattatcttttgcaaatgaaaaaagtacaccgcaaaaccggatacaacacatccctcaacttataaaaccgtacgaactaagtcttttgacaccgattttatctggcggctgagtcagcataggacccacgttggtcccacatgtcaggatgccacgtcggcaaggcagcctctcccttcttcctctcctttcctcctccccccccccccccccttttttttttttttttctcccccactcttctctctggactgggtaggccggcagactagttttgccggtcactcccgaccctcgcctcgccgcccactcgcgccgcagccgcaggcacccctcctcctccacaagtagcagatggcgtctcgtcctcctgccaccgcgcgcgcgttccgagagtccagggcggcgttcgatcgattgatttgatttggtccggtgaggcgacgccattgttgcgaccaagaaaccgtggacgcgtggttgtggaacgcggcgtggcgagatgtaggccgtggtggcggccacttctagagcctgggtggcctccccgcggcggcggcatgtcgcctcgtgttcttcttccccgatgacgacgactctgtcgtctctcaatcgatgcacggtcgccggcgtgctgccgctcggcattcgcggcgggcgcatgctgctcgcgcccccacttctgtggaacagcggcgccgcgacgaggaagatggcggtggcgacggccgcggcggcctcgccaccggcggaaggtggcgggaaggcggacggcagcgccgtcgccggcggcgtttcgcggacgatgcagctcggagccatgatcctcgtctggtacctcctcaacatctatttcaacatcttcaacaagctggtctgcacgggcatccctcctgaagcaccggtgcgccgccgccgcgtcgccgcacttcgtgtacatgtcaaccagcgcgttccacgcgacgaaacccagagcaaccttcctttccgcgacgcgccggtgcgcctcccgacccagcgcaaggtctccaatttgcgtgcacgccgagaacgcgacggcggcggcggcgacgatgtcgatgcacacgccactatcatccgccatggcgaagaaaagcaccacagcctcgtcaagaacccgtgcctcgcgtgggttgtcaccatggccgtacaagaaacgagcgcccacgcggaggcgagctccccgtgtgcgaggtagagctcgacgagcccattgcggacggcggtcgaggccgagctcggccgcgcgtgcctgcacggctggcaccgttctcgctgctgcggcggcggcggcgacgacggtagcggtaatggataaggcgctcggtggcagggcgaggagcggcgaggtcgacgatggccgccgcccacggcgaggtccccgtggaggcggtggtggccgacgcatggaggaagcggagcggagcctgagcgggcaagaggtggttgggcttctcgtcggaggtgtgggttccgaggatgaggcggtgggagcgggtggagtccggcgaccgggagcaaggcgtaggcggcggaggggggagcaaggcggcggcggcggcctccactctcccccagcctctccgcttcggactgaggccgcgtggtcgccccgtccttggcgccgacgaggagaccatgagcaccgccgcgccgagagtctcgcgctcacgccgccgccgtggaggagaagaggacggacggcgacggcgaccctatccctgctcggagccgccgccgtcgacatgagtcgccgccgccgctcctccctcgtctgcacgccgcgccgcgccgctcctcccccgcccgcgtgccgcgctgctcctcacccgcccgcgcgccgcgccgcgctgctcctcccccgctccgccctcgtcgcagccgcagccgccgccgccgccgcctcttcgctcgccgccacgtcgccggccgccggacgtcctcctttcccacgtcgctccggcgacctcttccccacccgccggccggctttgccacttaccgctggatagggatgatgacgtggaggaagggagaggaggggaaagaggtaaggatgatgacgtggcacgctgacatgtggggcccatgtgggtctcactaaaactaggtttaaaacctaaggatctcgggtgcactttttcctttgcaaatttcccttttcctgtactccacatgaaatggcgctaatgcttgtgctaagccggcccatatactatctgcagttgggccatactagctgtggaggggtttccggcccatatactgcctgcctagtactctcacaatcacaaaacacaagaaatttcatttgctcctctggaatctcaaatgccaaaggttcaaaggtatagttcgtgcctctgaagtctgaaccctccatcatctagaatgtgaggcgaaggttcaaattcagtcttcagatatgattgcttgtttcaattactagctagctgcagctaatcctaactcaatctaacagaaatagatgcacttggactacaattcctttattaccatcatcatacacaacaaccaatattcccttcaagacatacagatacaggtggatgagcagcattctgatcctatgatcattttaacatatgctcacaaacagctatggacgtatactacaatctgaatataaatcaactatggacaaaagcttgtgaagcagcgcaaaacggaggtaaggtcgcacctttgttacctcggtcactttactatatctttgaggagcatgtgtggaattagatctctgtggcttgagctgctcgcgatcccgctagggctcgttactacgtctggtgtggtttgatattcccaggtttccatcctagttcacgagctctttcttcccacaaagcagtcagtttcctttgttcaaccaatgcttctgatgatttttcccgggcttcttcacatgtatccatacctgaactgcatttgtcagcctccttttgatattgtgaagctaattttttcgcctccagcaattttacatctgcttgctgctgagcttgtgttgcctcttcttctctctgcttcagttcttctatgagtagctccgtgaaactcttctctgtttcttcaccagacgcacggctcttaacatccttgaattgtttggaacagtctgcaaatatcaaaagtaaccacaatcagtgaaactgcagcctctaaacaactgcaaaacatgtctataaaagataaatttcaaaaggtgattgtcatgtttattgcaagcttagatcaaatgaggtaacaatgttcattgtcaagataatgattcagggaagaattagagttgctacgatagaggctaaggtcactgaaacaattctcatgaggctgtgtttggcacagcaagttcccatctcctcccctcgttttccgcgcgcacgcttttcaaactgctaaacggtgcgttttttgcaaaaaaaaagtttctatacgaaagttgcttaaaaaatcatattgacccatttttgaaaaaaaaagctaatacttaattaataacgtgctaatggaccgctccgttttccgtgtgtagaagattggttcctatctagcccaagcgaactcagcctgttaagcctccaattctttttggactttgttatttcatactactactaggtattatgaatgagcagctaaagagtttcaaacatttgttatttcatcaagaatactcacaaaagtattaaacctttcatttgttagaggagaaacctaaaagagcactacaaaactattcttccttgtcattcatcatagcccgaatcgatgtaggagaaaaggtaaacacatcacaaaatatttcctttcgtaagcaacggcagtccatctgacgcttgtaaaaaatcataacactacaacagcagaagcaacgaaacaggtagggattggctcacgttgatcattaagtaacaatcttgtataacaaactaacacccatagtaacaaagtagtatccttttttagcatacccacgagctatatgttcaattcaatcttgtccagcatccaactttctttccaccactaaaatctaattgagctcctaagtaactccaaaattattttctccctcagttttcagcaaaatcttaaagttaagtggaacagattctgccaaacaatcactaattcagccatcacaagcccaacacaatttttttttcagacaaggaacgctaaactcaacaacatagagaagctacagatctccgaatctacacgctcatatcgtgctacttggttgccaacctatcatcaactaaactaaattcctttgcgacatgtcaatagcaaaatgtaaagctactacaagaagccgcgatgctaagctctgaatactaaagaaaagaaggaaagcacaaaaaaaaaggaatagagatatcggatccgagcagcgggcgggtaatggctggatgaatgagctcccgcatgtcaacaagatctgggaggagagtgagcaccgacacggaccttcggggagcgcgagcagcgggcgggcgtcgcagtcgcagtcgcacgcgggacacgcccccgtggagcggccgagcgcctcgctggcgtgccagtagagctgcgggccgacgatgtaggcggcgaggccgagccccagcagcgccaccaccgcggtcaccagagccgggctggggccccacgacgaggaggaggaggttgagccgcccgccatcgccgacgccgcgcgcgcgcgcgaggatggctgctgctggtatacagttgggtgtctcggcggaggggaggcggcggcgcggggaggttaaaggagtaggagtgtggggggagtggagatggaccggacgcggtcggtggaggtgggatgggagtgtggaagtggagagtgcagacgggcccgaacacgatatgagatgggatggatcgtgggatggtggtgggttcggcggcagccggcctggacgaacgcagttgtgagttgtgtttgaccaagtcagccaaacaggtaacagggtccaaggtttaagcaaaaagcacaccgaattccgcggaaaatgagtggttttttatgctttccagtttccaagttctgggtaccctccacctaatcggggctaataccttaggattaggtaagatttggttgggccaggaagggttaagaatttcctcgggattaataatattatccgttttggataagagtacgatcttaaaaaaaaaagtaactttaacaactatttcctattataatatacatagaaatatcaccaaatatatagttttcttgaagtatttttttagaaattatttatagtcaactattttaaagtttgactttacccttattcgaaacggctgatattatcagctcggagggagtagttggtcacaagtgtgacatgttagctctaaattcgagattgtgatgtatgagtcccaagggtaagaaagtgtggtatgatacagttgtggtagcgaaataaacacatgcctgagaaaatgtagcatgactaaaatgtgacgtagtaaaatgaagcaatcaaccagacaccctctaatcgtgcacgtgcaatagacgtatccgcataacacatcacacgagacataaatccatttaaaatttattgtgctttttcacaatataaatcacacatgaaaaggaaatttttataaaagaacgataacaacaagcagtcaaagtgagatatgttgtaactgcagcttcatggtgagatcataagctcaaagtgttgttgtgactaggggatgcaactggtatggatacttttcgtctgtttagacttttttcgattcaaatttttttatcggaaacaaaaacgaatataataataacactatcggccggtcggaatcagaaaacactctatgtgggaccaggacatatattactattatagagctagttatatgccattcttatttagaaaatatcgtgtaaatataccatgtgacatggattatatatactgctatccagttcatcgctcaattttctacacacctttactatgacaaatttcatagacaattcattcttatgtctatgctcttatgctaacatcgaggtttcgcagtctcgacgaaatctgaatggattctgttaatttcgaatattttgaggcggctcgaaatatgcatctgataacagttttatgtgaaaatagtagaaattcgttcagaattaacaaaaaatatgaatgtctctattgggctcgaaactcacttgccaatctcgaaaacctggttaacatgcgtggaacttgggagtagattttcgacacgctaaggctctctttggcacaactcctaattcaagaatttttttagctgagaatttctggcttcataaagccatggatatccacgattgcgttgataatattttagactaatgtttctattttaggtaaaatttaaaaattttaaactactataatttagtaacatataaattttaaatcaaacacaaataagatatctatacgccatagctatatggtgaatggtcctaggcttcaacgcggcttaggctgtgtttggatccaaactttcaactttttccatcacatcaacccgtcatacacataacttttcagtcacatcgtactaatttcaaccaaaacttataactttggacacagccttggaccgtttcatcgttgccagatcaccactcgtcgatctctatgcaagtggaccccctatcctcaaaacacccgtaaaaaaaaatccaaaatcaattgaggaaaaagaggatcgcgccggccgatacctccatcgtctccaaaaactccaaacccccgcttgaaacccacgacgacgaccaccaccaccaccacggatcattccgccgccgccgtcgccgccgcgcgcctcccctccagtcaacgctagaacccgccctcgacctgccatggacccatctcccggcctccagcgccggcccgcggcggccgcggcccgcggcggtgaggggggaaggcgcggagcctccccgcgggcagcgcgtcctccacggcgacatcgacccgccccccagggcgcggccggcggtgcagaagctggccatcgccgccatcgtggtgctcgggtgcctccagttcctccccgccacccacttccgggaccccgccgatccccagcggaactggatccccttcgaccgctcgcgcaagccggtggtatggatacgatacgatacgatacggccgctgctgcgcttcaccccccccccccctactgcctctctcactctcgcttcatatagctctactcttttgtccattaatttttgccatgtttgagctccgggagtaccatttctggaatggtgatacaccagttacattatcatgctcaggctgttacattttcacggtgtaatggaatattttcttttaatatgcctttttcccccttatcctggaggtgaaaattgggtttgatattgaaatgcgaaatgtgtgaacaagacatttttggtacttcctccgtccccctaatataagagattttggcatttgcttgcactgtttgactattcgtcttattaaaaaatttagaattattatttattttatttgtgacttactttattatccaaagtactttaagcacaactttttgttttttatatttacacaaattttttgaataagacgagtggtcaaacagtgcaagcaaaatgtcaaaatccgttatatttggggacggagggagtagttggtggcagcgtgacttaaactgggattgctgtgtcatgctagatatctcaggagacggtattgttttggtcagagttaggggaaaagacaaatttcttgatgtactgatggttccttttgcaggatttgcccgatgaggttggaagcgttaatgtcttttcttggataagctgtctggatcttcggactcttgctgtgctgacaaattccaccatatccagctcaaggttctgtttgatttcagcatttgtaactaatgcatatttcaaataactatagtgatagcaaaaggataaactcttttgctattggatattattattcagtgttcatttgcactgttaatgatatggaactaatgacgaaatctgttttcattctcaagtttttgttttctgatgtaattgtctttgtttaacagtgatccccataacatatccttcaatttcttaatacctgaaagaggcacagataaatcgccctactacaagctaaaagcagtactgcctgattcgaatgttactgttgctaggtgagggggaaaaaaactaaaactctacttttatcctgggcattgttgcaccctgattcctgtttcgttacattacagtcaaaagaaaattgaggacaagctaaacgttgccactccagaaggaaacctcttttggtcattccccaatgaattgtcacccatcattattggaacgactcaattctcgcaaaagagatatgtctatatctcagcggactcaattgtaaaggtacttacacttctctatatgtgatcatttactcaaacctgtcattgagttctctgaaaaaattaataattgaagtattgaacctgtataaactatcatgcgagcattagtgccagggacagttccatgcaattgctgatctaattgcttgttcacctttttcaatcatttcaacttgtgatagtgaaccataattctgatttttatgtggaatacattgaatacaaatctaccaagtttcttcaaagacatcactttgcttggctagcattatcagaagttttttttataaaaaaagtcaagagtatggaactaaatctgtgattccatgactggtgcaacagttgcttcaaatagtcaattaggaaacaaaaccctgcatatgtaagtgagtagtaattgagtatattgccatggctgtgttctttgatgaaggacatagaagcttttgagcattgaaatgttgtgtatccaactcaaacatacaaaaaccatacatatgtttgggttaacttatgttaatcgtcaatctcctcccagggaaaaattgaagatcttggtcgcatcgatttaggcacttatgctattgctgctgttgaagattgtaccaagcgcattggtgactatgttagtatagatgttctgaatgccgttcagaaaacagctccgaaaaatttggtgtataccgaaccttatgacaaggatgcatgcttacttgattttgatgtgcttgtggtggagccacgcaaactacggaaggaccttattgattctatcatggtgtggttcagggctttcagtctagccaatccaaggtcagtgactcacattctgtattgggcaacatccaccattgccagatcaccatgcactcaaactcattcaaatagcgcactgtttgtctgtggactttccatttttcagggatcaaattaggttggcaataacattggccttgtatgacaattatctgaagctcccttccaattggaagcgcgcagatgctaactcagacatactgaactacaacgggccaaagaatgtttgctctgaaggtggacgtcagcttcaagaagaaggcaatggcgatgagtggcaactgtaccttgatcagaaatcccttgccgtacttagttaactgaacaatggcatttcatccaacaacctgcacggttctctgttgcttggttgttgggagctgacgaccaccgtgagaaatacgcttcttgttaacctgtcacttgctcgtgaaaggattgtgttttgatgttgtactcagtagactgatttgtttctgctaagcttaaagaatgttcgtttcagaggaatataaacttcagttcagccttgttttgcttcctcctttctcttgcatttgacatatcctgtacaacactacaacttgactacacaagtccattcgagtatccagctgctgacattcttgatggcactcttttgacctgcgcacaaggctgaatccgagacttagccgcgctcaattgttccactaacatagaaaagctgctcaagctggcataatttagtttctacattattgccattacataatttacagctagattgctagtactatggtacatgctagtatatcacagcgtacatcacaggaaatcccagactggaatggtgtactggctttgatccgtggcttggtgacccagttgaggattgctgctaagaaactgcaatgactggatgtccggaggtggggcctacacgaaaacacggcatgcgacctactattaatttttgttaagcaattttatatgatcaaaaaacaaaggttaattccactacaagaaaagtatcaaatgagatcatgggacagagtgataacaaaaggttgatttaactataacacacctacatgaaaatcttcaagggaaatatgtgtatactcaacgaacacttgtagtcttagcctagtaattgctaatggaatctgtgaaagtgaaatcccttgggaagggaacatgggtgtaagttataacaatcacctgggggatttgtggaccgctatgaaagggtggttgctgtagatgaggttgctggagaggagcaggtgctggttcctgcaactgttttggagttcaaatttgcaagttataagaagaacaaaattgacacttctcttcagccattcatcaatgtagtcaatgctccaattacctgcccaaatggtgatatgccaggaaatccctgaagagagctaagtccgaattgctgtgcaatatacggtgcctgtatatgtgaagcaacaatattcaggacatgggttatacaaagtttaaataccaactacagttatccccgtctgcactctgttcatcaaaactggggtttaggactggagaaagcagaaagcaaatataaatgttacctgcattatatggcttgttgcaagaaattgactggttggagttctcagatgatttggaatgtcatttgatattgtaggaggatcaaccctaagcggaacttcagcctcctcaggctccggtagacctacaacattttaataagatcaatccttgatctatataaaatctagttctgaaaaagcttggatgaagaacaaaccttgtctaccctttttcttcttatttgattgaagaggactttgctgctgccgacgcgtatctacatttttaattttcttactacttactctgcgagtttcactgttgctggcttcattcggaaacaaatttggctgttgaactttcagtatagtgctcaatgaagatttatcatgtaactttgcttgcaatagaagttcaacttgctctataaactgatcacattggctctccatgtatgtataagcttcaatattttcggcagcttttgctgcaattttgtagaacgttcgatacaacatgctgtatcgtttagacaacaagaacctgggatcttcatctacagcttcaaaaccatagttctccctcggagattcactctgagcatcctttctccatcttttcaaaatgtagtgtggtggaagttctttaatatttcttacctcaagaactttcagtacatggcaacatggaatacctgtgaattcaaatttcttacagctacaaacaaccatacattctgatgagtcaaatctaacaaaatggtcacggggcctgtttttgacagttacctcatactcagatattggtccaatctcaccacagcaataagccatgcaagtcaaggtcagttcaaattccaacctgaacatctcaaaaagtgtaggagtatatgcattagcagcttgccaaagcatccgcagaggtgctactctctgtgccatttgaaccccaaggtagtcagcttgttgttcagctaggcgtttgttctccaaaagtttgtcataattgttaaagaaggatgggaaatccgtttctttctttagaagatctgccagtatagcatcagtgttattatcacttcggagtgcggctgcaatatctgcacagaatgaatcacgtccataaggtaaagcccatctttctctatctgcatacaatttacctagccactcattgtcctttagattgtacttatctgagaggatttcccagcttgacaagaaatccccctcctcctcatagccatacaaccacatgctaaaatcgtctgcaaaagtttccgaggcttggaaggcatcccttaatatcttagtggcatttttatataaatgaatcagtgaaaagcgctgggtggtccttggccaaacagaagcaactgcttcactggattgctgtagattgatcgatcataactgtttttggttgcttgccactcattgcagatttgaaagtttcaaacaaccatttgaaggattcaactgattcatcataaaccaatgctgcaccaaatatgactggctgcttatgatgggtaacaccaataacaacaatagaggcctactatgatcacttgtgctatatcttgtgtcaacacacagtacatcaccaaagtagtggtaatccagaatcgacttaacatctgcccagaatacatttgtcaactggtcatcttcatccacttggatggcataaaagaaagaaggatgttcacctttcttcctctgcaaatattcataaattgcctgggtatcacctaattgcatatcttttgtgtgccttgtccttacataatttttataatcatttggtatcaaaacaactcttggtggatctggaggctgctgtaactttgctaataacttatgtgatctcagaacctggatgtccaccaaaggagtttcaagatcatgattatgatcagccacatactcagtcactacatatttgccactcacagtgattttaatagtcatgtgtgccagacaaccagttcttgtttctggccgtggcttcttgggatcagtactgacacttttagagcggaatccctctttagaacagacatatgcccgagattttgtagtatttgttgctgttttttccaaccatccttttcggacgctgaaccccacagttccagcataggtgacatagcagtcataggccttgtcttcattcaggaaaaccattccaacttttggttctcctccaggtccagcaactacttccatttctggatctggttctccttcaattatttcatcttctttactctcaccctggaccaaagaaaacaactgtatgtgttaaagcaatgaggaatcgaatataaagaagtggttcatttggaatttttttggggttcattaggaattaataatgtaaagtttaaagtataagccattgttcccttttgttacccaatcaaaaataagacggaggacacaaacaattagcttcaatgcagcattgcagagaaaaaacttttcaaataaacatacatcatttcacaagtgggtcttaccttatcttcttttttgagattttgcttttcaagacgtttagagcgcctttccgaaggttgctgcagtggttgccaattcatgaatataagaaaatacaacaagatggcataaatgaaatatctatgtggaaccaatatagaattaatgtatagtttgtgcagcagatgccaagaagtgtcacagaatacacagtttgttttgatattaaccccagagaagtgaacaattacattggtatgcaataaaagatttgtgtattgctaataattcctagttcagtaacaaacacaaactgtgcaaactacaaatgaagtgatagtgcattctttcaaaaaaaaaaaggaaatttatatgccagtttgcaagtgagtatatcaagtgcagtgagttgtaaactgagttgtgtgacctctaacttctgaggtactaactgctagataccagatgtgtactattttggctcttctcattggctaattaatcacgtactaaaatggaaaaaaaatacaaacagagcatcagcaatatccattagtaacatggaagggaagttaccgtcagtccttcgcttgacagaaatctacctccatcaccacgttttcgtctttcagccaaagcttgatgtgaggcgatctgaaaacgacaagcatatacttaccaagtgaaactagttaaccgatgtgcatgtaccaactactgttggtatatatccagacaattcaacacttgtagcacatgcttatgtgttgacatttctagcacaaatgtatatatcctcacatgcttttgttgaaatttgaaaaactatctgaaatccttaaatatgatcaaccttgcatgcatcacgtatgaaaatgtgtgtgcatgacctagcgacataaatatcttatattgcctgggcacaatggtcagcttccaatcactacaagaaaaatgacagcatatatttctatccaaagctatatattgttcctgatttccagttgtgggctacagcgctttgtcgctttcctatttggatcactatccagttgagcgactgctaatcattttgagacaacattgagttcaaaactcttgacatatatatatgctcatttgcataaataaagcatagctacctgtgcagcttctattaagtgtgtgactagtacaaaaaaataacttccttccctttctatgttaaaagacatgacgaccagtaaaatgtcacgtatcaagcttcttactttccatcttatcagtgttcagtggtgcctacatacattcaaatctaccccctcagtaatttatattcatctttgtcacagctaataactaactccaaatattttaccttggcaggccttgccgaaacaggtctgctctgtcgctttgagaggtacttactaactatcttcttcctctcctcattagtgtactgtgatgccctcaaaccgagttccctcagcacacgtgcctgcagggcattgccctcggcatctgctttcctcggccttcccctccctctcttttcctgcacttccacttgtacctcctcttccatttcctcctccccttcccctttctgctcctcaacatcatcaccatcttgcgccaccacctcgtcctccttttcggcctccaattcgacaacaggcttctcatccttctctgtaacatcctttttagtcctacccctcttagaacccctcatcttgcgcgcctcttgcccgttatttgggactgctgtcccgacacccttctccgcagagctctccacttcgatcacctctgagttatttttcacagggttgggattcctcttattattggcgcccctcttcctcttgcctgcagcaccatcctgcacctcctcctctttcaactcatccaaaccatttgccttgttcctccgattggcgtaatttcctctggagcagaggaacctctgcatgatcatgacgccattaccaaccgatcggcgattggagcccgtgcgcgccttgaaccccaccctctcgccgtatccgtagtagaaccccttggcggcgtgcacggattcgaactccatccccatcaccggcaccgccgcggccacctcc

SEQ ID NO: 20023 - DNA, 4298 bp, Oryza sativa
gggatttgaaatggcgcggggatttgggcggcaagcgggcggcgcggggggattatatagtgatcggagatgggaggggagatcgggtgtggggaggaggcgtcttgccttggctgcggcggccggcgagaggaggcgagagagtgtggggggagctgggtgtggatgcggggcgagaggggatccgagggagaccgagaggcatctactactccgagatgcgggtacacgggctctgtgactgacagtggtggcccacaggggggtatggcccgcgtggcagtgggggtggacttgccggtgagtgtgacgttttgataggcggcggtggggctcgtggcggcgaccggaggtgggcgacagtgtggtgccagtgggggcgcgacgcgtgtcccgaggcatagtggtgtgggtttaaaaggattaggatgccggatttgtgcgggtcccaagcgtcagtgggttggggctagtgatactgtggtacaagtggacaactggatggcaattgtccgatcaaggtttatactcatgcttatcggctaaatttgaattttaatcttaaattttgaattgtttcaaggtttttttcattaatttttattttttatcttttacttttatatcgctaagaacacatatataaaagttttattcacaaattattttttttacaaatatgtttcgcttattcgaaatgatggctagcctagctgggctaaatataatttcgtttatttaccggatataatttcgtttatttacaaatataattatatcaggcctttagctgcctagctgggccgtcagagaattttaacgaggaaaaggtccactttgactccctttaaaataggccgaatctaattcgtacccctccaccgaaaatcagataagacaacttccctaactattgaaaccagtgcaatttgactccctcagcggttttgaagagtggttttgctgacgtggcgctgatgtgacggtgctaacctggtcttcatcccatgtggcgcctatgtggcattaaaattaaaaattatatgagggacccacttgtcattaaaataaaaaaatattgtggagcccacctatcatcctttctctctccaacccttcttcctcctccctctctctctcccccttgtctctctcttttctttcctcttccgtggtggcggcggcaggcggcgctacccttgcagagacagcgggaaatggctcccactaccgggggcggaggcggctgggcgttcggggacatcagtaccgtccgattttcttgacccactgccatccctagttgtcgtcgcgtgcttgacgtggacggtggcgacggtggacttgatggcgatggtggtcgcggcagcggcggtcgtaggtggtgacgatgaggcgtggcgcgcagtgatgcttcccgtcactagctgtgcaccctcgatcggttagggttttgtgggtggagttggcggtggtagcgaacctcgtgccgtgtgccgccccggcctccaccctctatttatgtggcgcagggtgacaaggcccaccagccattgggctgggcgcccccgatcagggcgcaggtcaagatccccgttgtgccgttgggcccaacggggaggggatctatctaacatgaagtagcccgtcctgaaggcctgggtgaggtcggaggcggtggagacggtcgccatgatgacgccgtaggcggcgagcccagtgaccacgccgccgtccttgagccccacccacgcgccgaatgcgaggaccaccaccttgccgaaggtggtcgcaatgttcatgtcgatgacgccggtgacgtacgtgttgcagaaggcgagcaccagcgcgacgaggcaggcgacggcgacgtggtggtactttcagctcggtgtagaggcgcagtacaacaatggtggacatgaccgacaggaccacatacccggcgacggcggccacgctgggcatccggtcacggacgaacacttgcttctgccgccggtcgtcgaagctctccgccgaaaaatcggacggcactgacgtccccgaacgcctagccgcctccgcccccggcagtggaagccatttcccctctctctgcaagggtagcgccatccgccgccaccacggaagaggaaagaaaagagctacaaggaagagagagggaggaggaagaagggttggagagtgaaaggatgataggtgggctccacaatatctttttttatttgaatgacaagtgggtccctcatatattttttaattttaatgccacataggcactacatgggatgaagatcaggtcagcaccaccacatcagcaccacatcagcaaaaccacccttcaaaaccattaagggagttaaattgcactagtttcaatagttggggagttgtcttatctggtttttcaattgagggtacgaattagatacggcctatttttaaggaagttaaagtggactttttccttctaatgaaccggtgattaggccggccgtcttggctgaatcagctggcatccgtccatggcccatctgcaaatggcccaatacaagctaaaatagaggggcccgcctacaaatttaacatatgccctctaaaaaaacaatttaacatgcgtaatttctgcatctcaatagacaattgaacatttgggatttcatttctgtttcattagtctttccctgaccattccgtgtaagctgcagtgtctgaactctgaaacacttccataatcttcccatcccaggcttgcacagaagatttcaaccggaaaacacactgaacttgcagtgctgatcattctccgaaaacgcagcggttcagttcagatgttacaaaaaaacccacttgtttccagtaggcttagccaaatcatcatgccgaggcaatcgaacagcactaatctactagagacgagacgaaacaaaaaataaagcaccagaatattttatctcaaaagagcattcaacttgccatattgcatattcgggttgctgtctgaaccatccctgtcatcgtctgccgcccagcccgccccgttacatacgttgtagaaaaacgaaggaaaaattctggtaaaatcgacggaaaactaacggaaacatcaccacactgcatgaccaagaggcttcgtttgtttgaaacaaaatcatcaatttaaatcagcctttcacacagcaagtgcatggctgatcgcattctttaaccccttttccctgcttcatcctcaccttggttatcttgagaggcacgaaagcatcgaaaatacgcaaatattgtgtacgtacgtctcgatcaaccaggatgaagcttccaagtaatacctggctaaccagcgcataaatatgccgatctcgcgaggccgctgcatgcaaacctgcaacacacaagaacaggactgagttgctgatcatgcgcttctcccgtctcgttttttttttattgtttggtgagacgagggattagcgacggtttcgatcgttttgttttgttttgttttgttctacagtgagccaagtacaggtcgatccgttggtgttgggtttaggccctgtttctttcagcttgggattattataatctagattatttggactaaactgaaagaaacagacaacttattgaagtagcttattataatttggagcccagcttattataatctgataagctcatttaggtgagctttttccagattattgggtgaaaaattatccaccatgccaccccactctctctttagacttgcaaacccaataatctaggctctaataatctagaaaagaaacaactaaccgcttattctactacagattataacaatctagtttatagtaatctgactcaataatttagattataataatcccaagctgaaagaaacatggccttaatataattaagcggcttattcgtagcacttctgccgttaatttgctagtggtgatattgccgcatgcttcatcaatttaccagtgaatcatcagctctgcgcttttcagcttcttaggtcccggccgtttgaactagggcggctgatggattatggctgaaattgatttcgtgatcattatttgagggaaaaagtatgaattacccccctaactatcgcggtcgtccgaaattcccccctgaaccacaaaaccggacatttttcacccccaactatacaaaccggacgaattacccccctcgacctaaatccgcggtggttttggtctacgtggcgtacgcgtggcagtccagtcagcattctatttattaaaaaaatgtgggacccacctgttcattct

SEQ ID NO: 20024 - DNA, 11194 bp, Oryza sativa
gtagaccaaaaccaccgcggattggatcgaggggggtaattcgtccggtttgtaaagttgggggtgaagaatgtccggttttatggttcagggggtaattcagacgaccgcgatagtttggggggtaatttgtactttttccttatttgagggcacaaattaaatgaacaaattgaatatcaggaagttgaaaattttgttttaaaactaacgttttatatgaaatgccaatgaagaaagttctcgaataaaccataccatttagctttttaattaggaagtattcccgcgataataatccataatccacctacagttccaaacgggattagtgagtacgatcacaaaatgtacgatgatttgaacaataatacctatggagaactgactgaactgtgatgatacataattatgcttgcattactgctaccaatcagtactatatcgataatagtggcagccctataaaaaaagctacttccctaatcataaatagttgacgtttcgaataagttttggtcaaatttcaaccatcattaacacctcaaattcttgttttttttaaaaaagactacatgtgtagatttattttcaaaagcactatcataatattttaaaccaattagattttataaaccatttctcaaataaaactgattgttatttgatttgaaaagcactaccataatatcataagcttattaaattttataaaccatttcttatataaaattgattgttatagttttaagggtttgaccaaatctcttattctaaaaatcaaatacttataatcaggaggatacaaatttcttgagataacgtcgatcaagagggagaaaggagttatatatgaagtataattctataattctataagtttcaaaaaaaaatctataattctatatttccagtgatcgatgtatcttaacctttttctgtatactcgtgtgtttcaaagacgtgcattgatttcaggaagcgtttctgtgtttagtttgacagcgcaaacaaaatcatccatcctacaaatctgaacattaagaagcattagaaagtacgtgaacatacatgagtaccgaaagttgtgtgatgagagcatttgatgtcaacgtatttttaccgggccagcccaaggagaccgaccaatttcattaagctacaaatacatcgataataagatgtcgaaaaacagggtcccaaaagtaccaacagcacctcccgcaagtaaggccctatttaggttctaaacaaaaaaaattttcatcatgtcacatcaaatgtttagacacatgtacggagtataaaatatagataaaaaactaattaaacatattgcatgtaaattacgagacaaatcttttaaggctaattgagccataatttaacaatgtggtactacagtaaacatttgctaatgacggattaattaggtttaataatttcgtctcgcagttttcagatggaatctgtaatttgttttattattagtctacgtttaatacttcaaatgtgtgtccgtatatctgatgtgacacgccgaaaattttcatccgcgaattaaacaggtcctgagaactaacaggaactgctccaagtcgatatcattcttaaggactcacattcttaaacattctaactttttttttctaaatggtaagtaactactgaataccaacaatgcgttatattttagggtagtgatagtagaaataaagtatcactcttcctgttttatattataagcagctttgatttttaaagttaaacttatatgattttgatcaaatttatagagaaaatatagcaactctcttataatacgaagttagtttcattaaacctaatattgaatatatttttacatcgtgtttgttttttgaaaatgttggtatgtttttatataaatttagtcaaacttaaaaaatcaacttaagaaaagttaaaacgatttactccctccgtcccaaaatataagcatttatagcatacaagtcaaacatttttaactttgaccattaatagcaaacaaatgaaaaaatcaataatgcaaaattaatgttgctatatttatcattaaacaaactatcataatatgcaactctttttttatttaaaacatcttactttagtaggtattattggtcaaaataacatatcggagacagtgtcagggtctaaaaatatctttattttaggacggagggagtagtttattactcctacctatatctctcaggctgtgatccaaacttcagtccttttacatcacatcaaactgtcatacatacacaacttttcagtcacatcatctctaattttaactaaaatctaaactttacgctgaactaaacacagcctcaatgtgtaatgtttagttaatttgaactaaccaatgttaaataaaaaaacagagaaagtactaaactaacatagatgtcaacgtcgaggccgacgtggtcgtggatacccgagctatagctcccaatttcccatgcaccacccggcccacgggccaatccaaaatttccaccacgccgcgttggtgcacaacgcggtagccggtagggggcgctgcttccgccccggttgagcgccaccgaaagagagccaggcacacaaaagtttcgtttccaacacgaacacccccacatttttcctcttccctccacttcgcccaatcccctcataaaagcgtgtgcagtccatcccactcagaatccatcgcccaccccgccattcgctgctgctgctgctgctgctaccaactactaccaccacaccacctccgcttcgcttcttccccaccctcccaaaacctccccaaaatccgcgcgcgatgtcacggaagcgcgagcgcccgctcgaggtcgtcgcgccgccggcgaccccgctctccccgagcaagcggctgcggcgggcggggctcgtcgttatgtggctgtgagttcccgctctcgtccctccccccgcttctggttccttccccctcccccttggaatagcgactcaccagtgccggttgcgtttggttcgcgtgggatctgtgctcttgcaggcgcaggaagccgaagccggtcggcgtggagcagatggcggcgcgcctgattcggcaggtgggttgtggtctctgcatttgggatcgtctcccaattagttttctgggtgatggttcatgttagttgattcagtttttttttctttggggggtgaagttggttttgatttaattaatttctactacttcattcgtgcaatagatgcaagtgcagatggtcaaattgtttatgcttctcatgtttctcgtcgcgcgccttggcaacgtggagaggctgcttctcgagcaaccgtatctgatccgaaggttgcttgaggagcactttggtatttttcagaggtttgcttctgtttactcgagtggaacacatacattttttttacaagcatgaaattcgagattcattgtcgggtttagatgttaccagtgaacgctgccagctcgttgtcgacaatgcatcggtaatcattatgggggcgtgacttgggggaagtggaggaggttggattgggggtatagtatagggtctcaacacgctcacaatttcttctatttatttgagaaccaagttcctccttggttgccatcattttattggatgtgtgttgggggtagtagagagaatttaggggtttttatttttgaatgatccaaaaagtgcgtgacacttttttttttggaaaaaagctatatgcttgaatctgatagcgggatggtctgtttaaatttggttggtttacctgcaaatcctagaaaagtactggaataagtggaattcctcctctgtagaaaccaactggagaaacttgcttattaattgcataattgcagtaataactgtcagaaatgaaaggcaaaacattacaaagctccactaactacttcccgagaattatctgaaacagttcttgaccatttttttcttggcacttatgattttgaacatcatagtcctgttttaatttcagattaccaggttacctacataccatctagcaaataaaccaggatagaacttctgtttttccccaagtaacagaaacaccaccaaaatatggataaagcgttgttctcttgaaattctttctttgtatctgatctcaaactttgaatgttacggatgtgatagataaatgctaccatcattaatttggtctcttattgtttcttatccaaaagatctttgatggaatccatacaagatacggttcgcaaggctgtccactcagaggccagtattttggaccttattcacgtaaaatgtgtgatctatctatacatatgctttgtcttaactccttttgatatgtcatacaacagatgaaggaaagacagacaacattactttctggaggtgcttatcagcatccaaggtatctgccatttttgtatcttctcctaaaatgttgaaaactagatgggcatttaaattcctctattaaggcactttaaaagtttcttgatccatgtcatgatcctaaaaaccaagaaaatgaagtcgtgttatgcattctaacatttctttggtgcacaaatgaacctgagtgcactgcaagttctacctatgaactgcaaacatgtccaaaaggaacataataaccaaaaggaacataggaaccaaaaccgtgcgaggagccctaccaaactggccctaaagatacataggaagaatgcttaagaatgtgctctgttgttgcgatggagtgaaagtgtactatgatatgtattccatgtacatgtattaatctctcattgtatctcaaattgtagaccaaatatatcagaaggttttccacaaactggagggagcactagaatggttaagttattttttgttgatgttgagagaccagaagacccacttttcacaggttctccagtacaatggcaaaatggagccaacgctaaagttgcaatatttgaaaatgggagtcaaatcacacagggtggtctttctaaactacaaatcgagattttaccagtccatgatgatttcttcactgagcgaggaccagcaaatttcaccaaagaggaattcaacaagcagatatacatgtgcaaagggaaagagtcagtattgaaaactgtcaatttaacaaatggtgaggccaatcttggttccttcttctttacagagagttcccatgggaaaaggttaagattggcagcaagagtaaaatatcaggatcttgcagtcagggttcaggaagcaaccagctattcttttgttgtcaaagaccgtcgtagtaaatgtgagtatccacctgttcattttaacatcagaacccttttgaccatacatgattggaaactccaatacacgatgtatgtttctcacaaaatgcagcattttctatgcctaatcatctgaagaacatgatactcgcacaagtggctaccaagataatatagacaaaatatttataatgaacatattatatatatttcattagctattctggtctcgtacatgcaatggcacttttctagtgaaacgaagtttgccacttgtcttgcacttttagaagggaacacctccaggtctgagttctgaaataaacagtatgcaatcctagtcctttgacgtctgttatacttttgttgatcattggggattttcttatgacttacaatgtcttgcgcaatggaaaaaggttcagatcgctgtaattttgtacaatagacggtaaattaacagtacgcacagcaagttgtttcactttgccaggtacacatgtggtaaatacccctagaactaattgcaaagatggacaaactgaaccaattgcatactagcaaccagcaataattgtgtacatacatcttgtcttgacacagccaaccttattgcctactttcagtaaataaaaagagcaattctccatctaaggaagaagggattcattgtttgaagaaaatttccctaaaaggaaaacgttgcaatgaccttgcgggcaaatatattactaaggtgaagcatttgatgcgctgttaccacagagatccagctggtctccaaaaggtaattatgcaattgctatgatgtttctacagttaccgtttcttcaaattacctgcaaaaagtatatactatcagtttgtcagggaacagtatattgttcatattccaactaaaaaaatgccacagaagtgaactgcgagatgctacttatcaatttttgggaaatggctgtagcttgcaaaaagatacctccgcctcctagccttcagtagaaaagtcccaagatattttataacttaaatttcataaatatgaatgttagtgctataaacaatcggcctgtacttgctattcgatatagctcctatgaaccatactctacggaagtttctgtaattaccttttctcttttcttcttctgttccttgtgcaatatttgttattagtattaggtatgctgcatgtagtttaaacaagatttaaaacacaaatcatgtgtggaacacaactacttacctttcacatgctgaagggttaaaacgtggcggtacttgccgcttgcactaacgttaacccagacattcttgtaggtgcagtacacatcagaattattataataatccaatttattaaagattaaaccaagttgatctattttacatttcatcattcaggtatactaattggaataaaatgttcagtgaacatcagttttgtttatttaccaagttaattgcttactttaccttgtaataccatgtttgctcctgaaaggaaaattgctagtaatgctatatatattcacgtgctaagaaactcacatcttcttgcaaccagcttactggcatgaagaatgaagattggaataccatgattagtcatgcaaccacgtctgatcctggggatgagatccattcttacagagttgagaaaaatactataatcttcttcaatgatttctttgctctagtcggtatgtcggttgatggctcctatgctccttaccacgccaacaatcttaatcagctacagcaggtatttattgaacaccattccgatgcaattaaaatattgacatctgtttatattcacaaaaatagtactccctccttcccaaattgatcatcatataacgtaatccaaaatatctcaaattgatcatcatataaccgcatggacacaaatttcatcggaatacaattaatgcagcatgagagaatgtgtgcatgctagggtgtaattggcatggtgttttaatcgatgcatgcattatgggagaatgtgtgcatgatgtcttgattgatgcgatttaaattatctttgatcttggtgcataaatatatatgatgatcattttgggatggagggagtactagtatgctgggcctactaacaattgcaaatattatcaacttgtacatcaagatgtaatgttggaacacatgactaacctatatgtggcattgctgaacataaacatgggagagtcatatagtcaatttgaagaccaatgcataaaacaatttgggaacattatttatgttaaatcagatatttatttgtgctatggagtatatcgttggccataagttgataaacccactcaatgatgattaaaatgtgttgttgtctgtgagtacttttgtagtgttccaccctacctatataaacgtaattccaactttgaatcctagccatttataatataatgtgatggaatgacataatggagtattttgttacagcgtaaaatgaacaagtggaaggagtctgcgtatcagaaatttgaggaactggagaagttggggtgtcttattcctgatcatgtcatgatcaatggccaacctgttcccgtgtctccaaaaaatgatgccagtcattccatacaagccaacccaacatgctttaatcaccagattgcacttgaaggtcttttatatattcattatgatccatacaaaatcctagtcatttcattttactcaagattcaagtcgttgcgtaattaggtcagggacatcgatttcaacagcagaatggattttcagcagtacacgtatttactccatacaatgttgctggaacttccacacaactaaaagagccgttgcaacagtatccttatgaacaaagtatgcatgaaggtcaatactactccctccgtttcatattgtaagactttctagcattgcccacgttcatatagatgttaatggatctagagatatatatgtgtctagattcattaagatctatatgaatgtggacaatgctagaaagtcttacattgtgaaacggatgaagtatatacctgcttaattttcactgaacaccctccaagttactataactgttcatagtttcaacttgcttcagaatctggtcgggagggtccttctatgcagcataatggaacttcttactctctgactgaggaaaacatcttgaacggtctaggctctggcttagtacaatcaactatcctatctcaaaatactgcagtagtaagtaaaaacgaaattgaaatattaggacatgatattttgtcgtgtccatctctttctaaatgaagattgaaattctttagttggtaatttctcgtttatgacttgaaatgtttctgtatataggtcccaggtgcagatccacggcacagtggatatgccagcacctctacagctgacgctgctggtacttcttgtcctgtaacaggtgtgcagctacactgaaactcttatagttcaacagtacatttgcagtgaactcgatcaactcaaaccacttttctacattatgtatttgctgggtgatgaaatgttgatgttggaatttcctcaatggattggtccatgggactatccgattttcagtgatctgtatccaaatgtataagtactttgcgctgaataagttgaacatgctatgggatttacttcaaagcaatgtgctcaatctgaagcaatgttgtcagtggcttgtttggtgttttttcctttgtttgtcatgacatttgtagatgttccaggaaccgtcaggactaatctatgggcatgtggtggaggcagaccaggcctttctcccagatagccacggtatgtgtacccacggagaacatggcagtagagtatgaatactttcgtaacagaagttttggtgctgttgagtttctatttgtatgcttcttttaaactgctttgacatgttattttcaactaaatatagttccaatttcctaaagtgtgcaaaataatgtcttatattcataataaattgggtgaactcaatatgttattaacaataacagaattgcttcgcccccttttgataccagcaacctgaaacagtatattattcgttacgagaaactgctagaacaggttatacatctagatctaggactgggagggaactattactccagttcatggcactctgaatttgacacgctcttttcagcaatactacgagcatctgctttagctttcctcaaaatgaatagaagttgaattgtgcgattaccaaattgctgatgtacttactggctacttaagaattttttgacacaatactagccacttaagattaggattgaatttaatatcaacctttcgtttcgtgccatgacagtgtgtttctcatttcagaactggcaaatgccgacaaccaatttactggaggtaatgatgatagtgctccatttgactgaaatcaccgcaacaagttattgtctactctcaaccatactaaagtgttcagtacttccagtgtgattataagtgtgtagtagttcgtaaatatagtagggacatattatgtcagctattctttaatttgttccgctcacgttaaatttgctgcctgcacatttggcatagtttgtttgtactactgaatactgagatcaaatattgatattgatgcactacgcctaattcaattcaattaatctagtttgtcccggtcagatgagtttctatctactttatgctggagtacatacgattgaaaatctctctgcagctgcagcgacaacagcacgagaattgcacgaaggaattgttctcaagaatcttaagatggtaaatacacacaagagagaggtacggtatacaagacttagtttttcttaagtacaacagatcttccattcctccatgatcctatcagcttctacacccaaaccacacaaatcaccatgcacgagccctcttcctccactgccaaatcaactgcaaaacaaacaagaacacatgccacattactcttccattttcatgagacaaacaaggtcacaagcacatcatccaccatgtgatggtgcatggccatatctcacctcacctggggcttgagtagccaagcatccatgtggtgatcagtagccgatgtcagcgtcgtcgacgacgaggttgccggtgatgagctcacggtaggcggcgacgggccagatgaaccccctcgggaggagcttgacggcgagctcgacgtcgatgatgatctccctcatggccggcttcttctcgccgctgatggcgatgaggtagctcctgccgacccagccgatccagccggcgatgtagaggaagagcaagcccggggtgatgaactcgccccagtgccgctggtcgccgctgacgatgaggtgcgggaggccgtcggcgccgcagagcaggccgaacttgccgtagttctcgaagcggcgcttcgtcttctcgatggtggcgttgatggcgagcgccggcgcggagtccggcgcgtacttcttgagcgacgactggagcttcttgatggactgcttctcccgcttcgcgaacgccttggactccttgcacggcgtcagcccggcgatgtcggcggcggcggggggcggcgacgtcgccgccgaggagagcagcaccgaggacagcgccagcgccgcggagaacgtcttggccgacgccgccagcgactgcgccatctcgccggcgccgccgttgttgcccgacgcggagcacgacacggagaaccgcgcggccggggacgacggcgcgcgcgccaggcgcggcttggcggcgaaggcggtggatgcggcggcgagggcggccattgctgctgctgctgctatcggcgagagagagtatttgcgatcggagtgggtttgcgggtttgtatcgtgtgggggggggggggggggg

SEQ ID NO: 20025 - DNA, 12337 bp, Oryza sativa
aggcggggattggcgcgggggagtccagcgtggacgtgtggggggcgcggccgtgtggagatgcagattttgtgggggctcggtgctttcggccttgtggctgccgcggtttgaagatgattttgtttggctccggctgtgtgcctgtgtgtgctcgccatatgcacgtcgtgcctgccagagtctcgattaggattttgttcacgggggttcccatttcaacgaggggaaataaatggttctggagatgtccatttctactagagttacttcctccgatcataatatctggcgttcatgatagcatttgattatacttatttaaatactaaccgctcctttattataaggtgccaagtgatcagtagtgctagttatctcaattaggattctttatttcccggaaaaaaaaggattctttattaagctgaacaaacatcgaacaattagggcctgtttagttccccaaaattttttcccaaaaacatcacatcgaatctttggacatatgcatgaagcattaaatatagataaaaagaaaaactaattgcacagttatgggggaaatcgcgagacgaatcttttaagcctaattagtccgtgattagccataatgctacagtaacccacatgtgctaatgacggcttaattagtatcaaaagattcgtctcgcggtttccaggcgagttctaaaattagttttttcattcgtgtccgaaaaccccttccaacatctggtcaaacgtccgatatgacacccaaaaatttccttttccccaactaaacacacccttaatccactatttcacacagtagcgtagtaccacacccgttctgcgcctgcacgctacgcgaaacctgaagcccccgcgcgcataccagctgggtcgtgttattcgatctcacaaacgaagaactcaagaagtaccaataacatttcatccatggactgtacggttcgcaaggctgtctcgcgaggtttcgctctagcagcagagcccagctgccgatgggtgggtggcatctgaaatcgatgcacttcagtggcttcaaccgagcgctatctgtggatctctcagctggagtatactggagcccatggacacttgtgcccgctccgcgtatttcctgatgccacccatttctacccgggcacactagctactggaaaatttaaccgccgtgaggcgaaaccagatggccaatataccagaggaagtggcgatgtgtgagaagaaaagaagactcgccatatatatgcaaaatctcgtttaggatttgtttactgtgttctcattccaacaagggaaagagaatagataaagctctagttatatggttgttgccaaaagatatttcgatcattattttaatgccagcctctttcgaagaagagataaagctttacaaaagacggttcaacacttgtccactgtgcaagataaatctgaacaaattttagttgaattcaaacatttagaaaactcaaaatttgctcgaaattgcaaaaacagaaattgccaaaaaaaattaaaaactaaacagattttgctaaacttaaacaaccatttgcaattttttttgatttgtataattggtgacaagttttgaattttgtaaagtatgtttaaattcaacaaatatttgtttccattagagtcttgcacatggtcgcccaagggtaaaattatcctttgcaaaatttccaagatatattaaaatagtggttggaatgtcttttgccaaacaactattcaactcctttaaaaaagagtaacgatggtgtcagcaaatatgccaccccatctattccaatgtagatttggtgctaccccttaaacttcttgatattaaaaataactaaatataaatggatgatcacaaataataatattacatcgaggtgaatttctatgacaaaaagataggtaacacattaatgtattttctcttatccgtatccaagcacgtcattcaactagtaaaactagaacatcagcaaattttacctttctctttcttagtaacatgttaacttagaattcaactgccctggggatgttccctcgtgaaaaactctaaagaaaacaatagagtatagtggcatctattagttcatcaaaaatcaagtttagatttgatctatacattggaaacaaaataagacaaattcgagtgtgaatggtatgttactatatattcatacgctgaattttttttatctcaatgtgtgagaagttgagtttggacaaaactcagaatttttgtacaaactatcaagtaacatgtagccgacacatttcatccatgaaccacacagcatgtactgctcgtccacgcaactcgcccgtctcggttttgctgtatagcagcgccgcaacacagctgctgatggatggacgagctccgaaaccaacgagttctctctatgtcgttagccgagcacttccgtcggttctcatctccactttggtgcttcagccaatggacgtaagcgtatggaaaacggccgccgtacgctcctcgtgcttccggatgccacccatttctaccccgtatggtacgctcgcactgccatacacgcgcatacttctactaatggtttgacacttgagctaattacaactgccgcgaggcaaaaccggatggtcaatatatttgaggatgtggccgtgtgtgggaaataaaagaatgcgctcaattttatttcttttgcaagacagacagttagttattgctgtatacttgtatgtgctgggtaatatatcaaaccggacgaattaacgaatggatcctctcatcctcctcaaaattaaaagaaaacattttttttaggggggggggggtgggggatcatgtgtaggagatgaagtaaaaggctcgcaaaaaaaagtaaaatctgggttgttgatacgaaaactaaaatttggatttatgttagcatggccacgaatccatgatctcatgtgcactatgtagtatcgactcttttttagaaacatgttacaaaagcaaacactcaaaacgcgcacacacttatccataagaacgcacacatgtccaccctatgcctatgaacatttttagaagattaggctagcatatcttgaggttgatgaagtcaccacgagcacctcattgtcgagaggtacgtcgcttaccactgaaaaattaattaaccataaatacgagcaccagtcttaagtataagacttgaaccactagtcaagcccgtagctattttgctactagcactcccaataatctagccactctaaggtctataagatcaagttagctcgtagacaccggcgaatgtacacccttcaccacccagttccatacgccacccatttctaaaccgcgtgaacatgtagttttgtgattttggcccatcgagaaaagatcagttctctagtagtgcatgcttgctcgcttgatgctcgcgcacgttcctgtgcgcaataagctagtgctaatcttaaccccgcagagaggccaaggtggaggtggatggtcaacatatatatccttcggaggaagcgacaatctttttgggtggaaaaactaatgcctcctaacattatattacggagaaactcagttactatgcacttatgctgggcaatcaatgaatgagagggtagttattagttaccagttcaagggtggatcttattgaaaccttaattggcagttctcctgttcggtttagttaaaaaaaaaaagatgaacatataggacaaagggaaaggctagctagccagaatgtaaaattttgatttatctttttaatttgttaggaaaattgaatctggaactttgcatgacagtgaacaagattgtagtacaacagtcttgcagcattgcaccactccactgctactacaatattcaccacagctaatttacaacattcagttgctggcagtggaaagaaccccaatcgcagctaataatttacaacatttgaatactttcactccaaaaaagtatctcgtccatcacttgtcgctacattctcgatccaaccgaccaattgatcagcgctaacggcaggcggttgatgagaatgctcttgtgtaggcagttcgagttcaacccgggaataagccttattagttagcatgcttcccaataccgctcattccaatcggttttcatcatatcgtcgtcgtgcaccggccagccaagagatacacagaagcaataaaatataatgtggagatgtggaacggtgggtgatggcggcagggtgtacagtacaagatatacacacaggggttgggttggtgcctgcatatatatgtgtggcgaatcatcaataatggagagagatgtgcatttacatgcatggtaaacatcgatcaacacacgtgccagaaacttcacatggaaattaattggcgtccaggaaccgattcaaggaacataaataagagatgtgctgatggctagttcgtcagaatataaaaacttgtactgaaattgagcattcgcagcagtgtgtatatttttcactaactgattccgagaaaattttatagtatttgagaaaatacctcgaggtatctaaatttttacactatctcttagtacctttattatggatggtaaaattatccgtctgttcctactcttagataacaaacagtctcatcgtttcagtatcagcttgtagtacaagacatatagttgagttaattatttgagctttcagtttaaccagatatataataagaggccaacatttagcacttatactgaatttagttgagagactaagcttgaattaagcaagtcgattcttcattctcttcatagacgattctgcattcacctcatagactaagcactggtgctccgtgtgccgatcacgagatcgagacgacatggaactaaactaaacacaattccattcttccatttccatgggaagtcataaaaatcgtggccattctacttcgatagcattcgccgcagcatttcgaggaagtgatgtacagtatattgctgccaccttcatggaatccttcccggtgccgctcattccgatagagagcaactgatgaacatgttcgatgtatcatccaatttttttgctaggcctttttaagcgcttatatattatcctacaatgcaccactaccatcgatctgctggactgtgcttgtgcttggtctcaaggaaaaggacaagtgagagagtacttagtatgatatggagaaaaaaaaagaaggggagatatgtcatggaagaagagaagagattatgagaaatatacatatactgaagagcaaaaggtggatatatatgtacatgtggcatgctaacaagttaatatgcaaaaactagctaggatgacttgacatggatcatacggcatggggaaggttttttttttctctcaggggatgtttttacatgtcacctagaaagctataatcttttcttataaatcacaaatatgactcaaaacagtacacactattaatagtcatattaatagaggtgagtgcacgtgctcataaaaataaggtgtgcctttgtgtattcatagagatgagtgtgtgcgcctatgttcctactgtgtttctcaaagaaaaaaaataatagtatatttgttattttattaaacttgtatacgttaaatttggacttgcatgtacagtgatatctcatattgacctatactgtcaaagaaaaaatatggctttttaattacatgacataggtaaaacgagtggatattcctcgagagagacaagggccacttccttcctgcatgcatgtgaattaaactcgtaaatgcctcaacaagcaatctttgaaggccgttttttttctctttttttagggaaaagagagctttattgatctcgtaatagaattacaatcttgctacagtatgagcttaacacaggatggggcatgatcactctaggccagttatgtatgtcaaagatgcaaagatcttgcaattaaaatggaagagataatatcgatctaacagtgctttaatcttagatgaaaacatttggccatcatgattttgtgttacatacatttttcttaaggaaggtggccgagtaaaacaatcaacacattttaaatctttattaaatccttgaaagaaaattgtgtcatctgtaatatttttggcccatcatcgatcccccacctctaaacttatgctacaacataaattgggcttgaaaatgtcttgggtgcgcgacttgtgacagtcctatgatcagtggacagtggattggatattgttagaaatgttttctcaatgccgctcattcccattgaatccgcactagaaatctacagttcggatagagaagaaataaattgatcagtttgggctagagatctgcacaattgaaaattgttaaagaagtcagctcacggtggattccttatattatgagtacaatgagtagtcgagatgtaatgggttggtaggtggtgacgtgtaatgttgcggtgttcatgctcagaaatgtaacgcttccgtgttctaattggaacacagtgctctaaattttgttaattttccaatctgagaattatatggaaaatcataaaattaaaataaatacatagccttggaaaaaaaattctaacacgcagaggagtcctgattcatgttggtaattaatagtaattttccagattggaaaattaactttctaaaagaaacattcaggttactaccatgggcaaaccgatctctagtccacactccacggccgttttgtttcgttatagcagcacagtcgatggacgggtgaggcctcaaatcgatgaagaaatccgacagccgttagcacaccccttgtggagtctccgtggtcatcaggaatacttgagctcatggacaatggcagatggacgatggccaccgcctgctccgcgtgcgcatgccgcccatttctacctcgactccccacactcgacgcacgcattgcattgtttaaccgccgtggaggcaaagctggatggttaatatatatactccctccgtttcataatacaatagattttggtttgatgtgacacatcctaaagtgtatgcccagattcactatactataatatgttacatccacctaaaatcccttacattataggacagagggagtagatcgaaggaagcggcaaacgagaggatgcatgcatctcaattaattactacctcaatcccaaaataagtgcagccatgggtatatatccgtgtctaatatttaaccgtccatcttatttgtaaaatttatgaaaaaaactaaaaaaatagccacacataagttacttttcatgttttatcatctaataataataaaaatactgatcatacaaaattttcaactaaggcgaacggttaaacgttagacatgaacaatgaaaaactacacttattttaggacggatgaaatacttcatatggtttggagtgcactaaagttattaattactaattaatttgtagtcctctccatccagatgtaatttgttcttttgctctgtcgtaaacctcttttgaatatgttattatggaattgtatcgtgaatttgtgaattgaaaactataaatggacctgattggtgtttttttttcatttttttttgccaaaaaaatcttttcacatgcggtcccataaaagagactatcctataaaaatcgagaatttccaacaaacctgcaaaacttgaggttttccacatgcctctaagttagagacggttcatccatccgcatgtgaaaatacaatataattatctgtaaaaatgttttttttaaaatagtcataaactcctaatgtcatggcagcgacaacagctgccatatgcagcacacaaaatgtccatgaccgtcagaacaggattgccgatagggtgtgaagatatgtttctactccctccattttataatgtaagtcatttcagtatttctcatatttatattgatgttaatgaatctaaatagatatggatataagaaatgctagaataatttacatgatgaaacggatgaagtagcagggttgccatggaattgtgcttccatccatacgagacaaaacgtgcaaaatccattaggttttattatctgataaaagcaaccgcaagagctagtttacaatgtatacgccgttgatcatggtattaatgttggaaatttggtcataattcggcatattttaatccaaaataacaagataataatcatgatatttacaataggatttgatccagtgatagtggtgaatgtaatcaacatgagcatgcttaacgttgaataagcatcaacaatcacataatgacacaatgttgacattgcgatgaacattaacagtaaaacttctaattgaaataatgtaataaggttataccccaagaatggtcctccgctggagtttgaggcagtattgcctccgttggtgttgacgggagtctccttctccttgtctccagtgttcgacatgttggtgaagatgaagtagatgttgacgaacagtgagtagtcgcgccttgcgctccccaaaaacctgatcgctcgcccgtctgtgcaaacgtcgcagcaacgcgtggtttcggaggcctattctcccaacgcgtgtgcacacattcgttgggatgggattaccgtagcagcaacagcttttgaaaatggataaaagtgtgtcttcttcttctcgcgggagatcaaatccattcccattttataagaggaatggaagatgaagagtaagagtcatggaataggaagaggaatggagcaactaattgtcatcaactagccatgaaccatcctccactacacaaccatcaaccaacaatcaattaagagtaattgatgtaagttaccaatggaataggaagaggaatagagcaactaattgtcatcaactagccatgaaccatcctccactacacaaccatcaaccatccatcaattaggactaattgatataagttaccaattccttaatcaaatggattaattctcaaaactcttcatcccattgatatcccatagaagaatgaattcacatgaattcctagcataatgagccttggaatttatttgatttaattgatttaaatggattaattacccaattaaatctaacaatccccaccaaatttcaaggctcatgagaatgctctctattccatagcagcttttatataccagtgtttcggtgaagactgttaagttgaactttcacctagaaaaggagctacacctgaccacaactgaacaatggactatgccttgaattgtcagtcttgtgcagttaggtttcactcaattccataactgatactaggcaaccattagtattccctcgggttggagcttataagtcatactccaggcctttcatgagtatctagagatcacccaaatctcatagactgtgactagcagtcgaactcatataggtgtgttccttctaagatgttctgcaggtcaacatctctgcttggaaaagccactcggatcacattaagacataagccatcctaccatgcaggaaagaagagaaacacatcatgaaaatgagcccttttcaagggtctcttcagtcacacaatagtttgtttcaccatccaaattcacgggatctccgatcataatggacaggtttccactattatgcaaccttaggtgggtatcaagcccatttccctcgatgcactgtctatcacattacgtggtagccccttggtaaactgatctgccagatttctagccgtttggacatagtccaatgctatcactccggagtttttctgctttctgacagatttcagtcttctcttgatgtgtctagatgacttcatgttgtcctttgaactgttcactttaataatcactgtttgattatcgcagttcattaggatagctggcactggtttttcaaccaccggcaaatccatcaggagttcacgaagccactcggcctcaactatcgcagtatctagtgctgtaagttctgcttccattgttgacctcgttaagatggtctgcttgcaagacttccaggaaacagcgccacctccaagtgtgaacacatatccacttgtggcttttatctcatcagcatcagatatccagtttgagtcactatacccttctagtacttttggatacccggtatagtgaattccatagctcatagtaccctttagatagcgcattactctttccagagcctgccaatgatcatctcccggatttgagacaaaccggctcagcttgcttacagcaaatgagatgtcaggcctcgttgcgctagccaagtacatcaatgaaccaatgatttgagagtatctcagctgatcccttgctattcttcggtttttccttaatagcacgctgggatcataaggagtaggagctggcttgcagtcactatatccaaagcgactcaaaaccttgtccacatagtgggattgcacaagtgtaatcccaccctcatctcctctttgtagtttgatgttaagaataacatcagcctctcccaaatccttcatttcaaaactcttggacagatagtctttgacctcctcaatcacattaaggcttggtcccaaagatcagtatgtcatcgacatataagcacaagatcaccccttctcccccaccatagcgatagtatacacatttgtcagcttcgttcacaacaaagcctgcagatgtaagcgtggtgtcaaacttctcatgccattgcttaggtgcttgcttgaggccatataaggatttcaatagtttacacaccattccctcctgaccttctagtacatacccgtctggttgatccatatagatctcctcctccagctctccgtttaggaaagctgtcttaacgtccatctgatggacgagaagaccatgagaggctgccagagcaagtagtactcgaatcgtggtcaagcgagcaactggtgagtatgtgtcgaagaagtcctcgccttccttttgggtataacccttggccacaagccttgccttgtacttttcgattgtaccatcaggcctaagctttttcttgaaaacccatttgcatcctacgggcttgcacccatatggacgctcaacgatttcccaagtaccattagacataatcgagtccatttcactgcgtactgcttccttccagtagtcagcgtcaggagatgaatatgcctcttctatggttcttggggtgtcatccacgaggtatacaatgtagtcatctccaaaggattttacaaccctttgtctcttactcttgcgagtatctacaatgttgtcctcctcaggattttcctcaggcgtttgatcattatgttctatcggtgtaaagtgctcatggggcatgacagtttctttactagaagtgctaggtgtatatttcataggaaattcattctcaaagaatgtagcatctctggactcaagaattgtaccaacatgcatgtcgggtactccagagtttactattaagaatctataacccacactgtggatagcataaccaagaaacacacaatcaacagtttttggtccaagtttccgctttttggctataggtacatttaccttggccaaacagccccatgttcgtaggtatgagagatttaatttcttcctttcccattcctcgaatggtgttacttccttatgcttcattggaattttattcaggacatgacacgcagtcaaaactgtctcaccccaccattccttggaaagccccgcagtgtctaacatggcattcaccatctcagttagagtacggttctttctttcggccaccccatttgattggggtgaatagggaggcgtcatctcatgaataattccaaactcttcgcaaaaggatgcaaactcattggaaaaatactccccacctctatcagacctcaaccgtttgattttcctttcaagttggttttctacctcagctttatagattttaaagaaatgcaatgcctcatcctttgttttcaatagatacacatagcaaaatctagtgcaatcatctatcagcgtcatgaaatatttctttccccctttagtcaacacgccgttcatttcgcacaaatcggaatgaacaagttctagaggtgccaaattcctcgcctcagatgccttgtgaggcttgcgaggttgtttcgattgaacacaagtatggcacttggaaccttttaccaaagtgaattttggaattaaactcatgttagctaagcgcgtcatacaaccgaaattcacatgacagagtcgcgaatgccacacattagactcatcattctcgctaatatggttcacaacattat

SEQ ID NO: 20026 - DNA, 1189 bp, Oryza sativa
aacatacatgaatattagcaccagtgtccacccaccaatcaggtgaatgaaaaacagagagaactctaggtaatattttaccgtaccccgatgttcctccgccctcgctaatgatcatgttggcagacttcctgtctttgcgctcaggacagtccttggcccaatgcccagacttgccacacacaaagcagtctccctttgcctttcccttgcttttcttcttaaaattggttgcagccttgggtttgacatcaggcttgactttcttgttgttgtgggatgcatgagggttcttcttctgtaccatattggcactagaacctccctcaacctttttgccccggacgtcctttgccctcgccttctcctcaacacccaaagagccaatgagatcaggaacactgaactcttgtctcttgtgctttagagaagtggcaaagtccgaccaagaaggtggtagtttggcaataatgtcacctgccacaaacttgtccggcaactcacagttgttgttctcaagttccttagccagcatctgaatctcatgagcttgttcaactacagaacggtcatcgaccatcttgtaatcatagaactgctccataacatacagctcactgccggcgtcagaaattccgaacttggcctcaagtgcatcccacatgtccttcccagaaggcatgtgcatgtacacgtccactatgttgtcagcgagtacactgatcaatgctccacgaaacaggcaatccgaagcctcgaacttagcctcttcctcaggagaaagaggtggttcacttcgtttgccccgtgaaacatagaagcactgcatcgctgtcaaccacaatagtgcacgtgctttccatctcttatagtttgaaccatcaaaagcatgtggtttcagtgcagcagcaaagccaactaccgaaaatgacctataaggtttttggaatgttggaaatttggtcataattcggcatattttaatccaaaataacaagataataatcatgatatttacaataggatttgatccagtgatagtggtgaatgtaatcaacatgagcatgcttaatgttgaataagcatcaacaatcacataatgacacaatgttgacattgcgatgaacattaacagtaaaacttctaattgaaataatgtaataagcgtataccccaagaatggtcctcc

SEQ ID NO: 20027 - DNA, 2376 bp, Oryza sativa
agcacatatcaggatcgttgtgtatgcaggtgcctccttggtagctgagcatttggcagtagcccatgcacatttctgtgttgcatccttggtagcggcttacacgccattttctcttcgcctacattgcctaaacaaaaaattgcaatgtgcagctagtagttaggccatgaatatgtttgattcgtgcataaatatcaatagtaattaaaaagatatactcgcagaacatataattaatgagcaattttaccattcaacatttgatacctcaaggtaccacataatggtatctcgaggtactaatttttatattagaaagtatcttgagataataaaaatttgtgatatctcgagatatcaaatggtggatggtaaaattgctcataattaatagtactcggtgattgcagaacaaatagtaaaccgtaagaatatataattcatgatcaaaataaattaaagcatagtagaccaaaaacgaattatatgctcatcgcagacaaataaattcatgatcaaaatcatttatttaaatcatttatttgttgtctgcgagtaaatcatttatagttaatttgttgattgcagaacgaaaattgtattatcgttaccttgtccttgggcagcatgagaggatgaaaaagcagtagccatgaccactagagctgccaagaacacggcagccttgcaactagtcttgccaagaagagccatattcagatttagagggaattagctttctaatgagtggtggtagctagcctatccttagttccctatgtttggtgatcctctcctaggtgtttatatagagaaattggatgatccattcctaatatcatttagaatgcatttaactgttatatatcctagtatatctctccacgacattaatattgtcctttttttctctcaacgtctcaaattggtagcatgcatatcctatattatcttttgggttaatttggtagcatttgatccactcttaatctcttttgttaccattaactttattatattctacaaatgtcctcctcttatggcatcctaagcttgggctgcgatgagcaggtccggtatgaccggtccatatcggaacatgtcaccaagatgaaagatgtacggtcatattcgttttggatgaatttcaaacgatttgggttcctaagaattaatttctataaaagccattcaattcatttaatgtagatacagaaaaataaaacaaattccttttttacaatgtgtagagagaaaacataggaaattttccattcactcaaacctcttgaaatatgcatacattcatattctttcaccatttctattcgtaatttctgtgttaaaatttcttcaaaacgaataggccctacatgatttatgagaggaggaagctgaattccaaaccttagagattagagaacgtagtagaggaggaggaggaggaggagaagaagaagttgcaccggaaacagttgttggaattttcttttctttcttttttttatgtttttgagaaggcagttattggaatgctgggtttgagtgccggggtcgacggggtttgggccgcgatggacgtcaatacacggcctgccaaatggggggggggggggggcgctaatgggcgcgtacgcgtcagcaatttagctggcgcgcgtcagctcggccgcctcccgtgcctttttttttttattttcctattcgcactttttccgatcgcctctgagcatgttttttttcctgtttctttccgatttttttcaatctttcgcacacctctttacgaatgtagaattgaaagtttttatttttgaattaaaagttattaaatctttacttgaaagttttctaattttatgttgaaagttttctaatttgagttgaaagtttttaaatttaatttgaaagttttcaaatctgggttaaaagtttttcaaatttgagatgaaagttgaaagttttcaaaatttgacttcaaaaaaaattcaaatttcgagttgaaagttttaaaaattgagttaaaatttttcaaaatctgacttgaatgttttcaaattgaattaaaaatttaaatttgtagttgaaagtttttaaaattcaagttgataggttttgaatctttaagtaaaaaaggaaaataatgttgtgtgaaaaaaagaaatatatcttgattgaccgtgattattagatctaatcacgtaaagcgcagctaatcactgttttttctcatgattcctgtgcacatgcagcgtcttcgcgaccaaaaaaagaagaggaacgacggttgccacgcgcgacgaagattaatgggctgcgcatgaaggcgtgggccgcatgcagagttatgggccaaaaatgcgcgcgagttaa

SEQ ID NO: 20028 - DNA, 7719 bp, Oryza sativa
atcacctgatccacgtccaatcggcgcagtcagccagggcacgggttctatcgagtgccgacgagacaaaccaaaaccctcctcgttgatacgcaatgccacctagggcgtcgtctatgctggcgcggctcgtacgcgacgcggcggccgcgcgcgacgcccccgcgtagccgcggccgccgtatctcgtgccgcgcgctcctaggcggccgccccgtctcgtcgtcgtcgtcccgcacgcctggcagccgccgcgctcgcgtctcgccgcgccgcggcgtctcgcgccgcccgcgtagcctcatgcgtcccatattacctcgtcgacgacgatgatgacgacgaccatgctacccgcccattgccatcatgtaaaccaatcccctcactcagtctctcttttctggtagtgcttgaatctctttttttttttctttttttttttgaaaaaaaggcaaaagctttacctcgcatatattaatagggtagaagaaaacaaccataacaaaggtctatttataaggctatgtcaatagaaacgggagcccgaacaaagaaattacggggactcttccaaaagagttaactcagcaaactttgaggctcccgccttggcctaggtcatggtctctttcttgatttttgcgacgatggtggctggagtggcggcgatacggcgaaaaatcctagcatttctctcacaccaaagttctcaggctattaggattattagggattttagagatcttatggggttacgcggcgtgtgtagcatccaaggtctatgctatcccaatgttgcactgctgcccatacccttctggagagtttgcaattcgcaaggagtacttgaagtcttgaatcttggttcaatagtgattaaaaataatttgtaggtaaaacttttatatgtgtattacgaaaagtaaattaagaagaaaaacttcaaaattcacgtgtccaattgtgtttataagccgaaggctaaacagtagatctgaatttttcgtttctttgtgctcgcaaccaaccaaattgcaacttacaagcctccaatttcgctgttgtttgactgtatcaatgttgttgtattttgtgatatagatgatcctgagccaggtaaggatatctcgggaaaagacttagagtcggacgaagccatatgggccttgtacgagcgctggtgcgaggcttacgagaaagagcgtgaccatgctgagatgactcgctggttcgagatgttcaagaacaatgcagagtatatttatagtctcaacagtgagattacttcggaagcagagcaactaattttgggtccgtactgcgatgggttcaacgagaaagacaaggctgaatttctgaatgattttggccattttaacggggttcacgaatttgtagagtagcggatgatcgactcccccatgaatcgcctttgatcccccatgaactgcaaaggattgaaccacgactgtttactcgggctggcgtcaactatacattgtgattcagcattttgtataaaaaaataaactataatatactcccttcgtcccaaaaaaaaaaaactctgagtttccgtgttcaattttgattgtccgtcttatatgaaatttttttataatttgtattttcattgttgttagatgataaaacatgattaatattttatgcgtcacttgtctttttaatttttttcataattttttcaaataagacggacggtcaaacgttagacacggaaaccagagtttgtttttttaggacggagggagtacatgttggttcatcgactcttcagagtaatcaaagttcctgcagtgaaagtgacaaaactttaagcacagataccagtttacagctcaaactgtaagaagacgcatatgcataggccttcgcaggcttaggtatgtaacatgactgttgatcattagaaaccttgtgctggataacatgttcaggttctcaacaaaatttatgttcagacagtccagatccttagccccagtcacaggttcctcaaactggcgcggccgtcggcttcggatcggcgttggcggcgcgctcgtcggctccggggaggccgatcggatcagagatgcagacctctagttcaacatactttctcgacacctctcattccgagaccatcacttgatgtatgtactacctttcttagtatcgaactaatcttcctcatcgttcaagcatggctggtctgagcccgtaattgtaactatcagtttgggcaagagatctgcactactgaaatttgttagagagaagttagctcacggtggattctttatatataagtataataagtagacgagatataatgggttctaggtgatatgtaatgtcgctttattatggcccaactttttgacataaattaacttttaagccaaatttcttatttttgtacgatttataaattggtggcttttaagcctccctatgggtgaagttctagctgcaacccacctaaaaagattactcaaagtttggcttaataatacatgaatatttatagattttaagaggcttttaaaaaaaacggtttgcttgtttggttctcctcgtatattccatttttttttctaaattcaatgcaaatggtttgttaacaacgctaaaacattaataactgtaattcaatgcaaatggatttcaagtttttttattctctaagctagttgaggtacatttctattgataattgaagtgccacttttacctcaaaaaattaaagtgccacttatgctttcgcctcacggtcctgtgcttgcaggctaagcgaaatctgaagaattgcatcgatctctatccaaaaactgtaacgccagttggaacacaatggtccaagcatgccatctttggggacggggggttccagttgtgagttgactcctaattctctgttaagttgattgtttcccagtctatgataaagaaaatcataaaattaatacacagccttcaaaaaagatctaccacgcacaggcgttcaggttgatggaatttgccaaactttctatgatgaacagctcagaattcccatgtacttcggccgtctctttgcaacacaggaaatacacaataagtggctgccacaattcatccatgggtcatactatacatgcccgttttgttgtaacagcacagttgatggatgggtgaggtcaaaaatctaccaggatcctccgacgttagcactccctttctggcgtctctgccagcttggggaacacttgagctcatggaccatggcagatggacgatggccaccgcctgctccgtgtgcttccggatgccacccatttctagctaggcacccactacattaatgtgaaacatgcatgcattgtttaaccgccaaaagatcaaaactggatgcctggatgaatggatggtcagttaaatactccctccgtttcacaatgtaagtcattctatcatttctcatattcatattaatattagtgaatctagacatatatatctatctagattcattaacatcattataaatgtgaaaaatactaaaatgatttacattgtaaaacggaggaagtagaaggaaccgaggaagggtacaatagttaacttccagtcctcttgatttgtatgtaggccctatttagtttccaaaacaaaaaattttcacccatcacatcaaatgtttaaacacatacatagagtattaaatgtggaaaaaaaaccaattacacagtttgcgtgtgaattgcgagacgaatattttaagcctaattgcgccatgatttgacaatgtggtgctacagtaaacatttgctaatgacggattaattaggcttaataaatttgtctcgcagttttctggcggaatctgtaatttgttttgttattagacaacatttaatactttaaatgtgtgcccgtatatcctatgtgatttttttagataatggaatagagcattccggcctttgctcaaagagttacagccaattattacaatctcacactcaaaatgagtgaagttcaaagaaacttaaaagatgaaaccaaccatcaagaagaaacaacttaaagactgccaacccaagataaagagtacacaattattgaatttgaacctccatccaaaattgacaaaaagttgcataaccgttgtttcaagaatacggcatgcagcctttaaaagctcactatcttcctcacacttttggggtatatcctatgtgataccctaaaacaaaaaatttttgccatctaaactgggccgtagtacatgtctcacggtccttgtgcccctcattctgatagagcaactatgggcatcgggaatttctatctaaatatatgtatctctacttttgttggtagggggttttattggtagtagggtgttttttatgtcttcattctatctataagctaacaaattttataataaatggccgtaccttctttaaagcaaaagccagattttatccattaaaaaaataggcatcgggatggtatgtgctctagtctaccagaaaaccaggtgaaacatgagatagtgtgacaatggaagaaattaaggagatgataagatgattagatacatacacaaaccaacacctcgcacaatataccgtcatgcttgtatacttgttgtatttccctgttatccaaaatactcgtcccagacactgtgttactgggagtatataaacttaaagacgcattatcaagtagatcacggatggaagaagattaaacgcacaaactatcagaacaaacatacagcctaaggccaaagaggatcgaggcggtaagatgacaccgtggccgatcaagctgagccactgtgcttgtacccactcaagagctctgactattctcgtcgagaattccacacggaactttagggttgaaaccacacgcttcttaccgttttatcaccaaaagcatctcctatccctgttagtcgaaagagtatccaactgcttagtcaaatgtattctcctggcgcctcccatttcaatgcccaaactatctttatctggggaaaccaaggcccccggccgcacccttgcatcattgtcatcgaattgtaatgttcttttctgtagtggccagctccaaagaggagtagcgtgagtggactccaaggaagtgagtagcggaaatatatttgtacgctggtttgtaaacagatgggcaatgtaatgtggttgtgagctggtggtgattgacaaaatccaaaagcacatcatcagtatcgtgaaacaaatctctagcaaataaatttcttgtgagtcaatccgaaccggagtaaagataagatttatcttcttctaagatccctatatatacatgattagactgagacatttgaggttagcttgtactcgagattaaatctataacagagagagtttcaccctggtccctacacctatgcctattgtctacttttataatgttctttctctaccgctgtgggtgggaagaaaacggtgagtttctccgtgctaaagatcggagcctccgactgacagtcagaacgatacccgcatgtgggccggtgacttcttcagtttcacgggccacgcacgataactaggcgcggcccgggcaatggtagcccatttagctggggcgtgtagcaccgacgaacagcgtgggattggaagttcatccggcaatgtgagccggtgtggctttggttgacattctgttaatgaatatttcaaagctaattaacactcactggacgagtggataacgttgctagcaacgttctaaaaattatttataatttgttaggtgaaaaacaagacggatggaacaaattaatgagagctggacaaaactagaagccgtattttgacgggatcgtccaccaggcaccagtcacatgaaaaatcgttgcatatgggcgaagactcccatcaaagtgaaacagtgagctttcaatccaggtagcagacacgaatttactatgacggcaagaactgaaacttcctacctcgtcacccccgagaaccgtgactacaaccatataaacctttgaatcacatcgaggttggaatatacccacaagcacggtaaccaccatatgtagcagatgatcttgtcgatctagatgttttctcgacatctctcattccgaggctatcacttgatcgatatatgtaccagtttacttggtatcgaactaatcttcctcatcgttcatgcatggctgacctgagcccccatatataaggggaaatattacgtgaaaacgagtaagtgttaaaaactcgtggaaatgatcatatctagaaattttatgaatttataaaaaagcctactaaaaataggtctagatatgaaatacattctcaccaaatcttaagtacaaacttaatttcatttgagagaaacaaaaatgacaaatctcaggtgaatagtgtcatattaattgttattattcacccaaaattagttttatatttttagtcccaaatgaagttaagtttgtacatgagatttggtaagaatttattttatatctacacttatctttagtaattttttatgatttacaaaatatttagatatgattttcatgagtttctatcactttacctgttttcaccggatatgctataatggctatatcaagactcgagagtgagcacagaaacgtgggtatcagggtacatatatcaacacggacagtgtgctctcatcaatagatgtgatcatgagatggtggatgggactcatagattagcttttagcctgcttagttaaaagtaagaaataaatagaatttcactttcgcttcattgtgtgcttggatggaggctagcccactagagacaattaataatgtgaaaagttaatacatttcattagtttttcgatgtgggattatccgcttatcccctcaaccttttccagcatgtctgactactagtcctatgactagaatagctcaaatgattgacaacaaaacgtatactgaagttttcgcgcaacatgagaaaatttagcccgtgtacccggtacttctccattccaacacggttgtatcagatgctaccacaccgcgacgatgcattgcacctctacgagggatcaggatgttgagttgcctcacgggcacacccacttccgaagaaatcacacttacactgggctttcacgaactggtgctaacggtgagcaaacctgaactacaaccatgccaaatcgacaaaaatactttcctggtgtcgctcattcccaaactatggatgctctcattgtagaagaagaacatagactcttactctcttagcatatattgtgatgcatatcagaaataagcagtgaatgttgtgtgctgcacagcgaagttaattatgcttcatgtggccatgcatgtgcgcgcagctatatatgcgtgcactgtcacctgttttgttctacaaaatagttccaccattcaagtttaatcgtcatatataaaaattgaatcttttgcattctttcccccccccccccccctaaatcagttaatcctatcattgctccacatttcattcacactcaaaacaccctaaatcccaaaactacatgctccacaccgccccctaaatttactgtcacaaacaaacacctagctagtactcgcaagcatgataccactattctttgtatacttgcttacattgctctgtaatccgaagtgcttgtcgtgtcctagactgt

SEQ ID NO: 20029 - DNA, 776 bp, Oryza sativa
cagtagttcatcagaaggagggagtactatttttgtgaatataaacagatgtcaatattttaattgcatcggaatggtgttcaataaatacctgctgtagctgattaagattgttggcgtggtaaggagcataggagccatcaaccgacataccgactagagcaaagaaatcattgaagaagattatagtattttctcaactctgtaagaatggatctcatccccaggatcagacgtggttgcatgactaatcatggtattccaatcttcattcttcatgccagtaagctggttgcaagaagatgtgagtttcttagcacgtgaatatatatagcattactagcaattttcctttcaggagcaaacatggtattacaaggtaaagtaagcaattaacttggtaaataaacaaaactgatgttcactgaacattttattccaattagtatacctgaatgatgaaatgtaaaatagatcaacttggtttaatctttaataaattggattattataataattctgatgtgtactgcacctacaagaatgtctgggttaacgttagtgcaagcggcaagtaccgccacgttttaacccttcagcatgtgaaaggtaagtagttgtgttccacacgtatgcgagtttttcttaaagagatttcttatagattccttctatatttccaaaaaagaataaacttagaaatcgacacaaatacggatttgtattttcaaaagcgaacgaaccttaaaaaccgattcatacacgaatgatgtacc

SEQ ID NO: 20030 - DNA, 365 bp, Oryza sativa
ggaaatggaaggtcttagttcggaggtggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgccca

SEQ ID NO: 20031 - DNA, 630 bp, Oryza sativa
ttctctccccgaacccctcgaagaagacggtctggtcaatctccggcttccacactccgatcaatcgccaccctcgcgatcaccacctgccggctccacctctccaccgccgctgcctcctcctccaacgtccacaccgagatcacctcgcgctccgccatgacaaggctcaacaccgccccgccccgcgacatgaccagcatgagctcgctcatgctcttggcgttgctgcagcccagcatcctgtcgacgcaccccggtggcagatcgatcgtcctggccgccgccgtgtcggcgtgcagggcgacgacgcgcacgccgtaggtgttagtgctagaccctcgatcgaacaccttgcgtgcgtactgcagcaatccggcacggcaacgaacgagattcagaggaatacagagcagaacaagaacacaggaaattgagaagtttcagaaaacaatagcagataggaaatttgtggggctaattttctgtggttttcattcactgaacagagtaacatgcaactagaataacagtacaaaaactcctacttaaattccacacaaaagaaagaatccccggctcaaatcgtgccatcccagatccggtttcctctgatccgacgactcacgc

SEQ ID NO: 20032 - DNA, 728 bp, Oryza sativa
ttcagaaccccatagtccgcacatcctcaaatacaaagcacttccctagttagatgtaggttagacttgccgttccaaaaactctaccttctacctgccctcaatttatgcacgattaatgaatgccacctgggtggaagcgagaggtggaaatggaaggtcttagttcgaaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacg

SEQ ID NO: 20033 - DNA, 1152 bp, Oryza sativa
aaatgtaactgacgcgtgggcccaatattttatttttattgttttactcactaacatgtgggtcccatttacatttatttttattttagtgccacgtaagcgccacgtcgatgccttatggaagtcaacccgccatgtaagtgccacgtaggacaaaaccgcctccgaaaccgccgaaggagttgatttgctctggttttcagagaaaaaggaggcgttatacccggttttctggttgagggatgttattcacgcaagcgcaagagatgaggaaggcaaaatggacttattccaaattgaattgttcttttgggctgagagtggcccgaggggaatgtatgcactgcacatatcatacacgataactaacaaatgtcaccaaaaattctgaaaaaaaaagtgtacataaattttcaataatagtcttgtcttcgttcttttaactcttgtcgaacttgccggattatcctctgtacgataaggatagcttgatagctatagaggatccatgtcagcacagttcccacacagagagtgtgagaaaggaagagagtgtaattagtcgtagatttataatcagctatagcacatgaaagaagtgactagcctaagagaattataacatacagttatatatcgtgtataagttcaattatgctcttaattacgtagaggttttcaaacaaatcaatggcatgtttggagagattaagattttaataagcagctagtgagaagctaactgataataacatacagaagctatgaaaaccagcttttggcttctaatctgttttctatattctataactacatattctaaaaatctaggtaaaaaatctagattgtttgaaaagcttctagtagaaaaaaaaaaggtgcagctgacaaaaactcgccaaaaagaccccaagtggcaacacgcaaaacctgggcttccttcacagggccggcccttgcgcgggggggggggggggagcggtgccactgccaccgatctgggcccccagatcgcaggggcccccacacacctccctcccgcgtccctggcccgcagatcgagcgcatgcatgtgcggaagccggaaaccgaagcgccccgcggcgaaaagaaaacagaaacgcgcgtgattgccgccgcccacatcccctt

SEQ ID NO: 20034 - DNA, 1409 bp, Oryza sativa
catgtagatctcacacctaggatttaagatctttagctgctttttcacggtgattaatttaattagctagtttttttagataatggaatatatttccagactttattcaacaagctacaaccaattattataccaaatcgcttaaaagcgtaattagctagttttttatagtttagtttttgcaagcatggctgcatacatgcttgcacttcttgcatgaaaaatgtagagaatggtcatacaaatggaagagagattcatctagcaccccttctttgaaattgctagtaaactttcgcaagttttttttctcttttatatcgacttttttataggggcgcgcgaaatcttgagtaacagtatagccgattcgattaagtgtttgggcaagtacaatgaggattaatcaacctactattagcccgtccaggtcatcacaatctgagctggagaaggacagagaaaggaagagagagaagaaagcgggtgcttgtttaatcgacagctcggcatgagcaacaagatggatggagtaggcgtggagcgacgatgcaggagccgatgccgtcgacaaagaacatgctttttggccttttgcatcccatgctccatggctcatcccttctctgtatatttggcggtaaatccccatccgcgggaaaaaaatcgcactttacacgccaaattagttagtcgaagcgtcaaattcctactgaaataccccatccagttagtaatccctcaactcaatctgctgaaacaatgggtcgctcgaaacgagagggtgcgccaccgccgccgccatttccgtcgcaagcctcgccgggatcctttgcatctggcatgatgttgccgggatccttaggcagtggtgcctggcaaggttcggggccaccgcagccgccgctccctttgctctacgcgtacgacgccgctgcttctgcttttcccatggcccaaatgaagcaaggattggatcatagtgccattgaattgtcagatctgcaagaacggtatgtacttttgatattgaatggttttggattgatgtgctccggaagttccgtgtacctccatgttgattagaaaattaatggtgttgactagctaagtttgattcttgccgtattctagttttccccttacgatctgatctgctgctagcagattagcatatcccctgctaatatgtcaaaagaatcaacgtgtacatctgtttctcatactaaagttaagtcttgctatattcagaaagggaaaaaaattgtggcaagagaataactgatagtaagcaagggctacagatacatatagatttattttatagcaaaaactagtgtacataggtcagtgcatggccaaactttttgtactaatctacacatacactttgaataatcaagaactct

SEQ ID NO: 20035 - DNA, 570 bp, Oryza sativa
caaaaagaccacggcacagatcatccttatttccgccagctggagacctgcgccgggggctggcttggaagtcggaggcgcgcttcgttggcgaggggggtgtagaaccagtcgctcttccagtcgtcccacttcttgcgaagggcgcaggggatgtagcggttcaacaccggcccccgcggctggaagtagcagccgccaaccaccgacggcggtgacaccgactgcacggtgaagaaccaccggaacagctgaaaagaggggcgcaccccgatgaacatctcgcacagatgcgcgaagatggccaatgtcatcaccgcattgggggtgaggtgcgccatctggaggtcatagaactccaggacatccatgaaaaaatgagaaaatggcgggactagcccagccattgcgaaggggaggaagaagatggaccgccccgggtagtctggtgccgggcgcccctcgcccagcatcactatctcccgaccggtggcggactccggcatgaaccggcgcggcagtccggcgtgcctctcattaacgatgcgggaaggcggtagtgcactgccg

SEQ ID NO: 20036 - DNA, 670 bp, Oryza sativa
acgaagaagatagatgctgtgaaacatgacaaatcaagcttacaagttccaaccctgactccatcataagtccatatgacataatataatagaagtggtgcatacattcgacatcaaaactacgagaacttccaggggttctcagggaacagcagttcacttgcaaactcaacatgaatccggttcctttcaaaacattttcagccaaaattaaaatctaaaaaagataaccaccatcctccacacttcaaaagtctgcattggatgagaaactgttattaatttatcaaacaaaagacagcagcaatttggaaattgcacagccatttatgcttcacaatatatgcacaaaaattacaattagagaaacaacaaacagtactagaatgtttcagtaggatgccaaactgatagtttaacaaaaagacactctgttggtaaatcaaatactcggttctttatactaaataggatatgaagacgcgattgcattaagataaatttagcatgcaaccttgtgacaaacatggctgggaaacttttttacattgtaagtaaatgtgataaaaattcctcagatgtcaatcatttgtgtacataacgattacactacaaggacccaatatcatgccaatttagtatctgcagttcaatagccatagcaggttcc

SEQ ID NO: 20037 - DNA, 40442 bp, Oryza sativa
ctgaactatgacggcgtttcttggttttgaatttgtatgttggaagaaaattgatggattctgaggtaccccctcttgtattgtttgtatcttctctaaatcccataacaaatatgatgcagggcaggcagcagcatatcattgcacagaggatgaagggcatggcatacccaatacaactaaaggtaaggaacacaatacataacctggcagggaaaaaagtcagcaacaagatcaagggagcatcttatccacacaaaaaatatttgtatttacctgtacaagtttggagcatcggcgggagaagaacgcccgccaaatatccacacatttcctacgacaaaccacacagcaaagaaacaatccaaggccatcttgaagtggtcaaaaagagcattaatcctgaaaaggcatttgcctttaaatagcaacattgtgaacatgtgtaaataacaatctaaacaatagtgttccttgcaatgctcatacacagatgcttcagacatgcactaaaacatatctagcctagttgatatcttgtaacattttcctaggccaacaacacgactcggaaagcctagccatagaactaaagaggaattccttatatacaggcaagatctcacaatagcaattttaatgcaaaagatgcacaacaaagtaccttggattagcgagcactgcatttcgtgcagcattccttcgacgctctgatgcactagcagaaggctcagttgaattgttctgagaggagccttgaagtgtatgtgctggctcattttcaccattgacaatattgcggtgtatatagcgccaataaagatggggtagtgtagcaaaacaaccaactgtataacctatgacccactcaaataatggagcttgcggatgttcctttcttgaaagagaaagcacaacaatagcagctacaatttggctcacattgacaagaacttctattgaaatccagagtccagaattcaaagggcttctgtgccggcgaacatagttatcacttcttctagcacctgaagtatgtcctgcactaggtgcaccaactgctgatggtgcctgcaaagcaggtactagcgctctggttgcagatctatcaacaggatttggttctccatggttttctctagcaacactatgggaagtcgaagtagatggaccactgtcccttggaatatcaattatgtgctcatggccactaacacctgtagtttgttccatcctcgaagcgtgcatatcggtatgaccttgaatttcaagtaacgttgaaggctgaggtcatcaattcttagatgcaacaaagaaagaagcaagctgctaaatttctgagacctccagttttctcaaaactgagtgcaggaattatctacgattctacgcttcagcagagacttccagcttcaagtgaacatttagatttatatcacaaagagagctattctgcaagagaacacagtaaaaaaaacatcaatttcgcacatagaaggaaaataaattttcaaataaacattaagacgactagaaatgaacatagaaattattgcaaagctgctgaacacggaaatgaagaaagcaggtaatctgtatgttcaacaagttgaaattatgatgcattttaaaggtgatcaaacatcacaaacctgtccccgtttatgtaatcatggggctttggacattgtttttgcccttttcagaatactaacacgcgtaaaagaaacagcagtggatattaaagcatacctacctcctctcaagcataataatatccatacagtacatagatggacaggtcacaacgcatagaagaaaaataataaactttgacagaacatgtatgcgcagtatgcaggtttgcctaatttagtaatatttaagtttgtctaaattataaagtgtagagaccaccatgcaggcaaagctagcagctgtctattcacacatgtttccactttctgggttatacctgattaacagcaaaccacagctgacacacaactttaccaggtgaaagttataccaaagtataaaaaacaggctaggctaaattaggaaccagaacatagagtgtaaaatcaggatgcaaggttcaatacaatacatgtgttgtattgtatcttatcatagcacgtaagaacatatcccacagtttagactctagagatgcaataggtggaatattcaacagatctgaaggcctgatgtcaaaatcaacactacaataaccacagcacggtacatcatatagaaacaatatcattcacctctcataggatccaatgatccataatgaccaaggtcattcatagccaatgtttggaaaaacatgccttaaattaataccaaaggcgtttggcaggcaaagaacaggacatcactcgtagtatggatatgcaaaacaagcatgatagcaccaagggtaagatatatcagtgaagagagaagaagcaccaaagtttgtaaaagtataatagcattcagagaagggagagtaaactaatccaccctactgaaaacacattgcagtatgacacaacctgacctaacacattcagataccaggctgaggtttgcatccagttcctgaaagaccaaaatccaagtcctgatctatttttaccagtactgaaacaaccaaactgggattatatcacaaaacaccactaccaacaaaatttgacaccaagtttaggcaatccatatccgtacacacgcacattatttctctcttttccaaggaattttcagcaattcacattccaaagaacccttactttctcaccgttggtgttgtaatgaaggccaacaatagtcaaaacggacaactcctaattgatgaatgcatagaaaatatatattgattttacagaatagtgtttgtcattaccacttaaaccctgaaaactaagacataacagtatgcataaaaccaaaaaccggatgaagttcccctaacatgaacaaaccacagatcgatcccctaacaagcacagccacaaaaagtcattcccccctactatctaggtcccactttcacatgatattgaggcattgcgcaaaagcacatttgggaatattaccgtaaacgtgagttgtgctacatttaaggtaaaaattcagagcaatcgcagatctggcgaatccaaaccatatataaacacacgaacccactcaggtcagccgatccgcgtaagcaaatatcacagtcgaaaggatttggggcgcagatatttaccacggacttagagcaacaccgtggagggtagatcggtggcccgacagctgagattccccctaggcacgactcccaactccgccggatgggagggtacccgcgcccgtggcagaggacacggcgagcgggaggcagtggcgacgagggagccgcgcgcatgggcggcgcacaaccctaaccttaccgagtcgtcgccagatgcacagagaggagggtagctcgcgctcgcgcgcgcgcgcgaggcgcgacgcgggagcggcgcccgcacggtagacgacggcgcggccgaggcgcgccgagctccgctgcctgcgccgcggcggcgacggcggcggcggcggcaaggtgaggtgggcggaaaagcggaaaggccgagagggagaaaaagggttggggggtggggttggttggtgacgaggtgagcaacgaaggggtcttcaccctctcgcgattggccgattggggatcgcttcgtcctcccgcaaagcagtgggggatatggggagacggaatatgggccgggtcgggccggatccgcgaccgtgactgaaaacgagccccctgaaccacccaccacacgaggttcacccaccaaccaccgtatggtccacattgcctcttcgcaggcccatctttctcctcggcccaaccaattacacggcccatctacacttgcttcacgacgtgttgcacgagttcttccgtaaggaacaagggcctgttcactttgatgccaaaataaatcttaccaaattttggtaaggcatagttgccgaaattttggcaacttgccaaaattttagcaggatttcttatatagttaccaaaatttggcagcaaactaaatatagccacttttttggcaactttaccaaaatttgataaggttgaaaatggcatcaaagtgaacaagccctaagttctcgttttatcgctcaatttgaaattcatccctaaaccacaatactactagatataacttgtctctcagcttaaaaatcgggtcacatttggtcccaatgcaatattcctctcagttttggctgacgtggcagctagtattacgggacgaatttcaaattcagcgacaaattgagggacctaaagtgaacttattcctttcaggaatgctcgtcttgtctatctcctcggcccaacaaattacacggcccatctttatactacacttgcttcacaacgtgttgcacgagctcttcagtaatgctcgtcttggatgtgatcacgaattttaccctgctcgagtgccctgttccattcaatttcggggacagtttggtcacggttttcacgtgctctagattacaggatagtaatacttctccgtaacacttttcgagctggcatgacctgcacttacagcattctgcagaaacaagtggaatacctgttaaattcagtgtatcatctgcaggattgcaggaactcttgtcagctgtagtattacagcatcactgtatcagtgtcgtttggccttgcaggcaacagcagcagagcagaagaagagacctgtcggatgatgcccatagcgaaaaccaccgagcttcctgcggttttcatggctaagctgtttaacttggttcattgaacacctttgtttagcttggcttttgtccattcatttgctgttttcgccaacagcttgtacctaaaaggcaggacaccaacaggttagatgcaggcgacatgtttgagacagatgctgcatcggagacgaagtccggctggatttgttcgctcatgttgggacactaggacatatactctactccacttatgcagacgcaagggccatatgctcaacgaagcttttgacgcgttggcctagtagtagaagagggccccctggcccagcacatagagcctgtcgcatcagccagggctggcatgaaaatggaattaccctgcatctttagcgtcattatctactggagtactatctcccagaccagtagaattcagctcgtgctcattgcgttttttagttcactgaactcgcctgacccgtaaaattccgctcgtgctctttgcgttattggagtttactgaactcgcctgatgacccgtagaattccgctcgtgctcattgcaatttggagttcactggactcccctgatgctactttcctcgtgcctggaattcaatgcattcatcagaatttgttgattccacgatcgagccgtgcagacaagagagcatgcataacgattattcccacgtgatgttgttcggtttactcagctgggagtagtagtaccgtctggtagtgcagctctgattctttttgctttttttttagaaatatattacatacaccataattacaacgtacgcatacccacccatatatcgacgaacaagtcatttatcacttaaaggataactaaacctatgcatacccacccatatatcgacgaacgagtcatttatcacttaaaggataactaaaccaatacgcaaacatccatattaagtttaagacttgaatcgggataaacacgtccatttgaatgaacccaaataattgaaccatgctggagatggattctaatagctcgagtgaatgtccacctgtttattgcatgtcaactagatggttgcaaaaaattttttaaaaaaattgacaagatagatcaatatgtaatatatcactctacaaacatgcaagttaaaattctacttgtacaagtcgtaacaaaaataacaaatttaagtgtaaatatacatatagtaatttgagttttgtttgttattttttgttacaatatgtagaagttgaattttaacttgcatgtttgtggattgatacattacatattgatctatcttattcatattttttcaatttttttcataaccatttagataacatgcaataaatgggtggacatccactcgagctgttaaaacagtttccaaccatgctccctatacgtatacgtatatatcagcatgcagttccattcgctgaaccttgccgacaacgattcctcactatctggcaccccatcctgcccagttccccatcaatccccgtccggcagcaagtgtgacaaggcaacaaaacgagctgccattttccgtacctggatacatacatgcacgctggcgacggacggacggtacgttcggacaggttatcggcacgtcgactgatcccggagaaagacggcgccaaaaggttgcgtactagcgtcaaggagcgttggaaacgtgacagccgaaacagccgtggatcgcaggcaacaaacagtgagtaagccatccatccagccagacgacaccggtgtccgttttattgcgagcattgaatccgaaaaggtgcctgcctcccggccgataaacagatagaagcgcgcgtgtacgtcgtcgtcgctggttccgctatcccgccaccgtgcgctgcgtgacgccgtcgccgtctctcgtgtttcgccacgagcccaacaaaaaaaaaaacaacggtctaatttagttcctaactttttctttaaacttttaatttttttatcacattaaagctttcctacacatcatataaactttaaacttttttattatattatttaaatttcaattaaactttcatttcaattttagagtgaaaacacacccaatattgctagccgcagcgcgcgcgcgtggccacaacccccatccgggcgggaaacgtgcccctgctgacgctgatggggcatcgcggccggtgtctcgcgcgcgggccggcctttcggctttcgctgccgccgcgaaaacgatcgacggccggggcgcacggcgcacgacgacgcgtaggtccgcgcgcgtttccgcagccggttgcaaccctgcagcgtgcagctagccatgcaccgctcgttcgccatgacacggtgtgtgctgtcaagcgtcgcgcgattgcggattcgccgagcggcaaccggtgaccgtgatgcgcacctgccttagctagctagcgttaaatgcttcgagaatctttggccctgagaataaaagctctctaaaaatagttcagcttttgatcaagattctaaaaaattataattataaaaaattataattatagaatctagaaaataaattagaagcaataagttgggaaacccacttttttcagattctcaaaaaccggctttcaaagccagccagccagcttcttcctaaaatcttaagcttcctaaacggctcctttatctgctcctacagcaatgagtgctttactacaggaccattctaaatgtagacctatacagatgcggtgctccttctgccgtgcttcctccgactttcttggagatggaagaaggtgccgtgctgctacacgctggatcgatgtagtacatatacaaaagcaatggataggattgatcaatccgtaactgctcctgtatgtcgagaggaggagaagaagattactgttactgctggtagtgtggtgtagtatgtggtatagatgacgcacccgtgatgacagcctcggggccttcatcactcatccacgtcggcacgaaaaccttttttcgatcccactagctggaattatgaccatgacagttacatctacgttgctttcttgttgttttcttccacaatgtcaaatgtgaagctgcaaagaaaaatggcacgcgctgaggaaaggataaaagaaagcaatgttccctttttccttcagggcagcatggaaagcgagctcttcaatctggagatttttagcgttttttcaactatggtgggtccttcaaaaattgtgaatctaatctcccaaaaaaaacaagtgatgaatcaggtaggggagttcattgacatcgaaagatatgcataatttacatatgccgaaagcgatccatttccctgccactaaccaatagaattgaagatcttatcagctccaaaagcaagtaccagatctttgtttatagcccattttatccattagctcgagtagcaccatgagctaacaacattcttgtatgccagatgaaatgccactcgcacagaagcaccgttggcaattgcaaatcatatttttggctgctctgtggtgtaggtttcatgtgaaaagatgaccatatattgcccagaagtcactggtttggtatttggatttaatttctgccgttggttttgctccaagccggccgcgtgctagtacatactgactgacttccataggagattcccacactgttgtatttttacagaagctgaagctgattcaattgaattaggctgtgttccttccaaagttgaaagtttgggttgaaattggtacgatgtgactgaaaagttgtatgtgtatgacaggttgatgtgataaaaaatttagaagtttggatctaaaaacagccctagtaggtcgatctcatcttcatgacttcatgacatctgcgcccatatgccctttttaactacaattttttttcaactgcatttttgtttttcccagagggtaaatagaacgttttcagggcaataaatcagaagaaacaaaagatgatataaatagctacatatgttcattcccctccaggatccaattctcagtttgcctggcacggattggctgatatgagttgaagttgataagatcgggtcaaaaaaatcccaagcttactaggctaggcacacggatttttatacgtacttgagctaacatcaaaccaagcagtgatggtatggccagattacatcacctcatggccacttgattaggggcaataaccatgaaaacccatatacaagttggaggcaattaattagagaaaagcgagagaatcgctagccctgtttatttttaaagcacctttgccgctgcatctatgcaaatgatctacagaagcatcagtgtgttggccttacataaaaaaaaaatactccatatctttctgaaggaaatatgcaaattctttcttttttggaacaacaaattctccatatcttgtgggacagaccggcgccattgttgatgactccagcagtagtaagtcatgatccatcgctgcatcatttggagcccacatatatactcgggaatcccaatcagtcgtggcctcgagctctctttcggccgtgatcatgaagccggtgatcagttcatgctcatgtccacatctcatctcattccaccaccagccaaaaaagaaatagaaaatctctctatttttggattttgccggtattatactagtactagtcaacgaacttgttgaccacaggatgtgtttcgttttgtggaggagatggttaatggaccatctaatcgatctgaactccagatatgagatcttgtttggttttgattgaatggttggtccatcaacatctcctgctctaaacgtacattggtgtattgttacttatttgttaatggaaaataaacaatgacgccgtgctgccaaaatcaagggatgatctcatctactgatagaccattccacccttacacattgagatgactagtagtgaactagtgataactcaaattaaacacaccataaatatagatatgttcttattaactactccatttgtctcaaaatagatttattttttatccattccacatataccaataaaaaaactagagtacactcactttatcaaatctgaatacaattattacttttttatctactcttggtgctctcatgctttcataaactttgatgtagtgaatactcaaatgtgaacttattttggacaaattaaaggaaccaaaaaataaatttattatgagacgagtgagtactactggacgagactttcagctcattgtttgttgtatgggtgaattttttcagtactttaagcgagctgaaaaaaaaactgtgataaaaactcagaattaaaatttaaatcgcgactgatacaccaaatgcaaaatgttggagctgtattacattaccgagggcctgtttggcatagctccagctccagttccactcctcctggagctggagctcggccaaacagtttcaactccaccaaaactgggagtggagttgggtggaactctatcacaaaatgaactagagttgtggagctgggtttaggcagctccacaactccactccagacctaactcctcgagctaaatttaggagttggagctgtaccaaaccggccctgaatatcaatcggatccaaggatctttggccgtccaatccattgagcgtttcgccccttactcctagtaccataccatgggtgtgtttagttcacgctaaaattagaaatttggttgaaattggaacgatgtgacagaaaagttgaaagtttatgtgtgtaggaaatattagatgtgatagaaaagttgaaagtttgaagaaaaaatttgatactaaggccccctttgaattggagggaaaatggaggaaaaacaaaggaattgaaatcctacactattcatgcctttgattcgtaggaatgagaaaaggaaaaatgtaggaaacttttctattcctacaattctagagcaaaaacgtaggaaatttaacatccactctaacctcttggaaaactttcccagagtctatctctctcatttaattcctgcatttttcctgtggtctaatcaaacggtcattcctatatttttcctgtgttttgcaatcctctgtttttacacttgcattcctaccaaaatcctgtgtttttcctattcctccgttttttcaatcctacgattcaaaggggccctaaaccatgttaggcaggcagttaggtaggtgagtaactaacggtgacacgacctcgtcagctttgaaacgttcacgcatatccgtgcagagccaaagtgcgtggacgcgccacgtaagcctaagccccccctccccgacccggtcgccgctgcttcctgccggcttccgcgcggccaaccaaacccaacccgaccggtcgcgcgccgcgtttcggcgaagcccccgacgaagcagccgcgcaacccctgcaatgcatctcattctcgccgaagggaccgatcgatgcgaggcgatgcccaacggatcggaccgggacgacccggtcgggtccatccgggacgcctgcctgccacgtcgacccggcaaagccagcgttgactcccaccagcgagagagaaaagaaaacgagcgtgacgtggcaggtcctgcgcgacacgctggcgttgacatggagcttaccggatcgccgtgatgttgtcgtcggccaacttctaggaaacaagttaaattgacttgtagatgttgtattactccctccgtttctaaatatttaacgctgttgatttttttaaatatgtttgactgtttgtcttatttaaaaaatttaagtaattattaattcttttcatatcatttgtttattgttaaatatacttatatgtatacgtatatttttacatatttcacaaaagtttttaaataagacgaacagtcaaacatgtgctaaaaagtcaacggtgttaaatatttagaaacagagggagtagtaattaactaactgaagtaggagtaggatatttttgcacatgtcaaaatcaacgtatgaactccaatctccaccaggaatgcagtagcagtactcgtgtagtagcgtggggtattagcagacctatcctttcacagcatatttacaaacgaaaaataatttgtaaataaaacttttttatatgtgtgtttttgatgatctaaaagcaactgaaaaataaactttgatgagaaaacctaaaattaactctaaatttaagataaaaaattaaattttagctgataagtgtaagtataagcgaaaaaacgagacgacaatatcgttagattagataggggtaaagtaaaagttgctgcgaatcctgacctgatcaagtcaggggttcattgatctcttctcacttctcagcaacaaagcttacacacgcatcgcacgttggaagaacagcccaaaacattcgcgatagacagacagtaacctcgcttgaatagtgagcactcgcgctgtctccttctgtgatcgccactagctctagttgacggtttgcgagcgtgaaacgcaacgcagagaggagaaacgaggcaaaattggcggacggatgagcgaggaagaggacgcgattggaggcgttgtttggttgtggcgtcgcgcgcgtatggcgtagcgtggcagcagccgtcccatcaatcacccgtcgtccatctctcgctgcctccttttccggacccgagagagaatccgacgagtacgagaggcagcagccgccagccgcgctgctcgcgttggttgtaccccttcagtttgcccccacgcatcactccacctgcactacctcctgctcctcgttttgtctttcgctttccttgtttcatctactcctatcctttttttccctcttggttttacactctatgacacgtcatcttggagtacggagtacttcacactatgctcagcgttcgtttgaaaaaattgtttcgtttttccacgaatatttttcaaactgtcaaagccatgtgtattgcataaaatatagaagcattgtttaaaagatcatgataatctattatttttaaatttaaaataattaatattcaatcaattatacaaggtgctcgtatttacggttaattttttttattgctagataatatatccataaaaaacactggaacttatatttgctagtcttctagtagatgtatttataagataggtgcggtgtgcgggtgtgttcttaagagtaagtgtgtgagcgtctatgtttgtatcatgttttaaagaaagaaaatcatatgctaaaaacttatctcgttttaagtatttttcatgattttttttctcaaatatacccctaaaggtaggaatagtataatttccgggggtgctcgttatacggtgtggcgatggtataattcccgaacccagtaataaaaccgctggatgtgaatcccgaggcggtgctccagaggccgaaatccacgtgccacatgagacgatatttattgcccccctgtgaatctcgatgcaattggcagggggccggcagagggcgttggtgagcgtaatttttgagccgtttgtttacggcgcgctctcacgttgttcatcgcgctgtgaatcggagcatcgaaatccccaagtagccccctcctcctcggctgccacgcaaaaacaaacccacacgccgtacattcgctgccacgcaagctggcaagaattttagcggggcccacctgctgacactggcgtgtgggcccgaggatcagggcgactgcgcgcggctgtcagtgaccctgtgcgtcgcagactcgcaggggagaaaccgcgacggcgaagtggtgttgttgctgtcctcctgcggcacgcctgactaggaacaatcattagcttaaccaacaagatttgttaattaccagtgttgattcaaacatgttttttttgaagattttgattcaaacatgtctcaaacatgcttaactctcattttagctgttttgcgttgtttaatttgaggctaaacatgtttctttttgtctatttttaggggaggggaaacatgtttcgacatggcattttagtaccaaactagggctaactggaaccaaggttcgtaattccgatagattattttagttagttttcatacaaagttgatggaaagtcatcgatttttttcctttggttttggtaaattgataggaccgaatttcaccttgaaaacggtaatgtaagccatgattcgagccataataaattcatgtaatgttttgtagtgaagaaatttaattagatcataaatttgtcactaaaatgtttatcgagtagtatgtgtttaaagctgcatgctcaccgcctcgtggataaccaagtgtattaagtgtgtggtgcatattcgtctttcatatgataaaggacaaatatgtaacgaaaacgctgataatttaaaattcaattgggatttacaacaactgatgcaccaatgtgatactgcaaattatttcctctggccggtgatcaacggccaaaaagctctcatgagagcaagtctagtagtacagcccactactagctccaattcatctataaccaatttatacaataattgcttactatactataaatatatggtcccacctgtcatacacacagtgtgtcttggagcccgctgctcttctctcttatcgtttatatcattaaaatatatttatagttgtctaatagcctgctattatacctgctctaatagtgggttcagtagctaactactgtacgtttaattatttcctggtgtttttatacacccaaatctagctggtggattctgtttacactcagcttttctaattaatttccctgtatagtactcttatctggactggtttccttatcgtgtgttttcaaatatgaagacattagaaatggatttgaccaattgaactaggtagtagaaaccgttaagcctaacaaccatgatgatcatataaaaattctggaagatcaccggtggcttctcaaatcaaatgctctgccttccagttctataatctaatacccacctgatatgcatggcatgtgaacaagagggcataggtggttacacttacattttaatctgtttgtttttttttcaagaaatcaacaatcgaatcatgcatggacaccacttgcttatctagaaggctggaagttagacacggaaatattttctaactaaaacagcccagtacatcaacttaggtgtaactctttttaaactgctggggcatgaaagcagagcattagaactttcatcctaattatggtggaatttactcacatttttatcttctaatagtaagaattgttggattctcaaattagctataaaattattaacaggaaataagtatgataggaagaataccttttataaatgcacataaacatgtatgcatttttctaattcaaaccaacatttcaattttgcattctaggtgatgttatcttatgacaccggacacgagctaaatcatgattttcaagggctagtcataataaaaccaacacagaggcaccatggcaaataagaccaataaatgttacaccgttaataatgtgtcgtagccgttttcagagtgtttttatatgatagtagtgtatttaataactacacgtatactttctcatgacgctatgtttaaaagttggcgccaatcgcaactaaaagtaacctcacccaattatctattaacttattaaaggaatagaaaaaggatcatccacgttcgctctcacggcctagaaattcttacattaattgaagaaaaaagaaaaacagagtccatatagaaatacaatttagaaatagttgaaattcgaaattaaaaaaataaggaatattggaagaggagactagagtccatatataaatacaatttataaataactgaaattcggaattaaaaaattaagagtattagaagaatagtatagagtccatactattaagaaataatagaaaatcagaattaaaaataaggaatattagaaatagagtatagagtccatatagaaatacaattaagaaattatagaaattcaaaattaaaaataaggaatattaatagagtccatatagaaatttaaaactaactattcagaataaacataatagaattaaaagtagagtttagagttcgtataaaaatacaatttacaaataactaaaatttaaaattaaaaaaacatgggaagaagaatataaagtcaatatatgaatataatttagaagtaactgaaattcgaaattaaaaattaaagaatattgaaagatgagtttagagtccacatagaaatacaattagaaataatagaaattcagaattaaaaataaataatattagaagaagtgcctagagtctatatagaaatacaattcacagagaacaaaaattcagaataaaagaaaataaaatattgaaagacgagtctagagtccgtataggaatataatttacaaattactacaatttgatataaaaaataattaataactaacatgtatataaaatacaatataaatattacacattagtagtttcgtaaagttagtacaaaatttaaaattatgttgttattttaatatattagattgagaaaacatacatgctattatataggagaaaatataatgatgctagccgcgtaatctgcgtaggaatcctgctagttttttttacaccaaaaagaaaatttaccgaggtccacaaaacgttgaactatcacttggaacacggcaatacgaaacacaacaaaaactgactcgtctgatttgtaaaaccagagagaaaagaaaaagggggaaaaggaagttataattttcttgccacccccatcacggcttcacttggcctcgtctataaaaaaacactcctctgtctcgaatccttcttcctctccctgcccccgatcggcctcgtcctctccacgccgcgagcccaccagaaaacgcacacgccgacgcgagccaatcaacccgccgcgccgcgcctcgccgccgtcgcgatgcgaccgggcgggccgccgagcttgcgggcggggctgcagcagcagcagcagcagcagccggggacgccggggaggtcgcggcgccggccggatctcacgctgccgctgccgcagcgggacctcacgtcgctcgcggtgccgctgccgctgccgctgccgccgtcgtcggcgccgtcgtcgacgtcgtcgtccgggtcgtcctcgctcggcggcgtgcccaccccgccgaattcggtcggctccgcgccgccggccccgccgccgctgtcggagctggagcgcgtccgccgcatcgggaacggcgcgggcgggacggtgtggatggtccggcaccgccccacggggcggccgtacgcgctcaaggtgctttacgggaaccacgacgacgccgtgcggcggcagatcacgggcgagatcgggatcctccgcacgccgagcacccggccgtcgtgcggtgcccggcatgtacgagcaggccggcgagctccagatcctggttgagtacatggacgggggatccctcgagggccgccgcattgcctccgaggccttcctcgccgacgtcgcgcgccaggtgctttccgggattgcctacctccaccgccgccacattgtccaccgggacatcaagccatccaacctcctcatcgactccggccgccgcgtcaagatcgccgacttcggcgtcggccgcatcctcaaccagaccatggacccctgcaactcctccgtcgggaccatcgcctacatgagccccgagcgcatcaacaccgacctcaacgacggcgcctacgacggctacgccggcgacatctggagcttcggcctgagcattctcgagttctacatgggcaggttccccctcggggagaatctcggcaagcagggagactgggccgccctcatgtgcgcgatttgctactccgactcgccggcgccgccgcccaacgcctcgccggagttcaagagcttcatcagctgctgcctccagaagaacccggcgcggcggccatcggcggcgcagcttctccaacatcggttcgtcgccgggccacagcagcagcagcagccgcagccgcagcccctcgcaccgcctccgtcatgatgaattccgatgggattccggcgttgatccggctcggccatggatggacggtggtttggcattgagacgtgggatctaggagtgctcttcctagccattttgggtattcaagccaccaccacaatttagtgatttaccctcatcatcatcccctctcttgtcgctgttgctcctggaattaagctcctctcctctcctccccttcccctcctcaacttttctttaatctcttcttcttcttttttttcttcttcttcttccaattaagttcatgttcttccaaatgatcatcatataatatgggttgttaagaaagcaatttcttcttaattaatttattttctaaaatcatcattggagcagtagaagtagtagtagtagtaggtggtggtgtccatctgctccagttgcaggaggaggaggagaagatggtgacaaaacaacattgtgatgctttgctgtgctggcttcttggattctgcaaattgtggggggtggattggattggattggatggatcatgaatggttggagcaagcaaatcttgaaatgggaaccaaatcaactttattttttcctcctcctcttcctgaatcctgatcctttctctctggtggttttgaggggagaatgatcgaatgaaatcatgaattgctctctttattctttgtctcactttgctaccagtagtagtatattgcttctgaacctgtgcttttcttctcttctccttttccctttcccagttcattatttttggggcccctgtagggatggcactactactactttgcatgcatcgatagatttgggtcatttttttttagcgtgacatccttaattttcacgtagtaaaaggaaagcatgaaaaagaacaagaagaacaggggacgcagccgcgaagggccctctgcttctgttgtgcagagagtgacaattgcttgcaaatggatagatttgtaggtcggcgaaaggggctgtacataggaaaagcgatgatgagatggtatgagatgagatgagagcaagagagagaagaaccaaccaagagggtgtcgcctccatcaatgtggtgatgctgtacgcaggccgtcctgtgctgacatgtgggcccgaatgggctgcttgcttcgtggaggtgtatgaattgagtttgtgaacagtgtgcatctacaataaatagacacggccttctcatgtgtgtgtgtatgagctgacttatgatgatgatgcagtgcacttgcagcaaagagtacaatgcgccccagctgagaggaacaattcaactgtgatttctaatgcaagattttatctagtataactttataaattacttctttcgttctaaaaagtttatctgttagttaaaaatgaaccagcatgatacaaaagaaagagaggagtgtgaattactcatcctcctatgtcctatcttagtagtaggttaaaaagggtgtttaattatctctcccagtgtacatgaacatgatgatgagtacttcgtcgtaccacgtatggttgcatgcgcagtactcctctgcttataatgcgtgatgcggtatgtcttgcgtgatgcattattggtgtagttaagatggcacgagatgtcaatgtttcgtccacagattacctacgggaagtacatccagagcactcatttatattcgttttgttacttttctagaagccctgcttatgattcatgagtactccagtagtccagtagtactagtaaacatggttgtgaatatcacatctcaagaatatactccagtgacttggagggggacgttgattacaaggccattcccgactcaatgactaggattgtgtctatagcattaaataaggtgatacctaggatgaaaaatgatgtggcatgtaaataaatgagaaaagagaaggaaaccatgtcttgagacatggtttctacacaacatccaagacatcatgtgagataagaagtattaaatttaagtatggaatattagtgtttgcattggaagaacggtgtctagtactagtctcttgatgatgtggagtttatggaaaccatgtctagtgttttaggttgggaatggtttaaaggaaacggttaaaaccttaatcaccggataggtggctcatttggtatcctacaaacaaattatagttaaataatattgtactatgtccgtctaaaaaatatagtactcctagattttaactatgtatcttgatatgctcttatctaaatttatatctacaaaccagtagaacggtagatattagtagtattaataaccatgccactttcaaaagcaggaatttcagaaaaatataacggcggaataaaaagaaattgattggcttatacttatgcttgtaagcaaaaacattgaattttaaacttaattttgaatttaatatactgtttttatcatagtttattttatactccctcagtcccaaaaaaaagtctaattctagagtgtgtccagattcatccctagaattagactttttttttttgaatggagggagtagcatttgcttttgagttgttaagggtatgtatatgtagtactaagttttacttacaaattttatttgctaataaacgtttcggatagttaatgtcttttcacgcacgatcacggtgaagtgaagtggcctgcgaatggaagcacgaaacggaaggacaagagagggggaaaacacagacccagacacacgagatcctcggcggctgctgattggagcgcaaggacagattcttctgaaactgaaatgataggtgcctgacacaaacatgccatgcccgaacagcgcctacccctagtagcagcagctgcagcggtagcactagcatccaacgcgtacgggcacgcctcggctgccactgtttggaagtttcgcctcggcgacggatcatcatctcatatggatgcggccctgctctgctctgacagcagtgaaggctactgatgatgaatgcacgccgcacgctgcgtcatgagaattgcgggtgttcgcgttcgattcgatcgattctctcgtgaagtcatgagatgtcgcagtgcagggcccccacatttgtgtatactactactccctctatccaaaaaaaactcaacctaacaataaatctgaacaaatatttgttctaatagaggtcaaatcctctgataagttaagttttttttttatgaagggagtaattctgtttaaaatgtactatcatttcagactcagtgctatttctgtagattatcctgtgtattttactacagtggagattattcactacgagctgacttgttctttcagtccttcatgatcaattcagttcagactttagtggtagtagtctttttcttctttgtacttatcgtttaaaaattgacgagtctttgttgattgttgatggagtaggaaatggtcgtcggcatgtcctcttcttaactactccctgaacgtcattcagttgagtactattatgcagcatgtcgcacatgataaattaacaggaaacaagtgtagctcaaagatatgaacagaagaaatccggtccagatgataatgtagctatgacggctgaacctgtataagaccagatctttggtggccctttttccgagcttctggatgaactgtcagcattttgattagttttaaaatgtcaggtcatttacaaacaacaggaggatcaagaaacgatcgacaactagtttacaaccacaccaacatgtaggcatgaacatggctctctgtctctgcattaacaaacagtagcttcctactcagattaatcaggagaagcattggataaaaatcatgcttaagtgagccttgcagtaacgcctattgcagtcgtagtgcaaaactcaggtcagctttaatttagttgtagttgagccttcgtccctgcatggcttgctggctcgtgtccgcgtcgtacgacgacctccctacgctgtgctcaatcgccatatcctggtgattaatcagatgaagcaacaaagattcaattgatgttcttgcttgcaagttgcaacgagatttgcaggagatggtggatggattgatcttacggtttgtcgatgaggttgatgcatggaggagttgctgttgtagggcgagctgtgcatgctgctccggccgccgccgctcatggtgttgcagagctgcatgttgtcctcgccgagggcgcggaggcggttgagctccgggagcacgacggtggcgaggtcggggcggtccttccggcggagctcgcagcagcggatggatatctcggcgaagcagcgcgcctcgtcgacgggccagtcgtggacggccgggtcgagcatgtcgacgatggtgccgtggtcgagcgcgcgcgcgacgtggtgggtgagccccatgggcggcttcgcggtgacgatctggagcagcatgacgccgagggagtagacgtccgacttgacgccgagcatgcccgtctgctggtactccgggtcgatgtagcagaaggtccccgccgccgacgtcatgtggcactgcgtgacgctgtcggcgacggagggcgggacgaggcgggcgaggccgacgtcgctgatcttgctgacgtagttgcggtcgaggaggatgttgcccggcttgaggtcgcggtggacgagcggctcgggcttggtctggtggaggaagagcaagccggtggcgatctcggcggcgatgcggaagcggtgctgccacgggatgaccgggccgccgccgcgccggacaggcagtcgtcgaggctgccgttggccatgtactcgtagacgaggcagccgtactccgggcacgcgccgaggaggagcaccatgttggggtggcggatgcagctgagcacctccacctcctggttgaactgcgacctcccctgggcggcgtcggggcggagcaccttgatggccaccggcgtgtggtccaggtggcccttgtacaccgggccatagccgccctcgccgatcttgcggccgtcggcgaagtgctcggtggcgagctcgatctcctcgatggtgtacttgcggtaccggaccgcgccgcgcgagccgccgccgcccatggacttgagacgctcctcggtctccttgagcgccttcatctccgcgctgatccgcttctgcgcctccatctccgccagccgctgcgacgcctccgccgcctcgatggccgccctcgccttcgccttctcctgctcgatcagcgccatggccgactcctccgtcagccgcgtctcgtgcgaccgctgctcctcatccgtcttccagcgctgcagctccatcgcctgcacgcatcatcaaacactcgatcacatcaactcttctcaacttccacaatccaaacgtaacatgtcaataacgtgggaaactattctaaattcttgataggagattcactcattgattgcatataacccaaatggttatgaaaaaaatatgaggaaaaaacaaaatagattaatatgtgataaatccatccacaaatcaaatttaactgcaacgaaaaaacaaatttaaatgtggatacacattaactatatatagtttaattaattaatatatttttaatttatagaagttgaattttaacctgcatgtttgtagagtgacctatcacatataatctatcttttaaatttcttttcaacttttttataaccttttaaggtggtgtttggatccagtgactaaactacttcagtccctgttatatcggatgaatttggagtattaaacataggcatcttataaaactaattacataaatgagagctaattcgcgtgacaaattttttaaacctaattaatctataattagcgcatgtttactgtagcatcacataggctaatcatggattaattaggctcaatagattcgtctcacgaattaatccaaggttatagaatgggttttattaataatctacgtttaatatttaaaattagtgtctaaacatccgatgtgataggactaaaaagtttttgtcccatctaaacagggtctaaatgatatgcaaacaacaataaagttgcgatgcttataatttcttggttgatcaatggttcatcgctaaccttctgtttagccgtgagcgcctccttgcacgcggtgctgtacatgtccatggtctgcttgagctcaagccgcagccgcttcatctcggcctccatgtcctcctggtatatgtacgtacgtgagagatcgatcacaacgatcgatcatggcgacgaaatctcatctgatgcaaacaaaaatctagcctgtactagctagctagcttgcattattgtgtgtaccatgggaagggaggaagcgaaggaggagttgctggactgggagtcgctgccgaaggagtcgccgccccacatgctgggcggccgcgtcgcctcgaagctgtggtggtcgtgggcgtccgaaccggacgacagccgcggcgggtacaggtccaagctccggcgagggccggagctgatgaaggagatgtccgacgactccggcatcgagtagtccgggaacgccttcctcaccgacgtgttcgcccccctcgcgaacggcgacctgtctccacacaaatgccacaagcttagcttcttgtttctcatccattcttcccccctagcttaagcttacggaaagagtttttctacatctaggtgtcagcacccgttatttgtatactgctcaaatagttatagaaactagcttaagcttacggaatgagtttttctacatctaggtgtcggcacccgttatttgcatactactcaaatagttatagaaaaaagatttaaaaaataatatcaattaagatgatataattttatagacaaacatacaagacatctagactaaggccctctttgtttaggtttataagccaacttataagtcgaaaagtctaagcctaaacaaacaagcagctttttcatttggcttttttgaagccataaaccactttaacactattaagccaaaagctaggttggagaagcttttttggtttatgtgaggtagatgtatgactcaactactaaacttaggacattaaatccaccggcttataaatcatataagccaataagctgacttaaaagtctaggccaataaatctaagcctaaacaaaaagggcctaaatcagatagtaatattatgttccttaaaaaaagatatatactacatccatttcaggttataagactttctaacattgccccccccccccacacacatatatattcattaacatatatatgaatgtaaacaatggtaggaaatcttataatataaaacattataaaacagaggaagtagttaatattacatgtacaatgcatataaaatttgttatttttatttctttatatgtaaatcaaatttatatttgccagtttgtataatgttttatattcacaatctatctcgtcaaattttataattttttatattattatttaaaccgcatgtatacacctaggtgtcgtgacgtctaggcatagaaaatactttcccctcgacttacataatgaagttgtcctgtatcttcggtgtcccggcgatgtcaggtctcgtcgtggacggaggaggcggcggcgtccatttctgcgtggacacgttatcgggcttggggccctggatcattgtgcggagcggcgaaacggccggcgcctggcggacggcctgccgcaccgacgtcaccttgccgcctttggagacgacgtacacggtgctgaagtccggcgccgtcttggagatgctgctcgagatctccgccttgaatcttttcaaatgccacaaaccaaattcaccccggtttcctcgacagctgctttttgagagttgatcgatcgagatgagatgagtagactgaattggttggttggttacctgacgaagccgcccctggcggtggcgccgacgacgagcttctcgatggcggcgtgcgcggcgaactcgacgatcgccttggacacgtcgtggtcgtccagcaccacgtccttgcagtggatctgcgagcccagccacgagaaaaacccccattagttattgcaccacgccgtgctgcaccgtacgagaatggacgcgtcgcgttacgtctttccgcgtgcagaagcagcggaacgggaggaacaggtccttcatctgcgggtccgacggctgtttgtacccggccgcgtcctccacgccacctgcacacgcgcgcgtgcatcgtcagagaaaaacttgaaatccgacgagagatttcagcggcgggggtccgggggatgcagtggttgcctgaggagcccttggtgtggacgtggacgagcacgatggtctggcccttgtgggcgagcgactccgtggcgtacttgagggcgttctggctgttcttgtccttgtcgatgcacaccgccaccagcgggtacccgccgccgccggggtcgccgccgtccttgcccattgccagggctaaccgattaaccaatttagttcccccttcctcgttgctctagtgctcgaagctttttgctatcctgtactagttccatgccattttccttcctgcgcacagctctgctaccaatgtcttcagaaaaactctgctggttgattgttcatccactgaaagattgaaatggggagggaaggccattgttcatgatagagcatggggatctcatttagacctttgctcctgttcctctgacctgtattgactattaataaacacgtcctacttggaaacgagtttaaaacgcttatcttgttccttgtcttcttttacctgctgggttaacggatgaccaccaatgcttcctctctccttttttggtctacactacaaaacagacagcgatggtatatatatactgatgacaacagatgtacagatcataggattatgtgtgtcggtctcaaatcattgacaagggcactcctgctttatattaccactaagccaaaattaacacagaaccagcaggagaattgcataaagagcatctttattcagagaactgcatatacaaccagaggcagtcaagtttataaaatttatatgtacaaaaaatattacaccgacatttacactattaacaatctaacaattatccttacacagttacactacaagacaacaaatcagaggcacccaggctccgataaatgataaccttacatcacgtgtgatctaatgaaccaggcatgttggtccacgggtgtcatcacctaactagagtggtacaatggagttaacccaccgtataaaaggctgttatttatcaataattcatcgaaatttagctacactagaaaattgtctatcaaatggtagattacgtcttcgccgtctgaattaacaggatggatcctaacctgcaccaagcatcagcttacatcaaatgtttagaattctctctctctcttaagatatcatcagataaatcatgcgggaaaatcctctctcttaagattgtggaaccaagaagaagagaaatatagtgaaccatgaagggctatctatcgacaacagtatttgtccataactactgaatgcacatagaagctactataacatagaaggtccttacgcaaaaccccagcagccacattgccttgcagttaatagttcaactaccaattactggtcagttatcagtcttagattatgtttcacaaaaagaatctgcaggagtgccgattatattattcagtaactattggcaacagaggtgcgggactagcagaagatacctggatattgtggtgggcattgtatcttagccagctcttatgaaagcatacatcaacacgttcccagggaacttgtgtaaggccatggatcatcacttctgtaacagtaggagtaaagtctcattgcacagctagcaggaaacatagaaacaaatttaagttcgtgggtttgttatagatgcctctactattaacaccattttagttcgatgcgtcaataaagcttatgtgcactttacacagagcaagagtctcctgaatttagagagcatcaaaaccaagcttgcctattgatatatatatgttatagttattcttaccttccatgctatctgtaagtgaagcttctacagattcctcttgctgatgatgctctgaatttcctttgtcaacatggataatatgtggatactttttatcacttggtgttaactgcaactgagatgcataaacaggccagattattaatgtagtgagcataaaagcacagcaacattgtactgcctcctaaattgaaaaggttaaatggtaatttactttaggtaattcgtgctgacgccgaattgatgatgttctccacccaactatatctttaccaacatgttaaggacacaagcaaccaaagttgccttgagttcaagagaataccaaaaaaggaaaaaaaaagtaagtaaagtgggacattggtaggatacgatcatatgttacattcgcataggcaacacggcgcttaaaagagcgcaacgcagacctgcacaaagcaacaacatgtcaagcatggtacatggaaatagatatgttatacataaaaatatagtagattgcaccaattgctggatatgtacatgaattttccatcatcacagtcttcagccattcgtaggagaagtgggggcttcccatcatctgagtctgtaaggaataaatgtttccctgttctcccaactataaaatgtgcagttactgcagcagttcgctccaaaagtggaacaccaaaaaggaagggaagctgtcaagaacacaaatgaaagagtaggatcaggtttattctatttattcatactattttcttattgaattcatacgtacaaaatcccaaaaaaattatcaaggaaggtttaacgaagtactccatgagttcagagctgaataaaaatcaacatggggttcagtttacggaatgttttcctagatcaataggccatatgatataagtttggtggttacaaggttctaaggattcaaattgagaatgcaaaagctaacaatcagatgagagataaacatgtcaaacacacaacaaacacataatctggacaacttacttgtttattccaccttgatcccaagtgtggagtagcaactgcaataaaatttattggctccaaaccagctattttaccaccatcagatgttctcagttcatttgagaagttttctttatcaagagaagcctcttcatttattgatggatcatacagttttccaattgcatatcttgtaactaaaccaccaagtgaatgggcaacaaaagagatcttctgcaggttacttctcctctgaacaacttgtcgaacctgagtattaaatattagtgccattaggcaccctttgtattaaactgcaacttcatataaagtgcgatgataaagtgttctactgattacagtgaccatgaactagtagatgtataaacagttggtacaatgaagttggctgtacgcctgtacctcttcagctaacctttctcccatcaagtcgactccatcatatgttaactttgaatggttgcactgactgcctgtttcaagaaatttagttagacacggaaggtgtatgtttatgtaggctgatcaactattactgcttaggacatagcaaatcaactgggcagtatgaggtatagacatgggagaacagcaactaaatctggagtgcagctttgcaagtgaagtttggctgcatcaatgcacatcatgctaatatggtacttgctccgcaaatttcagactgtgattgaaacagctagtcttacgaggaatttcaaacaagctacaccccagcttaacggaaacttgagagggatttcacactatccacaccctggttaaacagaagctttctgtaatctaaattgcacaaagttcacatcttcagtgcacaaccaaatcacgattttttttctaactagcttgatgcctgtttgtggaaatgcaatgcattgcatttgcacttccagattgaagacattttgtaatgtgcaggcaaaaccaattccacaagaccctctagattaaacacttacacgggagcaaaattgaaaagcagtaacttttttttttcagataatggaaatggtacaaataagccagtaactaatcgagttgtataaactcacgatgcacgaagactttccccggcagcctcttcacaaactgctctgcagcaaatttccaatccgccgaactgcccaaagcaccaaattatgcaattagctagtaataggaaagcataaaacaacacaatactatgccaaaaaaaaagagcagtgcaatcgcacgcacacctcccgtacagcccgttgaccatgacgacgaggtgatcggcctcctcattcccggcctcctcctcctcgcggttccccgcgtccctcccctaggcgctcgcctccgcctccgaaggctgcggcaggggaggcgccacgaagcacctcagccagttcgccaggtccagcttcccgcccccggaccttgtcctcgccttgcggccaagcagcaaccctaggtcgaggcggagcccctgcaacggcggcggcggcggcggccatctcgagattccgcggctgcggctgcgccccggccccggcggcgagctcggggcctggcccatcgcggaggcgggcccccggccgcggccgcggcggcgaggcgaggcggaggtggaggcggaggcggcggcgagggagcacgtggcggaggaggggttgagtctggaagacgcgggcatttccggttggctgcgaggtgtgtgtggggcccacatcgacggttccgaatcgcggagaccttttttttggtggaatggacggtggtgattggatggtggattcgcatcgagcggctgggatgcactggggcgtactgggtggttggctttcgcggtcattgaattattgcgtgggccgctacgagatattgggcttgaggtgtattggactcttgggtttggtagtaatgggctaaaggcccatcagagattgatccagtccaattcacaaacgattttgctaaatatttgtcgagtgatttttttcataggatttgacgtttttctagccgcacgatgttttccaagatttgcgcaaaagcagggtcagttgagtccatgaccgagtcaacctgactttgtattgatggatttctgtacatcacgcatatcagtagccatttatttcttcgctctatttctttctttctttttctagttaccaaaatttacaatgcactttgtactaaaattacaatacacttgtactgaaaatacagtgcacttacatgtcatatctactacttttacaaatgtaattttagttataaagcactgtaatttagttataaatgcaacatttaacacttcaaatatctgcacggtttctcaagcaatgtatttatactaaaacgacaaatattctagttaacaaaatttacagtgcacttgtactaaaattacagtgtacttacatgtcatatctactgtttttacaaatgtatttttagttataaaacactgtaattttagttataaatgtaacatttgtgttaatctttactgaatactactgtactaacaagcacaatcacaggctatctgtacttttttttttaccgttggatgcagatatgaggggagaaaaaatttgggtgattttttcttaaaaattacacgacagatgtctagacagtcccattcacaaatgttctctttttgttataccgtacttcctccgtttcacaatgtaagactttctaacattgtccacattcatataaatgctaatgaatatatatatatatatatatatatatatatatataatagtgtctagatttattagcatctatatgaatgtatacaatgctagaaaatcttacattgtaaaacggagagagtagtaatgttttcaacaatagtacttttttaagagagagatagtaggcactgtttgcagcaaatctctacaattatagtattctctccattctaaaatacagtaacttaagatcgtgtagtactagggtatgatcctttcagtcatagattgttatattttagaacggaggtaatactaatttgtacatgttttattttctcaaaacgatgaatatagtatgagtatgaaatccagcccaatttgccactgtttttgctcattgtttaatgctgcatcgatcaacagcagcaggaaacgaacgaaacttcgacgtattcgccgactgatcttttcgatctaagatgtggtctagcacgcatacccacatgaaagcatgtgtagccacttcgtcggtcgtcacagtgcttctacttacacaaaaaccctgccaaaaatgaattttgtaagtgacactgacacactggaaaaccgaaacaaattgaagccagaaaactacccttctccagccgtttacttcagggtgcaaactgcaagttaaattccatcctaggcaggcatgatttgacatcgtcacttgctccatcgatttcccaaaggtgtcaaaccgaccaatggaaaagactcgaataatatacaaactgagacagtactgaaaattgcaagtcaaacaagaaccgggacgtcctgtctcacgcgcggcctgcatgacgccctcaatgtacgtgccccatcacatgcaacgattctgcgtcgatcgattaattcttcatgaactctgattcgatcagtagatctatggtacttccagttgcagattaaatcttaattgtcaacgctgtttgtgcaataatcttcagctcgcatgcgtatatataaacaactgcaatggtaaggtagcctttgaagcctgcaattaaccagttagctagctaagctaggagcgacactggtcttgagctagctagtgtggtcggccatggagtacagctcaaggagggtctcctgctgcgtcgcgctggccgccgtgctgctcctgtcgtcgcgcacgctcggcggcgccgccggcggcgcgccgcggcggctgctgcagatcagcgaggcgcagcagttcgtggtgccgcagacgcacctccgcgcgatctacggcctgcacccgctcaagtggagcagcgacctggcggacctggcgacgcggtgggcggaccagtacaagggcgactgcgcggcggcgtcggcggcgtcggcggcgggcggcgtgaacgtgttccgcggctacggcggcgaggcgtggcagccgagcgacgcggtggcggcgtgggcggaggaggcgcagcactacgactacggcgccaacgcgtgcgcggcgggcaaggagtgcggccactacaagcagatgatgtggcgcgacagcacgcaggtcggctgcgccaccgtcacctgctcctccggcgagacgctcatggcgtgccactacgagccgcagggcaacatcatggggcagaagcccttctgatccacgggctaatcgtaattaggatctacccggtcttgatatgctagttaatatgctttgcattaatcttgatacgtactataatttatctatggttattagttggggctgaattagatcgaagatcgatgctatgatttttggtcgtgcgttttgtttatgccataaggatcaaacctatctcttcgaatatcatcgatgtcatcagctcttagctagttttgttcgattttttcattctgcatgacgccgcttatgagcttatccaggtaatactgggcaaaatgaaaacatacattactccttcacttcaaaagctgatcatccagatgtatccgttttgctctgtgtcttcatgcctcaccggtgtcctatataagatcagccataccaaaatttaaattttaaagttttttcattgaagtttattttagcgttagtttttaaatcgctaaagacgtatccacaaaacttttactataattttttttggcctaattaacagatggaggcttcactcgagaaacgcaaatcgtttcattggtctgagaggctgcgtattccttctattgggccggaagcgcacgactatggcccaaatcccctaaaccattagccttttcactgttttcaccttccgtccttccctctagtaaaaacagttccgacaaaacaatggcgctctagtaaaaaggtcattagatgtaacgaaatgtataagaacttaaccaccagtgagtgtatttacagtgacagtaactcagaaatgcagattgcacacacctgattcctgaaacttttattcagcagctgtacatgcacatctcattccatcatttccatccaggacaatcctgacaaactctgtggtatcctagtgtactgctcattcagtacggcctctcgccgacgacgttacccggcgggtagtagttgcaggtcatgaagacgccgccgtcgtcgcaggcgacgcgggcgcagccgacggaggtggtgccgcgccacacgatctgggtgtagtggccgcactcgcgcccggccgcgcacgcgttggcggcgtacgagtagtcgacgccctcggcggcccagtccttgacggcgtcgccggggcgccacgcgccgccggccccgccccagaagatgttctccccgagcgcgaactgcccctccgggaacgagtggcgcagcgcgcagtcgccgcgccgttgcgccgcccaccaccgcgcgtacgactccagccgcggcgaccacgccagcggcagctcccaccgcgccagccgcaccaggttgtggtagtagaggaactccagcgactccgcccacgcgcccagcgcgccgcacccggcgcacttcgccacggacatgtcgtacaccgtcgcgttgctgtacccgagcgccgccgctgccgcctccttccctcggcggctgccgtcggcgagcagcgagtggacgagaagggtggaaacgagcagagccacgagcagcttcatggcttcgatctcctattggtcgctgtgtttgcaacgaaattgtggtttgggattgaaggaagcagttatatgcggtggctgatagtgtagtgtttgtctctggcacccgtgaccgtgggtgggagcaactgtagtagccatattgatggtatttttgtccacatttttgacatctcgagacatcgtttcgatcatggcttgtttgtttatgcaaatgcgggtttgttttggttatcacaaaggccaccaagactttcacggatttgattctgtgaagaaacctgaaagaatcgttgctgacgagagatcgtcgaacatacggtccatgattgattgctgtatatactgcactacagatttttcaatagttcatcaaaatctgttgatgaaagcttgttctcctcctaccttgttacctgtgagctcgcccgtgacgatgaatggccgcttctagatacttccgtggtcacgcgcgagcttacaacaaggtccagggactccaggcttatgatgaatcggtagcacggccggtcggccgggcggtttgccatagattgcttctgcgcggcaggcggcacatgcatgtggtggccgcaaggccccgcaaacggtgtaacccaccaccgttgtcacaggaggcccggccggcttgtcgtgtactgtgtacgtacgtgtccgcggacatttcggccgcttctgaacttgagagaagttgagatcgatgcatgcaacggctgcctcgtcggcttctgaacctgaccactctgggttttctcttttctgtttctcctttcgcaaacttgtgctgatgcgaacgtacgtgcggcccgtgattgtgagcacgaaagtacgcgtcatgcgtgcggcgggttggaccgtgaccgcggcggacgttcagcccgttctaaaatgctcggcccgtttgacgatttgactggctgttcggtagccggtttcggcttttgagccaccgcgcccaggctcgtgcttcatttgacaggctgcgctcttttttctgtcgtagctgcgagaaagattgtttcgttttccgcgcgtaagtttcccgaactactaaacggtatattttttaaaaaaatttctgtagaaaagttgttttaaaaaaatcatattaatctatttttaaagttttaaataattaatacttaattaatcatgtgctaatggctcaccatgttttgcatatcttcccaatctccttaatccccttctcctcaaacacactcttaatttcgttagcacatcttttaaacggttaaactgtgcattttacatgaaaaatttttatataaaagttgtttaaaaaacctaataaatatattcactattttttatatattaatacttaattaattatatgttaattacgtttctcgttttacgtgtggttaattagccgtttcaaaaatctaaaaaaaaggcagcccttgtacgtactcctcctcaaaaataaaataaatccaattctgaaatcgaattgactcaagggccgtgtttagttgttttggtaaaaaaaattaacgtatacgaacacatatttaaagtattaaacatagactaataagaaaccaaattacagattccgcctgtaaacagcgagacgaatctattaagtctaattaatataccattagcaaatatttactgtagcaccacattgtcaaattatggcgtaattaagctcaaaagattcatctcacaatttacatgcaaactgtgcaattggttttttcgtccacatttaatgctacgcgcatatgtctagacatttggtgtgacggaaaagttggaagtttaaagggaattaaatacggctaagataggatttgttttagatagatggaataggccgcagctagaaatattgcaatttttttgtgaggggctatatttcattgttgccactgagttgccagcggctggaagttgttatgttatgccttagaaaatataatttctttattttttgccgggataaattataagttctttaaacaaacagcatcttttatattgttaagtcattccttttttacaagaatacaacatgagactacaatcagagaaagtacacaaatttactaaacataccactacatatcgacaatgcctatacatgctaagaactaaacaccgcgtcagggaagagaaagagcttgcttccaccgttgctgctttcaattggtttttgccacatccatcgctattctctcttaccgcctcccttggtctaaaggaattattctaccatttaatattggtgtctatgttttgcaatgaggttgaagatggagacagttggacggaactgcctgttacgagacttgagttccttctcaaattgtttgtttggtgtcaatgttgtgtaatgccattcgcggtgcattaaatgacgtatgtgtgatcttaggcagccacgtggtcgtatgttgtcctatccttacgaggatgctcgtccctttgcaaggtcgcgcgagtctcagtgggctgaagaaactcgtcaagtcaaggtgtgagaggaaccatgttggaaaaaccatgccccagtggtcccctcctgagctgccttcatcatcatcgatttgttgttgtcgtcacgggaaatatatggcgagcccgtcaaattttggcaagcttggtggcgtggagtggccactgccacattttctcccgcggctttgggaatgaggaggaggtgacatcgtaacaagaaggagaggtgatgccgcctgatctacttcatggtgagggaagggtgaaggaaagtggcgccgaaggagagagtggccggcgaagagggggatggagagacataaatgggaggggaggtgatttcatatttctttatatttttttgggtgttcagtccaaaatattgttgttccctataaattgataaaatatgaggactaaaatagaaaacaatagagggttggctatgttgcactttataagaaggggtgtgaatcattaacgtatgatgatttaagtgttaactattataaactaagatttacttaaaacaagaaaacttaggagtatttctttttaacgaaatgcgtcatttcactaagggaaaacgaaaaagttatcactgtttcaaaagtcctttggatgggcacagttgagaaacatattcataactaatgtcgtgtagtgccgtgtctagcgcacacaccttttcaagctcaattttgaccgcccaaaacttatcgagtggtaactactactccctccatcccaagctcaattttgaccgtcccaaaacttatcgaacggtaactactactccatccgtcctaaaatatagcaacctataaccggattcgtggtactaggataagtcccatccggtcctaggttgctatattatgggtactaagatacgtcccatctggtcatatgttgctatattctaggacgggggagtagtagtatgaaaaagctgcttttcactttggcgactatcgtgttttcagtgtcgatactgttgtgaagtcagcgctgctaggtcgcttgggctgctagctcggcaacgataaccccttttatgcgatgtcaaagctattgtatcgcttttgtgtttagcttgcggcgatgtcctgtttttgggctccgccgttgttagtagttgtgtaggtaggtttcatgctttttttgtgcggtgggtttcagtcggtttccccccgtgcagttgtatggttttcgggttcgattttccttataaactgaataattttttttctaaatataaaagctgggtttttttttaaaaaaaactactactagtagtgtactagcagaagcccgtgtttattggccggccatgtatggaggaattcccaattttacggcggtaagcccgtgtttacttggaacgagcaaaaaaagggcttgagtacccgtaaatagacgcattcgccaaaagaaccagtggctgataattttccaaatatcacgcagtcataacagcgcacactataaaatatttaggaaatactatgaatgtcattacttacctaaaataaaattgattgggtagaagtagtattctcaagcaaactctcattggtagaaatccaaccattaaaatgttgttatatggaagctttttaaacaaaacaattataaagagagaacgtcagcgataattggcatgcatatattttttacggcagaaagtttcagcccaacccaactggttgtgggacacgcccacaaggggatcgacatgtcagtgagagaacgtcggtcagtttatgggtaagaaataatagcttctccatcacgcggactctttccgtctctgtacataaaagaagggaacgagtagcggagtgaacgcctcgccccgcctattcttccaccatccaaaatcctccaccaagcgcagagagagagagcctcacaccaaacggtgtctcccatggacgacctcgccgtcgcccatcccatcaccagcgtctacttccggctcgccgtcctccctcccggggtcgaccttctcctacctcttccctgacggcgatgaggagaggcagtggttgacctcagacagacgtggctcactcccagccaccgctccttgatgggatgagggggtggcggcaacggcgagtcgtgcctttccggcagccccgtgcccgaccgccagcgtcgtagttgcagaagcgccgccgggagtttgcttgaccgggctcgctctccgccggtgaggtggagacggatttgcacgcgctctagatttgagcgagtggctgtagagcttgtctctggctagatttgagccagcggctggcggagccttcatccggctagatttgagtcgccgggctccctctagatccgagctggtggaggtcgttcggctcgttcttctccaggtaaattacttacttaagagccgataatttctctgatttctccaaagattgcccaaacgcataggcccatcagcccatcaccaatcttgccaccgtgaaatgcacgattccggcctagtataatgctagctgttcttacggattttatcatgtgactcgattgcaagcagaaccacattggcccatgctttttgcaggcctcatttcatcatatttacccgcattttcagcatttctacctcgatgctgtagtgggcttgtagagatcgaggatgtagcaaagcattgcgtcgtgatgcctcatactactatctataaatagtaagcttgtgatggattttttatcctagcaacccaaaaagtgggcggcgtgtagttgtagaaagcgacctcatggagaaaaagacactaccacccaggttgaaatcgctctgaccaatttagtccacatcgttctcttcctcctttgattttgatcttggatagccactactgggtgcatcttttctcctgctcgcgctctctgtgccctgttcatcaccgtgttctcgttttgtgttagtggtgtgtggagtctttgattgctgtgtgtttttaagtttctgcaggatgtctatgttcttgtgggttaagtggggtatgttcaacttggctctttagccatctttgtacatcttcacctgcctggatttctagtatcaactgatgttcttgtaatttctatattgatcattttcagaa

SEQ ID NO: 20038 - DNA, 14099 bp, Oryza sativa
atattaggccattctggttcgtgacacttcacattgcctaaggctggtcctctcctgtgttaactagctattatgcttctgctgctttagtatgcttatgttgggttatagctaccctgtgtgctgctatgtaggaccatgtgccaggttttctgttgtttttctaatgtgtgactagctagtatgcttttgctggtttgtaactaacttgtatgttgctgtgtaggaccttatgtctttgaacatggattattgtatatatttttaatgttgttaagcatttatggttgtattttatcagaacatggaagtctgttgtctccttttggtcgtttcgttacagttttaagagttggcaaaactgatcaggaaaaacacttatggctgatactaacgtgaacctgactataaatattcattggttcttcacatgcaattattgtcctatcagattttcaaatttcttaaaacacatggttttgtattcctgactgtcatatttatatctttattttgtagttatcttgaggttctgcagcgcaacatgccagttcagaatcacgaaaaaataatggaagatgcactgaagagggagttccagcattgcatgtttagtcacgcgcctcctcgtggtatggcctacttttagaagactgtttgtattaaaacattagcctaactgggcctacctattcttgagataatttcttgaagaaaatggattttatcattttccctactctattattgctaagatcctggatttgctcattggttgttgaaagtttggtctaagaagatcacattcattgattgaacctgtccatatgaaaattgacttggttaactgcaataattgccaaaaaatggatttaataattttctctactcaattattgctaagaacctggatattggttgtattgaaagtttggtctaagaagatagatacgtgcattggttgaaacctaatttatatctaggaaaatggcttgttagttggattgaacctctccttatggaaattgacttggttattattggcagaaatgtctttcccatttattgcattggaatttgctcgttggcattactggatcaccttcatgaatttgcatttgcttattggctgtatttgctttgatgaatttggaacttttccttcttttgcagtacacatccagcagagccaagacccacctgaattagagatcaacttgggtattgctggtgatgaaggccccccattgctcccccatggaaatcatgataaccatgcacatgcacttcaccgactcctgaagcttggcattctcgggggacctgatggatgtcttcatgatgtggtctatatctagtagatttgtttctgtgattcctgacttctagaagtgtggtttgtgagtatgactaatatgtagccactattctgggtttagttgagacttgggacatgattaggcactattctggctagtagtagaatgtaagtaagcgaagcatgcctggtgatgattgtagcctatcatcgaagctttggaagttggattcagacttgatctgctgctgctcctttcattgggagtatgcctgaacttccttctcaacaagagatttacttcatttcgattttcagcggagtacttttaaatttctcgcattagtaatcaggcaatgcattaatttgttttgcccgttgatttatatgatcaattaagttgacatgctctaagtctcagttggatgtgctgctctgagtctcagttggatgtgcaggggtttgcgttatgctgttgtggtattttactgtagttgcccaatggtttcactttttcggtaggatgtgtagaattctctttttagcctacgcagttgtgcttgtgacaagtgaagtcttgtaaagttgtaactgaacagcgtagtagttgcttcagtttgtagcacttctttttgttacgattttagtgaatttgttcattttgttacgatttactgttttttccttttctaggcaacctcccaactcctgctcgtttctcaccttgcatgttcgtaagatccggtgctcaatcattctgcacagttctcttgcagtctagtggattatgttccacactttgatttggggtgtgtttagttcacgctaaaattgaaagttcggttaaaattgaaacgatgtgacggaaaagctgaaagtttgtatgtgtatgaaagttttgatgtgatataaaagtcaaatgtttgaagaaaaactcggccttgataatggccttgtttggatcctccgggctattaaatagccctccggaatcttactatttaggattattaaacgtagattaccgacaaaaccgattccataacccctaggctattttcgagacgaatctaatgatgcatattaatccataactaacatggtggcccgcgcagattgcgcggttagcatcattatattttctctcatataatagcatatatgttttctcattatattattcaaatatattaaaatgacaacataattttaaattttgcaataactttacaaaactactaatgtgtaatattcatattatattttatatacgtgttagttattaattatttttaatatcaaattttagttatttgtaaattatatatattcctatatggactctagacttgtcttttaatatttcttttttttaattccaaattttctgtaaattgtatttctatatagactctatgctcttctttcaatattatttattttatatctgaatttttattatttctaattgtatttctatgtggactctaaattcatctttcaatattctttaatttttaatttcgaatttcagttacttcgtaaattgtatttctatatagactctatgctcttcttccaatattatttatttttctttctaaatttttattatttctaattgtatttctggactctaaactcatctttcaatattctttaatttttaatttcgaatttcagttacttctaaattatattcctatattgactttaaactcttcttcccaagtttttcttaatttcgaattttagttatttgtaaattgtatttttatacggactataaactctacttttaattttattatatttattccaaattttagttagttttaaatttctatatagactctatactctacttctaatattccttacttttaattccgaatttctattttttttcttaattgtttttctatatggactctatactctacttctaatattccttatttttaattccaaatttcagttatttcctaattgtatttctatatggactctatactctacttctaatattccttatttttaatttcgaatttcagttatttcctaattgtatttctatatggactctagtctcatattctaatattccttattttttaattccgaattttaactatttctaaattgtatttctatatggactctgccttttctttttctccgattaatgtgaaaatttctaggcgatgagagcgaacgtggaggctcttttttctattcctttaataatataatagattagcggctgattactgtagcatcactgtagtaaatcatggattaatatacctcgttaaattcgtctcgcaaaatagcctaggggttatagaataggttttgtcagtaatctacgtttaacactcttaaatagcaaaattccgtagggctatttaatacccctccggattcaaacaggccaatgttgttggcgcaccagctcggtccctcggtgggctgctctgctctgcaagtccagattgataatgttgcagtctagtggattatgacattatgttcccaactcttgattggctgattccttgtgtctctcttcgtggtgaaaaaaaaaacagcatctgctcaaacatttaaaaatctaattatcaatgatttatcaaatgcttagtttgaaaagatggtacttgtagatttgtcttgaaaagtacggttataagcggcaaatattcatgttcggaatttatataagttaaaattcatggtcggaatttaaaaaaatgaccaaacttattataatcggtaaatatttatgaccctgttgtgcacgttctcttgcaggctgcaaagttcaggtccgtctgctagcgcttgctgctttggtccaatctcagattcgtgctactccggttaccctgctacaaactcaccccagcgacgtagagcccaccgccgggctgctgatcccgtgctcccacggcgcccgcgccaccctactgtacttcagtactctcctcctttcggttgctccttccctatcaaaatgttgccattcatcgtgaacatgagtgcgacttcattactactcctacatcaaaggcttttacaaggagatgcacttgacagtactatggtttcgatcccgacatcccgtattcaatcctcaataaacttataatttcttcttaaatatgtttggagggcgtctctcccttcaaaacttttgaaacaaaatgctttcacagagaccgaccaatggcatggttttcagacttccaatgaatcaaaaatatttcactagcatttacaatgaaagtctttttttttacaggatgagttgaaccgtctgaaaaaaaaaatctttcacagataccgaccaatggcatggcatgggctccagtcttccaatgaatcaaaaaaaaattcacaaacatttacaatgaatttgagagaaaaagttacatgagggatatcctttctgagggattagaatcctctccccattctttggaaatgcctcaaacgtcctaataaattatgtcaaattccttcgaaatccttgtgtacacaagtgtagtgatttcatgccaaccatttaggagtacatcgtaacaagtaataacaatgttccccacgaaaatttagaaaataataataataaagactttaacaacaatttaagacatttgcaaatactgtgatcactttatattgattcttattggcgatgatctttcctcgttgatcagcctcctcgttaactctctctctctttgtctgtacttggataccacgtagttgggtaatactgacaattctcacatttgacttcatcctccagatgtatatcttccaaattgacagccgcgtgtgctagacgttttatgagtttcacaaatttatccttgatctcaaaaccaacaacagtgaccaacagcagattgtagtgcctgaaatcagaatcaatgtgccactctatattgtttttcttgcagtacagtagcttcctcatgacatccgctgctgccaagctgccacaagagtgctctgttacctgtacgcgacgcacgacgacaaattgctttagttgagcatgcccgtaagttttagagacgacacatgtttaattgataatacatataaatatattattccttctgtccaaaaatataagcattttttttaaatagtgacaagccaaacatttttaacttttattattaatagaaataataataataataaatcaatcatgtaaaattgatattactagatgtatcattaaacaaactattataatatacaactatttttatttaaaacatcttagggcctgttcattttgataccattttcaaccttaccaaattttggtaaagttaccaaaaaaaagtggtgacatttagtttgctgccaaattttggtaactatataagaaatcctgccaaaattttggcaatgctaaaatttggtaaggtttttttatggcatcaaagtgaacaagcccttatttttatatatattattggtcaaattagcatctcggagacagggttagaatctaaaaatacttatattttgaaatagagggagtagcaattaccgatatgcgaagctcctttaagaggggtgcagcttctaacacaaacatcgtccaaatgaggtcacattccttgtgaatcttgtccaaacatgcaatcctcagattgcggagaagtggagccagatgtttcgggctttcaggttggaaccagatctgcacaaaaatcagtcaggacgaatcaacaaacgtgacacttcaaacctgaaacagaaacacacgtacgaggaacaaccaattcttttacatgcataccttttcactctcaaaaatcatttgcagtgtacgtatgccggtggcattgacaagaagcccgcttagcttgagagttctgtagttaactgtaccgacagtggagagtactgtccggagctgtggaacatggccaaaaacaagcggaggtagagtccgtgaagggaaccagatgttgttggagacctgaaccagcctcgggagccacttgagatctacggtctcgaagtcgcacgcgtcaacgtcgaggcgaacgagccgcgggtgctccatctccaacgccgccacgttcgagccagctgatgcgtcgcagctgtgcaaggagaggatctccaggttctcgcaggcggcgagcacgttcgccacgtcgttggacccgcgcagcgtcacgctctcgacgcgcagccgcgtgagccccgcgaacgcgcgggggcacccgccgacgagcgacgcgagccgcctcccgttcgcaagcgtgtccctgcccgtgcactcgagggcgcgcttctcgcccctcacgtcgaacgccgcctcgcggaagcgggcgcggccgctcgcgatggcgtcgtcgacggagcggacgatgccgatggactccgccctcaggtagaaccgcacgaggaggcggtcgatggcgtgctcgccgctgcgacgcgcgaggatggctttcgcggcgtgcgccacggcgaggttggctcgagcttctcgggacagtctcgacgtgaaagtgaaaccatcctgatgatcatcatcctgcttctttctgaaggagaggacgtccagtacgatatcgggcagcgcggccgggagatgcctccaccgtttagcgagtatcgctgttcttactgcgtcgcgtaggtcgacacgtttcaggatggagagcaggacgtcgtcaggtagctcgctgagccggtccgccatcgatgcatgcacctagctagctttccacaggaagagatgagattatacttacatacgtacactcgctatcgattcgatgcgaaggtgaagaacggaagatcggaggaagtccggctagagctctctatttaaaggggtacacgtataaggacgtccgtgtcctattcaaattctatgtcgtacagtatacccgattccgcatccgtctcggagattaagtatttctttagagaaaaaaaacgttggaatttgctcccttctcgccttcttggtctcttgtgagatttgggggcatttaactatttgccacttttaagatatgataattaaaaatttatcactcgctatctatatgagtcctcatatattcatgatatgggtctagtggcaaattttttatcaccacttataatacaattggtagatcgatgcagcaataaaaattgggctcgcgcaggaagttacacttaactagtttattatcattttctcttcctttgtttaaatatctttttcctaaattaattatccgatttatgatccggtcataccattgtattcgtttaattaaatatttacaacaaaatatcgtatgattatattttaacaagagaaaaatgtgtgtttcaaatcgttaaaactcaatgttttatatatgataaagatatgtttcagcatgtgcctttatcatgtttcacaaaattcatgcaactaactacaactactatctctcctcaccatccatgtatacatgcatccatttagcgatcttcaaaattatgttcttctaaactatttatctaatctacgatatgcgtgattatattctgatgaaaaaaacaaatatgtttcaatttataacactcaatgtttcatatgtgatagtgacatgtttcaacgtgtctctactgtgtttcactaaaaaaataaatatttcagtgcatgatttcctcatttcaccaaatataacttaatatttcaccgatggttagctgaaatatttgaccgtctaaatttttcaagacataattggaggctcggtttatagtttcttccttgagattttgctatgtctcgtgagatcttgaatggggcgggagcggaattgccacgaacgtgcaggcgtgcagcccatatgtatggtggaacaggatgagatgtacgtgcggtgtgttgggccgtgatcgcgaggaacgtacgtttctaggccgtttgggacaccacgcccggtttcatgctgcatctcctctggtttgtgggcttcagtgacttgtgggcgccgctggcagatttcggcgcgagcatatgggtgacggcctgttaggatcagttttatacggagcatcgacaaacaaaacgaccaacgaatttctgcgccagcatatgggtagccagcaggggcatcttcatcagtgtgataattgcggatctcattttttctatgttatgcttatcaatcaaaatttaaattttcgatcttaaatttatagttgattttgaggtttttcaatcgaagtttattgtaagcctttgcttttatatcgctaagaacacgtatataaaagttttattcgtaaattattttttgtttaccaacgtgacgtttcccttagtatgctatatttgtttttgggctatagatggcaataatgcaggatggcacccactactttgcacccagttgcagcacccaaattacaggcgcagctgacaaagtagtagtagcacgccagaaattagctcagatttaacgcagcacactttgcgcaggttcgatcgaagggattgttattgttactgatcattacatggttcattcaatgtcacatgctccaacagtggctgcatgggggaggaacgagatgaacaacgatgaaccctgcaatttgcgagagcacatgcatgttctgatgttcctttgcctattgtcaaatcggcagggcattaaactagcgccgctgtcttgttgacatttgccacatgacaatgtatatcacagcacagattatcgtgcaaatgtaaggcggaccataggctgcaactatggcctggtttagttaaaaaaaagttatatatattttttttatacatgcatggagcattaaatatagataaaaataaaaactaattgcacagtttgtatagaaatcacgagacgaatcttttgagcctaattagtctatgattaatcataagtgctatagtaacccacatgtgctaatgacggattaattaggctcaaaagattcgtctcgcggtttccaggagagttatgaaattagtttttttttattcgtgtccgaaaaccccttcagatatccggtcaaatattcgatgtgatacttaaaaattttcttttcgcgaactaaacacaccctatatattgtagtactgcaagctctgcccccgaaataatactcaccagatcaccaattgaccgttccttcccttcagctttgacccgtataaactgtgtataagatacgtattggctgcacaagaccagagctgcagaagaaatacagtaaattgtattagtactagtagcgaccaaaggtccaaagctaggtagcatgtggacatgtggtgttcgcagcgacccaaatcacatctgcttcgcgtatgcgtagtctcgtgacgccgtgatgctgcaatttttgctgctagattcgcacagtataattgtactcttcttgcaggcattgtcgcgtatttaactcatcagctgccactgatactactctactccactatacttcagctacgcattcaactcgaccgttttggcgatcaatgcgcgaagtttttgcagctagacgacgccgcagagttagagggggagattaaaaccggttgggtcgcattgcattgcatcggattccaactgaccatgatgcacacacctcagagattcagagtttcagacttcagagagagagagagagagagaggaggcccaggctctgagcgtcttcggtacaggcacatggatgcgccaaatacgtacagtagcactcatttaacaactcatccgttggtcgttttcgctttgcaatactctgccaaccgaccaaccaccaatcagaggcgaccaatctcttcacctaaaagcctcacacacgcagagagagaaaaggtgatttctgtaccacctagccattcttcctttaatccttttcaattgttccattcttgcagcagctctgcataactcacattttgccactgtaaaatgtgttcaaaagtggagtacatagtacacgtgaaatgtgcgagaaggggacggggaaaaaggctcattttgttggacagaacagagtaataacagaccaatcaattagctgatcatatttcattgtagtttccccgatcctaccaataacatcataatatatattttggtaggaaaaaaggtaaaaaagcaaaaaaaaaaagatgttgcagcgtgcagtagaaagaaagaattattttgtacagttgtagtactcttgtaacatcatcatcatcatcatatggcaatgaatgagacagcaagattggttggttgctgcgctgcgtcgccctgccgtgtgccgcggtgctcccggccggccggcagagcggaccaaggaaagaatcggtcaccgtcaccatcaccggcgacggcagcggcggcggagggtgggtgggcgggtagtcagtaggggcgcatgccgacgtagttgccgggcgggtcgtagttgcaggtgatgaaggtgcccctgccgttgtaacaggcgaccatggcgcagccgacgcggcgcgtggcgcgccacatgatttgggtgtagggcccgcacatgccgccgtaacaggtgtggctccagtagttgtaccgcggttgttcggcgagccacccccccacggcttgcgccggcgaccaacccgtgccgctcccccagaacaggttctccccgtacggccccgacaagtgcaccagcgggcagttgccgcgccggaactccgggtaccaccgggcgtacccggccacccgctcgtcccacaccagggccggcaaccccatggccgcccttgccgggttttgctgccccaagaactgcatcctgtagtccccgccgccgccgcggcgtggggtaggcgaccacgacgaaggcattgccgggaagaagaagcccaatgccgaggagagcaagggcaatggcggtggaggacgccatgggaggcaaaatgctgagctgtggatttgcactactgccactaccagtctaccaccaccgcgctagctcaaggccgtatatatggactcgacgttgagagtaaaaaagccattttttagatgatggtgttggggacaggagccatgttcgataatgattgcgccacacaagactatggaaggcaggtctacctaaatgtgcttccgactagaataaaattagcagttcaattatgtgcaggctgcgccgagaggacgaactgattagcttctttgatttttatggaatctcgaactaattatagtagttagttctatgcaggtcagagtctactccagcagtccagctaatttagtcacagcattcattccgttaccgtttggtaattaaaatcgatgccaatttgttcagggaagtctagctctttggatgcaagagcagaggactgaaataaaactgcaccagaattatttttggtgagttggattcatcatgacgaaccgcctgacttggcctgtagcaccgatcgtgccacggcgttttgctctcgaaaagacgctatactacctctttacaactcacattggctgccaaatgacaacacagtgacatacattgatagccagcgcccatcagacagctttcattgctcgaaaagaattactactagtgcgtacagctccattgttaattagtgagtacttaattaaccgcttgtacttcgtttctgaattctgaactatgctgtgaactctgaaagtcaagaaaggaacagtggcaagtgcagcttttgcagttaacaacgattacgttataatctaatcaataaatctcagaggtcaagaggtcagtcgtggtaaaacaccatgtgcatctgggtggtactaatttaagtgatcatcacaacgttgcatttgcgtcgcagatttcgtttattttatggcagaaacagatgccattatcactcactcattcagaactgacctaccgaatagccaggaatatatacgaagaatgtattggcatggtttggaaggtttctgttggtatgtacctactgatgaacaacgtgccaatcactgtctgtcaagaactatgcccaatatgcggcgaaacaaatggagctgatggaaagacttttggcgtcccctgcactagctaaacagaaaaacagcatgacaattttgacattgttctctggagtacttgggtacgagtgataattgctttgggacagcataacaaagaaggatggaagataattgcagggttaggagaagacagctcagtgtcgggtgttcagaatttgaagtgtacagttcagtactactacgaagttgcttgttgtacacattatcacattattgccttgtctgaaccagtgtaaactgttccctcaatggatgtcttgacaaacgctgtaaatgtaaaatgtaagcttgcaactttcagtcgccagagaaaaccaaggccaaacatctcaacccggttggatttacgccttccgtttttttttaaaaaaaactctaaatatgaatctagacaaaagtacttattcagattcatagttagagctttatttttcttaatgacggagagagtatattagtaccatagattatgtacttaattagattaacaataaaaaacaaatttaacaataggctagaacaagtgtactacgtaaatccattatcttttaaaaatagaacaagtgtactacgtaaatccttattgaagtcaactttacacagctttgactaatattttaaaaggtcttcttatgagaaacttgaatatacgattttcctatcataaaacctatactttgcgatgatttttatgcttaaagttaactcttgttaactggtattctctccgtttcacaatgtaaagattctttaacatcaatataaatgtggaaaatgttataatgacttacactgtgaaacggaggaagtacgtattttaaactagcttgttttttttaatcggagggagtattatgcataactgctgcaagacgaccttgcaacaaaattccgttaaaataaccttattattttctccatttggcattttcaccaataaaatgaatgacaagaagtaacaaataatcagcggttcctatacatatacacatacacatatacacatatacatatacatatacatatatatatatatatatacatatatatatatatatatatatatatatacatatatatatatatatatatatatatatatatatacatatatatatatatatatatatatatatatatatatacatatatatatatatatatatatatatatccgctgaacaaaagatccccgtgaacaaattcaacacaaacctgtccaaaacaacacaaaacaaattcaattagccagcaatcactcgtgcacccaaatcacgtctcccctgcacactgtacgtgcgtgcgtgtcgttcacgggctcgatatcgatcacgtcacgtcttttcgctagtacggcctcacgccgacgtagttgcccggcgggttgtagctgcagacgccgtacgtgccgcggccaccggcgcaggtggcgagcgcgcaccccaccgccgtggtgcgccgccacaccacctgcgtgtagtgcccgcacgccgcggcgtcgccgccgcggcacgagttggacgccgcgtcgtacagcgcgcgctcccgcgacacccacgccgccaccacgtccgcgggcgcccacccgacgccgctgccgtggaacaggttctccccgtacggcccgtgcgagtgcaccagcgcgcaaccgccgccggggccgatccgcgccgccgtgtaccgcgccg

SEQ ID NO: 20039 - DNA, 11224 bp, Oryza sativa
  unsure (1)..(11224): unsure at all n locations
caccgcgaacgggaggcggcgagaagccattgcttgctcctaattaagtacgatttttttcgcttgatcgatcagatcaggcgtgatgtttgtgttacgttcgtatttatacgagctggagtacgagagtttttggctgggaaagtgcgtgccagggctgaaggagtggcgttcatgttcgataatggttggcatttgtttcaaaaaaaaaagattatggttggcatgcatatataactaagcaagataaagtccaagcaagctatatatgcataatttgatttgcgtccatgtctaacatatcaaagccagctagattttgtcgcacgatggattgcgacattttgggcacaatatacgggcacgtcgagcacgttacgtattgccacggccctcatattgcgttgcacataggacatctggaactgggccgcaaataccgtttcggacatttagcaagaagggccaagcgcttcccgttttcacagtttcggtccatctagtatgggctgaacgtccgtctcaatcccgttacggcccatatagtacctcacgttgcagctacggcctgcatactggagtatataataggaaaaagtacatatgagatccctcatcttatcaccgaattataaaattgtctatgtctcaaccaaaaaccaaaaatatatgatatctctcaatttacaaaaccagatcactctgcatccttaggtgattttaaccgcggttttgttcgacgtgacggctcagtatgagacccacatgaacctcacatattagggtgaccacatcatcaccctttctccttcccctcttgtactgagccgatcgcccgatcgaacgactgagaaagggtggacggagcaaattccacctacggccgtgtttagttcccccaaattcctaactttccatcacattacatcacatcgaaaactttcatacacacaaaaaaactaccaattttttctccaaactatcaactttttcccaacttcctaacttttcaccatctaaacacagcctatgtttacaagtttcaagcaactcgatcagccagcgtgcgattttgtcacaggttttatttcgagataaagcacgcacgcgtgcgacgtatataccgtttccacctactgacctacaggtaggtatactgcaggcaggtcggtcagtcagaccgcccgataatgtgttctgaatcttaactagagatgcctaacaaaacagttctatctatcgtcagtacagcaaaggttctcaaatcagccctgtaagcacgccgcaagttcgccatattgacgccaagtcgccaacaaatagctgtctagctactgactacatactttgaattgaacacagcaaattagcatgcatatatgatcgatcagtatacatcaatactactattatatatatatagcatagttgcatagggcaccgtctctggaaaccgagatgatgtagcatctacacaagaacaggactaccattggacaatctcatgctcctagggctaggagtatatttttgaatatgatgagagccatgcataattgcatatagccatatttttttttcacgaacacgcaaaataattgcatgtcaatatattagaagaaaaaaatattttgttacacaatgcaatcagccagaccggcttatgccaaggaaaggaaggaaagcaaaacaaaagctgaagctaggaaaaaactactacggtggctaaacgcaactccgaatagcgggaaggggcagagccacgctacactcacaagaaatcccagaagcggcaatgtcagctaaaaaccacaaatggaccttcgagagcacagagtaaaaactctagagtttcgttcctttcacagctgccaagagaccaggagtaccacatatggctatatctaactatccaagtatatgtatgtattcatgcatagacacggagattgaattaatcacacatatgcatgcattttatttctgtgtatttcacactcacatactatgtataacatcatcgatatgatactaatgctcatacaaaaaacatggcaattaaaccagtagtttaatttaattcacatacatttatatatatgtattaacagaaacgttcaagatcaatcgaaaccgagcgtacatatgcatattatctcatataccaactagctatcaattaacaattggatccatatcactgaatgtaatatatatatgtgtagctagcacccaacaccaaaatctattattgatcataccctagaacgtaatcgccggcgccgcccgaaccgtagtcgcaagacgacgacgtccacgtcgagaacttctcgtcggcgccgatgatggcgctgccgtccgggcactgcagctccggcaacgacgaagggatgatcccgccttgcgctccgccgatcgactcgcacttgaagaggaagtcgtatagctcgtcgtggagaccgtagccggcgacgaacccaccaccacccgccattgacgacgacgaggtcatctctacaccggcgactcccggcatgtagttcgaaccggtcgccgccgcagggtcgaggtgctcggcggcttggaacgcctccgacgtggtggcggcggcggcggcggcggtggcgagggtatggccgccgacgaccaaatgatgggggtgttgcacggtggcgacgacggcgtccgtcggctgcacggccgggagcggtctgctcggcagcagcgcctcgagcttcggccactgcggcggcgcgacgccgacgccgccgccgttgctgctggtggtggtgcagccgaacgcgctgttgtagaggccttggaggcgcatgtggagctggatccgctcgagggccgacgagcttagggcttgatgcggcggcgccgccgccgccgcggtgccgacgccaccgcacatggcggcggcggcgctgcctgctagaccgcagtggtcttggtttgcgcgggcgcggcgcgacggcgcgcgcttgccgaggagcttcttcttcagcttggtgttccagtagttcttgatgtcgttgtccgttctccccggcagctgcgccgcgatgatcgaccacctgtgaatgcaactagcattagcacatctctactaaattatctagattttttagggagattattagtaattagctagagtttttgttttgttttgttttgttttgataattaatagctgaagttattaatagtgcatgccatgttttagtaagtgatgcatgtacgtgttagtctctgagatgaaaggggaaaaagaatgaggaaagtagaagtagatagagaggtgtgtgcatgcagttatgtatgcacatgcgatgagaggacaagttgctaatatggtgattattacctgctaccgatgctaatgtagaggctacaaatgatgtgctcctcttcttctgtgaaatcaccatgcttaatgtttggccgcaggtagttgagccatctgagcctgcaactcttgccacatctcttcagccctacaataatcatatgcaattaatatactttaaattcatttgaattatacagcacccaattgcatcagatcaggagacagaaatgaaatggtctaggatagacaaccattagctagtactgcgctccagtattcagagacaaaaataagaggagaattgaagggctatgcatgcatactactgaagatcaacaaatacaagctagctagaatttaactaataactaagatcaaactacttggcatatcttccagtgtgctagacattaacagactactcaagtttaggttcatgtaattatcatgtgtgcttcaagctgatccctcttaatttatcaggaaaaaaaatcaacttgatcccctttgatctagatctctcactccacgacaaacaaatagggcaatctacaaatggatgatcatgttatagttcaccccttttagatcaaaagtctacataaactttaccttctattagtaaaacagccaatccaccatacaggtgatacaaaagagggaaaatagcatgtattagatgcatctctaaaaaatgttttgctttaatccccaatttagactcaatcacacaacaaaaaccatactactacctatcaaaagctaaacatatggatgattaacttgcactagcaagctagcaaccacctgtcataaccaaggaaattaattgctagcaggataaattagaattcatgaaaacaaacccaatttttgctgggttagcccaagattaggctgaccaaatgttaattgaaataagaagggggctttgtgcgttacaacatctacataaggaagaccaaacagcgcggtcggtgcccagccctagctaataacacacaaatcagccactagagagaagtccagaaacagcaaaatgaattgaagaagcaagagcaaattaagctaggcgaaagaacacaaggtaggagaggagtatatatatatatgcgtgcttaccgatcttctgcggcagcgcgatccagttgccgccggtgccgttctcctcgatgtaggccttgagcttggcgtcctcctccggcgaccacggccctttcttcacgctcgccttgtcgcagcacggcgccctccccatcactaactccttcgaattcttgatttcttgctgctcagctcgatcgtcgtcgccgtcgccgtcgtcgtctatctcagcagaagagagatctagaaccgatggatcgctagtgcctgacgacggcgacgatgtgtagctagctgctgcggctggtggtggtggtggtggtatggtgatggcgtgtttggcagcagcggtgagcgggtgcatctggggttgtggccgggctggctttatagtaggtttagtagatggatagctagagaggaaggaggcaccggacaccgggagaaaaatacgggtgtgggcttgtgagaattgtgaatttgtgaggtgatgatgtgacggttggctccattatagggacaccgccacattattttttgtgtgtgtttgtgtgtgtgtgtgtgttgctggggattaacggacgccgccctaccatgcagtcaagtcagacatgcactcaccaagatcttctctgccaagccaacttttgattattacgctagctgctgctgacatcggttaattaattgatttgcactagttaaccatgaatacttacaggtgtgtgtcctctgaaactgatcttttatcagtatactgcaaatatcaatccattatgtttagcaaaatgcgcatgatctattacaatggtactagagctaagtcatatgactaaatcaacaatagtgcattgatcaacacggtttatactttatgacatgcgcatgcttctcctttttaacatgatcagggttgcttcatttttttttccaataaaacaaaactatcaaaggcaacataggtaaatggattacgttcattgagaaactacgcgtcgacgcatatggacttcattgaagtcatcgggtgcatatacgataaacaacacgcgatgatcctgcaaatacgatgacattagcacactaaaaagaaagtcgttacatattgatatggaacgagatcgcttgcaagtagtattacccactcctaagagtaaaagcatctccaacagcctctctattcctccaagccaaaaatttagcaaatgaaccaaaaacactccttcaatagactctctattcgactctctaagccaaatgcctgtccatctcaacccacgcactggccaatattggccagcctcccagactggctatccttctatccgcctctccctgtatccatgcttctcctctccctctagctctgccgccacaccggctctcaccatccctgctgagctcccccgtatcccctcggttgccttgtcatcgtcaccacctgtgggaggagcatcgtcgccatcgccttttgccgtggccgccatccacagggaggagtgctgccttccccgaccttcctccgcacccaccatcccctaagctgaggagcaccgccgcgaccgccgccgttgacagccaccgccgccagccatggccgccgtcatttgcgtcgtcaccagccatggctgccgtcatttggaggcctatgtcaccatgcaacccctgccggattgggccggccgtgcgacctccagactggcggcgtggatttgaccggtcatcgtcgaggtcgtcgttgccgaggtcgtcatcgcgagccgccgccgccgccatcgccagcctctggatggtcgcagtcgcgcgggatgtgtccgagagaagaggaagagggagagaggaggaagagggagagaaagagaaagaggaggaaggagtagtagaggcagacgtgtgggtcccagtgtcataggctcataatggatagtggctattggagtgagaaatgagtttggcttgccaaatcaattggacagctggctatatgggtgtttggagagaccgatttagaaagactgttagagatgctctaagtaggggcacatatgttagtcagcagtaccgcagatccagtgtcgttgcggacgtcctgtgtccttgttgatatatatgcccacttattcagtgtgcgcaatggatcccagcagagcatgcatgtcgatttggcgtgtgacaaaacccttccaaacgcatgccaatcccctgttccatgcatgcctacctttacccagatccgtttctttctccctgagttcccaaatccgccattgacaattcctccacaaaaccaccacctttttcactgcattcagcagctagcagcctctccctctgtcacctttattagcctcagtgttatgccgggatcatatgagccttcaggagttcagacctaacattcgtggtccctgcaactcttgtcaaagaaaaagctttgcttaattattttgttattatatttaagtagctaatcaagcactgcacagatgtcgtgttggctggactgcccatgaagccacgactttcagggtttcatgtttgaaattctgcctctgtctcaggagttactgtttcaaactagtcattgactataaacatgagcatagttaatggatggtccaagcagatgtgccaaaccgatgaactattagcagatgttctcaagtgcagtaaaccttgctgcgttaaacacgtctactagatgtgcacgtaatgatctcatcaccatcatcatctgttatatatttacctagcttactatgtgattacatatgtagaacttgtgttttctgtatacgtgttgcttcagaattgagacagaagaggttaattttaaatttatctatgtatatatgactgtacattcttttcataaaaaagaacaattaaagctggttgtcaatctggtcgtagaaatcttctcgatcaaacgcgtcactatgcgtggttctgaaacggaaaaaaggccgggctgcctgcccatacgtcaggcatggtgaatccaagttaaggttcagagaatgtaccaagaaaagcagagaaaagctatctagttaaagaacatgcagactgaaagagaagattcagaagaaaagttgagactgaaagaggcaagaactctaagcgaattgaaagaaagaaacgtgtacatgactcggtcatttactgcaggcagctaccaagacatggggatatcaatatgcacatatggttttcttttcttccatcatcaaatttatcaagaattttaatttgcatgcatgcatactgccaacatctatggtctcccagctacagatcaagagctcatgcatattcttttgttttgaccatcttctcccagtcctccatgctgctgttggctgcttgttttcttgtgccacctaactaacttggaaaacttgttcatctattaaatgccatatatttgcctagctatgtggatagtgctactctgctcttctaccctagatgtggcaaaactcaaaaaggggggaaataattaacaataatactttagtatcaaggttagctgcatgtaactatcactgtaattcagtagataatatttacagtgatagtatatacccaacaactctctaactaactatgatcattggacagcgataaaaaataattaaccaacaaccatgcatccaagtgaaggaaatttttgggagataactaacttactatggcaatcaatctcttaaaactgattgagttgaactagctagctcactcactactgtctagacaagtggcacaaatgtccacatccttatttatgcaccatggaagaagctccaaacaggaagctgttgggaattaatggcaaaaggctaccactttacattgcatattgctaatactaaactaataccaatcacaatgccgtgaaattgagccctcacatattgaccttgatgattaatttgcctggtcatcgacgtaaaaattaacaattgattggtcctaacgaagtgtcaagccaccgacaggtggggacaggccaccagagtggagcacattagccccactgtcagtgactcataagacagcgatggtaaaactagatggatgcaatagagccaccacctttttctcaaaaggcaatccaagttaatcctgatcaagtccacaggatagactttattaacctaaagcaagatggcttaaaatatgcaacccttcataagctagcaaggagaaaggatggaaggagtcatttggtattttcctgcttgtcacttcctacaaggtcatattcccaaaggccattgcctgtcatcagcaacatgaacagttttaaattttggccaaaggaaaagagatgagccccagggaagaaaaagttgggaaaaggggggaggaaaggcagtgggaataactggatatctttgctgagcctcattggagtttagcatttgatcgcatgcatagtacttgaccttagaggctgtaccccaaaacaaagtacaagagacgctatgaatgcatataataaggtaatcagtaaagtggtaatgaaagtggggatatggtctaatttgtgccacaatggtgagagatttttcaagctggctcgatcaatcactcgatccacggtgacgcaattcaagtaatgaattccatcagattcgaagatagagctatattatatccatcagcggtgcgatcgttcaacacattctgtgtcatatagggatattacggttccttcacgtaaccgtaaattagatggtcaagataaaaagaccttgcaatatcgtcatttacgcggactgaaaattttttgcgttcatcctggctccgagtcggtcgcacggcacaacaaatagacgataaaaaaccttgggtgtgtttagttcacgtcaaaattgaaagtttggttgaaattggaacgatgtgacggaaaagttggaagtttgtgtgtgtaggaaagttttgatgtgatggaaaagttgaaagtttgaataaaaactttggaactaaactccgccctcatctaggaacaaaacctcacagcacctataccatccatgtcctatcaatcaattgtccataaccgatctgaatgttttttggttgctaccacatgcctacaatgtccacttcacattggctgatcatacatccccgacaaatgaatgacaggagattggactgcacatcaatccagacaccaatctgtcgtcagggccggttcaatttcccctccattttcacctcttatcattggcaaatgatggcaaattggcaagctgctctgctccctgccatttcactgtctgcacatagtgaccaagttcatcaaccaaagatatcggttaacgcaagaaaaacaaagaaagttagttagtgagtgagagtctcatggatatcttattcattgcttcagcttgaagcacgcatgacacatctgttttgactagtagcaatcactgtttcttcctatcaaacttgttgcttgcacaaatctctatcagttgtggtactgaaaaacagggtgcctcatctctgtgtattcagtattaaaatccttttcagtttatttgcattttattactgtgtcagctctgcaaacctattggcgatgctgtaagctcgctgacgtcagccctgaattgtggaagttgtaactgtcatttgacatgtcttgatcagttcttctactactagtatgaattttgcatggacaggcaagttgttaattagtggcaattgtttcttgcatttatggatgacaacctagctagatagctagagaaaaaaaaggagattaatcagttgcatgtgtcagtgatgaaaccgtgctggtcctgctggagaaatctcagttggagagattcccctcgttgcgttgctaggacagagggatttgattaaattgataagaacaggagaagaaaaaaggttggggctctagcttgttgccatcgtgtcaaattctgccttttcagatacaaccaacggccaaggccaacacatgccccaatattgaattccaggttttctgaacttcagagaggattaggatgtcgcaaagcaggcaggattcaagaactcagtatctttcagcatttgaaatttcaggcctcaggttcaagttagttaccgccaaatcgaaaaccggaaatcttggagctgacacgaaacacctctgaaattgtaaactttttaagacatttgcaaaggagatttgtgataccctggacctgaatagctgatatacagttcagtttagattttagtatactgacgagccatttgcaaagaacaacatggaaatccttagctgacaaagaatgcattttccaccacaaaccattattgataaactggctaggaacttgccaaccttctggagctattctaattttgggatctaaaaccccctagatccatgatgactcatgaaatcagaatgtcttgtactgaaggtaagcaagcctcgtctctttggagctgtcatttctatcagtttaatagtgcatatgcagcgcataacgactgccatggatagcaaggccactcattctccagacatttntntgcctacatttattccgagccatgatttcacttgctttacacctggcaaacgcaggcaaaaatcacaataaacgcacaccaaaaggaaacaagtaagcactatttaaattgcaatcaatcaactgcattgtcaattaattgtgaccccgcatgaaccctagctagattagagctaggtggtgtgtctgaaggaggaggagaagaagccaa

SEQ ID NO: 20040 - DNA, 1607 bp, Oryza sativa
atgagcaaacaggagaaaagaatgtcaagcctaccctaaagaagctccatatgaaccatgcttgccctaaaatagctcacatgcctatgcatataagagataagatcattaaaaaacagtgttgtatcataatttagtgtcactgtgtgtgcaaaggtcaaaatatactagctgagtatatgatttaaaacagagatagaatcaagatgagaattcctggcgtggtagcaggtgcagaaatcaagagttaaattttgcttaaaatgcgctacacaaagaagataagagatgaaaaggagaaaaagaaaagggcaggcaggtatagcaaatgaatgctaggaaatgaaatgagaatctcagatgttctgaagagacagccagcatacaatccatataacttcatggagcagagccacctaaacaacgtcctccattaatactgtattgcgagcagaacaaaaacatggggtctactgctttaactgtcaagataaacctttttaatctgatggccgacaatgcaaaattggcaattaacttggttggaggaatgacaataggaaatactgcgagtccattttgacaccacatgattgatgccgtatacttattatacgatgaaaaggatggatttatgatgaagaaaaatgctagcaactcttattatgaagagttctggctcagaatttctcccaattatgaagagattgttctgggaagatatttcatagcaaactacgctgtcaaaagatgaaacaaagccaaggtcattttaagcgatgcaccaccactattgacatccttcagaaacatcgacggattgattggcacggaagaataattgcatggacccaggaggaatagtgccactgatgatctatacagggaagaaccatgttgcaagtgacatagaaatcttattcgtgagctatttacaatctgaataaggatatctctgttcgagttgtcccctctttccttaggacacaattttgtgcaaaaagataactgtgtccaactttgaacagtgtctactactgtgcacatctaacatgtgccagccggaagaagcaagccgaagcttatttacattacatttctatttctatagttcccgtccagaggataaggtatatagcatactgttccccgaggaaggcaaacgacagctgatgattccaggatcgaaaatccctgcatcaagaaatggaaacttcagcaccaaaatcatctctggatttttatcagagggaccaataaaacaagggaaaaccatcaactcacattaaacttgctctggaacttccgtgatgaaatttttttcctccgtgtaactcattagattaacaattgaactaggataaactggaatgctgcaaagacatccatatcatagttactccatagaatcttgttctgagtttgccttcctcctgtatcaagggaactggacgtaggaaactttgcatggcttgtgaacctttacttcacattcattgctgcagccatcttcctcaacctttgagatatttctgtgaaggatggtctatctgctggttcactggcccaacagttttccatcagtgatttccattcacgatcacacc

SEQ ID NO: 20041 - DNA, 25510 bp, Oryza sativa
aaagaacaggatatctcatctgctagacggcaactaccacatccaagttgagcaccacgatgtatgcaaatttaacccagttacctacgctaacatgtttttaacttcagtatttgataattagtataggcacccataacttcaacacatatctgacccatttccgatagttcagcctacacaagcctttcaaaattgtttccaaaaagcatttgtgaaaggaatggatcttctgcagaacaccaaatggcatgcgctaaacatgaagggtggacatgatggaattcgcaatcaggaaacaagtcactgtgataattgataaagcttactagtggaaattttgaaaattaccaataatagcagcagcacgcatatcagaatatggttcttcgccagtaagcagctcccacatcacaataccaaacgagtatacatcaatctacaagtaagcgccatatcagtttcagttggaatataaaaaatgaagaacattagttttaatgacttatgatccataagggtgcttataatttataaagccagtgttcttaccttctctgacaccatattgcttttcccactcagaagctctggtgccatccatggtaaggttcctctaacaccgccagacaccaaagtgtgctgcttcacctttgatagtccaagatcaccaatctgagcagaaaatggaggtgggatgacagtcaggtaacaaccatttgaagcaagagctgaggaaatgaagatgagagggcagggatcaaactttgcagattggtcgttgtggatccctcatgttgaccagtaggttctcacactttagatcaaaatgaactatattcttcccatgcaaatattccatgccaaatgcagcatccatggctaatataactcttttacggcgatcaattgtcctgtgcagttgctttaatttagaatttggatatttgagaataaaagaatcatagtgttctttgattaaacaagtaatacctgtctttttttctcaaaaactgtttgagagatccattgatcataaactcagtaacagttgctaagcttccatcaggaccgtcacgaactacaccataaaatgaaaccacatttggatgatgaagtgaacttagaatctgagcttctttccagaaatcagcaatctgcaaaaccacatatatatctgaactagagatcttctccatagaatacacaaaagcaagaaaatcactatccagagggttttaacagaaatctttaacaaggaaaaaaaaagctatgaaatcaatcctaaaagttctaaggtgttaacaagtcaatcaagcataccaaacgctctctctcagatggtctgccagcaaaacagctagcctttatccttttaatagcaacatcacatcctctccatttaccatggtaaactgcaccataagtacctgaacctagctccctaatttcctccaagtcatcattttttatagtctgcatgatccaaacagagcatataagcgggatacaatgttgaattaaaaacaatactacatatcaagagatcagaaaaaacacctgtagtccttttgataaagcttctgcttcagcggttgtagcctcaattccagaacttttctgctgctcaccacttccatgcacatcagaatcctgatctgtaccagtattctgcacataaaaaggattttagttaagagcactaggtagctaagccagtaatgtgtaaaggtcaagtattacttacaccagcaggtgtctcctccaacttctttccattgccttcctcatcacaagtcggcaaaagagtgggaccagcatcttgttgagccttttctttctcttcagaatcttctaatgcagccttcttaacagatgcagccagctctggaaggaaattcaatctatcctctgaaatatccccacattcctgcagtgctgtagcccctccttcatgcactttacttgtgacagtttcatattcgacaggcttcctctgtttgggatcaacttcaggtacaactccgatatggtgggtcaaggcacttggatcattcatagcatgcaaagaagttgtttcattcgcatttcgggtaaacttctcatgctctggaccttcaagtttcttcaatggattgatatccatcctggacaactgatcagtgaggggtaatgcagctactctgcatcaacttgtgatgatagaacagatcccccgcatgctctttcaggatgaatctccatcagtggagctcctggttgattttggactgattcaggggcaaataaaggctgaacatactggccactgtttggatttgaccggttttctacaacagcagggatatcatgtccaacaactcgatatggtatgcttccattgggtgagggccatgggtttgggattctatcatatgcaggcatacctggaatccgtggactaacatcacctgtatttttgacaaagttgccatttggaattggcaggtgtggtgattcatagggtgaacctgtatggacaggactatttgttctttccctcaaagattgaagtggtggcagattttgctgcatttggtaaaaggggtttgcaccatatgttgaagagtggctataatgctgacctgtagatttttcaaattctggtgtctggacatatggcccaccgactccaacttgttggttatgatatggatcactgacatggtcactactgccatgaaaatagtgcggactttcatggctagatcgactgagagatgtaactgagctgttgtcaacaatgtatggttccatcgctctagcactaccaggcatatgcaaccttggatcttcatatcgctgatggctttggtttgcatgtgcatgccaagctctatcatgagaatgcgattcgttataaaacatgggaggagggtgaccaccagtctgctctttgacataaacaccattttccagtctaacatcttggtttaatacaaaacgctcaccagggcggttgcaatctggacatgaattagtagggtgaccagaatactcatttgtcatgctcgtttggtcaaaatgttgaataggcctccaacgaggatccacatatcgaggatcaccttgacccttatggaatggtgaacggcagtgatcatacatactgcttccatccaagaaattgccagggcgacccaagttacctgggaagcctgcgttttgctgaattacagcgcctggaggaagccagaccaaattatccacatgctgtggtgaatgaacctcataatgccgatattttggcgaatgccttacaaagtcatcaggaatcctctcatcaaaatcttctgctccaacttgaaaccttggtgaaatgggaaaatctcgaggatcatgcactccatagtgccctggagagatatatgcagggctccaaggagaatccatctccccatacctttggctatgtgaagggcgaggaacattcaaatgccgcagaccagcaatatcaggaattccagactcgttgcctccaataccaaagagctgctccacggatacaggagaggaaggtgttctaacatcgccgaggctattaagtgcatcaacatacctcctctctgtctctctctcatctccattgtaatggacagccgctgctgcggcctcatcgtctaagtgctgtgagaacaagaaaatcctcaaccgagtaaacccctctcctgcagcaatgagcttgtcgtactcctccatcatgttcaccacatcgtcatcgttaacaaccgagaccagggcatctagatcctcatcaggttgctggtacttgatgatatcagcatcctcatagagctcacgcatccgcgctgctaggtcagtgtaggatacatcacgcggcagcataacaatcctggtctcgccgccgacgtaacgcagacgcccatcaagtgggcggggcaggatgcttcctccaaagctgcagaggaacttggccatgcgaggggctccatcagcctcggcgctgcctgcagagacgctggcaggggcagcagcgggcgccatgcgtgcggagactgggaaaaatgctaccaagttggggtgatttgggtgaagtacatcacacgattcaaatcaaacagttggtattcactttttttttttgcgccgattagtctcttcctgaagaacaaaaaaattttaaaaaaaagattatgaacacattcaagaaaaaaaaatctccatcttttatcagaaggatacacaacaaacactcattgaattccaacataaccaacaaatttctctcttttttgtctgattacctcagatcagagtgaaagatcgcacttcgatccacaaaagatgaacaccaaacaatgcaaaggctgaaaaaaaaaactctgcccacaaatacctgatataaatccccaaaacaaaaaatcttgagacaagctgaatgcaagcacagtcaagaaaacatttcgatgattgcaacaccgtggcaaatgaaaggaaccccagctccggctaaattcccctcgagcacaaggggaacaaaagatcgcaaccgattccacccccgatgaatatctggcgccgttcagcccgcagaaaagaaaaggctccccttttttctcccgcagaaatagggcgataaaaaaggataagaacgaacagaagaaacaaacaaacaaacaaaaatcaattccccacaccccccaagaaaaaaaaagagaggaggacaaaatcagcacacagcaaataaatcgagggatagacatagaaggatgctgctgcggcgttactgcgtacctatccggcgatctggcgctcaagcaaagcgagcaaccaatagcttcggggcggcggcggaggtgggaaaccgcctgaaggaggggaggcagggagaggaggagggagggaggaggaaggttgattcgggcgggcgcgcgcggatattctcccccagagatggctaggggggggggatcatgtcactcgcgggagcgcgagcgcgacgcgagggccatcgccgccgccattggaacgcaacagagagagagagagagagagagaggggacgaaccggggcgtggtcgggtcgggtcgggtggggtggcgtcgcgctcgtcggcgtcgagatgggtcgtgcgcgcgcacaggcgaggcgaggcgtgtggcgtgtggcgtggctgcggcgcgggatcggatcacgcctctggtgtgtttgtttcgttttgtttagggttgggttgggtcggtgtacacgcggcggcggcgggggaggggcgtgtttgttgttcgtttgttcgctggctgcttcggccgtgcggccgctcggtttcggtgtagagaggtcatctcatctggttggtttgcggctggggttcatcttccttccctgggcgaccggtagtgtactgtagacttttatttactcgtatagtgtacacgcatggaaagtatggaacgagtcgtcaactgaccgccggatagtccatccttgcagttagcacttgcaaggatgaaaaatgatgtcttccgacgcgtccagttgaagaaatatttctaactataaatatccagatttatagtagtaatttggttgtgttttaagttgaacaaagagaataaaagaacatcgtttttcacatgaaagcttaccaaactgttaaatggtgtattttttttttaaaaaatactttgtataaaaaggttgctttaaaaattcatattattatgttttaaaataattaatacttaattcattacgtactaatagaagtattaatatatattattataagtttataaagttttgaaaaaatatatcatttaggagtcttgaaagtgcgcttataaaagaggaggtattagtttagtagccttgactttgcattgttttaattagtttgaccactcctgttttataaataaattttgaagtattaaaagtatactatatttaccaaagtatgttacatggtaaatgcatataaatttataaatcccatgcatggtaattaaagagatgattaaaaaagatataggtggtcaaactaaactatctatttagtcacaattaccagggaaggcgtgatggatatgttgcagtatgtgccttaattagaaatatgacgtctccatgtcaatgtatatcattgaaaactgtcattttcggtgtagtactgtgtttatcaacggctattatctttcaataaccaataagaaaaggtcttttgtttgtaagagaggaatgaaagagatatagattagaaagatatttccccttttctttttatcctttatttcttttatttctatggatcaaatattcttttttatggaagaaaaaaaatagatttaactcatattcacgaagccctagatttttgggccgagctggatttgaaccagcgtagacaaattgtcaacgaatttacagtcaaggtgatattcgaacgcggaatgactttgtttggtcgttttcataatcccttctggtaggacatttgccctatctgttttctcatagacaaaatctgattagtgtttttttaaataataaataaaggtgaatagtcaatctaatcacccttattactgattattagggcatgtacaaaagtagagtcagatatgagctctacgttatctagagactagtcatcttacaacagttagagataatatggtctctaaccattaatgtatcaaaatactttttattactctcttttcctttcttttaccaccatgcaacaaaattggctctaataaatgctaaaagtcgactctgacccatggccatgcataacaaccatacccttttcttttttttccatgtcatcaaattaactggcttggcattagagagataccactaataaagaccattgtacatgcccttatgtttatccttgtggcatctaagtgggcccaatgacaactttgaactaaaataaaattttgaagttataaaataggcagattaaaacattaaaagtcaaactagtcttaaataaaacttggagaaccacgttaactatttacccaaatagtaaaatctgattactatttaggcacaacaatcccatttttataaactggatttgccctgcaactcttttcatataccaagtctcgataacagtgtgacatgctaaaaaagtctccagtctctactctctacccatcctttaatcgatccattgcatgtcctatatacgcagttaaaattggcacttttatttgtggcatcacttctctccaaaagcataatctcatgcaaaaaaaaagagagagagagggcatatattattttttgttttttgccgggccaccggcggtgaataaacgacccgaggaattttattaataaaattgacaggtcctctaaacgaacatgactttacatcgtccaagtcaaagcacacagcatgccgggtatatattatctgttgcaattatactttcagccaagttgtaattaagcttgctaacaactaagtggcaataagactgtatatcctttttcaatattcacatctgggaaacgcataaagagagaaccatggaacccatggcaccaaaaagcaaccacaaatcgcatcaggctatgactcagaaatacttatgcttgatatataccgtgaaaagaattggtgagatcacacccaaatttttttccaataatgaaaggagtgagactaccaatatcgttggtattatgctctaaaggaagaatcaaaccatgcgtatctctcagcacaaagagtgataaagagtgttatggaacttaaagatgggcacggagaatatgttcttcaggtttgtctggagcaggtacagaattataaggagttgcttccactaaagaaaatgccctaaaaataatgcttgaataaaaaaaaaaggtgctccatgctctttccattctgtcgtacattccgtcatttctagccgccagctagtatatcctatttctatagaacattgctattgaaaaggacaaagtatgagattaacatgtttcagtggaggctgcatgtatatgcatttatgcatgagtgagctgttttgtttagttaggatatactcctacatcgttccttttctgttcatagtaacatgtttctccaaataggttcatacaagtccctattggccggaacaaggaattcctattctcaatcagttattaccactacacaaaagggagaacaatggctatgtttatgcatttcctttactgacaaacccatttactacaaatatatttccccttttgctttcaaatgtgtttgcattatcatttttaggtggtccctcttaccatgttatcttcttttctcaaagaatgattttatgacttttaagatgtgccaatattaataacattttctaatatgaattttgatacatcttaatctatatttacaatacataatttctgaatttggtatatgtatctctcagaaagggtaaacttctctctcaaaaacaaagaacactacttctcgatcatttttttggagtttatctcacttcttactatgggaattagaccattcctagaaaatttacatgtacttcaatcatttgagttagggatatttttcgctatgtacggtccagcaacttttggcacgtagaccaaggttagccgcacgagtgacgcggcgatattaatttcagagagcccaaggccatcatcatatacacagagaagacgtagtcgcctcgcctcgccgcttgttcatacacagagaagacgtcgtcgcgctcgtcgcttgttgccttgttggcttggctatttggcacggcacgacaaaaacgaaagagcactggtgccgattcccaacaatgtaacggccgtttcgctggcaaaacgaaaaaaaggcagcagaccagagctatctgctgcctctttcgggcgccaacccaacctgtggctgcagttgccgttgcgctgtgtgccgcgtctgcgtttccgcggcagcgtgtgcaagtctcccggagccaaccaaattggtcgtcagctcgtgccttcacgtatccgccatgctatgcacgcgaaccatcctgtaatactgcagcagatggcatatgcgaaactgcaacccagataccacaagctttttggccatttcccctccttaccaatcctacgtgaaactaccatgaaatcaagcaagctggacagcttcttgctttctatttttctgtcaaccaagacaggtgtcacggcgatctcctccgtataggcgagtttccaggcatatgtctccggcgccgaaccaatcggcgccggccatctccgccctctcgagtttagtcacttcaaacatctcgttgtcgaatagaggcaggtcgcatcgcgtgattgggccgcctctttggtctcccctttccgtgtgtgaatgtctctgcatttctggcttctcccacagtgctctccgctctgctcgacgtcggcgtcgcgatcatcgtttccggtcctcaggtttggggctgcgttgcgcgccactcgaccggaatggcagccggatgcttccaaggttgacgctccatccagctcgccggacagcaacggctcggcggacggccggaggcggcaggatcggacggcggaggaggggttggaccacccgatcgacggctggatgggctccttgtctcgcatcggtagcacagggagtggctcagttccgtcctcgcggcagccaccactttacagattgtcacttcccaggtgatgtaaatgtgcaggcgcagcgctagctgccagctcgctttcacgatcgagctgacagtcctcgatgggcattgccaattattaccatcaggaaaagaacaacaaacagcatcatggctttcgatgctcacgagctgctgacaggaaagtggcaaccaaagatatactccattcgtcaaaaaaaaaaaacaactttagacaaaaaaaattatctaggttcattctcaaaagttatctttttttttttttgacaaaggaagtatctgagagcaggacacggtaattctgacaatggatgaggatggccatcgtgacaaagaaaaccaccaaacgacttggaaagtaataaagggtccgtggccagctctgaagggcgtcgagtacattccaaactcaaacgctttcaggcgttagccatccaacatcaatagttagcaatccatgttgatgactattcagaaccatgcctaattgccttaacagggggacacgcgcccacgacacatcagtgaacagtgcaatgcatatggctattaggctatatgctgttgtgatagtgattagctacgatagacagctacgtgtacgtgatactactttttaacaaacatggtgtaattttgaattttttttaaactctatggtgcatcttgtaaatttatgcttgtaggagcctttaccaaagaaagaaagtgtgcgtcaattcagaaatatactccctccgttccaaaataagtacagttttgcactgttcacgttcaacgtttgaccgttcattttatttgaatttttttatggttagtatttttattgctcttagatgataaaacatgaatagtactttatgtgtgactaaatattttcaaatttttcacaaaattttcaaataagacggacagtcaaacgttggacacggatattcacggctgcacttattttaggacggaggtagtacatgatactgccatgaaatatacgtgttacctctgatgttactgttgtacaaaaatacatctcctaatattgtagaataacattctgtatgataaaactttcccatccagggtacgaactaagtattgacctgtcaaaagggccgaggaaaaaacctcctcgagagaaacaatttccccctgcagattcaggcacttcattaattagccaaggaaaaatggcataacaatatcatgaaatgcaaggtagtaagaagcattcggtactgagatgagtgaaaaaaaagtagattcattgataaagtaaaaaaactatctacaataaccttcccaatgtacatactttacatattagtgtgcaaggcatacttacagaaaggggaagaatgcacactccaatctgcttcaacaaactaatggtacaacaatatggcaagtagctgattctctgcaaaaaaaactgccatggcctccaagatgttgctctaaggggaaaatccccccaaaaaatgctatttacattgtattcctgcgcctctccatctactatgtgttaaattaacacaggttaaactgttatccgtccaattgatttcccagtgccatcagcactcatgacactggtctattttgcaatgtaagatcagaaacagatgaaagctcctcctccaaagtgttaagaagatcaaggtactctctgaacacatcatgtgactgcaagttgtttgtaagcaagtcagggacattcttagaaagttcataaaccgtacaaacaagaatattttatgattgtaaacctgtaaggtgatgttatatgctttccacagtcgcaaatcatgtcgaaagagatccaccaaaacctgagaaacaagaaagcatgtgtgcagcaaggatgagtatgcttcttacaaaacattcaataatcaatccatggtaaaaatccaaaaaacaaaatgaggaaaaaaaaccctgcattgtcagatgcagaagcctgccacaagttagtcaaaagaacagtattttctgaaattgtgtgcacaattgttgaacatgtgaaagataggcagtacctcagcgcgtctcaataaagttgctagcacaacaatccattccttaaacttgacagaacacatgtgagcaagaaggaactcagcatcaagccgactttgaagagtgtccatttgaagctgtcatcagaatatcaattataaatgagaacaaagatccaaggcagataataatatcagcgagattgttctggtatattggttgctcaggtattgagtgatttactcaagtaagcactattctatttgttaaacaaacatccataattactaagcttgcccagattcgtaattttatatcatgaacaatcaattcagtacattatcaagctttgtaaaagtacaaactgcaggagaaaacagcagaaaactcgagaaaaataatccaagaccgcaaaatcttatctagtgtgtgatcttggttaatacctgttgtgttgctttgttttaaattgaagaatttcatctttcaggattacagagcattgaattttttaaaagaatatttttttttgcaggcccaaatgttatttattatgaagaaaaaaagtagaaaagctagacatgattcctatattgataggcaagacaaaaaaaaaatcatgtaattttttctttttttacaggaaaatttgctactaaatggaacacactaaataatgcttcatggtttgttaacgagaccttttgtccaatcagttcaagtgcagatgcaaaattctctagtcgagcagaccctagcctttctcgctgaagatattcctgcataaagttataaatatattaataacatgtggttttggatcaacaagactggtaatgatgatgaacagtgaaaatcttaccacaagatcaaactgagttcctttcacaaaagcaaccagcttagaaagctccttgccagacatcaaatagctagcatggttctccagaatattcatgacagaggcaatatgtgggctgagctctttcattgagttactgcacaaagaaagatttacagatgacatattttctaatagaaactctatagccttttaagttaacttcacaatgtaccttctcaaatcagaagattgtctcttgaatggtgaacgtaattgaaagtagctcagaaaccttggagaaagcttttcagagtctgtactggcattttcaaagtctctgccagatcttagcaagaagcgaacctaggtacatgaaggtatccccttactcatctgtggcattttattataggaaattaaaaagatatagcatgaatatcataccagctccccagcaagctcatagagagattcatcaagtgtagcctggatagtaacaagcactaaaaagtgagaactggaaatgtgaaacaagtaaacgtacagatcaaaaccagctgacagtgagaaggtaagagaatcacttgtagcaaacggagtgcacagtactgactgacagcagggccttccagcttcgcaatgacctgtaatagcaaagccattttcagcaatagttcttgcaggtattgatgaccctctgttgcatataactaggttatcaaacttaatagatgaagaaattgtctgttcacgcaagcaataaatactggactttatagaatttaacgtctttagaagagtttaccgtaccagaatgtagcaagcagcagtcctataccatcgccgttggaagcattcctcaaacatcctagaacatgagggatcagttttactaaaagaattagcagaattattgtattgtattccaaatcttgatcaaattgagacactgttggtgggtaagttttgttttcactaaatttcattttgattctgatcatttccatgatacaaacactgtttgcaccatggtataaaagaagaatatgtgaggtactttggactttggagatgtttatagacagaatgaagaatcagatcttaaaaaataactgaaaaaaataaatcaaatgccacttctctccactcaaacaacaaggcagcacacttactctgtggatcgtccagctgcatggaaaagatctgcccagtgccgaccatcagttttcctagcaacactgactacaacatccatgtattctggaaagtttcgaagtaggtcacatgtcttgtctagaagagacttctttgcaggttcatttttctgcgaaagctggttttttgaagcactttggctgcaattggcaaaaaaagccaccagaaaataggatacagaataatatttcagcaaataacacaatagaatgaaatctagcaactcggtacacaaataatgcaagaatgctaccattaccaagttagaaccaatataccttgatatctctgcatcaaataccgtaaacaggagccattccaaacatctagagaagtgaggtttctctgcagacaagtttgccaaacgcagagcttcttcatgtttgtctctctggtttcaaaaattttacagaatgagagatgcatagggaaatgattattgccatatgagtttggcaaaccatgcatagttaatggtccataatacataaaatgatgcaagtagccaagtaaaggctccctgtaaacaggggatattcaaagtgaaaaaaaaatgtttttttttcccaaggctatggttcataatacatatggcttattctatgtgaaaactgtttcttttaatagaaatttcagaatataatatttcgatccctttacagaagtgattgatagaagagctaggtaagtgctagattcgcaacaaacaaaatgtcttgcagcacaactcggcaaaggaagatattacaatatagaaactatatgagaaactacatgacagtgcagtggtttgtaaattgttacaaaagaggatctcatataaacggactaaaccagaggaaagaacaagtatggccaacaacccataaaacctatactcttcttgtttcagcaatgagttctacggaatactaaaaagtgcagagaaaaggtggaagaaccaaaggaaaatgatgaacaaatgcgcacaacctagtgaattggttcattcagccagcagagcaacagaatagagacacctttatacaaattaaaactagtggcctgaaacaaggtttagatgctcaaataacaataaatggtggcagaccactttgggtgctcacgtcagtcttgataagaaatcaggtcattttctatttaaccatgacaataaacaggtttttcgcttggtttgcaccatcacataatccttagtgagaactcaatttcacgtgtaatattactaggagtcaaattttcttgactaaatgaagatttcatgatttaccactcttcttgcattaatgtcatatagttcctatatatagcatttctatataaaaagaattatgttttgatttacctgaaggagatgccgcagcaaacaatgcaatattgtttgggcttgaggagaaggttcaaagcatggaaactctgcagtcgagaaggacattctctgagaaataccaacaactacaccaacatttggaagaagaccaagcggatacacctcacggtcaaattcaagctccggatccagctgcagaaacaaatagcatgttctccattaactttgaatactaccaccaataagagttcaatgcaagaaagaaaacaacatatgaaactattatgattttgatcaagtttttccccaaaaaaaattgataaattcacagagtggatcgcaaaactcaaaagagatgtcaatactatcacaagatacaaaatctgtacctgcaagaaatcttcttgtttaaaaggattttctccatgggatgggtaccacacctgccaaaaaaaaagagaagggttggataaaaggatagcaagatgtggaaagatgttcgatctattaaaagagacaagcataattccttaaaaataataaagaagaaaaccattaaaactaacctgcatccccttatggccatagtcaagccatgaaacctctttgataagattacccttctcttcgtattgggaacaagtgacccaaaataattcaactgaattagtaagtgattgttcatgtccatcatccatgtccaacacagaaagttccccattcatccgcaagattaggcatctgaaatatatataacaaaacaaataaaaattaaggagaatagaaatcatttacaattttaacatttgaaaaaagtaccttgaaggttgttgggacaagtcagaagatccattagtatcatgtttcggctttccttcatcagttggttcaggaatgaagcgcatcgaaacaggtggactctttggactcatgattgaaagttctcggactgttgaaagctgctgacccaaagaaaacaacaaggtcaaatgaaatggacaacacattcggtgcagtggttgaaaatattttgcttcacctgtaaaacaggactactagcaggtgacaattctcctgatatcaccacatggaaaatatgcacatcaaatggactgtaggtaacaagtatgtagtcctggaagacatccatgacaattggtcgaccaagaagtgatttccggtaaagtaatgagctataatcaaggtgatatcttgggaaaaagagaagctcatacctaagacaagtgcaacaaacatgtcatataactaaatagatagcaagtcatgcccgcatattggtatttaaataggaataaaaagctaggagatacagaagatggctctctgatatattagcacactatgcatttcagctagtattctgtgagttcaagcaccatgagatttgtgcatgaaactctcagctcaaatgtaatgacaagtaaaaattgtcatgtgtctgttaagaaaatttcaggctgaagacaataaacagacagaaacagagaaagtgaggaagcaagactaacgtatttgatgattcaatgtagttgcatacaataactattttgccaagccacaacaagcctttgcattgaatcttttgctcttgagtaacatccccaaaaacacgccaccttttattgcgcaaatcatacagcactagcccatgagagcctgcaactgccaagtacataccatcattgcttgcaacaacatgaagaactggccaattctgtgaaatataggatgcctgcttccagaaaaaaaaactatattataacaagtcttgaaataagatgcattgaggcatttttgcctcctaaataagtttgatgaaatcaaacacttaactggaacattaagatgcaacatcttaagttcatcagtatcatccggttgtaccaataggattcgatcttcaccataaagaatctggcgagtatatgttgtgcccaaaagtcctctgtttaggcaacatttggcaaatgagaatgcaagaatcctttctgacaagttttcttcaactgcaaatagtttatatccataatcatcccactgaatgtgtgacgtccctcccattagaggctcaaattttaaagcactaggtttaaccattggagatgaggcagaatttgatccggtttgacgaattgtgcacatcaaacgacatccagatacagaccacacagtaagtcccctaaatttccatccaactgcaaaagcacaattgtcaggcgtccaagatatacaagtaacaggaccagtatcttccactgaatacctacaatttttcccaaaggaaaaagggacagttatatatcagctttaacggaataactgaaatgcattgcacagtaaatacacaaaatcacacatagtaatgaatcagagaccaaatattaactaattggtacgtctgcataagtggagcaatcaaacctaagtacataactggagaaaacaatatacagattaagtatttaatctaaaccaccaggcaatccaaatttgcattgaagatatgtaattaaatggaaagtaacctaatgttctgttactgtgcaagcaggatatccttctaaataagcacaaatttgcaactatccaccagaaaattaggcagtaacagctatccacagaactaacaaatagttgtgtgagacttacccccaatcatacaaagaaattgtgcggatatgccttgcattttcagctaggtcatataaatcaacaacacctctactgcacccaacagcaagaatctgctgatcagaagccacagaagtgcacatcgcgtcatcagtgttcaaccatctctctactctgatgctgctggtttgctttaatcccttcttaccaactgcacaaagtccaatctgacagcccgagtacaaagcaactagcaatcttagcttcactgacaactcaacatgaataatggtggaattccctgtgcagcagggtgcaggacttgcatcagaattttctcgcaaactaggcgggtcaaacaccaaagcatctccgacagtgggagttctgttggatgaacatgcggagcagccaagcttgaagctgtccgagaactgcaaacaaacaatacatggaacatactaagcatagcaagcacagatcaagcaaggagataactatttccccatctcatcaaacaataacatagagaaacagtagcagaatacatttccatgtacctcagcattccaggagatgacctgcaagtgcccattggacagtccaagcagcatactcttgctgtcgcacacgaaattgctcctgcagcatatgatatcacacttgcaaaagttagctcccccgcatgaattcggtatctcgtttttcggataataaagaagcgaagcgaataccatacgttatgaaagcgtcattggcgagaggaaccttctcgacgattatttgcgatatggaggcgaggcagagccccggttgtggcttgcctccgatgatcagcggcttccccgagaactgcagcttgtatatgtacaggtagaaggacgaggtctgcacgtacaaaccactcgatgagtctctgcgcgtagagagcgagcaggagcaaagcggggggagagcagtgtgggggtggctgaccaggacggcgacggtcttggcgtcggggctccagacggagtgggcgttgtccccgtgggcggcgagggattccggggagcggtcaaggcgggcgaggcggaccttgtggtgggcggcggaccaaaggtggagggaggccgggcagacggcgaggaggtagcggccgaggacgcggaggaggaccacgcggtcggagtcccccgggtcgagcgggatcgactgcggccagccatacgccatgtacatctcggcggcggcggcggcggcggcggggtcctcgtcgccgggcgcgcgcctcgccggtgaggttgttgggcgagatgcgcgaggggggaagagatctgggaacgagcaggtgggtgcgcgatgcgggagatgcagcagtttttcttttttactttttccttttcttttctttttcgcttttctttttttaaaaaaaaactgatcagatcagagcgtcacatattgccgtcagattgcttcccgtcgccgagtgaaatgaacaagtttagcgtcccaactgatgaaacgatccagttaagagtttttttttcctttttttctttttccaaccggaactaagctgcttgatctttcagtgaacgtcacgtattgccgtattggtacagtgtaataataataaatgtataatgactggagtacgatagctctatcaattttcagtgccacattttcgaagagtttggtgctgcctttcagctggcagcatttgcgggtattagcaatttagcataggcgatttggtacttttggcagaaagatggatgataaattgacgtaagattacaccaatcttctataccaagatgtaatgacagtaatcacgatgcataaaccacacaacgttagggctttacatagtgctagtatattctgtattggatctagtgccatggagttctataaaaaaagatctcaaaaaaaaatatagtgccatggtgaggcccactagtgatgcttgcagcgacttgtacagcaattgtttttttctgggatgactatatgatctggacttctggagtatgaagaaatgacaccgctcgtatgaaaggacaacgggcataaatgtgacgtagtattactcccagaaaacaattaaaccccacaactaagtactccccagttaaattagctcacctcgcaagtttctttttaaccccatctgagtagtacagaacagaacaaagccagagaggaactcgaactcattgacccacatgatagagtctcctggtgtactgttacatgacaacctggcctagtgccttttagaggttaccaacacgtcttcgcacgatgagcagtgcaacaccgtgcattctaacagagtaacaggcaacacgatcaggccaaggtaaatcacgaaattttaaggcgtcttcaagctacttctcgttcaaagctgccttatttccatttacctgaatcctggccagttttagagcctggcatgctggtcacagtttcaccacaacttcagcggattgacgacgacccgcgacaacttcagaactagaccaaagaattgcatttgcacaggtcgtcaaaacgggacatggcttagtttcaggctgccaacataattgccttgactcctgccaaatgtaacggcgttactcatactgtatggtatggtaaggatttcagcttctttttttttttacggcacggcacaagatgacatgcttccgtcctttttcagcaaaagagatggcacttactgcgcatgagctgcaagctgttgtgaatcagataaaaatgatcattccatatcagaagattcatcctcatcctcatcctcattttcatcaaggatataaaccaaagcatgccgccgagatgaaaagacaccagccactcctcttgaggctgaaaacaacatccaggaaatgtgaactctggcatcacgtatcatgttaagtgagtagcaacttaaaactcttgtatggaagtaaacactcaaactcaccactgactgccagtggagtggacacggcgtgaggtatgctacgaacttttttcccatagtcggtgtccaactggagctcctgtgcctacattcattgcgttacggaaatgaagatattactttctgacagtaaaagtaaggtcgatttcaacaattatgtgtcatttaatcactacaattgatgagataatatatggccttggtcacgtagtaataagttgtgtttgtgataacacaatgatgaataggagacatgcagtaggttattgccaataccaggttaccgtttaattattagtgtaagaatgctatgaaataaagtggatgccaaaagaataaaagaggaacatttgcaaagatcttaccgacagctcttgtacactgtaaatatttgaagggaacatccttgagagaggcacaaaagagaagttctccatctgcagcattacaatataagaacttccaggaccatcagaatatgacctttcactgagtagtacaacaatctggctgtcctgttttaatataaccatttcttttgtgagctatgagaaataatgtataaaaggtgaattatcgccaagatgcagcagggagtactaccttgtaaagagatacatcaacgcactcatattcatcaggtatatgcaatagaaatcctgaagaagatggtccgctggcagaagagttagagaagtcctttatcacaccaatgcaattcttcaagttcaaggatccatcgggtatcttgaagcatatatagtcagtcaagctatatgaagacccactattctgagaatcttcatcctgctattttgaataatcatttaatattatgataagaatttaacccaaacaatatagataaggtgaagacaagttcaaaacagaaaaataaatatcacttttttattacattatatttgaagtcaactaagagctatgtcatttgctaaagatgagatgggcacccgaaccactcctaggaccatgggtgaagagattaaacatccttccccgagccagcctattgcctattgaagtgttctcatatgttcattttataatgatgctgtagtggaataagcagaagtcaccaaaaaaacatgaaccttatagaatgacactgatgtcagaatacaggttgatgacaagtcaaccgatgacgtgataggataaagaggaagcaattcttggcaatgtatttgtgaagaaatagtggtgaatggcatcgagaaagcctcctccaggctgaaacatatgatagacaaaaattgattacatttaagcaatgagcaatggatttaaaatggctatgtctatataaacagagaacacaaggatttgactgtcaaaactctgattcaactgtttccagataacaaattatgtagaaggagtaaaaaataactctaagataatcaaaaaataaagtagtaaactggaacctttcatccagctcattaaattgcttcattaaagtcttttccaaaaaatgggtatctgtaaatccccccaaaactactagctgctcaagatgtcttacagtgtccctgaaaaggcaggtttaacacgattaagaaatgcagaaaaacacaataacacaaagagagaaactaaaatagtgatgaaaaaacacaacataagaacaggcaacagccctttgtaatttaatagcttttgactattttcactgctttggattcagggcacaaaaagagtgtacacatcaagatattcaacgactggatttcatgtgaagcaatagtattgttttctttttgaaagcaatacagtacccaacaccaagagataaagtatatatacacaaaaaagactaaaaattatacatttgaaagttatgttcgtgttcggaggtactctcacacataaccatgcacttgtgtaacgtttaaatatactaaacaagttttgacatattatgcacattgcaaggtaacttgtcaacaaggattggtgaattactagcttgcaaacaggtaacatagatatgtgcagaacacaataccaaattgtacataggaaacaataaccaacaatcggcatgtttcattgttacttacaaatcacactcaaatctttgatttgcatcaagtaactgtttgattggatccttatcaagaaggaacttcagaaaaagcaccacgagttcactacaaaaaaaaagtgacacccaggtgattaatgacaaagtgtttgactcacaacttgagcatgaagggaataatagaaggggaaaagacaaaacctgttcgcagctggaacttgatcggttggttcacttaataaaatcttaacacactttaaaacccaactgaagaaattttggaactgaaaagtatatccataaatggaagttactacagaataacccttaaagtcgtagcacaatctataatcataacatcatgtaggaaagaatagagcatggaagcaaatatatcaaacaattatccccctagtaaacatgctcaacatggattaccttggtttgcttgaacttaatcttcagtctaatgatgttgtgcatgtagtttcagaatatgacatcttacctcagcagatactacatgcaccaagatgtcatattctgatactacatcaaaccaacagaatctagagtctagagtacagataataacattgaattcagaaaatgtaattggttgttttaacaatcagtgccaaattagcagacaaatgtgtgtccagtctatattgtctactaatacttcgagcacacaaaaggttctgtgcacttgaccagggaggggaatctcgggcagaaggcctaagttaaaacagaggttgagaattgagaacatggcaagaaaacaagcagagaagaatggtaccagataaagaacagtagccgcaacccttgaaaaacgctcaacttgaacaactagcattcctatcttctcagtcacaccataaataagcttttcatctaacccaacgttctgaaatcgtgagcgccatcttgcaaggcctcttagttccgcaagtctgaatgaaataatttcaactgcaggctgtaataagcaagtcattcagcgttcataacagactagctgatattcctggcttggatctcaaataaatgataccataaattgtagaaataaaactactcactcaaaatatgatagtaccatgtgtagcagaaaaagaaaaatatgaaattgcctagtttacaaagtacaaactctagaatacccattacccaaagcaacacaaaaaaaaaaggtagagactgtgacatcagctggaagtggctaacctgaagatgctcactgacaacaacacgaagttctcgtccagcactatcaacagccttagctatttttttgagagcctatccacataggaaacgacaagtttagacaggttctctcaaaaaaaaaaagagaagaggatagggaagaagtttttatggaagcgagaaataccgcttcaccaagtgagctgactaaaaattggtgaagtgctggacttgtacgtgtaccaaacaaaaggctcataaactcatcctcagagctagattccatccctgtattcaccaacagagacagaataaagggggcagacttcttgaggtgatggttatgacttgaaaatcgatcataccatgggcagctatcagagaaggcaaggcgctgaatttttcattaaataagttcatggcacttgaccattgtttggccatcatggatagggaagaacggacaacttcaaccagatcttgaatacttgatgcttgttgggagatctgatgtagctcatttttccttcacagcattgatgatacacaaacagattaaaaaaatttagtaggtaaagcactaaagtgatattaatatccttgcaaacctagtaaataaacacaggtgctatgtttttgaggaatcaaacaagaaagatgtttgcacctagctataaaacagaatgatggttctatgactaggtgagcttatcaaaattagtcatttcaggtgtcaatgagtgtgttgctctagcacttcatgtggaaatctccatcatgttttgaagttaccataaaacaccatgcaacaagataatggtttcttaacaacaacagaaagtagtcacaggcaatcaaactatcatgacattacctgttgaaaaagatagaagtgtccaaatgcagacaatgtaacccagtagaaatgtgattactatgagaaaggttgtcaatatcaatcagctttccagggcacaggagaactaactgatggaggtttcctgataaacagacctgatgtgaacgccattgtcagaatttcatacttaatatgtgcttatgatttatgaaacaaaaaattcattaccttgcttatggaagcatcctgaagccggtaactagttttgtttccagaggattggaaatggataggaacctcattaatgttctgaaatgccatagacataaaattagttatccatgagacactgaactagataaatgaactaaggcgtcatggcttacaaacaaaaagaattaggtaataggcatcagttgatcaatgtccacagactcgatccttaaaactacatggaacaaagagaaatgaaagaaaagttgaaacacactccacctgcttgtgtgcgcattaaaaaaagaaaaataaaaacaagcatgctttatcataatcccagtaggaaaaaaaatagaacactcccagcacttttgcccagtgagtttaagtttgaaaac

SEQ ID NO: 20042 - DNA, 7807 bp, Oryza sativa
atctactgactatctttccaactgggaatattccaaagatactgaagcaaatgcaaccacctttatcaccactgcacagaatattaaaacgctggcaggaagcgcttgaaaattcctgaatggattcttcattctcatctgaaagaccagtgtctccagaactcagcccaccgatcctaggaatcacaggagcgggaggaaagaagcgtgcagtgcggtcttcataggataacaggccatccttgtcggtctgcggtcattagcaaagaattgtgatagtgaacttttacagtgaaaccctagactaagagtattgtaaaagtgaatgaattcatcatttgtcgctttatgtattgctgaataatgctttaaattgaatgatgtactctataactataatagtatgatgagacacatttttatttatacatcattacattatatatagagaaatagttggtgtttccaaaagatggaaaaggcaatggtatacccttgatagaagctcatcttctgcccagttcaaacatacaatggcaacatcatgggattttattcttcttagcattttcccattctgcaatcagcaccttcacttaaacatgcacaatgaggtaaagtgaaataaaagtaacaagtggacagaatcacaacataaaattggttctacaaacaaaacatttgataatgaccattcaattacaaaggaattgctataggttgaatgtattaaaaaatggtgctcaacaggaaaggaagtaattggaaatgttctttgtgtctagttcgagtgtcatttataaatctctaccaaagtaccaatagctccttggaactatttctcacaatggtccctacacagttcaaccaatctgctcataaaagctggtgagggtgaagatcaagatcaagagaaaataagcaggggatcaggtttgtatgatatatgagtaaatgtccaaatccaacacaaaacaaaaagggatcaacaagatttgaacatccatttcattaatatacacacctcaacatcatgcaaaagaaccaaaccatcttcggtaccaagtgctactattttaccatcggggctccaacaaatagatgtgatgcacttccctgaaaaataagcaagattttagtatagcgccaacatgattgtattgaaaatataagcatgatgggtgcagttagatagttcataaaatatgtgcttatatctagttctgtttcgtcagaagcagtatgtccagaaaatgctgtcagccaaaaaaaaaatgtaacaaacaaaagtagctgcaagggtggggcaatagcaagtggctacctggggagatagtccatagcctttgccaattgaatcgatgaaggacaaccttagagtcatcagtaaccatagcaagtagatccttctctggattccactctgccatttttatctgcaaatagtgactaacggattatgacagcatgaattaagaaatgacaacaaaatatcaaagggaatacagattccacttacactaaatctgaaaacagaaatacacatggaataaatggaaaatgaaattcagcaggaatatgaaatatgacaggttaattttgaattcactaatcaccatttcttgtgtgtcactactctttttttgaaaccgagacagcaaagctggtgttatgttaacaaagccatgcattgataagataaaaatagaaattgccagatcaaccgatcaagtatgacgacagaggtgtgaaatgcaaaacctgaaaccaaactcatcaacaagagctaatcgacaagctggtgtttaactgtttatagctccctatcagtacagaaaacataaaatggactgtttccattcaaagcagatgtcaaatgtatcctatacttggagaagcatacaaaagggtctcacagttttgcaaaatgggatgatatggagggtgggaaatggatcgaagattaacatctgggcggatccttggataccgaggggctggtcaaggaaacctataacacccagaggcgctaatctcgtgacaaaagtggaggaactgattgacccttatactggaacttgggatgataatatgctgtcacaaactttctgggaagaggatgtcgcagctatcaaatccattcctgtgcatgttgaaatggaggatgttttggcgtggcactttgatgcgagaggatgtttctcggtcaaatcagcttacaaggtgcaaagggagatggagagaagagctagcagaaacggatgccctggggtctcaaatggggagagtggggatgatgatttttggaagaagctttggaaactgggtgttccgggaaagatcaaacacttcttgtggagaatgtgccacaacacgttggcgttgcgagccaacctgcatcaccgagggatggatgtcgataccagatgtgtgatgtgtggccagtataatgaagatgcgggacatcttttgttcaagtgcaagccagtgaagaaggtatggcaagctttaaatctagaagagttgagaaccaggctagagtagcaaacctcaggaaagaatgtgttacaatcaatttgctgccgcccggaaaatgaacgaacaagtgccatagtttgcctttggcagtggtggaaagagaggaatgaagtaagagaaggaggaacaccaagaagcccagctaagctctcacacccgatcatgtcacgagctggagaattcgtcaggatgaacgcaaaggacaaaaatcccagaacaggagagtgtgcagtttggagatggccacctctgaactttgtgaaaatcaatactgacggaacgtacagaggtaacacaaagcagggaggatggggctttgtgatcagggatcgggctggctcaatccttcaggcaggagctggtccggcagctcatctacaagacgccttccatgctgaagttatcgcctgtgctgctgcaatcaaggctgcaagcgaaaggggtatgtccagaattgagctagaaacagactcaatgatgcttcggaatgcgatccaggataattcctttaacctatcatctctaggtggagtgattcttgagattaaacatgtaattttgagctgttttcattccttctctgttagctactcgcccaggagttgtaataaggtagcgcatgagctagccgcgtatggttgtaatctccagaccgtgtcttcctgggcaggctgcccgcctggtctggaacggctggtatccagcgattcagatggtttggtaatataaatctctcggtttctctcaaaaaaacaatgtgagagattagctgaacatatcgcccacccaaaaccagttacaacgctctcaatcacacgcactgatggtactatgaaccgatctaaccctgctaggaatttcaacaaacggttggcacgcaggtaaagggggctgcaacccctggacccgccccgcccacccgtgctctaccacgaagtaagcaagcaagcatgctctgctaggatcaactcgtaagcgcattaatcagtagcttctcgacacagaccggctcgattggacaagcaacaaaacgaactcggtatttggcaggtcagacgacgagcgattcagaggaggaaccagagacgatacctggaaggggatgggcttgtcgaactggagctggaacggcgtggccgccgcccccgccgtcgacgcctcctccatctgctcttccgcctgctcggtgtcaatcagggaggtcgggatttgggggagaacttttttgagcgggcaggcgggaatgaggagcagacggcggcagcggcggcgtgtgacgcatagggaagaagagcttcccaatttaggccccggtacacgtggcccatcactcaaaaaggcccgtctcgctggattgggccactctatgggcctcaccaccaaacggcgagaagtgcaaggcccatttgagagctttgcaacgaaagggaagcgttgcactgattgtctgaacggctcactgacgacagtccatagcacgtttgaatgcctcctatataaaataacctctattatagtagggttaatagggcttaatagttcgcgtgatatagattactggaaataagatgggaaatgtaggtgcaaaaatcaccttttacaatcctataggtagctatacttagggcaaatttgaatcgcagagattgctatattttgcgggagtacgtgagttctagcttgtcaaatctgattcagctttccacttcgaagaaagcaaactgcaactaaaaaaactgagggaataacagtggttgtgactcagaaatgcgagcaaatgatacgaagaagatagatgctgtgaaacatgacaaatcaagcttacaagttccaaccctgactccatcataagtccatatgacataatataatagaagtggtgcatacattcgacatcaaaactacggagaacttccaggggttctcagggaacagcagttcaacttgcaaactcaacatgaatacggctcctttcaagacattttcagccagaagtaaaatctaagagagataagcaacatcctccacacttcaagagtctgcattggatgagaaactgttattaatttatcaaacaaaagacagcagcaatttggaaattgcacagccatttatgcttcacaatatatgcccaaaaattacaattagagaaacaacaaacagtactagaatgtttcagtaggatgccaaactgatagtttaacaaaaagacactctgttggtaaatcaaatactcggttctttatactaaataggatatgaagacgcgattgcattaacataaatttagcatgcaaccttgtgaccaacatggctgggaaacttttttacattgtaagtaaatgtgataaaaattcctcagatgtcaatcatttgtgtacataacgattacactacaaggacccaatataatgccaatttagtatctgcagttcaatagccataacaagttccactgacataataaagcctcttccaggtaactcctatgttatggacttactgttagatcaaaatattcagctttcaagctattcatattggaatggatttcaaagaaaccaggaaagcatcatggcacagaccatttacatgcccctctgaaccctcaaaagtagtggaagcatggtttatgacaatatgaaaataatgaagtgaattgagcaggtttgattgcaaatgtcaattcacaagcccagttaatcttcgcacacaattgccaaatgcaagaagttttaaaggatgtccaaaaacaaaatggctattcctcagtcagggactcagggatcaggcgtacaaccacatttgacatgctgcgaaaacagaatttcgtgcgtacaatgttcaattgtaatagtattacattatcaccctagcacagaaggcttgatggaaaaatctactgcatttctccatcgcccgtgcgataacatgttcaagcatgcaaagtaacactcactaagcatcctaccatggtcttaacaagcaactcaagatataataacaatccatacatgatatgttcgataaagaattgagcgatcatcataacagcagagtcgttcatcaatcatggctaattgcacaaatggagcgactgtttaatggtcattcttcaactgatgcttggagaaacaagcctaatctataacccgcaaacagctaactgaacaggatacaatccgcactaacctttagatgctgctcgggtacatgaagactctgaccttgcgcccctgcaacgatgcaaacatagcagaaaaatcagcacaagctcataaacaagaacaagaatcgcatagaatgggagcaacgcaccatggaagcggggggcaggttggacttgaacttggcgcggacgacgccggagttgccatgggggcgggtgaccttgccccagatgcagcggtagttcgtgccgccgctcttggtcttggccttgtacacgtacgccatcctcttcccgcagtaccacgccacctcctccttggtgttcaccccctcgatctgcaccagcgacgtgttctcgtactggttcgacttcgacctgcccaaattccaccaatcaaaatcgcggcgacagaatggaacacatacacacgcacacaaccctcggttgccggagacggcgagctcgcccctcacctcttgtatccgaggatggtgccgcggacgtagagccgcacgcgctgcccggtgcgtcccttcaccatctcgtcgtcgccgccgcttctgccgccggagagagactgggagctcgcggaggtgggggtttcggaggcgcggccacgaggggaagaagaaaccctagccagcggcgctggtagctcttatgtacccgtcagtagcagaaatgaacggcggcgatcttccggtgcagatttttctacggctgtgatttatccgagaggatcgtgtgttttggtgcgtcgtaggcctcattcccgtttcatagtgggccaatttgttggaaagcccatccaaataacctgaaattgaatggaataagtccattttacctcccttatctcttgcacatgtgtgaataacatccctcaaccggaaaaccgggtataacgcctccttcttctctgaaaaccaaagcaaatcatctccctcagtggtttcggaggcgtttttgtcctacgtggcagctgaatcagcttgtgggtctcacttgtcagcgactctcctctttctgttatcttttccatcccctgtggcagctggagacgagcgccgaatggaggacgccgcccgggggatctagcggcgtcatcccgtcggaactctactgcaagatttgtaggaacgtgatggccgacgcggtgctggcgagcaagtgctgcttcaacagcttctgcgacaggtgcatctaggaccacatcgccgccaagtccaagtgcgcgtgcggggcccaggcgcgcgccaacgacctgatccccaacccgacgctccgcaccactatcgccaacgttctcgccatcaccggcggcgcagcgagcgcttcaagtggaactgagaagccgaggagctccgtcggcagcaacgcggcagaggtggcgccgcagagcccggccgcttcgcaggcgagccacagcaacgtgtcttctaagaagagcgccacaatctcatcaggtgtcctcgaaccaagaaaggcgcgggagacagtggcgggcgaccaatccgcagaatatggagccctcgccgtcgacggcgatcaccacggcagctacggcttcccgttcggcctggcgccaggctacgtcgacccctttttcggcgtcggcgtgccattcggagccgatccttacatgtactacgacggcgcaccttacggctagggtggtgctgcttacggctactacggcggcaaggatcaccgtgacatgaagaggacgtgcctgcgatgatcgcacgtcatcggccaattgttgcctgttgcccaacgcaagattggatggcgacactgccggtcgctgtcggcacagcgagaagagcgccgaatgttggatggaggacgtcggagcgtgggaaggtcgtggtggcggcgttctggctccgtccgcgtcagaccagcgacgcgtggtcgacaacccctgtgttgcatcctcccatgccaactttgcatgtctgtcggcgtccatcttcgccaggatgctggggagggagaagaaaaggtggcggcgaggccgaggaggcgaggatagggatgaggtggcggaggaggggcgtgggaggggaggcacttagctcccgccgcccccgc

SEQ ID NO: 20043 - DNA, 1357 bp, Oryza sativa
gcatttcctagcctccattgcctgccttccctcggcaaggttagcaatcagcacaccaatacaccatctccgtagcccaattattaatttaattactgctgtccaatctctcgatatcaaaacataaacatatgtaggccatcccgacgcacggcgtcacgggcattagcgcttaattgtttgtttccgttcactcgatcgaatcgtcctcatgccctaagcatcgcatttagacgcttgcgatcaactaattggtaaaattttaaatttatatttgtaattttgtagtgtaacttatatgagttaaactatcataatagtgttaattcttttaattatcaagccatgtcatcaataacttcacatctagttgattattattttgtagtagtatgttaaggacccctacatttagttttgcaccggggcctgaaaactcaggatcgccctgttccttcacttcatatttctgcacgttcatccactttgccagtgccatctataaaagactaacagtcttaagagtttagtatataaaataccaaatcaagaccaggattgcccaataggtcggccgattctggtcaattattgattgatcgcagtatattttacagagcttagatctaaatcatttccgatctacgctatcttcgaggcaggggagttaatgctggcaattaaaagtagttaacgacccgtagatcatcagtacgtagactcgaattgtgaatgtaaaattaagcaagatcacttccatatatgagtgcacgcggccttggagctttccggaccaagaagttttaaaatcgtagcaaaagttacaagtgtcttcaccgggatcgatcgactgatcgagcatatatataataacagttctaaagtaaacgttcgattaattagtttactcacataattaaacaagtggcagttgttcatctaaattttggcaacaacttggcaagttaacgatgcactagcgacaaattaaatcagccagatgccagatcgagtgtgggagcatcggcagtctacttaaggactgacaaaagcacgaagcaacgtacttagcgttaagctagcgcaaagtgcacctcactaattaagctagcaacaatggcggcgaacttctctgcctgcctcgtccccgtcgccgtcctcgcgctcttctacctggtcatcttccccaacgacttgagccagctcaagtcggcgcttgccccatgcgacgccgccagcaagagcgtcgcggcggcggcggcggcggacgacgacgtcgacttccgcatgttcttcggcatcctcacccgccccgacttctacgagcggcgcgcgctgctccgcatggcgtacgcgc

SEQ ID NO: 20044 - DNA, 621 bp, Oryza sativa
cacttacaaaattcatttttggcagggtttttgtgtaagtagaagcactgtgacgaccgacgaagtggctacacatgctttcatgtgggtatgcgtgctagaccacatcttagatcgaaaagatcagtcggcgaatacgtcgaagtttcgttcgtttcctgctgctgttgatcgatgcagcattaaacaatgagcaaaaacagtggcaaattgggctggatttcatactcatactatattcatcgttttgagaaaataaaacatgtacaaattagtattacctccgttctaaaatataacaatctatgactgaaaggatcataccctagtactacacgatcttaagttactgtattttagaatggagagaatactataattgtagagatttgctgcaaacagtgcctactatctctctcttaaaaaagtactattgttgaaaacattactactctctccgttttacaatgtaagattttctagcattgtatacattcatatagatgctaataaatctagacactattatatatatatatatatatatatatatatatatatatatatatatatatatatatatatatatatatatatatatatatatatatatatatatat

SEQ ID NO: 20045 - DNA, 34877 bp, Oryza sativa
  unsure (1)..(34877): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnatataactaggatgtgtctaattagatactatgttgctatatcttgggatgaaggcctttttttcctttctagttaacatgcagatccaaccttgattttcgttagcacatttttaagctgttaaatgatgtgttttgtgtgagaactttttatataaaagttgctctaaaaatatgaaataaatccatttcttaactttaaaataaataaaaccttgttaagcatgtgcttaatagctttctcgttttatacgctcatatttactcaattagattcaaacgcttgaatggagagaaagtatgttgatcggatgataattataaaatcttggggttttaaaagcgctgaatcgtattgggtggggaagagtctagcaagctagcaactgtgcttgtgggaatatatactgaaacaaacactttatatgaaactgatttagtattattttcaatacaaaacaaacacattatcaaaatatatttaatgttgaatttaatatatgaatctgatttagtattatagatgttgataattttttctataaatttaattaaagttaaaagaattttaaaaaaagttaagtattttataatatgaaacggagggagtactcagtactagctagggtctgaaagtcccagagagtgtcttatacgcagatatcctccccgttccatgacatacgatgttacgtagctgtagctggtagatcgattgcagttgttctctcgttctttctatccatacttgcattatattggcgtattccactgttcctactcaccttgtactagttggctgataggcgtagttttctatgggtgcttgaacgaaggatttgtaaatggtttgagttggattctccgagggtgtttatgcttatacttatcagctaaaatttaaatttttaatcttaaatttgaagccaattttaggattttttttatcgaagtttattttctaaccattgcttttaggtcgctaaaaacacgtatataaaaattgtattcacaaattatttttcgtttgtaaatatttcgtttggtttattccacgaataagcgaaacattggggccacgagtttctcgcactacaagtaatttgaaaatgaaggtagtacgtgtcttcgtacataagtacaagttatttattagttttagctaaaatattaaatgaaattatgtacgataaccatatgtagtgtacttcctctgtctaaaaataggtttattttttatttatcccacatataacaatatgaaggaaaagattacaatacctcaactttatcaaattttaatgtaattgttcaactatatctacttctcagtgcatttatactctattttcacaaactctaattaataccatgattttaaaaataaatttattttgaaacaaataatcttatttcggaacggatggtgaaggatgtacatgtatacaagttatttatcatagtggctactatagcagatagctgggctggctatgtgcggggagcactgaattgttaatggttcgacggagtctacatcgatctctactcgcttgcagttgcagggcgaggtggcgggggacgtgtagtggactacataccatgttttcttatgctaggtactactatattatttataggaaaatattgtgtatgtttctattatacagttgtagaaggtgtgatgaaaaaacaaaacactgtgcacggtgtgccgtactcttaaaacactatgatgatgcaaatcataggcaaccacggatagatatttaattagcgaaaataattttcttttaatgtttatgcaagtaatataatattagcttttattgggtttagctttctcacctgtggtgttacagcatgaaagctcaatttttagcaggaaggctggaattaaagaagtgttggcatttagtcgtgagtgcggccgtgcggctgcgagtgggcctggctccaggcctgttcggttacacggcctcgggctccgttcctggggcggtcacatgttgtgggcccattgcaccgtgggcccatttggatccccaccttcgacaagacgtaagcccagagtccacagatccgggcccacaagctggtctcgcgccggtcaacgggcagctcgtgacgcacgcgagtcgcgtactagtactgctgtactgtgtgcccgacacaacctgaccagctgttgtacttgcacccagcctctctgtgcacgagtactcttttccgataaaaaaaaaattcaatcctagctataaatataaaaatatacatgtgtttacattcttaattaagattatttttttttatgaaagattgagcattcatgcaattcaaaacaaaaaagttgcaaatttgcattgaagttcccacccgacgcacgatggactttacttcctttatatctttcataaaaataaaaaaagaattcccatatatgattatcaaatttggatttattttttcctcatatgatcatgatcaaagttggatggaggatgtacatttaaacatacataaattctctgcaaaaatacatgagcgataaaaagttaaaaagtataaatgatatatttgaaactactctagtaaacgagtagaggaaatctaagcatctctaatctatatttcctataaagttacaacccacaaactctaaagcttaacatacagccatgccacattatcacccactgaacatattcaacctcatacaagcatgcaacattgtctacaatatatttaattctacaaatcaacatgcaaacatatccaatcatcaccactcacatcattttcacaatatttttacaaatctatctatcatttttataatatttaacataaacttatcaatatgttccacattaaagcgcgggtcatttgtttcatgataaatactgataaactctaatatttcatttgttttctttttatccctagcttgattgtagcaaaaatatatatatattgaaaattacttagtaattcctgcagcaaagcgcggggaatcacctagtaattattacgattaccactatggctttatggagtgccaacgtggtggaaaatatttgtgggacctacaaatcagtctatccctctccttcatctcctccttcggcatgcagccaaccttccctcaccgccatcacccatgtcccgcatccagtcccatatgccgtccacaccaccatcgcctgaatatttgctcaagatggaccctgttcatctccaccgccggcgctactcgagaggcctccctcctgagctcactcctccaggctagcctcgcctcgtcactcgcagggtctacgactccacttccacgtgcagacttgtacacttagtctgcctataacctcttctctgtcgccccttcattcgaaaaccgttgtagttgggttcgttggcgttgtgggcttcccccatttcttcactctcctctctaatagggcctaggtcagcccccttcactacgctgctcccaacggcgtcgtctccactggcagctgtctccaagtcgcttgagcacgattgcacgaagttgagtcgggtggcgccatcctccctggacagtgtgactgttgacggtctttaaatcataatatttgaccgtcaatacttgtatataatgaattaacatatggcatccaacttagtggtagggattattactaatcaattccactagtgttagtgaaatatgttatgcagttattttgaggagaaaacacatccatcatgcgacaaaatggacctccgcatatttaggatgcgtttacccggattggagggcccataagtcgataaaaaccacttagaattgggccaaaatatagtgcaagttattggggacccattaagcaacctaccggccaaatgagaggctgggaggacactttttgggttcggccgaacccaccagttcggccgaacccgttctgcggccgttcatcgccagattacacgtgtacgctcctgatcacttcccaatggcagttccggggcattttggacatttcacataggctgtaaccgtcatacctgcctatataaaaggaggagctcactctcatttccaacacacaactttgaactgaattacaagatactctattgtatcttttatacattagaataaggtagagagtgaggggaagctttggaggagtgcccggaagtttggcgctcatccaacttctacctcgacgagtgtagcttcctaggagcaattctggaggagtaccggagctgtcagtacactctgctctgggttcggagaacttcttctgtaaagtaagtattcgtgttcctttcttatgttatttaattatttagtctgagtaagttatatttccatctttgcgggttcattgtttagtattcatactaagtgctctagtactaggactccagatagagaaggaagttcctgcgcaagtattagagtagtaattaataacttagacgtggtgtctaggttagagattacctttatttgttgtgtatcccacggatttgtcagaagtaggcggcaggtggtgacagccctgaagcccgtcctagtaatcctccatgttcggatacatcatagagctatagccggaaccacactggcagaccagcagggatcggtgcccgaagcaacagatagaaaattacctttgcttagcatagataattaaaactcatagaaagtcctgtctagcttagcctgcctaccactagttgttgtccttggatagtcttagtcttaggtagattacacatgtttcctgagttcgatatccttttgggtcacccgaaaataaagtgctacagtggtattccgtacacttgcggatttatctgtggttgcaagaaataccaactatgaccggcttgtgcaggatgcgaagatgcctcaccacttcatgccgcgggggagatcgagctgacagacttgtgggtcccacggctctttccacgctcgcactccacgtaggcaaagttgcaaataggtaaagaaatcacgtgacaattttacaagttcaaacctagaaaatgtatttggagatttaattgttaaacctaatattgacacatagttaaaaatttggtgatgactaattcttgctattggcgtaaaattttcgcaaaaaaatcctaaagtaatcgacaaagtttacggtctcatctttttgcttatgcttatatgcttatcagccaaaatttgaattttcaaccttaaatttgaaggtgattttggggttcttcattgaagtttattttttagcctttgcttttatatcattaagaacacatatataaaagtattattcagaaattatttttcgtttgaaaatacgacatttggggctgttaatgttgagcaaggattgaaaacatgtgggagaaaaaccttacgtgaaattaattagagaaaaatgcactggcggttcttaaacttatcatgaggtttcacttagatccacgaacttgcaaagcgcatatcgaggtctctaaatttggtttattgtatcatcctggtccaaagggtcgtttgaccgtggtcttgtctacgtggcacgccatgtggacgatgacatgggtttatttttcctttccccttttctttttcctcctattcttttatcttcttcctctactagagccacctcaagctccccgcgttgaagagcccgaagaagatggaaatgaaaggaagaagtgagaaaaaaaagaaataataataatattgtgccatgtcgtcgtctacatgtcatgccacgtaggcaagaccacggtcaaatgagactttggaccgggatgatataataaaccaagtttagggacctcgataacactttgcaagttcatggtactaaatgaaacatttttacatgtttaaggaccaccagtgcaatttactcaattaattaagggcccctttgaatcataggaatgaaaaaacggaggaataggaaaaacgtagtattctgacagtaatgtaagtgtaaaacagaggattacaaaatattggaaaaacgtaagaatgactgtttgattggaccacaggaaaaacacaggaatttgagaagagataaagactcaaaggatttttttttccatgagattctacctcttgttaaaattcctccaaaacttgtatgggaaaatgcattccataggaatttcataggattccatggggttcattcctttgattcaaagggctttgtaggaaaaattcttataggaatgaaatcctctaaaattcctatgaatttcctttgatttaaagggaacataatactccaacatatccgatactcccttcgttaaaaaaaaactcaatcctagatttgaaattagacaaacatgtgttcaggtttaaacttaggattggattttttttttttaacggagggagtaagtagtactctctccatctcatattataagggattttagatgaatctggataggctccttatctagatttgtagtactaagatgtatcaaatccatctaaaatctcttataatatgggatggaaggagtagtagtaaaagagacggaaggcagcaaaatccaaattaaggctgtttttagttcagtccaaagtttagaatttggttgaaattggagacgatgtgactggaaagttatatgtgtatgaaaggtttgatgtgaaggaaagttgaaagtttggaaaaataactttggaactaaacaaggcctaaccctagtgagtgagagaaggaaaaggcgagcgacagtaactgaacacagatacgtacgtaaacccaggtggcatggccagtcgggcagtccaaactactgtaggtgacgatattatcgaccaagatagaattgaagtaggagtagtaaaaacgataggatggggcgtgacagctagctgcagcctgcagccgctggcggtaggagcagtcctctgccggaaaaaggaaaaatgcgagcgcacaaaattaaacttgtgccctcctccctgcatcatgcagctgcaggcacgtacgtacagtacacttgccggccatgggcgccatcgtcgtcgtcgtcgttggcatatgcaagctaagctagctgtcgcttcgctcgcactgtacgctcactgttcgcgtgcatgcacaccacaccagccggcgacgagacaaatccgcggccggcccctgcagagtccgtacgccgacatccatgctctcccgtgggctccgccaccattgccattgctccagcgaccactggagctctctctccctctctctctctctttctctctcatcttaaggagggcaagtaagcacaaaaagaggggcaccgttatgtaccacggcgcaggtatcgagaggcggctgaccggccggcctttcagaaaagaaatgaaagtttgacaggcatgtctgaaatggtctttagacacgaatgaaaaaactaattttatagctcactgcaaaccacgaggtgaatttattaagcctaattaatccatcattagcacatatggttactatagcacttataactaatcatagactaattaggctcaaaagtttcgtctcacgatttttgtgcgaactgtgcaattattcattgtatctatatttaatgctctatttggatgtccaaagatttaatgttatatttttaggaaaaaaaaattagaaactaagccaagcccaaggttgaatgaagaagatgaggacgacaacgacgacacgggtggtggtggtgggcgcgcgccgtcgtatcgcacttactccaccggccggccacgacatggatggacagggggaggtcagttcacttcactgccgccgtcaactccatccatctgtaggagtacgcagctagccatagctcctactcctggctcctactcctggctcctactactaggagtagctgcaagtacgcggtcgctgtcgtcgtctacctgcagccagccactagagcaaagtactgtagagagagcggttgattgcacttggggtaatgcagtgcgcccatggcatctctgcacctgtgtgtctgtctctcgccatggctggctggcgctctctatctctgatctgtgcctaggtggtacagatgttttcatgctgcctgcccaccttgcctgccaatgtttacactacagcaatggcccgatgcaccatggcacattgattaattagttgagcattctggtacattgatcgtacttactattcaatattggccgtaaacctaattaaaccagtgcaaattattgttagcacatagtttcaggttgtaaaacgttttaactttggttaaaattaaattgcttcaagtttaactaaatttgtaaaaaaaaataataataacattttcaacccagaacaaatttattatgaaaatatatattgaattattgatttaatgaaactaatttgatattataaatattactataattgtctataaacttattaaaaataccataatacattattaatatatattcaattatttgactattaaaaataccataatacattattaatactccctccatcccaaaataaatacagttttgcattgtttatgcccaatgtttcatacttcgttttatttgaaaaaaaaattatgatatgtattttcattgataaaacatgaatagtactatatgtgtgactatattttaaattttttgaaataagacggatgatcaaacgttggacacggatatccacaactgcacttattttaggacagaggtagagtgatgtttacaaactataaagattagataaatattgcaaaaacacactcaaaatttgtataatctgtttgtagacattgcaagaatgtgtcatagctaaaaatagaccctaaaaattagtaatttgctgaaggccactctcagtttaattggatagagaaattatttaaaaagaccagaatgcttcaaagaccaaaagcttcttacatgaggctactgtgaagacagaataagatgtactccctccgtccaaaaaaaaagacaaaccatgggtttccgtgtctaactttgattgtccgtcttatatgaaaattttttgtaattcgtattttcattgttgctagatgataaaacatgataatattttatgtgtgacttgtctttttaatttttttcatattttttttaaataagacggacggtcaaacgttgaacacggaaactaggatttgtctttttttttggatggagggagtatttgggctaatggcagatttacagttgcatagtaactttttaaatttttcatcccaactccatgatcgaagcatgcggccccagagagtaatggttatgaccttgtgagtggcatgcagatccgtcggtgttgagcacgtacgagagtggcgacgacaaccacagtgaccttaggaccgacgacgacaacggcactagcctttggaggtgtggatccagcaacgggaaggtcggggtctgcgtcggcgacgacggattttgtagtgctcatcaacgacagagccacctctcaggcatctcgagatgttgttgcctatgctcctccaccatctatcgcctacagattttgttcgtgtatgaaaaaatagtctaccacgggaaaatgatactactttcgtcctaaaatactgtagtttagtccatctaatccataccaatacaaaagaaaaaaaatatataatgcacctattagcaaactccaataaaattatctcatactttaacaaatcattaaaaaaccactttcacaattgtattatcccatactataacaaattacaatagatctataacccactttcacaattgtattatcccatactttaacaaattgaaatggattataacccagtttcacaatcctcaatactcctatattgcttaaaagataaattctttatggataaatagataaaaatataaagtctccatgaatcttccaaagaagaatattaaaagcgaacacgcaaaacgagataaccattaacgcatgattaattaagttttaattattacaaacttgaaaaatggatttatatgatgttttaaagcaacttttatatagaaagttttcggataaaatacaccgtttagcagtttgaaaagtgcaaatgaaaattgaggaaaaatctgtattagggcccctttaatttggaggaaaaaaatagaaattttggaggatttcaatcctatagaaaaatttcctatgaagccctttgaaacaaaagattgaatcctatccatctttcgaaatttttatggaatggacaatcatgtagagatattggaggaaatttagcaagagttttaacctattggtaactttcttttgagtctatctctgtcatccaattcctacgtgtttttcctgttgttcaatcaaattatcattcgtgtatttttttctacgtattacaattctattttacacttacatttctatcaaaatcctacgttttttctattcctacgttttcttaatccttcctttagattgttcgggggtgaggacgacgtgctcctgtcacacattgctttcaagggttttagatcttgtttagttaccattttttttaagaaaaaatcacatcgaatctttggacatatgcatagagcattaaacattgataaattaaaaaactaattgcacagtatgcatggaaatcgcgagacgaatcttttgaacctaattagtccatgattagccataagtgctacagtatcctacatgtgctaatgacgtattaattaggtttaataaattcgtctcgtagtttccaggcaagttatgatattagttttttcatttatatctgacaacccctttcgacgtccagtcaaatatccgatatgacacctaaaaaattttgttttcgcaaactaataaacaaagccttactggttggccatcaagtaggttaacgacgcacgtacggtgtactaatgctctgcaggctgcgtgctgacgcccgtagtgctagacatggagtacagtatcccaaaaataccacttaaggggtgtttatatggaggaacgtaaacttttgacatcacatcgcgtattatacagggtgtcgcatggggtgttcgggcactaatataaaaactaattacacaatccgtcagtaaacagcgagataaatttattaagcctaattaatccatcattagtaaatgtttactataacaccacattgtcaaatcccggagtcacattccctcctagtttggtttaggtaagtagtactccatccgtctaaaaatataacaacttctctaccaacattctcttctcaagaaatcacaaccctccaccattcgcttttctcatctatatccatttctcaacccatcatcatctttttttatttaactttacctacttttctaataattatgtagtacaactctaaaattttttatattctgttacggagggagtacactttagaaatgtcaagtcgatcgacagctggtcagacacgagtaccgttcatacagtagtggcttgccagtcacatctgaatatagcgtactggcaggctgatggacgtatacagattcgctggttggatcctattttgaataactcggttgtacgtaaaaagtactacctccgttcttttatagttgtcgtttgggagttgtgccccctcacaagcacatatttctagcgactaataaaatgggacagagggagtatcttggaaatttacccttttagcacgcaccaggtaacaacatactccctccctccgtaaaaaaaataataaatataaatcatagtataacgaatctgaaccgaggtatatttatattcgtagtaatataatatgttatatttaaagtattaaatatagattaaaaaaactaattgtacagttaggaggaaaatcacgagacgaatcttttaagtctaattagtccataattagttataagtactatactaacctatatatactaatgatggattaattaggttcaaaagaattcgtctcgtggttttcaggtaaattataaaattagtttttcattcataaccgacgaccctttaaacatctcatcaaacatccacacttaaaattttttttcctgatttaaacaggccatactactagtactggttgtatcgatctgctagggcaggaccgcaggagtagactgtctgcctgcagcagctattcttcaaaagcgctacagtgtacacccccggaggcaatgtcagatcctgcagttcacgtgaaaacgacataattaaacggacacacattatttttaaaacggttttgctaaattttctgcgacacattttctggttgattacagtcgtttgttgagacattggatcggttataggattcgtgctagcatacttaattacgcgtaactagttgtgctttataggttacaggtcgctaattagcggtctactggagaactttactactattttttcttcactgcatgcactcgatcaagtatgagtatttgtaccgaccagcgaaacacatatgtaattaaagtataaatatgtaattagtatatattagtagtatatttagacagtagttacatcctacttacacaccacttacatatataattagtatgtaattttgtgacttacatatgtaattttagtacttacatatgtaattctgggacttatattgtaaatacactaaaattacatatttaatttagtgacttacaatctaaatacatgccgactaacttttggtgaaaaatatggcgtcataaaattattttgacataattaaacggatacacataatttttaaaattattttgacgtatacgggcacacatttaaaatattaaacgtagactaataacaaaataaattatagattctgaccgtaaactatgagacgaatctattaagcctaattaatccgtcattagcaaatgtttactgtagcaccacattatcaaatcatggcgtaattaggctcaaaagattcgtctcgtaatttatatgcaaattgtgcaattgatttttttcattcacatttaatgctccatgtatgtgtccaaatatttgatatgatgaaaaagttggaagttcgaaagtaactaaacaccccgctgttcgtggggcaaggttaaggccagttcgagctgttcgtgtttcggaaaattgaacggattagtagggtatgattaacacgtacacccttcgtcttataaaaaattaggtgattcctcgccctttgttatggaaatttctaagtaatttttaatatttttaatcaagctaaaagtaaaattatattagttattaacaattaataaaactggtttatcaagctatgttcagagaaaaatatattagtaaactttacatgagattgtagatgaaatatgatatcccgcactttaattatatggatgaatatatgctgaagattataaaaatgatggatacatataatatgttaaaaatattgtgaaaaataatatgaaggaagatgattggatgttgatttgtagaattcatgaattatagatgatgttgcatgcttacatagattatgtatgtaattattgctagcagatgatgaggtggcatgtttatatgttgaacattagagtcaatgggttataactttatagtaagtaagataggatatcaaatgctcgttcaaattcatctctaagagttactttttacagagaaagtattaactattgtagattataaaattaattacttttaaaggtttttatataaaaaatttattcacaaaacataccgtaaaaattatgattacagaagacgagtgaattgttgtttcgagttgctaaaaagaactcagtcaaagtgatcatttcgctcgcttatataacaagaatgggccgtgctgagctagggcttggtgttcggcccgatcctagcctagagtcctagaaaacagaatttcccctctttaattcagaaaactaagggactacatatatatttattaataatatttcttccaaaaattcgacatatgtaattatagtatatcatgatgtaattatattgtaatttgcacgtaactaaaatgtaactttcaaaattcctccgtaacatgctattttcgtgaaacggaggtcgtggaaccgaatcctcttacatatgagtgcgctgtgattttttcgttgctcaattgcacaaatcctgaaacaaatctaacaattcaaaattatatacatgtcttaatggggtgctcaggaacctagtttagaaaaaaaaaaagctatagtttatctattttcataatgtgcgtaccccgtcggttcaaaattcactgctacaaaacttcaaataggtgtcggcactataggtgccagaagtgttaaaaccggcacctataggcttttcccaaccttcgcggtccaaaaacacaaaaaaaactgacactgttaagtgattataggttttggttctataaaaaaactaacacctctctatacttgaagtgtcggtttttagtaaaaacgacacctttaattaattataggtgtcgggtttttaaaaaaccgacaactacaataaataaaaggtgtcggttttttaaaacaaccgacaccttttaaaaaccgagccgtgagccgagccgccgagcgcttagtcaagcggataatgtcaccgctctcatcattcttatccacttccgctctctttctttcttttttctctctttccgctctctgctctctcataccctcccctcgcctcttctcctcttcttctctcgcacccttggcggcccggcagtggaggcggcaccctctgctagatccggccgagagcggcggcctggcaggaggggaggcgggggcggcgcctcccctccgtcagatatggctgggaatggtggcccggtaggaggggaggcgggggcggtggcagcaggcggtggcgggaggggaggcgacggtgacggtggtgcctctcctccgctagatctggccgggagcggcaacccgacaggaggggagcgggggcggcggcagtggtgggagggaaggcaacggctggcgggaggggactcggcgactcatgtgttcttgtgtgttttgtgttcttgtgtgctcatcagttatttgtgtatgacttgtgtgttcatctcatgttcttaatgtgttcttcatgtacatgtttcatgtgaaattgctcgatgcattggctcaattcgggctgatgcatcgagccggctttttttttattcctgaggcctcaaaggtgctagttttaaaaccggcaccaatgactgaacatggtgctggttgggaaaactggcacctaaggccggttcccaaccggcaccgattagcttctctgtagtagtgacactactacaaaatatgtaaatggtgcccgttggaaaaccccctttggtgtcggttttcccaaccggcacccggttggcggcattgattaccgagggtcaagggtgcctgttccaaaaccggcacctttgaggcacccatgagccaaaaaaaacggctcgatgcatcgagccgatacattgagccatcaagccgatcccatctactacccaaatcccaaaatttcctcaaatcctcagaaattacattcattaagaacactcatcaacatcacatttatcaataacacatcaacatcacattcaaatacattcatcaagaacgcattcatcaaattcatcgagaatcggaaagagaggaggaggacgccactgacgtctcccccgtcgccgccgtcgtcggatggagaggaggagggcgccgttgccacggcaccgccgtcgccacctccactcccaccgccgagccgccgccgccgtatcccctttagccgatgggccgccgccgccgcctcacctcccaccagatctggtggaggggagtgcgccgccgccgggttgtcggagcaccgccgcctcccctcacaccgccgacccgcagccgccctatccccttccgccgctgggccaccgccgccacctcccgtcccgccagatttggcggaggggagggcgctgccgccgggccgtcggaccaccgccacctcccctcatgtcgtcgacccgcagccgccctatccccttccgccatagggccaccattgccacaaaatataataggtgccggtttttacttagaaccaacatctataattacttaaaggtgccggttttttacgatttcaacccgcagaggtgggaaaaggcctatagttaccggttttagcactactgacacctacagcaatggcaaatatttgatattttgtagtagtgtgattagacaccagtatcaaactaaatccgatctaaattagagaaagtcctccacctccattctgaatttctgacgtagctcagtcccgatcaccacttcacgaagcctatccctgatttatactccagtaacatccagcagtagataaagcacagtaaaattgatccaagccaacccaacccacacgcagagcagaggacgccgtggccacccgtaagagcaggtacaatagcagcaggttacatgtgagctaaggagatgcggaagagaccagagaggagagagaagtaaaacaggctacaaatttataatcagctataacacagtctccaaaatattatgtgtatgagaggtgggatcgtatattaatagtgtagtatatacttataaataactattgtatgaatgagtagtatcttaggctttgttctcaactctcccatctcgttttccatgtgcacgcttttcaaactgctaaacggtgttttttttaaaaagtttctatacgaaagttgtttaaaaaaattatattgatccatttttttaaaaaaatataatacttaattaattacgtgctaatggatcgttctgtttttcgtgcacggaacatgggtttccaatccagtctgccaaacacagcctacttgctcatcatcttgccaaaaattagtagtactagctgttagagtagtccgtgcacagcttaggccattactaatgcgtagctctgggtcgtcccctcaccggtgggcgttcgctttttcgtccgcgccggctccccacgatggagcgcgtcccccggttgagggacacatctcttgccacttttcggccgagcaacacagccgagagacgcattggggggcgacagctcctgtgggcacaggttccccgtacgtattcctattccaccccttggccggaggatggggataaggagggagacgtgttcctgttgccggaggaggaggtggagaccaggagcgcgtgcgcgggggtgggggggggtcggaggaaggggaggagaaggcttcatcggtggcggcgaggtcggcggtggcgaggtcaagcatgcggcggaacttgaggaagatgaggtaggcggcccttgccatgagaaccaagtgcgatggccgccaccgccacgccattgtgccccctcctcctccttccgtggcgtagcaggggggtggggtgggggtgggacagagggcacgcctcgcgtctccggtgagcctgacccgaaaaagccgtcttcccgtcgtcgctggcgctgggtagccccgtgacgccgctccccgggtccgacgaggccgaggaccgtgccattgctgagcaaggggatggggggagggcacgcctcgcgtctccagcgagcggcggcgcgctggatctggcacagtgcggcgtgggaataatgggagaaggagtagagacgggcgacgggcggaggagagtggcgagcggctgcggcgagagggagaggcgagtggtggaggggagtaggcgagcacacgcggagggcaggaggcgcgccggtaaataagagaagagagagggagaggagaggggtagtataataaaatacctacgtgggctttttaggctagggacactcgttgggccactaggggtatcctccattgtaaggagagtttcgtagagagtgctctcgttgcagtatccctatttgtacatgcccttgaggttgtgtttagatccaaactttggatacaaacttctaacttttttcatcacattaacctgttatacatacacaacttttcagttacatcgtatcaatttcaacccaaactttttaactttgaaagtaactaaacacagcatgagtgtcaatgcatgtagtacactgtactagcagctttatgtctgacaagaccgccacctgagtggaccccacgacgcgtgacatgatgacggccgcgagacggtcggacgctgagcgattgagacatggagacgtcgtttcaggatgcgttgtttgcattgcatgtgcacggggacaaacgtaatgacgtcgcccctcgagtactctacgtgttcccctccctcgtcacgtctcctctccagatactactactacttgtactagtcctaccgtgtgcttgtgcatgcatggcccatgcacgtcatatcgccggtcagtcatcttcacgtccacatgcatcaccactggtcactggagtactattccattccacgtcggaatatgtttatttttactcatcctgattaattgtcttaaaaataaatttaggctgtatttagatctacgggtgtaaagtttgggcgtgtcacatagaatatacggacacacatttaaagtattaaacgtagtctaataacaaaacaaattgcaggatccgcctgtaaaccaagagacgaatttgttaaggctaattaatctatcattagcaaaagtttactgtaacaccatattatcaaatcatggcgcaattagagttaaaagattcatctcgcaatttacatgcaaactgtttaagtagttattttttcgtcaacatttaatactccatgcatgtgttcaaacgttcgatgtgacgggggcaaaaaaaaaatttacctgtagatctaaacacccccttagttttaagtgaccattgtatcaaagtttataaaagtagtagatagtaattatattagaaatagataaagagagaaatacgtgtcctgggatttaagaaaccggtggtattttgtttttttacatatattcatatgtatgaaattgatgaaagaaaaattagtactccctccatttcacaatgtaaatcattctagcatttcccatatttatattgatattaatgaatctagacattcattaacatctatataaacgtaggcaatgctagaatgacttacacgaaacggagggagtagtaacttgtttttatagaacggtgaaatgatcgaatatgcatctccgacgacggccctgcatcgatcactgcatgcgtgtgctgggtattcactcttctgtgccgacccgactcagaccaatctcttgttcaacattcatgcattcacgtactaacgtactgcatgccttgttcctaaaatataaagattattaggattcagattttataccatgatatccgttttttttgtgtgttgattctcataaatcgcatcattttagtgatttcacaaccaatcggatacttagaacatctaagcaatttaaaattttgaaaaataacaatcaaagtgacaaaagctattttttttacttaacatcagtatttactaaacaattaatttagaaatcattttattataaagtactcatgtactactagctagcagtagttgtcactgcgccatgtcgactgagacccaggccatctcttgttcaactatgtacttccttcgtctcattttaaacgtagttgtggatttctgtatccaatatttgatcgttcatcttatttaaaaaaatcataaaaaactaataaaataagtcacgcataaactattatttatattttatcatctaataacaataaatatactagccataaaatattaagacatacgatttaacgttagacatgaaaaccaacaactactcttaaaatgagaacgagacggatgaagtacgttattattactcgtacacacatatagtacacaaagctagctaaagcttgcatacgagtatatgcttgttctgggctcttggtcgtgtcgtctacttgctgtctgtatggattgagacgatgctaggcagagagcacattaacgcttacgtgtccatgtacttgtgctgctcgagttgtacgaactacagtagtgtactacgactcgagtcgtcgcagcgaaaaggttgcattgggccggtccatggaccggttaaagcaaggtaacattgcgttagtacattagtactctgtacaatattggactatgtgctagtacaagtactatactctgatgatgtactaactggccagcctactatcggccatagaactattaattgtattttgtcaaaaaagaaggggaaaaaaacttgtggagtttgattctaacggtcttaaattgttaggagtatgcatgttggtccggcatagattttccagtcactcgggttttacgagtacaattgaacggccccaccttgtcattcaactgcatgctttgatgaccgtgctagtctgcaactatggattcgaagagagaatatttttttaggttgcccggtagacccacacgcatacacggaggaggctcgtccacacgcatacaactatggattagaggagcatgtgtcgctgacatatggtctcgtaacggtgcactacttaaaaaaaaggccatagggtcaatatcaatattagtaaccgacatctatgaggaaaattaaactggcacctttagctttgctcgagcaaagaaaaaaaaagaccagctcgaatcgagccgaactcactaagcaccatcgctgcaccatgcgcccatgcgagttgctcccaaatcaaattgaaatccccaaatcatccacaaatcatcaccaaaatcaattgacatcacagataatcacccacaaatcgtcaccaaaattgtcgcttgggctcttaccatccaacatcacaaatctctcaaattgttccttgaggatctacaccttggactcacgaacactatccgtgccttcatgcaagttccgaagcgtgtcccaaatcactttgtcactctcaatgccatccacacggttgaactcacttccactcaaggcgctaagtattgcattagcggcttgagcgttcttgtgctcgttctcgtcgtcctccttggtgggatcttcgggattttgcaaaacatagcatttttcgactattctccaaataaataggttaatagacttcaaatgtatcttcattttatgcttccaagcggcatagtccgtaccattgaagtacagagctttgtcgctataggtactcacataagatgtagatgtagggggatagtcataagggatcttagctcccttatcaccatcgttcccatcccccgcttggcccgacatgatctctccaagcggttaaacctaattaggagattaggctctgataccaattgaaagtgttaattaggcctagaggggggatgaataggctaattcaaaaattcaattaaaagcgaaagcagtaattttcggatatttccgaaattttcggatatccgaaaattttcggagtcagcacaaatagcaaagtaaatcctagatctagttgcctacaacaagaatatgctagcacaaatagcaactagaactatagcggctcaaacaagcaaagctagtggagagggaggaagtaaaatcaccaaagatgaagctcacgaagttgttcccgaagtttgaatccttgaggggattctactctccgttgaggagctcactaagagccgggtcttagctaaccctttcctcaagaggttgcactaagcactcctccttccactaagggtatctcttctctttcggaggtgagatccgaccttcacaaacttctcccggtcaaccataagtagatcggtggctcgggagcgacacctagccgcctaggagtcttcaacctccaagagtaacaaatgaagcaaagaactcctggagatgatgcaagtgctcacaaatcttcacgaagtcaacaacaagcactcacacaaactcgaatccacaactctcacacacacaccaaatccgaatcgaacacgggtgagaggggaaataagaaagcaaagctcaaaagtgctagagagagagagcaagccaagggcacaaataattggaatggaaccagcagcactcacaagtgaggggggctatttatagccagaacccaaattctgcccgttatgcacaataattgagattttcggatattccgaaagattttcggacatgtctgaaaattccagctcagcaccaacaacaaagtcaatgagagatttttcggacattccgaaaacttttcggacaagtccaaaaatttccagaaccaaaaacaccgttctggatgttctcggaaaagtccgaaaatagctttcgaacaagtccggaaaaacacaaaagcatttttgaatttgctgaagttttctggaaactccgaaaatctattttggaaaagtccaaaaataaacagaaccatatttgcctccacagtcattttcggaaagtccgaaaatgtttttcggacatatccgaaaatttccaggagcgaaatttggttatgtgcattttcggaaagtccaaaaatgactttcggaaaactccgaaaatgtctagaacaactcaaattgaggagaaacacttttaaaaattgattttgagcactttgatcactcctcatatgtcaatgcatcatccctcttaatagtgcggcattcctatttactcaaatgaaaagaaaagttacaatataccatttgctcctttgccacatcacatcacatcaacgtatttggcgggatatgcattacgctaactcattgaggatataacaaccttcacatttgcttaaataaaaattttagtcctctttaatcgcattgtaattaatcaccaaaatcattaggggcctagatgcactttcactttaactacagcttctcagaatctgcataaaaacctgaacgatttaggagagtttttattctgaaagaaaactgtaggtgccaaaagctccctaactaggcccttagctaacacagaagggttcatggttctgcttgtcaaatagttgtaaaactactcttcttatgaacacaaaagctggctttggagaatgtatataggtagacgacgtaagcttaagaatttgtatttttattaaccaatgaaaaaggttataaatcacttaagttgatatgtggtttatgataatttaaatactatatagattgataataaaaagctaaaagtaaggtgatgactttatgagagaaaaaatgagagaaataatttggacaacagattaatcatttaaaggctagaaacaattgatatgatgtggtctaatgagagaagatagaaaacattaactaagtagggataaagtatataggatattgtagaaaataaatagatatatgctgaaatattatgtaaattatgtgggatgatgatttaacatgtttgtatttgaaaactttagaatatgataaaatatagagtaaatttcacaaaactacatgtactttaacaaaattatcgtaaaaactacaaatgtaagacgttgtatcaaaaaactacaaatttaacacaaaatttatctcaaaactacaaatttaagaccaagtatcgcaaaactatagatttaatactggagttgtcacaaaattacatattttacagtttaaatatctaccactactattatgttagagttataaatgttgtagttttgtacttataacatggtgcaaaacatgtagtttgtgataattttattactaaatctgtagtttggtgatcttcgaagtttaatatatagttctttgataaatttggtcataaatttgtagttttgtaatagaccttcttcaatttatagttttgtgatagattctttaaagtatatatgtagttttgtgaaatttactctaaaataaatgctaatagatgatgatgtgctatctttgctggttgagtttgtaggttacgtttagaatgtagtgggttgtaactttatagataatagagatgtgctaattccttttttcccattgaaatcaatatatatatatatatatatatatatatatatatatatagtaccaataagttcaggagtaagataacatttaaatcggctaattatcatattaccaaaaaaaatcattttcattaatattttctactctcgtgtgtgggttgtttgagtatgaagtcaaatgaatacaaaaccttgatggaatcaatataaccattacgtaaaagtataattaggatcattgcgataaataaacacaataaacttattggaagtggtactagttttcttatgcataaagatgaggggatatctttattttttaagtgcgatcataattttgatatgggcactataacaagaacgttgattaggttctccaatgtaaatatctatccaattaagaaaatgttttaccacctcatagcttgtgatctttaactattttcagttaattgtgtgcctgaacaccaatgcgttcagttctctatagataaagtagataaagatgacattgtgtttataattgggcacatcgctccacacaatcctattgagactgtgaggatttggataaggagcataatgatgaactaaaagcactactaacaggagattttgtgtaactatatatatgtacattagagaactattttatttatagtttaagaaaatgatcatttttattcttatgtatagtgtgattcatatccatccgttaaagatgagcacgatcgagtatacatgtgagggcactatagttgtattggatggtctttgtggaggaaggtaaagttattggagtacacttagccgctgataagtcatggggagataatatttctactgaatctgtgatacatacggaatggttagaattggagatggtatttagtaaatatgtgatacatgatggaattactaggagtgggaatcataagttcaaatatttactctctttaattttgaatatgaatatgaaaagatcaattgttgatgcatgtgttttattaattatatttttttttgttttagttagctcttcatcaggttcatccaaggacacttagactaaatgtagactaaagtgtaaagatgatcttctaatttggtacagggtcgtttagaaaacttaactttaatcctatcgctatactttaggcattggtttgctcgctgctatcagaacgcgctctactatgtacccagacaacagggaggactacggtgatatcaagggttgtcaccacctctacaccaatctaagtactgtgggatacgcagcaaacactagtaattaaccatctagacaccatttctatgcaattaattactactctagcgttagctaaacacaaagtaaccactatctcttaatgaataatagtgaacagtgatccaccaagctaaataggtactaactaagaagtataccatacaagataaatctcagttacttaattaagatattctcaactcgagcaaaataattgctaaggtataaaagaaataaagagagttatcaacaattccgaaactcctccaactctttcgtcctcactgtctcttctttattctaagtatacataaataaatacaaagagcctcttataattcatctgtacatcttggtggtgttgtgaatgaagaggataggggtatttataggccttagaagtgtggagattctaagcatcaaaagagcatcttcactcttgagctgacaagtgtcctccatggcagtggcaaatctaggatttagtatatgggtagtccgacctaattttttttttctaaatacagtaaatctaacgatgctaatatatacaatgcaagtatagataatagaatagaccaaatcaccaaaagtttaatatgatatattaataaagcatcttaaagcatatataattagtaattaagtaaaatttcgatttaaagaagcttctatggctataaaagtctaaagaagattacatactatgttttcttcttatcgggtctactttttctcctcaacaacttgttcttgagtgtgctcctcaatcataaccgaggaagaaggcaatttagaagcattcttctttgcagcgtgttttcaaaaaaagagatgcaatatctccatctttcttcatgcttcaacaatccacaatttagtactacaatttaatatcacaatgcacaagagttcaaaattataaatttgaaaattgaaaacagtacacaagtagaaaacctaaaattgttggcgcgggcggctaggcgacggtggcggcgcactgtaacaaggaggttaggaggcaggtcttcgtgagtccgtgactccgttttctagttttccccatcttcacgatggctcctcgcagtggcataacacactgcagcagtgcagcactacggcggcaaaggcggcgggttggggaggcgtcgggctatcacgcgttggcatcatggcgtcagcgcgtgggccggcggttgcgcggtgctctgatcagatcgtgtgattcgcattggcgctcgcgagggcgtggaggaaagaggcgcattgggcccgacgcaagtcacgcgacgtttaagtttctttccatcccatcgatccaagcgcgtgcgcgctccggcaccgggcgggatcgctattttctctctttctatttttaatattagggtcgatcgccgatttttgggtggtccagggaccacccggaccaccctatggatctgccattgcaccatggtggtttattccgatagaaatgttcacaaccgccttggatagtcgataactactgacctataaatattgagggccaggtgggctgtctctgggttggccgacccaaccgctagctggcccttctggccctaggctttctcctaggccctggtaggtaagtccttggcccagtcacatggtggttgggcccattttctagtatttcgttggatttgtgggcccaagacttcatgggcttggatattaatgtaattcttcccctctgtcagggttacggataagcgaaactgctaatacgcgctcagtcgcgcgccccctcccgcgtgcgactggacacgtgtcgcgcgtggagaggagggcggcggacggcgcgttttttttggcgtacgtttccttttttttttctgtttttccttccgtatattttcagtttacggtttcttttttttttctgttttttctttccgtatctttttcaatttttctaatacatatgtatgcaaactttatatatgtacatatacaaactttatatacacgtatacaaactttgtatacgtgtattttttgggttgttatatgtacatatacaaactttgtatacacttatacaaactttgtatacacgcgtatataaagtttgtatacacgtatacaaagttgttatatgcgtgtatacaaagtttgtatacgcgtgtatacaaaatttgtatacgtgctaatacaaactttttttatgtatgtatatatatacacacacatacacatagtatagtactagtagtagtataaaatactagtatagcagtataaagaggaaggatagtatactagtagtagtacaacgagacataaggggctggactgaccgcgcgcggctgtaggcgcgcggtcagtcgctaatcagccgtccccacggataaggcataccctctatcctaggagttatgagatatacgaatacggtatatatcgtgatatatggaaaggacaagtgtaaagtaaggaaatcagcaaatcggtatggtaaatatcctttatgagtagggctatatatgtgtcctactcagataagagaaacatggtattgtatcgtgcagggtccgatgtctccgagttctacttggagataaagctgacctgcggtataaatacacaccccctgaggggttcagggcatcgaatcctaagggcaagacacccaccaccacataagcaatccggaggacttgaagcctattcgccgaaagatctcatcaagcccctcttgacaaggatctcgtcggtaatctcggagatccgttgtcttctctgcactctgtggttttctctataatcccacataaaccggattagagctattaccttacgaggggcttgaaccagtataatccttgtctccttgtttgcttgatgtcaaatcgtgtaaatcctcgtaccaacgtaccctagtaccctcatcatctagtttacgagtatcccccgtcgacaccctcctttatgtatatttcatctcaactttggttgtttgtcacctgtatccaaatatataccaacactcgtggaaattgttaaaattaaaacctaccactatattggatgttttatattttcaaaattatgcatgtattgacggtgtaaatttggtatttaactgccatcaacagtatcatcataattatattggtgtctttatgattcattgtagacaaattcgacaatagttacaatatagcagcaaaatatgtatcttgtcagatgaagctggtagagccatgtcttaccatggctaataaagcatgtcttcttcaaaccatgcaaattagttaatccatatgacacatattcccatgatctcgcctgcatgtacacacaagactctggcccaaccacatctagcttccatcctcactttttctagtcaccaagttgaaataaatccagataaagaatgaaatagagttcgcatctaaattttcggtttctattgaactagtctgatggtagtattaacatacgcataccacatggtatattacttttcagcttgagttacatatgacttttagaattgtccaaaaaaaccatatgaagaacttacttgaagcaattgaaatataaaattagcaacacaactatattggtcacttacaggctttcaagctaggtacagttttttcacttgatacatttatatgtattatatatacttattggccatttagttttattaaaaatgatcactcatggtcgcatctatttctagagtttgttagcttttgggcatattttagtttttttttctgttttagaagcaaggaatgaatttgttaaagtttatatgatgtgttttatattctgaccaactaaattgtgcacaagccaatttatttaatacgatcgcaaaaatcacagagttggaaaataccattgtgtgttatggttgacacacgggtctcacatatataggattgtattttgcaactaacttatctgtgtggtggtattgtccaaattatcccattgtgcacggcatatgctcttcatttttcatagataaggaaactatttttaggaatattgtttgcacgtgataggggttgacgtgtgcatggttcttccttggaggaggtgaccatggaggtgatgaagaagttaccatatttatcactcttcaatccatgcaacactatttaatttagaatgattaacatgatgatatttgttatattttgttgttcttgttttctgtgtcgggctttttagtttgtttttgtgctatagggatgaaacataaaaccttttaatggttgtaatgttttatgctactagactatatggctatattatgcttactgcttctttctggttgcttaaatgagtaatgggagaaattgaaatgtgctttgctagaatgtgagaggcatgaattgtgatgatggatggtaggcaattaggaataaaattgacgagagtagttgtcccttcttttgcctcccggaaataaaaattcaaccatctcacaaaaaagttgtgataatcttgttgaggaaattatctacttagatatttcggcaagatcaaatatcgctactacataattaatttttgcatacggccaaatcgattttcacaggtggctaggcagcccgcatgcacccaggtgtctgcgaaagtcatatttttccatgcggccagcacaaccgcatgcgaatctcattttcgcatccagtcacatataccgactgcgtggaaaaataatttcggtgaaatatataaaaattcaagaaaaaaattagccaaaaccctagcccactgctggccaaaaccctagctccccaaggcgggtcgtcgttgccgtagcagctgtcaacaaggaccgagggtcggggatggcagatccgcacatcccgatagcgatgccaccggatccaccaccctcgagctccgccatcgccacctgccatcatcgtcatcatccttgtcctcgttactcaaaccagccggtggatcctcgcgctgcgcgagatggagaggcggcgagatccacatgggaggggaatggggcgctggatctggccctcccgtcaccgccggcggctgatccttgcgtgtaggggccagagaggtagagggatccatgcgggagggggagggacgccagatctgccccttccgtagccgccgctggcggatctgcgtgcatggggggtggagcggcggacggatccgcacgggagggggaggggatttagggttttctctgattttgggttttcttgaacttagctttctaaattaggaacaattagtaatatgtgtgtgctaacgctatggcaacactgctagccaccaaaaccagaaattgataagcagtaatacaagtgacgtagcaggtagaaatccaccaaattggcagtaaaaaaccatatcgatattgtgttaaaatgcatataaagattatcacaaatttcgtcattgacatcgtactacatttcatcaaagttaccgaagaaaaggaatggaatgtctcgcaggtataaagacaaggtaacaaagataataaatggatgagtttgtatcattgaaaataagcccttctttcgcccaagtcattgaagatggtaattgatggctttgctgcattctttcgcctccctttccgagatcaagtcctaagcaaccatcataaaaatttggaaatttcaaaggcacatggattaaaatgtgggtaaacaattcgaaaggattaaaaaaatgaaatagtgattaagacctgagtcctactaaaaagcacccaagagatccttctgccagacacattatagaatatttctttcaacattaaacacataaaagaatgacaattacaaaaacgaaacgtagtagcagaccacttgggtgatcccactcgataaaatagctcagtcgattattttgattttttttatttttttagtaattgtccctaatattctcaattgaagcccatagtaaatagcagtaatcctatattgtttcatcacattgcgatggcgtttgaaactcatatagttatgaagataaaattaagtgttttacataaaacaagatggtattaacatattattaattaagatttaattattacaaacttaaaaaatatatttatctgatattttagagcgactatcatataggaagtttccgctcgaaacgtttaaaaaacgtgcacgaatatccaaatttttcatccagcttttgttcgatgcgtattgggcctcaactacattgcataaaccattattggcccattattcgatctgtattgggcctggatagaacttctgggcctatttggcccactatttgtcggtccgaactttctcccgtcgagggggcggtggtcagcgccaccccgcttggtggtcaaaccaccccacaagctttggcgaaattcggaacacggtggaggagttcgccgtccccgagatgccgccgccgccgccgccgtcggtgcgcacgaggagcgtcacctccgtcgcgctcccgacgcacggagatggcggcggctgtcgccgcgtgccgctctccccgttcgacgcgtactgggtcgcgctgccgcccgtccgccgcgtcttcctcttcccgtccccgccgccgttcggagacgtcgtacgcgcgctcagggactccctcgaggcggtgctcccggcgttctaccccttcgccggcgcgctggtctactcgccggaggaggaatcgctgtccattgtcgtggaggccggtggcggcgtggcgttcgtggaggccgagacggacctcgacctcgggaggctcgtcgacgaaggggaggagcacgacgaggacgcgctgcggcagctcgtcccggacatccgccgcgacgagctccccgcgcccgtcatggcggcgcaggtgacggagttcgtcggcggtggcgggggcgtggcggtcggggtggccatgcaccacgcggcggcggacggccgcggcctctggcgattcttggagatgtggtccgccgccgccgcagcggccgtggccaccagtgtcagggaggccctcccaccgccgctccacgaccggacgctggtgcggttcgacggcgacggcgagctggcccggctgttcttgcggcagatcgcgccggacttgcccaaggtgagctcgctctgttctgttcccaccatgctctagcttaattagccatcatgaccaaagaaatcgaaatgaaattgatataccatgacaaattcaaataataattacagtagtattagcaattcagcatgcgcaatgaggagtcaagtagttaacattctctcgtagaaaaatttggacaccttcggtatttgacatggttccatttgtaatcaatgaattctgttaaaaattctgacaaaaagttcagaacaaaaatatgggaaactgtagttctgattactctggagttcatgttcttccattcaaaactatcctgaaattcttcgtgtgttactcttgattcatcgtcagccataagccgagatgttggttgccccttcttttgctactatgattttgcaagatttgaaaattcggaggtgagatgttaatttgaatcagtgccaatagagcgtatgacatctgtattggcttcagatcgaattcttcgtaatgctatgaaaattgaaaaggacgggcttgattatctttgatcatggagatggagatgcctcagttacatcttttgtaaaaaagaaaagaaaatgtatcgtgacttttgacctctgcaacgactaagatatattacaaaagtgcctaaaaaattacacataaatctggtgatttctgcatttgaggatctagtgattatgaatttggaatagtcaatcttaaaaacgaaaatggagcatttcgtcatgaaaattagcattttttaagttcaatgagtaaactgtgaagtttcttactccccccgtttcacaatgtaagtcattctagcatttcccacattcatattgatattaatgaatctagacatatatatctatttagattcattaatattaatatgaatataggaaatactagaatgacttacattgtgaaacagagagaaagtaattacaaacttacaatgtcaatttgataagcatatttgagagtgtcactgacaatctcctgcagatcgttcacgcgcccctgcgccaatgccctctcagccggcgaacgttcacgttcgccgcgccggcggtgaagctcctgaagcagcgcgccaccgtcggcggcggcaagacgccgtccacgttcgcggccatggcggcgcacgggtgggtctccatcgcgcgcgccagcggcctcgccgacgacggcggcggccccgtgttcgccgtcttcctcgcggacgcccgcgcgctcatgtcgccgccggcgcccggcgcctacgccggcaactgcgtcgcggtgtgcgcggcgtcgctggaaggggcggagctcgccgccggggcggacgcgcacgcgcacgcgcgggcggccgcggccgtcgggggcgccgtcgacgccgcgaggcgcgacccgctcggcgaccgcgcgcggtggcacgacaagttcgcgcgcatcccgcccgggcgcgcgatgatcatggccgggtcgccgtggttcccggcgtacgcggtggagttcggcttgggcaggccggcggcgagggcggagctggcgtccatgaaccacgacggggaggtggtgctcgtcgccgggagggaggctgggtcggtccaggcgtcggtggcgatcgccgccgacaagatgccggcgttccgtgagatgtttgtggttgggtgcggatggggcgagcctgactcgaactagttctttttatgtctaattatagattttagtataatgaaataaaatgtaattttcgtaaaaccctatctattatggaccaggtcacccaaaaccatcgggattttggcaagagatatataaccctagtttttatggttcttacgttttataaaaccatgtccttaaccaatttaacatacgagaaaaagaacaatatgccacttttagtgggtttcaacatgccacccattagaatggtaaggataaaatactacttaataggttgctttgagatattttaccacattaaggagttttaagaccataatgcccctattgttgatagagaggaagggagagagaggggagcggcagctggtgctcaccggcggcggtcgcgagcaggggagcgcggttgcgggctgcgagcacgcggggagggcggctagcggcgacggggaaggaggacggtggcgctacgctgggaggaagatgggcgac

SEQ ID NO: 20046 - DNA, 40891 bp, Oryza sativa
  unsure (1)..(40891): unsure at all n locations
tgtcctcctcccccgtcgtcatcggaggcagcgagtgcgcacacgcgcggcgagctgcaagcgccgccgtcctcctcccaccgtcgacgccgccctagtgccctacacatcgtcgcctcctctccctctgatgtgtcgtctccgccgccacccgcctccacctcgtcgccctattgtcctcctcctcagcgccgcccattgcagtccacccccgcgcgctcgccgcccgccgccggcgagcaccagctcggccttctccccggcgcttccctctcccttcctctctatccatagcaagggtattgcagtcttaaaactcctcaaagtggcaaaataacctaaagataacctattgagtggcattttatccttgctattctaatgggtggcattttgttgaaaccacacgaaaagagtggcatattgtactttttctctttaacgtactcctatatcaaaatttaaaaggctatacttatattaagagtaaaaactacatatatttatccaaattatcataaagctatatatttaacatggtgtatcataaaactacagatttaacactaaatttatcacaaaactatgaatttaaagtggaatatcataaaactacatatttaataaaaaattatcacagaataacaaaacttgacatttataacccaaacataaaattagtgctaaggatttaaaccctaaaatcttaattttgcgataattttattgttaaatatacgacgaatatgatgatttgaactgatgataaatcattcatacgattgaaaaataattttctccattaaattagggtacagtcacttgcaacttgttcattatagttgattgattgaattaaggcctggttcagttcccaaattttttttcccaaaaacatcatatcgaatctttggatacatgcaaagagtattaaataaactaattgcacagtttgtatggaaatcgcgagatgaatcttttgagcataattagtccatgatttgcctatatgtgttaatgacggcttagttaggctcaaaagattcgtctcgcggtttccaggcgagttataaaattaatttttttattcgtgtccaaaaacctcttctaatatccggtcaaacatccgatgcgagttccaaaatttttcttttcgcgaacttaaacagggtctaagtcccacgcttgagttatgtctaacattgcgggagatgtgtctgacatcccgttagttgaagtatccttttgcagtttactttgattactggagtagtacattctaccttttgaggggtatatgggtcttctggtcaccaccttaatttttgttaaagtgacaatgatcccttatattaggtccctcggtcaaaaaaaaaaaaaacacaacatagaaggtagtaatgtgatatcttctaattgaacaaatctggacaactaggagggtcctcctaggttgcttttttacatggagtgagtatatatttagactagaaaaaaatacccgtgcgttgcaacggataaatgctattttaatcttattattattatatgttttaaaatctactatgagaactcgtttggatcatttatttagaaaatcatgagccgtaattaggagtccgatcattttaaattagcatgcgagttttttaaagagattttttatatgattcctcctatatttctaaaagcgaacgaatttaaaaaccgactcaaatacggatttatattttcaaaaggaacaaacttaaaaactgactcatacacggatgatgtaccaagtactagcaaaaatatcttcaatatttataatagtagagattggtgtaatatgccgagagagtaggttaaaccgttcaaggacaaaacgaaaattatgttgcaacgagaaataaaaattccaattcatgcctaatttttcagttctcaattaatgcataccaatcccgccatagatgcagaagactgctgactactgtacgtttttgggaacgttctgcccgtattttgcctgaaaatctcgctctctatttactcacaaatactctctccgtactcgtaaagtaagtcgtttaggacagcgacacggtctctaaaacacaacttttactttttgtttctataaaaatatttattgaaaagtgatatatgtatatttttatgaaagtatttttcaagacaaatctattaatataatttttacattttcaaactcaataacttgagagttattgatgatttatattctcaaggtttgacttaaacaatatcctaaacgactttttttataagtacggagggaatatttgacatgggtagaataagattcagccaaacgttttaaaatctttgacaatcaaatttatactagagtaggctcataaaatctaattaagtccaaaatacttttcaggaaaaatctatgaagataattattaaaataaatatctaaaacgctatttatggtgaaagtttcgaaagtttaatcaaatgttgtcatatttataactagaggagcatttcgaagtaactgttcgttgcttagtgtgatcataaactaagaaaacacaatctaagacaaataaaaagaacaaataccatagatatgcggaaagtacgcatactcaaagacaaggttttcaatgctttatttgatcgaagcattagagagaactgcctcatctttccacttacgagcataagctaaaatttaaattttaaaacttaattttagaattaataatatgggttttcactgtattttattaacgtgtatataaaagttttacttgtaaattattattagtaatctgtaaattatttttaattactaataagacatacaaataagtatatgcataagcagcataaggcaaataatgagcttgcaaatctggcgaatttttctgaagtgtgaacatggatgcttctgctatcatttaggttgcgttcgatttagaagctaaatggttagcttttctcagcatacttgcatataattaattaactactaactattataaaattgagaaatagatttgtttaattttttaaagaaacttatataaatatgtacaaaatatatcgtttaatacttcgggaagtgtgctaaagaaaaacgagatagttgctggatacaatgagacttgctactacgggggtgtttatatccaggggtgtaaggttttaacgtgccacattgggtattatttagggtgttgcatgaggtgttcgggtactaataaaaaaactaattacaaaatctgtcagtaaatcgcgaaacaaatttattaagcctgattaatccgtcattagtaaatgtttgctgtagcaccacattgtcaaaatatggagcaattaggcttaaaagattcgtctcacaaattagtcgcaatctatgcaattagttattttttagcctatatttaatactttatgcaagtgtttaaacgttcgatgtgatagggtgaaaaatcttggggtgtgatctaaacatggcctacgtactccattcgttttatattgtaagtcgctttgactttagttctagtcaaatgtttttaagtttacccaaacatataaaagtttttaacacaaaataaatatactattaaaatatattcaatattctatttaatgaaactaatttgatgtggcaaatattgttaaaaattttcaaaaaattggtcagaccttaaaaagtttgattaaaaaaattaaaacgccttataatatgaaacgaattaagtgctactccaaccatttcgcgttacaagtagatttgactgttttaaaagcaaacttttttaaagtttgaacaaatttataaagaaaaagtgtaacaacacttatagcgctaaattagttttgttacattggacattgaatattgttgattgtttttgtttaatttttttaaatatgctatattgttttataaagaagtttatcaaatctaaagaagtttgacttaaaaaagttaaaatgacttataatatgaaaggaatgtagttgcattttagttgaactcaacttttaaaagtagttgagttttaaattttaaagtagttgtattttagtacttctataaattttaaacgtagctgcattttagtacttcctccgtcccataaaaacctaatataaggcctcgtttagttggggaaaatttttcagtttggttgtcacatcggatatatggacacacatttaaagtattaaacatagtttaataacaaaacaaattatagatcccatcaggaaactgcgagacgaatttattaagcctaattaatccatcattaccaaatgtttcctgtagcaccacactttcaaatcatggcgcaattaggcttaaaagattcatctcgtaatttacacgtaatctgtgtaattgttttttttctatatttaatatttcatacatgtgtgaaatattcaaaatattcaatgtgatatgtgaaaatttttgttttggaactaaacaggagtgagtgggaatgtgacaccagagcgtatccggataaatgtatatgcgcatatggtttttttttatgagtgaatacaagcttgcctaccatttgtcacagccggatccgtggcgcaatggtagcgcgtctgactccagatcagaaggttgcgtgttcgattcacgtcgggttcaaacccccgaaccatatccgggtttatttttctttttttcaattttttttaccttttcccagttttcattttggcgcgagcctttcccgccaaaagaagccccctcttccgcgctactgccctaatcccgccgccgcagccgcagccgcagccgccgcctcattccccgccgtcggagatcgccaccccgaaccacccgcgccgccgccgtggttagcgcgacaatggctgcgccgcccggtgaggctccgctcaccgccgccaccaacatcgaggtgcgtttccatctctctctctctctctctcaggcggttgctgcccctctcgccggccggcgggcgccgctgctgctctgggattaacttccgttctccttgcagccgttctatgtcctccacaagggcggcgccgctgcctcgtcgtcctcctcgtcggctccctcgctgccgtcgtccggccgggcgcgccgccggatcgacgtttccgggctggcatctcccaaccccaaacccgggaagagatcccgcgacgacgacgccgctgaggacgacgacgacgacgagctgtacgagcggctccgcctcgacgccttccaccgcgtttggtccaagatccagtccaccatcaatgtgcaaactcaattcccccatattccatcgattcgtttactactcactcgcttaattcctcagcaattgcagaatctgacgagtgcgatttctcatcttgggattgatccaattttcgattgctcgtgtgggcaggaggttcttcgggggatcagcctcaagctgttcgaccaggtgctgcgatgggtgcaggaatccttctccgcagtccgctccattgcgagaccttccgcagccgaggtgcggcagccataccctctcctcaccgatgtgatctgcaggaagataccgacggcttttgttctcaccagtgagaatccgccatcaatttgttcagctggttggtaggtgtggcgaagaattgctcggtttgatggtttgggcttcttaattttgcagagaatgcggagttcgttgacgacatcacgacattccgggatcttgcagagtatcttgagtccaatggatgtcacctggccaagctgtcggcgactgaattatcggaaaaaaatggagttggttgttgcttcaggagcttgttgaggcagctactttcagatgttccagatgtgagtgacatggcctgctctcaagtcttttttagctgtactttacttgagagtttgagactggagtgcatagccttacttgttgtctgttctggttttgtcactcgaataggtagcggatatatttgcacttgcatcttggtactctgcagctgagaactatgatcagcctatagtcgtcgtaattgatgatttagagcaatgctctggtgatgtcctgggagagcttgtgatgatgctaaggtaaaatttatgtttcatagcattcaatgggtttaaacaactgcggttacatcaaacatgaagtacataaaagttgttttgaccacggttctataccttaatatggttgcttaacatatagcccctccgttctgaaatatttcttgttgtttagttcattttttaactagccaacgtcatacaaaaagaaacacagggagtatttgtttttatcttctctctctctctctagaaagagaggaaggatcctctcccatttctattatcagaagcaaaacagtgaccacaccatccagattacaagattaaggctaaaacagaccccaccttttagccctggatagcgtgatcccactattttcagctaaaaagtttcaagatgctaaaattttgaacgcaatcatgaagctaaactagagagcaactgctacattttcagattacagttcctaaatcacacataacaactcggtttcataaaccctccccggtttttgagccaaaacacagcattttactttcataagcatccatgtcttctgtcttgccatcatgacacttccccttctatcccccttctagtcttctacttcagccttcttgtcatgcttcattataactgatgatagcataaaagcataccaatttgttgtatgatatttttttctctgttttggtgtggaactcaccaatcccttgtttaatcctcttttagaagatattcttcttacaattaagaaaatgaacctggttttatctttcatttatatccttagtttcacctaataaaatttatagtcttgggtatgattttaacctgaatattctatctgttgcagcgagtgggtgattaaaattcccatcttctttgtgatggggattgcaaccacccttgacgcaccaaggaaactactctcatcagaagatcttcaaagattagagccgtgcaagctgaccttggggtctccttctgatagaatgaacgcacttgttgaggctatccttgtcaaaccatgtgctggattctgtatcagtcatgaagttgcagttttccttagaaattactttttcaagcatgatgggaccataacatcttttattagtgctctcaaggttggttcttcatgttaatcttaatctcttttcactgatgttaacaagttgttatttatgtttttccccttatttttgatggatgctagtactaaatcaaattttatgcagcttgcttgtagtaagcacttctctgtcgaacctctgagcttcttgtgcatgggaatgcttgaagaggatcgtgaggtctgttttattttcttccaaacataattcaatgttagctaattatgttcttctatcactaactggaaaataaatatttttaagtttccatatctttcggtacaaactaatatcttgtattgacatggatttatttctttctgtcttatcccacagaacttctggcatgataagtttaatgcactaccccaagaattgcggaaatatgcatctggtctcccgtcatgcacaaggtacaatactgactttaaagattttcaccagtaatatactttgtctaaaaatttccattgcagggaaaaggactcaaccaagtctggcgacaatatggttgacgggttgtctgagcttatgaatattcaaaaagattggagttcagttctcttggtaagttttctttgttctccagaactttcttatgtttctagaaaacagagttgcccagctattttttttctttaagactcagattttcaagttcatttgtctattgaccttgtgatgtctaaataaaagctaacgaaatgtggtttactcgtgatctaaacttgatgggtaccaacaaatgtgttaccatttgcaattagagacagtggaattctggattatcacttcctttgtacttatgaatacttggataatatcatgcaagcctttttttctgcttaagttatagagccataccatcgaataatgtatttcgtatgttgtgattatgcagtgcttgtatgaagctggaaaacatggtaaagtgcaacttttggatattttctgtgaggctgtaaaccctgacctgcacactcagaaggcacccaatctaccaaatgagaagtcaggaactagtagaagatttatagatcaggtgatggatacaataaggtatgttgatgggagttggtttcaggtttttggatgcgaagcttctgattcattgctctagattatctagcggcatttagtagggtattgttgattaatatccattgtagcttataattactatgggagcaaaggggaatttgggattgtaaaattttgggggcagcgacataatagtaccgactgatggaggtggaccctttactgtaatgcttagctcctcttgatgagtgtgttttattggatcaggtaccttccagtggaaacactattttgtcttctagaagtttggagcatccatctaaacgggatggataaggtatgcttattgctaatttttgtagaaaactttttggatatgctatgaactgccataccatatgggttcaagtttcagatggccactttacttggttgctgtctgcaatctttattcaaaacattctgaagggagataattgcttttggtcatttgatgttcgaagtaataccttttgtgtcgagatggcttgagcatttgtcacagtttttgttttgaccaagtcagataactcattcctagtttttaccagttgaaggcttctggcatagagcctagtgtactaaatgtactttttaaaactgtggtgtgactctagttgagaatgtgttcattctaatcccagataacaaacaaggtgaaagagcttcagtccaccacaatcagtacagacagtgtgaggatcacaaaggataagtggcctaggtacttcctgctttattccatatttcatttaaaaattttattagccaaacaaatattaagaatgccaaaacaagttgcaatagcataatgaggttgagtatctctagtggacgaatctgtactgcatttttcagtttcgattatctgaaactggctgaaaatcattttcatggcatatcaggagatcaacaaatagtactggaaatagtacagtagcactgaatgataaagtggctatgctgttggatgatgttaccaggtaaatgttattataagattgaatcaactaagtactattttaatcttatataacttactagatctatttattcagatgattagtacaattgaactgggattatctttctctattttgtttgcttttcaataacttaaagttctttcagcatctaatgcctagatatttcaaacaggaaatttctggtctctgttgagtgtttaccttttcatgaaatcgtctgtttcaagaatgttagcattcttcaatctgtaagtttttcctttacagaaagaaagccggtaccattatgtactacttacttacataataatctataactatcaaattaactgttttaaattctatcacatctcattgtaggctttaattggaaatccgagaagaatggtccagcttgatctagtcaagtcacacaaacatcttaaatgctcttgctgcaggaagaatggaattgctgtgttggcatccatgcatgatacatcaattatgtaagtcctggaaagtattcttattgagcggcgcatctggtggaaatagccatatggtgaaaacttaatcaattggcatactaagttctaatgtttggaatctaaagctcaaaataacagacgtcattctgttgacatagcatgccatgttaaccatcctttatcctgatgtgatcattaaacccattttttaatgtatttttatgctgacacgtattatcctttttaatcttgcaggtgcaatctagcccaagaatatggtgatgtaatcaaccttcatgactggtacatatctttcgatggcattatcaatagcgtgcattcaaaaatcaaaaggaaaccgcacacatctccctcgaaaaagaaatcaaaacccgttgctgcggagagtgaagccatgatccagtatccttgaactaacctttttattacaatttaatatactaaacgtccacaaatatatttgtacagatactagggcagcatttcttgtaatcattaaatccaggtaatccttgactcattggttccagagcaaggttttgcagagctgtcaccgagctacagatcaccggacttcttcggatgccgagcaagagaaggccagatcttgtgcagagaatcgcattcggcctttgagaccttcaacgctagtttaccaactgcaaaccagtgtttttcagacttgtgatgctcacagcttttgcacatggcggttgctgatgaatgatgatggcatgtgagtttatatgatgttatcgtgcaaatggaggaaatatggattattcagaaaccccaacgacggctggaaacttgatattcggttgacaaaatgaagcagctaccgttgcccatttggaatttatgactgcttgtttgcactgcatactggatattgtcttttattcttgcagtcagtagcattagttctcggctttgttctctgtacatctgatgcagcctaactcatcaagcttgtaatttttgtaattcgagtatgtgaattctgacgcactaacaatccatacgagtgcccttcaattttcgtaaaattgatctcgatatactggtagtaatcagcgtttcaaaagtttagacaaatggttaactaacttgcatggcatcaataacagcaagtcagcaacagcatgaaagctgcaaagcttcatttcagtggagcaattgccaatcatcactacttacaacaattagcaaccatccacagatcgaaaaactaccgttagcatagactatgaacccctttgtctatgtcccataaatggattattcgtacttctaactcgactgacgcggagaggcaattcatcttgtccaaaatgcaatcatatgctcgagcaattcagaatgaacagtagatctcgattagttacgcatgcatagtaaagtacaattaccaatggtctgaacagaactaaaaacatgcagccataataaatatgaacattatctaaaaaaataaatatgaacattgacttacaaaaaaggagtaaatttgaagacataattctatagttaggaaaactgaaaattccaacggttttcgaacacagtggcctaattatcgaatggatcatctccgacacctccatctgcaccatcgccgtcgccgtccccaccgccgtcgatcaacatcggcgccgccgccacctcgttgaagctaacaatggtgtcgtcctcaaatttaaacacgaattcaccatccattatttgggatatcatttcggctactcgttcggaatcaaactccgcggcgcctagctctagctgtgcgtcgccgtccgcgccatccgtcagctcctgcggctgatgatgctcgtgctgcgcctggacgccgccgccgtagtcggcgagctccgggtggtcgtagttgccgccggcgtcggccggtggtggcgccgccggcgagttcttcggcggcgccattggctctggtgggatcgccgcgctgggcaacaggtgttccaacgtattacacgacgcaggatccgccatcccgaggtagccgtcgtgctgcaccggcccgccgatcgatgacggccaccacgccgtcggcgagctcggcagcgccgcgcagctgatcgtgctaggagacggcggcgccgcggcaccgtacgcgacctcgtactcgtcgtaccagtcctgcgggagctccgacgacggtgctgacgcctgtgacgtcgaggccatgttcgcctggtccgccatggacgtcatctctccagccaagcccggcagagcgacatcgccgccgacgacccgggcaggccaggcagctgcagtggcagtgccagcggcatcgtcgacgacgacccagccaggcctggcaattgcggtggcagtagcgacgttgccgacgatgatccggccatgttcagcaatggccgtggcggtggcgtaggcggtggcagtgcctccggcgtggagggcttgtccgtgctcgacgccgcggcggcagcgttcaccggctctgtgtcctccttccttctgatcttgtacaggcggtacacggcaaggtcctcaagcttgtccaaaatccacaaaattaatttatcaagccaaattagcacaaattgaattcgatcaatccgcttgatcatgaatactccctccattttatacgttttatattataagtcattttaatttttttctaatttaaacttttttcagtttaatgtttgactaaataaatttatagaaaaaatatggtagtatttcaaaaatatatatattatcaaaatatatttaatgttagatttaatgaaactagtttgatgttttagatgttattatatttgtctataaacttgaagtttaactatgaaaaagtcaaatcgacttataatatgtaatggaggccgtataatggaatgttaattacaagacaaaacacaatatttagacggagttgctagaaatatagtcgatttttttcagccacttacacagtagttacacctcatttacaccccacttacatatgcaattagtatgtaattttcgaatttacatatgtaattttagtacttacatatgtaattttgagacttacattgtaaatacactaaaattacatatgtaatttatgaacttacaatataaatacatgccgactatttttttataaaaagtatgacgccataaatatagctacaccctatttagatatagatcgtaatgtaatgtatttgcggactgatttgaatttaaatataaattaccaagtactacctggtttttggagctaggaatgatcttggtgtactcgtgcatggcccagttggtcttgacagggttttggtcgccctcgaacctacgctcgtagaacaccatggtgagcttctgaccaacatcgatgccgccaaccttcttgctcctcaccgtcttgctcccaccagatgccttccacgtcccaccgtttgccaccctcatcggctgcctcttgttcctagccttcgctgcgaatagcctcctgctaaagaagtagatgcatctgtcctccatgttctcgatatacgtctctgcacacgccatcgccggagaagaagaagacaatgatgaacatggttttaaatcctcagttatagctgctgctattcttcggttataaatgttaaaagaagggtccaactatttgcttttatgtataatttaactgtaataactccatttaacccactataggtattgctgtttgagaaacccaaccgctaaatgtcttatcccactatttaaaatactaatgacgaaggaaacaacaagagaggggtagagtgacggtggcggcgaagcgggcgtaccacggaggagggcggggtggaattcaagtatcctgatatgctcaaagacgttattgagggcgccggggacctcacctcggacgagcttgcacatgaggatggcgaaaagctctaggtccatggggacgaagtagaaaccgacaggcatgccgtgccggttcttgccgtactccggcaccaccttctccttccccttcaacttcccattgttgttgttgcttccaccgctgccgccgccgtccccatccgccggctgctcgcgcgtggtgtgacgaggactgcgtatttgaggggtggcgcgagatgttctcttctttttgtgggagtgaggcggtcatttgattcgaattcaatttaggggaacgtttttgatttttttttaatccaatacatgaactcgccgccatcgggcatcgggttgcggacaacggcgtaagccatggagattgggctgacgttggcagatcatcacgaaggtgagactgacggtgggctcgccgccgccgccgccgccgccgcagccgccacgggcggagggagagaagggcgggtggaccttgcggtggtggtgattcatggggaccgcggcggctcggtcgcgcgcgacgccgctcctggttccatggcgatggcggtggtggaggcaggccggcgggtagagagccgccgctcgccaacggcgaaggggactatatagggcgtgtgggtagagagttttcttctttcttttttttttcctttttctttctttctttcgtttcttctttttaatggccagacacgtgggcctgatgggccttgaatttgggcctatgctaaccaggagttccaaaaaaaaaaatccaaatttgaataaaattcggatttacacgttattatttagaacaataatgtaaatcattattgttaagataagtgggaaaacaagtgttcctgcttctagtccgaacaggctgcatgcaacccaatcgaattttcggttagtggatccatgccattattgctttacccatttcgaaaaatgtcattactattaaacgacctgtatcattacaattcgagagctattttgagatatgctagtacttacccgtttggtgcattcattaaatttctgcgttaattggatccatgtcattacaaatctgtcattttggatgaatgacactactattctcatcgattcgtatatgtcattcaaattcacacaaaatttaagctgctcttggatttcattatttagttgcaaatgtctccagcaatggcccttttaattgttgtcaatgatttttttttatttcacgcaattattgtgacacttgggttgctgaagttagttacataaattgtccagctctgattgtaaactgtcctttggcacttgtaccacactccattttcttgcagacgcatactaaaggaatattctttgttgcagtggtagtggctcatcagcacggtcattgatgatatctcttggtctgaaggatcattcccaggtattatttgaacttaccttcatatatgactgtaattctccatgtttttctcctgaatcttgccaaatcagcaagcatggtcgattgtactgtgcatattagtgtgttctgaggttagaccccgttattttgcattggaatcaatagtattctcgtgtatgtatatgaaacaattttgttacttctgcaggcaacaatgaaatatattgtttccaccataattgagaaccgcctatggtaatactacctccatcccaaaatgtttgacgccgttgacttttttaaaaatgtttgaccgttcgtcttattcaaaaaatttaagtaattgttaattctttttctatcatttgatttattgttaaatatatttttatgtatacatatagttttacacatatcacaaaagtttttgaataaaacgaacagttaaacatgtttaaaaaaagtcaacggtgtcaaacatttaggaaaggagggagtagtttaatttgcataccgagctggggttggaatggctgggcacatgtctattcacttcatcaacagagatgttgacatgattagtgctgagcaattaacactctcttaccaatctagaatttcgtaactatgatttcttcggagtcgatgtatgacaaactagttatataaccaaagttatagcgagaattgcactactagctttgatgagtattccatctacgaacttctgaatgctaatggttgtattatgttgctttgctaatttgtggcctaaaattggtgaaagcaaagcacttttcaggggcatatttattcggaatttcaaggtcgcttcttttttgatggaattttgttaataatctataccctctctagagcaacacataacttgtactgttgtggtgcagaggccaggagtatcctaagaacaatgtattgactgataagaaagcccgttgttggctgcaatataataggtgaacacgtcacttgtagttagcgttataactaaggtatacaatagagatatcctatgcttaatgtaacataaatattctattgtttttatgggcccacatcttctcctcttctctttctttttcccaaccttgcgcggatgcaggcaacggacatgggcggacacggacaatggcgagggcggcggctgcggcggacacaggtgatggcgtgtatgtcactacggtggatgcagacgaaggtggcggccgctgtggacaagggcaagggcgacgacgacggctgcggtggacgaggacgacgaacacgggtgtggacggtgggacggacgtgggcctccgccgcggaggacgaggacagtgggatggaagcgagcaacggcaacggatacgagcgaggatggcaggacggatgtgagggacaaggacgtcgaccacaggcgaggatggccggacggccgcggacgacaacggcggtcgtagtggatgaggacaacgaccgtggcggacacgggtgtggatgtgggatgaatgtaccctgccgtgcggaggatgaggacggcgggacgaatgcaagcaatggttgtggacgcgaaggacgaggatggcgactgcaggcgagggtggtgggatggccgcgggcaacgtcggtagcaaccaaggacgagaacgaccgcggaagatggtgatggcggacgaggatgaggacggtggccgccacggccgtggatgagggtggtgggacgatggcggccacggaagatggcgacgatggtgacgcagaaagacgcgcagaggaacgagaactggtagcgatggtagcattacgggcccacacctcgggtcgcgcgtgtagccaggtggttaattagtcgcctgcccattctctcttttcctctcatttttccagctcaacaaaaaatcctatgtggacctcctaccgccctttattgtacatgttcttagtgaaatagtaaaattaccaaaggtctatacgaaactaaaaacatggagcaaatagtaaatatgaacattaacttacaaaatcgagtaaaatttgaagacaaagaatttatagccagggaaacttgaaattccagcggttttcgaacgagggccctaattgtcgaatgggtcgtctccatcacatccctctgcaccatcgcaccgctgtcgatcatcatcggcgccgccaccacctcgtcgtcgtcaggaaagacttcgttgtacttaaggacggtgttatcctcgaatttgaacttttaccatttcggcgattcgttcggtgtcaaactccgtgccgcccagctgtgtgtcgttgctgtcggccatggcgccgtagccgtcctcgccatccaccagcaatgccggctgcggctcctgcggatgatgctgattctcgtgctgcgcctggatgccgccgttgtagccggcggcgtcatgcggaggcgagagccggtggtggtggtcgacggctggtggtggcgccggcgagctcttcttcggcgtcatcggttccggcgggatcgccgcggtgggcaacaggtgttctagcatgtaccacgttggatccgccgccatcctgaggtagccgtcgtgctgcaccagcccgccgttcggtgacggccaccaccccatcggcgagctctgcggcgcctcccagctgatcgtgctaggagacggcggcgtcacggcgccgtacgtgatctcgaactcgtcgtaccagtcttgcaggagctccgacgacggtgtggacgcctgcgacgtcgaggccatgttcgcctggtccgccatggacatcatctctccagccaggcccggcaatcgccgacgacgacccggccatgcccggcagctgcagtacaggcagcgacatcgccgacgacgatccggccaagcccagcaattgcagtggcagtagcggcgttgctgacgactgtccggccatgtccggcaattgcagtggcagtagcggcgttgctgacgacggtccggccatgtccggcaatggccgcggtggcgtaggaggtggcagtgccgacgacgtggagggctcgtcgacgccgcggaggcagcgttcaccgattctcttcgtcctccttccttttatcttctacaagtggtacacggcaaggtcctcaagcttggcaaaatccacagaaattgatcagcccaaattagcacaaattgtatccaaaattcaaactcaaacaacaaaatcgatcaatccacttgagcatcaatcagttaattacaagacgaacaaaacacaatgtttaaatatactctctctattttatattatatacaagttgatcttgactttttctttttgtaagtataactttataagtttaaccaaaacataacaataattaacattaaacaagcatattatcaatatatatccaatgtttatatttaatgaaactgattttatattgtagaagttgttaatttttataaattttattaaacttagagagtttaacttgaaaaaaaaatgtccaaatgacttataatataaaatggtgaaagtagattgcaacgtaatgcagattgatttaaatttaaatttcaattaaattaacaaggactacctggtttttggtttttggagtcatcaatgatcttggtgaactcgtgcatgccccaattggtcttgatggggttccggtcaccctcgaacctgcgctcgtagaacatcatggtgagcttctggccgatgtcgatgccgccgaccttcttgctcctcaccgtcttgctcccactagacgccttccacgtcccgcccttcgccacctgtgtcggccgcctcttgttccctgccttcgtcgcgaactgccacctgttgaagaagtagatgtacccatcctcctctttcccgatgtacgtctctacacatgtcatcaccggagaagaagaagaggaggaggaggacggtgattgatgaaggggacagaaagagagaggtagagagggggcggcgaagcgggcataccatggaggagggcggggtggaattcgaggatcctgatatgctcgaagacgttgttgagggcaccggggagctggccgcatacgagcttgcacctgaggatggcgaagagctccagggtccttggggacgaagtagcagccgacaagcatgccgtgccggttcttgccgtgcttgggcaccaccttctccttccccttccacttcccattgttgttgccaccgccgtcgccgccgccttccggtggctgttctgcaatggcgggcgagttagttggttagagttgtagtcaaccaggaggagagaggattaattagtcggtgagatagagagagagctagccgagtcgtgatcagtcgcggtggcggcgctcgcgcgcggcgtggcatgggctgcatatttgaggggagggcgtgaggcgactgtttggttcgaattcaatttgggggaaatcgaaggggagtaagagtaggaatacgatgtaaaacatgatgtgagagaccggctgctatttccaattgtggcagccaggcggacatactatttggtgtataatgttttgcacgtatgtcaatactaatactccctctttttttttttaaaaaaaaactctcccttgacgccgtccgcgcgcgttgatctcctccacttccacttccgattcccacacacgttctccggtcgctcgtacgctttcctttcgagagcatatgcgtgcagcatcccgtttctttatctgtttgttacagtattgctttggcgctcgatcgattcgctcccgatcttcccaacgtcggcaccctccgatccgcctcgatctcattctcagttaatttctcacgcgccagcagccagcagggcgccaatcaagtaaccggcgactcatccctcctctcctcatcagaccgatccatgaatcacaaaattcagattttagccaatgttctagcgctgctagttttgaagttcatctatgagcttgtgactgctaatggttgtacttatgttacgttgctataatttgttgcctgaaattgttgacagcaaatcacttttcaggaccatatctgtgttcgcaagtcagcgatcccaaccggaacagtgcgcacgaaaaacggagaggcaattagcgcgtgattaattaagtgttagctatttttttttcaaaaatagattaatatgattttttaagcaactttcgtatagaaactttttttaaaaaacacaccgtttagtagtttaaaaagcgtgcgcgcgaaaaacgagatggggaagttgggaacaggggtcacttcttttttaattgaatattttttagtaggaaaaagtacgaagtaccccacgaactattgtggtcgaccgaattacccggttgttgacagaaaacacgaggcctgggagatctgcttaactccagtgcaggtccaaagctcgcattcgaatgtatgagtgtgccagttgatttgatcctgtaatcaacaagaaatagaagcaaagaaaccgcagttaaatctataaatgatagccgatcggctaggtaccgatgacacatcatttatctttgagccgatgtcatatgaatcaatcggcgattataaataaatagtaaggaactaaatctattcgatcggctgtagatattaacgatatatagttcttatattaatatatacttaaatcaagtgattgggataggtcggtcatcgtgccgagacagtataaatcacttagatcgaaatatatattaataacaggattatatatgtctatagcataaccgatcagatagatctagcgtgtatcggctaatactccgatactactctacatcaagatattaaaataggtataatgtattaaacagaagcttaatatatttagattgcgacgatatcttgacacagagggcggatttaacatgtcagtgaaacatatagagcgaatatggttaaatcagataagattggctgaaactccgatactactctaatcggtaaccagagtacaggctagagattgatattctaagcatgacttantagatcaaactcaactgatgcaacataaagtacgaaaagaagacaatatctagacatcaagccggtggaagttcatagagtggtagatatcttatataatctaggtcaacgtcgctatttaaccaatcgggtgccttcctgttacaagatgttagccgattgtaggttagatgacgatattgtcgaagattatgtaagatatatgataacttgacgaattacatagccaagattagagtatcataaagatggaagcactaatcccgagaacataattcatcataacaagttttacctcttgttgaagatcgaaaccgatgcagctcaacccgaaagcaagaactcgtcaaaataaaactaaagcaaaaaggtggcgatgcgccgagattgtattgaacgtgtatgttgttaattacatagggctcggggtctatttatacccgagaattacaagatatgcccataccggacacgactattatctctaacaaactctaagataccataagtctttgcggcagacttttgcccgtatttatctataaggaatttacataagatatcctaattaatagatacaattgccttcccaggactctatccgtgcgtggcaatcatcttgaggtacattaacttgaacccgatgtcgtgtacaagtcatattgtcggaatcggctgtatcagcttacttagcccgactcaaacccagccgatcctaatcgtagccgatctggactccagccgattcctgctctgtttccgaactcgatctccgcctccgacttcgctttgatcaaatcttctttcctgacacaaatgttaccaaatttggtcgttaacacatgccccccaagtccgggatatttgataatgttctggatttgccatgtaccggctccgagcaagtttcgcactccgccgcttttgactgttattccagcactttaaatactaaccgttacccccgagaaatctcacgccgtgacttccgttttcaccgctcaagcgaaacctcttctctctcttctccggtgattcccccggtgcaaaggcgatttctaggcgacttcctcctcaacgagatctccgcccgcaccaatgtcgtcttctgccagcccatctggtgcgctatcagccgaatacactgaggtaagttctcatcggctaaatccccttccttagcagcagatcgattttctcctacctcatattgctttccttctcttggttgcctcggatttgtagcatatttcccaccaagtcgcaattcccagtctgacgcatgaaaaccactactttctcggcccaatcggcaatcctgaccccaccgagttcattattggtgaaattaataggatccccttcagattaaccaacccagatctaggtcactggaagaatactttcaagtcctggccgtctctagagaaagttccaccagaaaagagctggactacatggttcaaacgtgtatcagctagtaagagggtttactgggatgaaattggaatcggccaagcacttgaccttactatagcaaactcggccaaagatgaacccctgatggcagctgcttcctacttctggtcaaacaccattaatgcctttttgttcaatcaagggccgatgaccccaactctcatagatatcagcatgatcacgggtctggatgtcacctcatcagccaaccctatgagcttgaacacaaagaaccaatatgacttcaagaccaaaagcataggaggttggtcaggctatgtagcggcatatatgggtcagggctcggtcacccctcaggaacatgtggcctttttgttaatgtggctagaaaaatttctgttctgtggatcaagttgcggccccacaaccaactggcaatttctagctgaagctctagaaacaaagagacaaatctccttgggcaaaattctcctcggctacctataccagatgttgaacaatgcatcggctaagatagccgtcggctcagtagttggagcaggtggaccctggtggctgctacaaacctggttaaacctgatagttatgaaggttgtcaatcggccatccgtatcagaagctaaattcccaagactagagccgattgtaggagatgatggagaagagagtactcatcggagatgcacatcatacggagaatacgcttctacgccaactgatgctggggcaaaactatcggctgaactgctcaaagattggttctgcagcttctatgaaggctttcaaaaagatgctcgagtttggtttctttatgaagattctgcagaacttgaacacccattggacttcagattcgaagacatcaaccatgaaatataccaatcatccaggaaaattttctcggctgtaattagcccatgcatccttcctgttggcattcattaaggaagaaacatccaagcttacgaattctatcatccaatgagctcagctagataacttggaatgggccaactcccaatcggcttattctttgccgacaagatccaataccgaggagaaatttcatcgaccttaatgatggatcggctactcaaccttcaaggatgtcaagcccagaaatttagcccaaattttcagactattttgtgtgttaaatccctgtccaggaccagccagggtacacaaaacgacaagtaatatacagttccaaatgtaaataaagcgtaaaatacttacagaagaggcacttagtcctcacaccgaaacaaaagcagcagtagcggaaaaggcgatcctagcggggcttcagctccactccacaggcaaaactcaactagggtctgagccttggtcttccaacttcgtcttcagcttagaagcactacacttctgaaaaggggaaataatagcaaggctgagtacaaccaccgtactcagcaagccacaccaatgatgcaaacgtgcaaagggatacaaggacggtttgtggctatttgcataaaggcggttgtaaaacattttatttagcaaacagtaaaactgttgaataataaaggtaaattagatctccactgatcaacgctacaccacgttgaacaggcccaaccaacccacctgtactacagtgcattgactcgatttattaagtgtgagactattcacggtgaatctggtcgatcgcccataactgcgggcacggctattcgaatagttttactctggccagaggtgcacaactatacccacaagacacaacccaccgacatgtcaccgcgtcatcatgtgcccatgatgcacacgtcaccatgtcgagtgattgtgacgagacccttcgcataaccctcccctaaccatccacaccacgctaaggtttcacccccacccctcaaaaggtagtgggtggtcccctcttgtgccgtggcgaatccggcagctggacaaccggacaccccggcctacccaactccatcacgcccaccctcgccaccggtgcctaggaaagggtcgagctatacttcagatcaagcagttacccactcccgcttgtggcaagcgctgtaagtcttctagggtttcccgtgaaccggtccttaattgccatgggtgcgactcacaaaaccatgcacccacagcccaccattcagtcgcattttagttggataattacgaccatgaaacatggccagatgtctcgagcacgcagctcaacaagatactagaatgtctaatactgtaattatcccatcgactgagctagtggtaattaagcatggctaatcatatagttctagctaggtcatcaaagtaacataagctaagcgatttatcacccatggttgacaaagaacagatatcaagtaaacatggcacaagcgagcagataggtaaaccctgatcccatgtaattagcaaaacatgcatatttatttgcaaacggtaaaacatttataaattgggaacaacatgctcaaggggaatgtgtgacttgccttgcttcttcacttggattttcttaactcttttcctcgcgaccgcgatcttccgaaacgacggattctacacgctggcacgcaaaatgaggaaaaaccctaataaaaccaagcaaacagtacataaaaagtaaacaaacatgtagaactcaattttagatgaattttgcaatttgaatggcctaattcggagttcgaatgaattagatatgaattttagaagttttgagccatttaaatagatttctataattattaatgatttattgcgcaattatcaattattttctcaaaggaaaaggcattcgctgacgtcagcaaggggcgccggcgccgacacgcgggccccgcacgtcagcggcacaaaggggcgggcgcacggtggactcggtccaccgcggcctagcggcaccgtggacccggaccacgggcagcgaacagagcggcaaggggcgggctcgccggccagcccgacaaggcggcggcacacgcacggacggccgtcggcgatggcagcacgacgcggcgccggacaagggaggcagaagggaaaagggaggaaggaggcctcaccgtgcgccgggcggcgaagggcgacgagcgcggcggcgagctcctcgggacgattgcaggatggcgctcccgcggcggctccacgggcgggaaacggcggacggaggccgggatgacctaggagggcgatggaatgattaggggaaagggaggaggcgcgaggcggtggaaaaaaaagcggccggaggccggcaacatggggagtagctcacctcgacgggaagtagaggactccagcggtgaatggcgagggcgaaggggcggcaccagacgaagaagccgatggaggcgacggcgcatattaaggtggtctgggacggcagcaggaggcggccggaggcggcaaatgcaacgtcggcctcaggttggcggtgggggtggtttttcggtggtggaggggataaacggatcggtggccgggcttgcccgcgcggcagcgaagccggctgcggtggtggcagggcgcgggtgcggctcaggtggcgacgacatgcggctggaggcggtttagggtggtggtgactcgggtgcatggtggaaggggagtttcggcggaggtttgtgcaaatggagcggtggccggtgtgcggcgaggcatggcgaagccggcggtgtaagcggcgcagcgcggcggtggctacggcgacggcggcatccagccagagctcgccggaaagcggcggagcgcgggctcgcgcggggagcacgggagaggaaacgaggagctcggggaggagagggaaatggaagaggagagcacgagggtgctttttataggctcggggaggagaaatcgtggccggacgtgacggatttgaagcggcaacggccggcgacgtgggcgacatcgtgggcgaagtggggattgatttggcgccaaaaattggggaaaagtgggggattttgtggaggaggtggagggaaaccgattttatgcggtttgggcgcgagggcgtgagcgggaggagccggaatcggcggcgacgtgggcggcaatggcagcaatggcagcaatggtggtttcggctttggaggccgaaggtagaggaaggacctgacaggtggggtcgtcgggcccacctgtcggggagggagagagggaggagagccagggggttatttagactttgcgcgaggggaaattgatcgggccgagaagggaggggtcggcctgagagggagaagggaaggagaggggcgagtgggccaaggagggggaaaagatcttgggccaaaagcggcccaaagacaaagaggggaaattttatttgttttctttttattttaattgattaaatgaaatttgtgctattaaaattatttcttaagctccgaaaattcacgggaaatttcagagagtattttagggcacaaagaatattgcaaaatattcccggccaatgatttttaagggaaaattttaattctcccattaattcactcgaataaattgctttaacttttaatataatgatttttaagaaatgcattattaaatgatttttaaacccgaacgaaaatcggggcgttacaaaggaccccctctgggcagtattgacaacatagaactggcaatgttcagaagtaaaaactttgacagatggtggggtgaatggaagctgcatttattccaccaagcagcttcaatgtatatgacagacctcttcccagatgttgtccctcaagtaagtctttaactccacttgatttaaatagctgtttggccgattaatctcaactaatcctccttttgatttgtagacaacagaatcctctcctccccgtcaaagcaacagtggtaaggatatccaatatgccccaggtttaattcctaacggaggtgggctatctcctccggttattggatatgatgcccccaagacctcagctcttcttcaagggctcatcagggaaccagccgataccggcaaaaagaggaaaaccagatcatcggctgtaagcatcacagccccaactaagaagaagaagacaaagaaaaccaagccagccgatgatctgcctaccctagatccatccattgaacaagctctggatgaagagatatttgaagatgaagttgatcaggccacagccgaagtaagcgatactgaaagaacatcatcagataactattttgtcttatagccgatcactcccaggtcttgtaattgcagaaaaagaacactacggtgaagaagaaatcggctgcaacaacatctaagccagctccaccggtaagatagttttaactttcattggttaatttccagctgattctgactaacacttgtttccttttagccttcccctcctccttctcctcctgcacaacaatcgtcaagtgaccagaccccttcagctgtggggagtcatcacatcgaggaggaagaacaaccagctgctcctgctatcccagtaagtttttctttgtctcaacaagcattcagatcggctatgcctgtttaacctctaactgcttctaaatcattgctgcaggtcttagccgatcttttctctttcgacattggagactaccttgatgaaggagaagaagataccacaagcaaagccttagcccctttatctgatgatgtaaagaaaactctggaaagtatcttggatcggctagaagcatcatcactggatagcttggtggttgattgtggctcaatcagggctcggctacatgagattcaggctctaatcccagatgagttagccgatattcttaccccagccgtttactttgagcaacaccaattcaaactggaaagatcaactatctgaaggcccaatcaagtctaatattgatcggctcgaggctcgcaagattgaactcttagcacaacttgaagaatgcaacgctgagctggacatggaacacaaaaaactagccgatctcccaaagtctattgaagaacagaaagcaagactcaaatcggctatcaagcatgttgctgatctgaccaagtctctgaaagttatccctggaaccaacgctcaggatgcccaagccatagaagaagtagagcagattaggcagaaggctatatcggccatccagcgatacttatctcaataattgttgtgtaataaaacttagaatttttgtaatcggctaacactttactgtcttaacaatcctttgtgccgattaatatgactttgaaatatgctaaaaaattttgcactgcattttgatatatatgtgcccccctagttttacaatgtcaagagcattgataaaattatataacaactaagggcgatataacaatatcggccattgtacatcggcaaaccacaaccgattacaccatgaaaaacaactaagggcgatataaccatatcggccatctcaaggcgatgtaaacacatcggctgtcatgcatcggcaacacgagccgatcatgtgttaacccaaacacttgggtaatatttcttcaaatatttgccattgagcgctcgcccatagacttcgccatcaagcccttgcaacatatatgctcccttagacacaaccttataaatctggaacggtccttcctaattcggcgaccatttgccgaatttattatcacgagtaccaatcagcaaaatcaacttccatacaagttcaccttccgaaaaatctttaggtaccactttcttattataatgccgagcaacgcgttccttatccttggtaacctttgcaagggctcgcaatcgcgactgaaccagatcctccctctcatcggccataaggttgtaatactcatcggctgttaaatcgttttgtaactccgtccgtcgagagccgattctaacttcccatggcaaaacagcctcatgtccataaacaagtttgtaagaaggaacttgaatcgatacatgacaagccatcttataagaccacaatacttcagccaaccgagtatgtcattgccaaggataatcataaattttccgcttaatcaatttgatcaaacttttattagacgcctcggcttgcccattagcttgtgcataataaggtgaagaattcaacaacttgatacccacactatcggcaaactgaacaaactcatcagacacaaagattgaaccctgatctgtagtaatagtttgaggaagaccaaatcggtagattatatgctcctgaacaaattgaatagcatccccagaatcaactttcttcaaaggaatcgcctcgacccacttggtgaaataatcagttgccaccaatataaatttatgtcctttactcgatggtggattgatcataccgatcatatcaattccccaacctctgaacggccatggcttaataataggattcatagccgacgccggtgctcgctgaattgctccaaacttctgacaatcctgacaccccttataatatctgaaacaatcctccagcattgtcggccaaaagtatcctgcacgccgaagcaaccacttcatcttgtgagccgattgatgagtaccacagatcccctcatgaacttcgctaattgcaaccttagcctgatcggcactcaagcacttaagtaatactccatcaatcgtccgataataaagctcgtcatccaacagtatatactttaatgccttatatcttaatttcctagaagccgactgagatggattactcaaatactaatgcacatcgtacctccaatcatcggctgatatcgctgcaatttcaactttaacatctttgatcattggcttataccccaacgccccttgagctaaatcattagcttcaagattttttttcttgagatacatgctttaaagtaaccagccgaaactctttcattagttccaagcacttctcattataaactatcaacgtatcgttcttgcattcatattctcctgccaattgactgattactagcaaagaatcccccatgatttcaatgtatcggcttcaacttccttgagtaattgcaaccccttgagcaccgcttcatactcagcttgattattggtcgcatatggtttaatagtataagcaaactcgaaacatgccgccctaggggaaattataactaagctgatgccacaaccatgagtacataccgatccgtcaaagaataaagtccatggcactatctcaaccgagccgattgaatcatcacgatgctctacaataaaatcggctatagcttgtcccttaatcgctttcggtgattcataccgaagatcaaactcagtcaaggaaaatatccacttcccaactcttctctttaatattggagccaatagcatgtacctgactacgtcggctttgcatataacagtacactcattagataatagataatgcctcaaccttgtacacgaaaaatacagacacaagcataacttctccacaggagaatactgagtctcagcatccaagagccgtcgactgagataaaatacaactcgttccttcccttccaattcttgaatcaaaaccgagccgattgacttctcaccagccgataaatataacctaaacggtattcctttctgtggaggaatcaaaacaggaggagagctgagatactccttaatattatccaaagccttttgctgctctgccccccaagtaaactgctgattggcttttaacctcaataagggtgtaaaaggttccaaccttccagacaaattagaaataaaccttctaacaaaatttatcttgccgatcatctcttgtagctctgtcttattttccgggggctgaatcttcttgatcgcattaacgctcctttgggttacctcgatccccctttcatgaacaagaaatcccaaaaactggccggccgacacaccaaaagcacattttgtcggattcatcttcaagccatatttcctggttctctcgaaaactttccttaaatcggctatgtggtcctccacttctttagatttgacaaccacattgtcaatataaacttcaaccagccagccgattaaatcatgatatatataattcatggctctttgatatgttgctccagcactctttaaaccaaaagtcatgacgacccattcaaataagccgattgcactagggcatctaaaagccatcttatggatatcttcctcagccataaagatctgattatatcctgcgttcccatccacaaaactcaaaattttgttccctgatgcggcatcaaccagctgatcggccactggcattggatattcgtcctttggtgtagctttattcagatctcgaaaatcaatgcacaccctgaccttgccattctttttaataactggaactatgctagaaactcattcagcatatcggcagggacgaataaaaccggcatcatacaaccgtttgatctcagctttaacaggttcaagcatattggctttacatctcctcggaggttgctggcatggtctaacccctggcttgataggtagtcgatgttcaacaatcgatcggctgagtccgggcatctcataatactcccaagcgaagcaatctctaaactcttttaggagttctatcagcttggttctaaactctggagacaaattttttctaataaatgtcggccttggccgatcgcctggacctatgtctatttcttccaactcatcggccgacatgaaatcttgaccttgcttgtcatcgagatcatctactgtatccttggcgtagacatttgaaccctccacgacgccctcaaagtaatagcatgggttctccatcttcaattggctgtatatcagaatcggacacttttagaaaatctccatcccagacttttccagataaacaatcaaggccatccatctcccaaagggctaaatcggcactggcaacattgactgacctgtcggctggcacgatctctgtcttgtcgccttgccattgaatcaagcattggtgcatggtcgaaggaatgcaacaattggcatgaatccaatcccttccaagcaacaagctgtacgaaccattcccattgataacaaaaaacgtggtaggaatagtcttgctgccgactgtcagctccacatttagaacacctctggtttccgatggattaccaccaaagtctttgagcaccatatttgtcttgatgagagcctcggtgttcctacccagcttcctaaacgtagcataaggcatcaaattcaccgcggccccaccatcgaccatcatcttagacatcgtcttcccattgacgtagccgtttatatacaatggtttaaggtgtcgattctccgtcccctctggtttctcaaatattgcctgttctggtgacagaaccaacttagccgatccttgccaacatcttcgcctcatcggttgcagcatcatcggctataggaacctgattcttgacacaccactcctgtcttggctttggtttcctcagtcgatggttgatttcctcttcaacctcctgaaaacgctccctgttcctcaatctctggacccttcttttctgattcttcgtgaaaataccagaaggacaccattgattcttcctgattacctcatcctcttggccacaatcttgattcatcggacccaatctctgatgaacaggaagtcttgcctgccttagccgattacctctactatatgaccggctcgagctctcgatgaaatcactacacccagggcagttttcaatggatggcaacctcatcccttcgttccagcagaatctgaagaactcacaaccctaatgaggatcaaaaccatcgtcgtattcttcataatgcttctcctgctgcttgtcatacttccactgatacttgttgataatcctagccgaattcacttgaaaacctgttgcacggaccctatcggctgcttgactagctgtatgcaccatattaacaggaaaaggattaccatcgaccttcatcggctttttggaatcgtcaaacctaatcttgcccccctcaatggcaacctggatttgctatctaaaaaccttgcaatcgttagtagaatgagatccagaattatgctatttgcaatatctcttcttacctaattcctcagccgatgggatcgtatgaccagcaggaagctgaatttgcttttctcagagtagtaaatcaaaaatcttgtcagccttggtgatatcaaaatcatacttttcctcttttccaggactttttacccattggcatggtatgacctttttgctcctcacccattcggctgcagctatttcagaatcatcttcctcgtcatccgatccatacatgtatggacaaacatgattttcttagagcttctcctgacttccgccaacctacgctcatgcaaggttaccttctgtatcagatgcgataagctatcaaagtcttcggacgagaatttctccctgattggaggaatcataccctggaaggccaaatcggctaactgagcattagttaaactcaagctaaagcatttgttcctcatctccctaaacctctgaatatactcgtgcacgggttcatcatgccgctgcttgatcgctgtcaagtcggacaacttcatctcatgaaccccactgtagaaatagctgtgaaattgcttctccaaatcggcccaactattgatcgacccatatggcaaagaagaaaaccaagtaaaagctgatccagacagagataaccggaataacctaactttcaaagcgtctacagccgatgcttcatggcactgagcaaggaatcggctgatgtgctcataagtcgacacgccctcttgtcccgaaaacttggagaaatctggaactttaaaccgattggggagagggactctttcaaaccactcaggataaggctgccgatacaagcttccagtctcttttggtttaagcccaaattgttctctcattacatcggcaatcacgtcggcccacggtcgttgctgagctgctccttgtggctgttgttgcatagactcgaactgaccatactgagatgcgaactggggctgagccaatccccctagctgatattgggcttgcagggaagggggctgatattgatagctcaagttacccccttggtaattatgaagattcggctggatgttgcgcaccaagtgctcaggaaccatctgaggcatcactgtaccatccggctgtgcatggtgaaccaaatgttctgggatgacctgatttacaaactgctgtacaggctgaccaccaggtactgcgaacccggccgatgcattcaccgaccccgggtgctgaatcggctgaacgacctgctgtcttaacggagtctgttggatcggctgctgaggctgctgccttggtggcgtctgctgagctggttgtacgacctgttgttggattgattgtacaatcggctggattggtggtgtctgctgaatcggctgctgctgcactggatcaaaaataggtggaggtggcagaaacatggcagcgacttgatcttgggttatgtcacgcccagaaatttagcccaaattttcagactattttgtgtattaaatccttgtccaggactagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcatcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctggtcgaccgcccataaccgcgggcacggctattcgaatagttttactctgatcagaggtgtacaactgtacccacaagacacagccccacgacacgttcccgtgcgccgacatgccaccacgacataccggaaagaggccgtgacaggacccttcgcataaccccctctaaccgatcgcaccacaccttagggttcgcccccgtccccagcaggcaacgggcagcccccctttcgtgccgcggtgaatccggaagccgatcaaccggacaccccggccgacccaactccatcacgcccaccctcgcctgggtacgtcggctagagaaaagctacactacaagcccagccgttgcccacgctggcttgtggtaagtacgataagttcttccagggcatcccgcgaaccggtccttaactgccatgggtgcgaccagcaaaaccatgcacccacagcccaccattcagtcgcattttagttggataattacgaccatgaagcatggccaggtgtctcgagcacgcagctcactctgatactaaaaaggtctaatactgcagttatcccatcaactgagctagtggtaattaagcatggctaagcatatagttctagctaggtcacataagtaacatgagctagtcgattcattacccaaggttgacaaagaacagatatcaagtaaacatggcacaagcgagcagataggtaaaaccctgaccccatgtaattagcaaaacatgcatatttgtttgcaaacagtaaaacatttgtaaattgggatcaacatgctcaaggggaatgtgtgacttgccttgcttcttcactttgatcttccgaactcttttcctcgcgaccgcggacttccgaaacgacggaaactacacgctggcatgcaaaacgagaaaaaactctaataaaaaccaaggaaacaggacataaaaactaaacaaacatgtagagctcaattttagatgaattatgcaagttgaatggctcaattcggagttcgaatgaattagatatggattttagaaattttgagccatttaaatgaatttctagaattaaaccgaattattgcgcaattaataattaatttctcaaaggaaatgacaagtgctgacgtcagcaaagggccggcgccgacaggcgggccccacacgtcagcgagccaagggggcggcccacggtggactcggtccaccgcggcacaggcgcgggcgcaccacgtggacggccacgtggcggccacggcggacatgcggcagaggtggcgccgacgtggcgccacgagggcaccgacgcgggcggcgccgaacggccacgtggatggcccagattcactcgaggtgaatcgggcggcctcaggcgggcgcgagccggctcgccgaccggccgaccggggagcggcggagtgcggcgggaaaagggagggggagctcaccgagtagcatacgacggaaggaggtggccggcggcgagatggcaacgcgaggcggtgacggcagagctcgggacggacggaaacaacgacgctccgacgacgggcggcgctcgggaagaggcggatgagcggcagctgcaccctaggatgggaggggaggtgttagggaggacggagcggcgacatggccggctggagaggaagggaagggaggaagggctcaccggcgcacgggaatctggacgtccagtgagtttccggcgatgggaagagatggccgaggttctcctcgtccttgtggagccgagggaggcaacggcgtgggtcggcaatgactgtagcagcggggcgacgcggctggagtcggccagtggtggtggtggctcgggttgacgggggaggggtggttacggtggcgatttgggaaaacggagcggaggccggggtagagcttggcacggcgttgccgacggcgcaagcggcgaggtgcagcgacgactaacgcggcggcaacggccggctgaaggcggtgtgtggcggtagtggctcggcctcgcgatgggagggtggttccggcggtggaggagggagatggagtgaatgccggggtgcggtggggcgctgtgatgctataggtggctgcggcgcagcgcggcagcgacgggagcggcggtggcgggcggctggagatcgccggcgagcggcggctagagggagcacggtggggaggtgtctagggggcgcggggtgctcggggagaggggaaaacggatgaagggaggcacgtgagtcgtttatataggtcccggagggggagaacgtggccgggagaggcggatttgaagggggaagaggcgccggcgacgtgggcgagtggggtggttcggtgccggttttggagggggggaaaagtgggggaggagagtggaggaggtggggtgacgcggtcccgcggtcggggcgagcgcgcgggtggaggaggaggcggaatcggcggcgacgtggggaggccgtggcggcggtttcggctgagggagccggaggttagggatggccctgacaggtggggcccacctgtcggcggctcggggggaaggagagaggaggagacggttgggggagaagatgacaggtggggcctcgggttgacggggaggcaaagcagacttgagggagagagagagccgagcgggccgagggagaaggccggcccgagagggagagaggggggggggaattgggccgaaaggggcccaaagagaggagggaggtttttatttgttttctttttattttaattggttaaatgatcttcgtgactttaaaactatttctcgagctccgaaaattcacggaaaattccggagagtacattagggcacaaagaatattacaaaatattcccggccaatgatttttaagggaaaattttaattctcccattatttcacttgattaaattgcttaactttttattcaatttctaggaaatgcatcattaaatgatttttaatcccgaatgaaaatcggggcgttacaaatctaccccccttacaggaatctcgtcccgagattctgggatggctagaaagaaagccggtgctgatgggcggtctgactgatctgcaccttgaactgccacattctgcttcgaactgattgattgactggttgatcaaacctgcacgattgaactggctggattcgacctttctgttcctttgctttgccaaaactggaccgactggttctgcttgaactgacccagtctaggactgcggatgctcctgaaacttacttagtttggactgaactgttgaggttagcaattttggtaacctgagaattcaccacgctggctataagaggatgaaaatggaatctggcatttataaatcatttaccctatgtccgcttcgactggtcccaattcaaataacaagtaattccaggaaaacctgcttgacctgtctttcgtctgaactgcaaccatcctcgatgctacttctctaagctgaactgttgacctggcctcaagggtgtacattagaattgaacctgttgacttgagattgggagactctgctagtggctcgcaacggactcctttaattactaaccaaattgctgcactgggttgaacattcaagtgaaatgccgacgaggtaaaccaaaactcatctctgagacctacccccttacagtgggtagtcttactttcgcctgactgagaacctttgaactgttgtccttgaaaaaaatgaccaacatttctcggatttacagatgccctgactttgaagactgaaacttcatcggtccatcaaattgaagcaatggcgatgcactttcatcccgacaagatttggaacttaagccttagttgatgataggaaattccacataaaagtgactctcatttagctcatggacacactgactcttgactgcaacacactactgctggagttctttccgctacacttgaccttgcatcgagctttgcatctcccgcatcaatacatccatcatctaatcttggacaccaaatgttgatcacgagcagggttcttctggcactgggataccttgtagctttcaactgaaccattgattggtgactttaattgatcttatctctgacactgaccatccgctgccaggacggaagagaggtggaagagaggggttgctaaagataaggtactaaaccacttgcctactgatatgttgtgagtagacttttattcttcaagttgcttaagcaaacaacctagtatggtcgcatccccaccaatgatgcaaaccatacccctacacacaagcaaacaacacacaatctagaaagctaacggaactactcttctgggaaagattgggtttaggtcatctccgagaaaactccacttgatcttcgcagaacgacgactctgaactgatcttctcgctccttgcacgaagcttgaggctcgaattgacttgacttccgaacagacatgaagctgacagctggtcctctaggtttgacaactaaaagaattggagagattgggaggagaattttgaaaaaccgtttcacaaagaaatgccgaagggcgagaggagacaatttgcaagtagggttttcagaaaacttgtccttagggtttgaccatttggctcaacctacagtcaagttggctctgataccactttgtcacgcccagaaatttagcccaaatttccagactattttgtgtattaaatccctgtccaggaccagccagggtacacaaaacgacaagtaatatacagttccaaacgtaaataaagcgtaaaatacttacaaaagaggcacttagtcctcgcaccgaaacgaaaacagcagcagcggaaaaaggcgatcctagcggggcttcagctccactccacaggcaaaactcaactggggtctgagccttggtcctctaacttcgtcttcagctcagaagcactacacttctgaaaagggggaataatagcaagactgagtacaaccaccgtactcagcaagccacaccaacgatgcagacgtgcaaggggaacacaaggacggtttgtggctatttgcataaaggcggttgtaaaacattttattgagcaaaacagtaaaactgttgagtaattaaagtaacattaaatctccactgatcaacgctacaccacgttgaacaggcccaaccaacccacctaaactacagtgtattaggtcgatttattaagtgtgagactaatcacggtgaatctgatcgaccgcccataaccgcgggcacggctattcgaatagttntactctgatcagagg

SEQ ID NO: 20047 - DNA, 16930 bp, Oryza sativa
tgggccgaaaggggcccaaagagaggagggaggtttttatttgttttctttttattttaattggttaaatgatcttcgtgactttaaaactatttctcgagctccgaaaattcacggaaaattccggagagtacattagggcacaaagaatattacaaaatattcccggccaatgatttttaagggaaaattttaattctcccattatttcacttgattaaattgcttaactttttattcaatttctaggaaatgcatcattaaatgatttttaatcccgaacgaaaatcggggcgttacaggttagccgattcgtagcctgcccgccatgctgtggctgatcccttgttaacaaccaagggttcactagctgtcctagcatcatagctagtgtagcaggcaaaggagtcgacgctggcgccgtcggctgagttgtggatgcaacggagggaactgcttgaacagatggctgaacatcggtgatcaaagattgataatttgggaagacacctccttgcaagtaaactgggcctgcagcctgatgctcagctaccgaaccatcggctattgtcttcatcatgtttgacaacgtattgactaataccccggactgattgatcaaagcatgatgcacagcgtaatcaacccgatcttggaagttattgaaaaaatcttgtgctagttcactattctggttaagatttcctccttgtggctcctgggcgtcatcaccttgaacgccatgaactccttgagaattgtcgccttgatcgctcgaggagccgttggtagcacctttagtactcggctgagtcgagccgcctggagcttgtttcacttctccatctttagaagaaccggtcccaggactatcagcaaccacttttattttatacttctgaacaagtatccccttgcgggtctgcataaatgagttcaggaactgatcccgtgcctattgcagggttgcttcaaactccgccttctgctcaggcgtgaatttctctggatcgatcggcatgacgtggtcatcaatgatgtcagtcaatccctgcttcaacgccttgcctttaacggaacctgggctagatagtggtggtggttgtttctcggccatgaggaagaactgacgtctaacttcttacatgtcccactgggcgtgccaaaagcgtgttgacagaaaacacgaggcctgggagatctacttaacttcagtgcaggtccaaagctcgccttcgaatgtatgagcgtgccagttgatttgatcctgtaatcaacaagaaatagaagcaaagaaaccgcaattaaatctataaatgatagccgatcggctaggtgccaatgacacatcatttatctttgagctgatgtcatatgaatcgatcaacgattataaataaatagtaaggaactaaatctattcgatcggctgtagatattaacgatatatagttcttatattaatatatacttaaatcaagtgattgggataggtcggtcatcatgccgagacagtataaattacttagatcgaaatatatattaataacagcattatatatgtctatagcataaccgatcagatagatctagcgtgtatcggctaatactccgatactactctacatcaagatattaaaacatgtataatgtattaaacagaagcttaatatatttagattgcaacgatatcttgacacagagggcggatttaacatgtcagtgaaacatatagagcgaatatggttaaatcagataagatcggctgaaactccgatactaccctaatcggcaaccaaagtacaggctagagattgatattctaagcatgacttaatagatcaaactcaactgatgcagcattaagtatgaaaagaagaacaatatctagacaatcaagccgctggaagtttcatagagtggtagatatcttatataatctaggtcaacgtcgctatttaaccaaatcggctgccttctgttaacagatgttagccgattgtaggttagatgacaatattgtcgaatattatgtaagatatatgataacttgacgaattacatagacaagattagagtatcataaagatggaagcactaatcccgagaacataattcatcataacaagttttacctcttgttgaagatcgaaaccgatgcagcacaacccgaaagcaagaactcgtcaaaataaaactaaagcaaaaaggtggcgatgcgccgagattgtattgaacgtgtatgttgttaattacatagggctcagggtctatttatacccgagaattacaagatatgcccataccggacacgactattatctctaacaaactctaagataccataagtctttgcagcagacttttgcccgtatttatctataaggaatttacataagatatcctaattaatagatacaattgccttcccaggactctatccgtgcgtggcaatcatcttgaggtacattaacttgaacccgatgtcgtgtacaagtcatattgtcggaaccggctgtatcggcttacttagcccgactcagacccagccgatcctaatcgtagccgatctggactccagccgattcctgctctgtttctgaactcgatctccgcctccgacttcgctttgatcaaatcttctttcctgacacagatgttaccaaatttggtcgttaacacccgtgaacccaaaaaccagacatcgcttaccctaaactttcaataccggacgaattacccctccccccctcaatccaatctagagcggttttgtcctacgtggcgtgcacgtggcaggtccaatcagcattttctgttttttaatggtggggcctacatgtcatactctctcacctcctctttctcctcttcccctctctcaggcgtgggcacaggccgcgcgactgcgggcgttcatgtgagaagaaagggagagagagaggggaagaggagaaagaggaggtgagagaatatgaaaggtgggcccaccattaaaaaagagaaaatgctgattgaacttgccacgtgtacgccggcactggaaacggagacgggagcggcgaactccgggaggagccggagttgtgggcggccacggcggagaacccgaaccgcggcatctggtcggcatagacaacgagcagccgccccctcagcacgtcgatagtgagccgtagtgcgacccttccgacggcgtcggagctcggacacgccagatacaacccgctcctcctcctccttccccaccgccccgacgcgcgtaaagctcggacacactggcaccaaagaaatttgacacgagcatccgtcgacccttggcgtcccacttggtgcactctgccataggacacccaccgacggtgcactccaggacggtgaccactgtggtggccgccagcaccatgatgacgagcgcaacaaagggggaggagaggggaggagatggaggtagggcccaccactccggctccctcctagagttctccgctaccgcctccacgtcccgcgccattgcccacccccacgccgttgcccaccacccgcctccgcgtgacaacagcccgccgtctctcaacctgcacccgatgacgcccgagagcgagagagagcgggggaagaggacaaagagggctctcgcctccacatcccgtgtcgtcgcccaccgcgccgccgtgcgcgctgaccgcccgctgctgctcaacccgtgcttacgcccgacgacacccgagagagagagggggggaagagggggatgacaaagagggctccaccaagagagaggggaagaggaaaaagaggaggtgtgagagaacgacaggtgggccccaccatttaaaaaaaatgctgattggacctaccacgcgtacaccacgtaggacaaaactgctttggcttgagtcgagaggttcagggtgagcgatgtctggtttttcgggttcggggggggggggtaattcggtcaaccacgatagttcggggtggaggtaattcgtacttttttcctttttattatcatatatatactctctagagcaacacatgacttcatatggtcactataggctaatttggagattgggcaagttcttttttcttgttattagtcccccttatgcatggctacacacagcaaagaacatgttgctattttccagatacgaattcttcctgaatagtaaaagaacaagtacgatttaccccctgaactatcacggtcgatcgaattacccccccccccaaaccacaaaaccagatattttacaccctcaagtatttataccggataaataacccccctgagcattgttcttagaggtttacacttgaacttgtacacgtggcgccaacgtggcaatccagtcagcaaagaaaataaaaaatttctctaggcccacatgtcatacatatccctcctagtaccccttgcgtgcgcgctctctctctcaggtggccgacgacagaggtggacctcgctcgggcaggcggcaagacagagcgagctcgagtggccagcggtggaggtggaggcggaggcagaactcgctcgggaagccaccggcggtagtggagcaagctcaggtggtcgcggtgggggcgacgagctcgagcgatcgacggtggaggcggaggcggatcgcgtcgtccacgcggcctccgctcccacccactgccgtcctcggctcgccgccgccagtgagtgatggagttgaggtcgaggttggagcttgcaacggtgaagcaaagttcttgatccctctccccctttctctcatgctcaccagatccaccggtgtcctctgcatgttcgccgccctcgctcccaatctccaccgcacaatccccacccccaatctcccatgtgccatcctcgtccctagcctccttctcaccgttgccgccctcaaccaccatggcactgcttgactagtagctcgagtgacccacgatggaggtggatgcggagcgagctcgacaagctgacagcggagatggtatgagctcgggtggccggcggtggaggcggaggtggagtgagctcgggaggccgccgccagcggcagagcgagctcgagtggtcacgatggaggcaacgagctcgagcgaccaatagtggaggcagaggcggtgaccgacggtggaggcagaggcggagcgcgtcgtccgcgcggcgttcgcccccgcccaccgccgtccttggctcccctccgctgcacccagccggctctgtcctcggctgttgccgtcctcggcccctcttcgtcgccgccaccagtgagcgatggagctgaggggagggagaagagaggggggatttgggaaagagataggatagagagaggtagagagggtgaaatgacatgtttggcccattgatttttttttaaaaaaaaagaaatttctgactggattgccacgtaggaccaaaaccactgcggattgagccagggggttatttgtccgatttacatagttcgggggtaaaggatgtccggttttgcggttctgagggataattcgatcgaccgtgatagttttttttttggggtggggggtggggtgggttaattcgtactttttccaatagtaaaataatatcttctccagtttctacttagctgcactgaggtgccaccatcactacactccacaaaattcaggttaccctgatgaacatagccctaacaatagcaactatttcagttcatatttccgcactatttattgatccatggaactattggtatgctacaacacatagagccatcgatcacgcaaatgcaggaccactgaatttgtgatcacaaaatgtcgtcctgaagagtaattgtcagaacaagcccaaaatgtttgctgggtaggacaggcagttccaacttatgaaactccttacgaactatcttctccttgtagtacacgacacccggaatcgcctcttttccgatcatctcaatgtcgtcgatcttgaaatccgacaacttgcacacgaactggtctggcctcttctgctgcttgaagttggctgacagcatggcattggctttcgtatcataggtccaaccattgtcacctggcttcagctccacccaagcatcaatccagccgtcaggtagagggaatggaccatctactttgtcttcccagttcatgtcgccgcagaagattgcattgcgcaattgtccaagaatctccagagactgctttgcctgagctactcgcttctcgctgtacttcagatcccacagaggaggtagagggcaggggctctctaggtgacttgtgcccacagccaaatggatctctcccgttttgacgaccgctacgcatagctccctcttcattattgatttcgaaaatgggatggggttcgattcgctcaccggtaatttgctcatctgcatttgtttgcaattgaatcagattagtgaaagaagtctagaagaaaaaaactgttgcaaccgaaattagggacagtcagtaatgcttttgaacagaaaaggttgaggctctaagcagaaaaagataataaattcatggtcccagatatataaaactcctctgttcataaaagccaggttgataacttgctcgtggttctttcttagtttcttttgatgaaatgtgttagtgttagcaatgtgaaaagtacttcattgttgtgcgccttaacagtagtaagccatgtaacaccaggtctagatgatcatatggcagaataactcacgttttttctaaaatggcaggatagtggtttcggtcgcttgagatacaacttcccctgcgccgagttcctatggggtagcactggtccagtgaagtgcaagcttttcctctcgcttgcgcttcggcggtactgttagacggccgatcaaatgtgcagccgtgggatggacagtcacaccatttgccctatgtgtgcgtaggaactggaaacggctcaccgtatctcggtggagtacatcttcgcgcgacaagtttggcacaagctgctgtccaagattggcctggcctcattctcaccctgccagcaagcttcgcttcaagatttggtgggagtcctctcgcaggagggtgtagaaccacaacaggaaggggttcgattttctcgttctccttgttacctggcacctgtggttggaaaggaacgctcatgtctttgagggggtactttccatggtggacacagtggtcgatcacatcgtacaggaagggcaactttggattgcagcaaagcctagtcccctaggagctctccttggcatatagacaaaggctctctcccttattcccttgttgttttccggaccatggtttgaaatttcagtaattttggcccccaccggcaagcacaaatctccccaaaattttcggttttttgtcaaatatttataactttggtcaaattttgttcaaactcagtaaaaaaatatgttaaaaattcaaacaattttggtcaaaagaacctgaaaatcacgaaattttcaaattttaggcaaccaccaaaattgcaaaccctgttccggagcccagttgtgtttcttagttagcctagtgtgctctcccccgtctcacctctaacccccccatgaccagcttcagcgggctgtagttgtaaaaactcttttttttttccttgctaatatatcaatgcgtaaggctttttcgcgttcaggaaaaaagaaagaaagaaagataaattgaggtggcacttagataactaatgcactttatctaaaaagaagtaaactaatgcaaaacttgcaattgaactcctgacaattcaactgcgactatcatattaacgctgaccttgtgagacgtttagacctgacaatatgggaaacgatacaagtgtgaaagagcttgcatcatcatccataatttctgctgccattgcatatattatattcatgataaaaaatggatattgctggctgctgaaagtagagagagagagagagagagagagagagagagagagagagagaccaaagagttctgtaacttccagaagcttcaacacatatggtacttgaagtttaagagaagcgttacctgcatgcagaaatgtgacttccgcatagccatctcatgtgacaacaggcatttatattcttgccaccacagtccgatttttccataagctgatatatgtaaggtgtaacctcctacagttcaacattgatacaaggcccattaagaaagaggaaagggataatgcacagtttgaattctgtacctggaagcatatgaagtctgggttgtgaagttgaataagatctccaagagcgcccagccttctgtgcagttcaatatcctctctgatccagacattgtatgtcatgattttgaaggtcttcttgtttaaattattctcaaatttttctgcatgacaagatttgtattttagtgtggccatagcgaagaagaagaataaaagtacagctttgaaggaaaaataaacttctaattatctagatagataacataatcacacacatatgtaaaattaactaccagatttggtcatatgagaactgcggcaactccaagatatagatgcaaaatacccgagcaatttgcatatcaactagatcttacacaattgctcaaacaattaataggaagaagcaccgaaagaaaaatattgcatgcttatggcaatttagtagaaaacaaatgacagaatgaaccaggtgaatagtattctgtatcaagagaatattaaattcagatcacatagagcaaacaaagtatttgtctcatcatacatccatcaatactgcaccctccattaacaagtagatgtcgttttaggatgcgtacagtcaaaggaagtcttaaatcactaatatatgcaaaagtattaagatttggcatgtaaaaatgatatcaatagatttgtcacaaagaagaatttaaaaaacaaatgacttaacattcgtgttgaagactctgatgatctaaaagacaagtaaataacgactggaaggattgatataaaacagagaaaatgtactttctctaagtgtatacaccaaaaaatttgtgcagaacactccaatcggttggatagactgtaaaatggcctccaaagcattaagtagccatctctcctttatttatatatcttgtaccctataagttacagttaattcaactactaatatataccaaaaccaaaattaaatcattccatgtattcccgtcccctccactccttccatgctgcgtcctatccatctcaattgtgaggtgcattgcacgtgcaagatcacaaacttgtaattaaattagctcatcatatgtaccgcaattatgcagcgtggccatgcagaagaggtaaagaattaatagcaattttgcagtcgccattaacattactacccgtttcagatcacatttattctgctgttgcaaagaggaatcagtagattcagaaagagttagaatctctcgtactcgggtgtatcgtatcctccaattaaatctatacaaattaatcgaccccaaatcgaaagcaacagcaggggtaatcgattctggacacagcgaagagggaaaaaaaaggctgcgaatcttgtgattccggagatcgattcgtagcaacacaaagccctcaaatcaaatgtacttttcttggcggcggcggcgtcggagggacgcggcgaacccgccccatctgccccctcgccctcctcctcctcctcctcgtcggcgcacgcctcgcgcacccgcttcttcctcgccctcggaggagggggcgaggaagcgggatcgtcgccgtcgttttcggcgtcgacctccacggggcgcgcggcctcgcaggcggagcagacgccggagccgcttgggttgaggagcgtgcaccgggcgcaggcccacggcggcggcgcgccgcaggaaccgcagggggaccccgcggtggcggcgcaggcgcagggatcgcactcccacgaggcctccgccgctgccgctgccggcggcggcggcggcgccgccgccggggagagggagagcatggtggttgggggaaaggagtggggtttttttgggggtctgagttgtggagagagaaggaagacgattggctttccgaatttgaattggagctattctgggccgtccgatgagcccatcggatggctcctgattcttagcatctttgcgggtgattttgccatttttggtatagggttggtaatgggccgggccgggctgggcttgggcagagctgggccatgtctgatccaagcactagaaattccttgctcgacgcatgccgaccttcttgaacagtggagggtattttagatgtctatcatgttattaatatttatttgtgctaatttagacgatacatggtttataaaagtatatatgaaagtataaatcttaagatcatgtcatgaagaatgtctagaacctctaaaatatagggccagccgtgcaaccagattctatagaaaagaaaatggagtaagttgttcaggatgtgagcgtttcgttccttccatggattctaggcaagcaagatcgtctaagaattgaagcctctctcggcaagacaccaatcaatcaatttcgattggcaagcattgccggtaccaaagtatttataagtgatatgagaaattttatggttttcaaaataatatctcgaggtactaaaactttacgatacaaattttgttacatatcaaattttatatagaaagcgtgatgccttccgattaccttcctcaagaatgaaaaaattactcaaatggtatagtactcttgctgctaatagctgctaatagagtaatacctcatttccactgtgcattgcagaagcatccaatgagccatgtccactgaattatggggggaaataattgagatggagacaaggggcagagcatatatccttttgggtgaaagctacatttcacttatctttttccatggcactatcgatcgatcgatcgatagagaatagctagcagtgtgtttccagaactctacaacatcatcacacgctattttcttctgtgctgatgaaaacgagtgactcaagtatatatggtttcaaacaaaaagaaagaaagaaaacgagtgactcaagtcactgttacgttccctccattaatttgtccagccagttcaatttttttcccccacaagttcaggacaggaaaaatgactacaaatttagggatgtgattcattttccttattaaaaatcaatttttaagaaagaaaaaaaataaacggctccaatcatagaagaggttactgtgtccaatctaccacctcgtaagaacatggagaacccaacttttcggttcttatatatttttcttcgattctatgactacaatttttaatatatatatatatatatatatatatatatatataataaattgtttatgtggcctaaaaattttatgacttgttaccgctatcagaaaatcccccgaacataacctaaatctcactatatatgaagctaaaactcaaggctgacgaaactcacgtgttttgattattgactcagcttgcgtggctcccttaactataacaaagctgaatcttccgcgaaactggactactagtctttacgtctaaaaaataatgtaccccaaactttagtccactcgttggtcttgtcactaattaataattaatctccgaaggatgagcatgaatcatatactatatgtatatcacattaacaaattcctaacccttgggcaccaagaaagatgataaaattaaggataagactttttggcctgcattagtcgtcatttcttaactgctcatgcaacgactttgcataatttccccataaatgttgcagactaaggccctatttgattcagcttggattattataatctagattattaggagtaaactgaaacaaacaagtagattattatgatagattattataatctactgaaacaagtagatttggaggagctttttctagattattgagtggctaaagactcactacccttacatgcctctaataatctagagaaacaaataacttctagtttattttatgtcagcttattacaatctagcttaaactaatttgatttaataatttagattacaataatcttaaactgaaacaaacagagcctaacacactacaccgctaatgctaatacagtatgggcatgtataattgtatatgcttactcaccgatgagtcagattgaagtagcaagcatatatatgcacatggtgagacgtcctcaaataataataataataataataataataataataataataataataataataaaaccgtcggtgtgacctactacaggacttaaaacaacaaattaaattaaatttaaccaataactttcggaaatcttctatactcaagtcatgtcatcaacttgttaatcttaagttggaatgatcagtatgctccttcaacttagacaatgcatgtggcttgaactaatacaagtaggtgatggtagtttgcccttactttggctacgttttatgaccacccggaaaacgtggtggtttattaatatataattaattatgtattaactaaagataacttgaaaaatatgttaatatgatttttttaaagcaacttccgtatagaaaatttttgaaaaaaatacaccgtgtagtagtttaaaagcatgcgcgtgaaaaatgagatggtgagttgggaaaatgaagaaaataactcaatcttgtactttttgattatgtaaaaaaactattagatttcttgtcaaataattaacctcttagatcgatctatttccttgtgtttaaaatgtagagtaagttttagatgtttatgataaaatctactagaaatgttttctatctagtcacacaatcacaagcgtatgttagcattctaaaatgccattttgaagctcaataactcatatataaataactttgttatttttcatttatactctatatcaaaaaatataaatgttatttgtgggggaagaataaaataaattttaaaagcatgttaggttcgattttatggattttcactggttttcatccggatcctcaaacaaacaagtatatgtgtctgcaatgctccctctatttaaaaatttaagaaatatttcttttgttaccaagacaaaatttttttaactcatttatcatgtgataaaactaaggaaatagtatatgcgtgtatgcaaccaataaatattaatacgactccttaccttccgatgaacaatttaatttaacacataaaaactacaaatataaccttagattttgagaaaaaaaataaaaataaaaaattcgaaaaaggatattttttttaaagcctgatcaatgcttaaccgtcagtccacagagctccggacacgtgtcccaaacagcgcagccacgtcaccaccgacccaaatatcccaacacccagttatcgcaccagtattgagccctctcaacattacttccctcgctgacatgtgggccctctatccaatgagcccacctgtcagtgactcaaagtcagatggaagcaggtgagaggatgctcttccagcagataccactcactgttcgaacggacgatactacggcgagcatcagcagcagagcacacagcaaacaacccggaaagagaacccaattccaatccaagcgtgtcagacttatccaaaagggacccccagctcgcgatccatccatccgccaccgtatttaagcgagccatttcgatcattcgagaccccaccgaagcaagagagaattttgaagacaaggtgaaagtttgaaaggggaggagcagcaatggcggacatcgcgctgctggtggtggaggagttcgagaagatgaccaagaagttgaagcagcagaggcagcagcagggccggatcagcgaggaggtgcccgccggggatgcggcggcggcttcgcgggcgggggagtggggttcttgggcggcggcggcggtgaggacgagggtggcggcgctgaaggagcccgccgccgcgcaggggctcgccgccgtcgatggcttcttctccgcttgatctttctttgtttcttcttcttcttcttttttcctttgttgggaagtgatttggtgaagcaggccatatccaatttggaggatttgattttgttttttcttttcctctttaccagtatgtgatgtgtacatatatcgactttgtgaagaaatcgcaactttttctccagtagtttgttcactctgttcatcaccatggcgacttttttatcactcagttcatcagtcatcaacgtggttgatgagagagaggagaaaggaatcttaaaattttatcgaaatttcactgaaaaacatccaaagttttggctgtgaacgcgataaaattttcacgtttataaacactacagacccttcagtttcatcccaaatagtccccatcgtctagcaagatgatttcacacttttttttgagggaaaactaagtttccattaacccatcgatgcggtcaagtcacccgcaaccaagctttgtccaaaggatttgcatctgagcaccattgttccattcaatcaatctatgagtacatttttttattgcaagaattctaatcccagggaagaacgacgccgatgccaagaaacttttgtttcgtttcagatacgacatgctaaatcatacaggaggacgagtaggaaaaggtgctcagagacatttcatatgtaattctttatagcagaatctagaattttttggttatcggttaccctaataaaccaaatccgaaactaagattaaattttcaaacttagaagttgtttttaaaaatatttattccttttatggcttttaagtcgttaagaatataaaagtgttaactacaaactatttttttttctaataaaccgttttatcttattagtaaatataggcaataaatgagagtctttataaaaagaaaaaaaaccctgcaaaaaaagaaaaaaaacacctaaattaaacattccccactcctcaccccatccgacagtgacctcttctgcatacttggcttggacctacatgccagggacacttgatctcataccccatccaagtgaggaatttcacatgaagagttttcagaatttccacaataaatacgataagctttcagaaaaaagacccaccacattgcaagtcatggatttcccagcagttctgttcggtcgtagtgtcgaaaggctcgcagaaactcgaattcgttcatcacaatcctcactgtctcactgagcaacctcgttccatttgttcaattatacttaaatcgtctgaactttacaccattcctcgtatcaagtttcttctgtacgggatttgcataaaacgtgccaaatcgtttcaggcagttcaccctgtctactgaaatttgttcagatcatctcagacaagatatgccggtatctgccgtagtccgacgtcgtcttgaaggtcggcgtgaactcggagaagaagctcagcatggcggcgaggttctgcgcgctgtttatggccacagctttctccaagaacaggacaggctgcacagttattacctggaacagtcaccatgtctagttagttaaagaatgggatgtgacaacgtttcttatgcaatgcaagctttccatgcctttgtgtattgccattacagtagttgtgtgcctataatatcggcagagatagtcgattttgtaagtcatttccattatcctaaaaaaatgtatcaccagtgcaaccactttactagtatgaagtgagcaacggaaattcagagagtaaataacttcactttttacgagttgcaaacttgcaatgcataggaaatacgaacatgatgatatagtgattttataaatttggagcaagatgggagaaacgtgtgcgccagttggcaaaagagtaccttgtattttctagcgtaacgaagagcctccaggtggtatccgtcttgcagtaacgcagtgacgtagtcatggtgcaagccccgctctctcagcatgtccacgcccagcttccttgtcggagagtgttgttgacctaattccatgagttgcatcgcaagttccttggagggttctaggatctgaaggaattggtaaatgaacaaaaatataagcattaatagctggagtgtagcttgtaacatcggagtgtgaaatgttgttatctagaactgtcttgcatggtatatgttgtggtgacaactaattttgggaatagatgcaaaaagattttggtgggaaagcttttggtaagccaccggtggcatcaaaactcaaaaaccttagtaatcgaggttagcggaaatccggtgcccacgctgaatttaatctgtcgcagggaccaaaagggggtgtcagttagacaaccatgattagttagttcaggcttatactacaaagtcagatctaagagttcttccatcagacaaagttcaggtgtgaacagattgaacaaaagtaagtagcagaaagaaagtatataagattgcaatgcaaagagccaaagactatctcttgaagacgtacacaaatttttaaatgaaattgcgaacaataacaccacctcttttctttttgtgtatcttgcaacgcaaattgctaagaatatttccaccacattttcaactttgtgcatcagtcatttgttaagtatgttgaccctcagcttatagcattgttcacaaacaattttatgaacgttatcctgaacatttacaatgaggtgagaacaccatagtaacatactgaccttgttggatacaaacaaggctatttcaggataacggttgctgcgggccagcagtgttgtcatcatcacaaaaaggttaggaggagccttcaacccagctcttgagacactgcaaaatgcaaattaagcttgagtattctatagtgtcacctaa

SEQ ID NO: 20048 - DNA, 816 bp, Oryza sativa
cccagagtccgcacatcctcaaatacaaagcacttccctagttagatgtaggttagacttcccgttcgagaaactctaccttctacctgccctcaatttatgcacgattaatgaatgccacctgggtggaagcgagaggtggaaatggaaggtcttagttcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagattacgctgcgttgctaacgggccgcacctcctatttcctcaagggtgaggaaatgaagtccatgtacaccacctacaatccgcagaatgtggtggccaccgcccgtttcctgttc

SEQ ID NO: 20049 - DNA, 9445 bp, Oryza sativa
ctttcatcagctctttctcattgtgtaaacttttcagagcatggctgcatactaccctactttgttttgtcatctttgctggcagactgatatctaatgtccccgcatgtcttcattacagcgaagctagtgatcatttctaacaactgcccacctcttcggaagtcagaaattgagtactacgctatgttggccaaggtcaccgtccaccatttccacggaagtaagttgacacccatgcttttcgacatctcttgacctttgcaaagatttaaacagtgaggcatgcttgggagtaaatatgtaatcaaattatatcgtagaaacgccatgctaattatttttatgcgtttttttaaatgaaactgaaataaggtgcacagttctatcttctgttgccatggcaatgctgcatttgtttgtagcaactgcaaagtggaccaaagaagacttacaaattcatagataggacaaatgaataaactgtgcagacatcggtttctgccatatgcccatattgcttgattagccagtcttattacattagctgtgtctttgtttgaaaaataacagctatctgtttgttttcagataatgtcgatctggggacagcctgtggtaaatacttccgtgtttgctgcctcagcattattgatcctggtaacttccatacgtctacctagtatttgaaagaaactaaacaaaaccgttatttgatagtaatactgtacaatgcgcttgatttccaggtgactcggatatcatcaagaccacgggtgagcagtaaggatgagcggttccgctggcgcttcagatgctgtcacactgagctgttctagacattgtagttgttgctggacttgatttggtctctctcgtgtatcgaacagcttttaccagtcaaccaaagtttcgtgggaacattgttcttggattggaaaattttgttcctggcccgaatcatgttttcaattagaacgcttggctgtttgttcactgaacttcgcatcattacacgtggttgttaaagagctctttagatgcagaccagcttgcgctgctgcatttgcacgagggttgacgataccgccggtaaccgcgtggcttaccgggggtacggaaatataaataccgtggtaacttccttaaattcatataaatgttaaaaataatttgaatttttgataaattttgtctggttttgtacggtttttatacggtttgggaaatcctgatttgcatgcacgatggagaccggcttcataaactgaccgaccatgggagagctttgccgattcataacgctgtattgagcaaccagcatttcggccatttgaatagaatttatacatctgaattaataggaaacaggacttgtgaaattatctatatatattcctaacattacaaatcattttcttattatttagttgaaatcttttaaaactctgtgatttaacatatagagttagagactttgaattcagtatagtcaaaacagactctgaatacattaagagtaaatttcacagaactacatgtgttttatagttcaagtcgcagaaaaattacatatattttagcagtataaacttggaccacaaaacgtgtagttttatgaaatttactcatatattaacataggccacctatgtctctccatctcgacacctcccgtaggacccatggtatttaactatttgtcactcttagatttgttgtttaattatttaccatccaaatatgtgagccattatctatttatgacatacgtgctcagatgataaatcattaattggcacatttaagagtgataaatagttatataattcttaggaacctgctcgctgctagagctcgagctccgtcgcttccagaacgtctccgccgcgagggaaagcgtagaatgggaggaacgaacagctccggcgacgtcgaaggtgatctacagtggcaaagttaggggagttgagggcatgcggtgatccaagcagccgctcgagctcaagccacgaccaggcatcgaacttagcgtcagggtaagacatgatggagacacacagagcagaggagataggaaaaggagagaggaagtgccactgacagaaacggtcaacttttttcgtagttgtaaaacgccaagtcgagacaaccttcaaaaccgctcagggacgtaaattgatctggttttaggctgtgttctttgccaccccctcttcctcgtattccgcgcgcaagcttttcaaactattaaacggtgtgtgctttttataaaaaagtttctatacgaaaattgtttaaaaaatcataatgatctatttttgaaaaaaaaattagttaatatataattaatcacgtgctaatggaccatggaccgctatgttttccgtactggagggattggctcccaactaaagcaaagaacacagccttaatacttgagtgagcttttatacccgattttgcgacgttaatcttactcggtacatagttgagggagcagttatgtacttttcaagtacataaagactgggttagctcgaagtcgagcccgacccgttcgttgacagccccaaaattaggcccatcgacgacagcccataacatcgagaataaatctgggccgcccgtgccttcgtcgcggtgtgcgtcacgagccgtcggatgggaggaaaaccctaacaaaccctagcgtctccgtccgctctctgtctatataagcgccgccgctctccattgccttcgccctctcgtgttctagggtttgcacacgcggtctcttctcgtgatggctgtggacttctaatctttgctgctgcgctgcttgctctttccagctgggttgatttgatttgatttgttctcgctttcaaatctgtttgcttttttttgggctgttttgtcgatgggattttgtttgggcttgaggatgatggatgatgcagatgaggaggcacaagatttaatgggtaatttgcgtctgaggcatctctgtgatgtcacaccctttttcaccttggagatctgatgcatctacaaatcttctgccttctttttttttcctcgattaacttttattttcttttaaaaagttttcctctattagcccttgttcttttagtctttcgaagaaaagaaaaaacgctggggattgatgatatgatgatcaaatttgattccctattggtttgattggccgccatgatggcctcaaattgtattagctctatctgatcatcttcctccacatttttcttgtttcattttttccctcctggatctttctgctgttttttttgcaaaattttatttgctgtgttcattgtacttgattcctgtatgttattgttgtgctgttgtctacattttagttttggataagtccgtactggaggatatgatgatcctgttcccagatgatagacaatgaacatactatcctccaattttaatgcatgagttgattcttttagcatgttgtggtgaaaatttatttggtgctgcttaatatggagaatatgatgatcctttccccagatgatcgacaatgaacatactgagcgctattatttctcctttgagaaccaagccagtattctgattctccaaatattatgcaggcatttccttctattttgagcaagcagtggttgtttcctagagtatgatggatgtattgatatgttcaattgtttagcttgcgtatgataacacagataattgtctattattatctttgcaaatttgttgctccatgttgaaacctttagcgttgaaaactggttaccagtggatttagtaccgattgtgtatgagtcataataattctccatacagtaactgtgatgccaactgttatgatctttatgaaaaacgcttcactcgtcaactagtagcagaagtgggaatacgctttatgaaaaacgcttgtttttactacgagtcttcagtatgtttgctaggaaaattttctgtatatgcagggaattcagctagcagggtgatgccgtctttctctgctcatcatgtagcaaacccgtgagacagacatgcatcagtatctacagcaaaagcttgattccaaaccaacgatggtagactgcagtaatacaatctgacaaatcttagaacgacgacgacgatgttcgttcggcacttctatttcttctaagctcagagtgcatccttaggccatagcttctcaatgattttatgcatcagggcctcttcactttgaagccattgtcaggtaaagttgccatcagcgatgccatgccgcttcattttccgccgaatgcccacgccgccgctgccattgacgtagcttcgtgtcacgcctcgagcaaagccaggaacaatttaacgacgtggggactagatgaaggtttgctttgacacgttgcccagtcctacggacgagtgaaggagccttgctattaattcctccccatagtttggagaaatttgataattttggaggaattttcgaatatctcaagactacccaaacccgtccaataatctcggcccatttggtccggaagttaagcccatccgtattttacgcccgatctcggcccatttagtaaggaagaaaagcccatccgtaatgaaaagcctcaccttcgaaacagcgttccatcaatcatcagcattgcattaattaaagtcgcaattacacaattgccttaatataagtcgttgctgtgatggcaactataacttaacgatcgattgaatatattggtcgattaattaaagacgcaattacataatattcgccttaatataagtcgttgtgatggcaactttggaagaggaatcttaactacattgtgggacccagcggggctgaagattcctcgcaattctaatctcggccatatatattgctgcttgggccaacaaaaactggaccgcgacgtgcaggttaccattcgcgtaggtttaccagttagttttacttctcaacaaaagaattattaggcaattctattcacaggtcaactacataagtacggcgtaatttccacagtaattgtttggattgcagtaggaaaaattgttcaaaggatggcgtaactttggcgtggaattaactgaaatgctaatcaaagtattccattccaatgggtttaaaatttgaactctaaagacttgacattaaagaggagtgcaagttattagtacatgttttacggagtagttggtatttggccgatgcctttaagcaaaaaaaacacacacacacacacacatgtatgtacttcctatacggttgtgcgagtacgggtatatatatttataaacatatgtgtatgtgtgtataatttttaagttatttgtttaattaggacgttccacgtgtttgactatcaggcaagtgttgctatctgtttgaatcagctgctaactgaccggaattattatttttatataattttgactttgctagaggtgattcttcagctgtgttaggattatttacctttcacataatatcgagtatttctcagttctcacaatttggatttcagtcccatccttcaaagcaacctggttcactcacatctaagaatatccacacctggtaaaacgcttcagttgccagaggagagctgcacatcgcaaatgaaactctgcagtgccggaccgccagtgacaaaccgatagccatggccagtaagggtccatttgatttagaggaaaatcataggaattttggaggatttcaatcctatagtaaaatttcctatgaagcactttgaaacaaaggattgaatccaatccaatcctttgaaattcctatggaatagacaatcctataaagattttggaggaaatttagcaaaagcttcaatctcttggtaactttcctttgagtctatctctctcatctaattcctgtgtttttcctgcggtttaatcaaacgttcattcctgtgttttttctgtgttttgcaatcctctgttttacacttacattcctatcaaaatcctacgtttttcctattcctacgctttctcaatccgactattcaaaggggccctaaatgggagtgtgtaatgtaattaattaccttgcctgcatggcttctgacgagccgatcgatcatccagcaggaagagaagcttgactagttgagtgaaacaggagttggattgcaccgcgctgtagttctgtactgctgtgctatggtcacagcgtaggcaagaacaccttcctcgttttgcctgcacagtgtttccgaaaagtatagttttggatggtcaggcaaggaaccattgtcagttaaggttttgcagcaagtactgtttttgcttaagtcctcccacaagaacagaaacttcttcatctctgataaactgaactgaaatagtactagcacagaacgttgtagctaaaattcgtgcttaagttgttaggcatagcacacaggagacaggtaagacattacgagcagtgtaattggactaatttggtggtgatgcctttagtgtagtagttagctgtgctaccacaagttagggacttagggccatgtgggaagctcaatcatatggtcagtggctgtgactgtgaaataccaactgaaataagccagggtaatcatgtagtatcaacaatcgaggatattttttatatatcttttttgggggagggatcactagattgactacacaaaccactagacgcatgcatagtactagtaaataagatggtgaacttacttggctggctgctgattattgtgattggattaagaatttccatgccaccaataatggatcgcggtacaagtcaagagcgagtgacgcaggcctcacgttgcacttacccctccctgaccgcaagctttagctgactcagggtgatcaatcagtcgatcagatcttgatattctttttcagcaagtgatgacaaagcaggtgtaaaagaaattcccaggtctgatatcagcaaacgggagctccttttccatgtttttcaagaacctgcagtcatcggcagtggttagcgtttggcaacttgcacatggacatttgaactctcaagcaaccatcaacttcaggaatagaaggagaaaaggacgatttaagaactggtcatataaaagctacaactttattcggtcccaatgaattttaacttcattttccacaaaaaaacttgtccaatggaaatatatccaagattctcatgcctttccccctccctaccgtataggcataaagttattcactagtataagagattaggaccattatctaacagtaccgatatgtgtgtgggagatgcgaaggttgcaacaactatctccttaaaaaattttgattggtggaattaacagcgactggtgagaaagttgtagggaaaagaagcaattgaaaaggagagcaaatcacccagcttctgtgctaatgactttatggccttcatcaaatgacagttgagtctcacagcgagatattggtaccctcctccatacctcctctctcttcctcttctctgcaacatttatttgcactgcatacctatttgttttgagctgcaggacagcaagtacaagagggggtccttcccatacttcattctcctgcagaaaaaaaagagctcatgatatctagcttccaaccttccaggttcaagggctatctctgcaagaactgtgctgctatggaggacaccttggacgccggcacgcatcaacatcgaggataagtcctataagatggccatggatgatccatcttgcagttgcagattcctgttgtggttcctatgttttgtagcatgtgttctcctggagtctgctgcttctgttcattcatggtgccccttacatcctagcttgaggcaggaagcaaagtttaagcagaagacaaacaagttctgggagtaccaggaacagagtaatacctgggtggaaataagcatgcctttcaatttgatgtcctgcatcaacgatacctgcacgaaggtaggatcaatcgagcaaccggaaaggagacatggccgtgcttcaatttctagtcaggaggagaaggatgcagagatcgatgacaatgatcaagcagatagaaatgatccagtcctgcccataagaaaaaggatttccttgacgcgcatgtcagaatcatctgtgtgggtgacagggcaaagtggatcaatttatgagaggttctggaatgggctggcatgggtgattgctcctcatgaactaccaatttcagttggctatgctacagcaactttcattgtgaatacaactattcttgctctctcagaggctggaatcctctatcaggtaacttgcatctctatctgtatgacagaactatgctcatatcataactgttacaatacccttccttggtcatctttaccgttgtatgtttttcttcaactgttgaagttctgtaacagaacagtagttttatcccttcccctcccttcttttccccaacccaattccgttgttttgttgcagtaccttatattacatgtgcccaaaatttgaaattgttaagcaaagatcaatagacatgtagtcatgattaatgaagagccgataggaagtcttatgggaagagcagaggaataagaactgtatgtaaataactagggaagtagtttcctctcatgagacaataagcttctgatgaattcaattgccaaaaaaagaaagtttctattatgctagatctaatatttctacacactttcagctacagctaaatgaacatgcacaacctatctggacagaggtaatattcaactttgaacaacaattcatagtccttggagaaaaaacacaaagtcaagctatgcacataagaaatgggatagtgtcctatgatggaaggtgagactgctttctacacctgatgcttcctttctagtgcagtttgtgcatataaaaagataatttaggaaattattgttcctcccaaacaggaaacttttcctatctattacaaatggatccctagtggaggtcacagaacttcagcccctaaggtatgaagcagtattactgaagtttatattaatttgcacggctgccatatcttggtcaatattcaatgaaataactagcatatgaatacaatgttcttttactgaaaagaaaacagtaggggagagccctaccggaaaacatatgatgtcctattcaaatttgacatgataaatcagtaccgtaaagtcatgttttatgaaattttcattactattattgttgtgtgagtgcatctgatatataaagaaaacatatgaggttgaaaacaacgcatctttaataatatttagagctaagtacaaaaaagtacatgaatgtgccacatcatcataaacatcactatattagatggcaatccacatacttctcaaaaaaataatgatgccatgccacaataaagggttgaccattatatttctact

SEQ ID NO: 20050 - DNA, 52507 bp, Oryza sativa
attctgaatggttccatgcctaccaggctaccacttgattaacttgagtgaatgccgctatttttttcaggaattaagaaattggcagcttatttacactattaccatgacctactccacaaaataatggtccaatactactgatgtacaggtggacttaccatggccacccaccaggaggagatgtatcatatatatctgatgctggaaatgcaagaccagggacagtgttcacagtaaggtatggtcatgtgttctttaggaggtaatgggttgtgtcaatccaaactactttagtgggaaaataaactggttcaatagtcggttctctattgtttttgtgaatcttgaatatctgaaacaaaagtcaacttgtacaaatggggagagaggaaggtgagaaaaatgacaatgtttatgcactattttccttatcttctgcccctgctctgtgtacattagaatttagacatttgagatatttttggtgcctgaaagaaactagaggcacctttattttaagaactaccatggttgagatgttttacaagtacttggaaggcattagaaagcattagatgtaccttcacttaaaattgatcaactgttgatatttctttgaagtgaaggtatctctaatggagtaccttcctagaatcattgatatgttatgcagatggatgatccacctattagacaaatacagcataagaatatctagagccataaggatttcaagtagcagggtgtatacctccaccaaataagccactcttagatttcaaataaggtcattcagacctcccgctagctaagctacgctcagtttttcaaacaagaaaaaggctatactcatttatgtttttatcccaagatgtagaataccttgtataattactgtatttcagtgctaagatgggaaagtgtggtgcagttctacaggagacttgtatgagttcgacagagaatcaagaccatcatggaaaaagcacatatggagtgaagaaacagcagagaatgtctcattaagctcatcagttgggtgtgctttacatggcctgctaggatctaactcagtatcacttttcttgataacaaaggtatgcaaggattttcttttcagaaatgacttactggatccaagctaatgcagcaacattataaatgcatacagtctagcgatgctgattgttataatatgaaaataatctcaaaaatatattatctgctcctgatagactgacagagctgatgaaggtacttgcaaaaagattagtatatttcttgagaagttgagatcatgcttttgcacaaacctttttctacaaaagaatactttttaagacatattcagtctgtttaaggtacctgatgtggatattttagcctcaacggaatctgcccccatgtcaagtaaacaggaaggatgtgccttatctctcttttatgtggtccaatgcgtcagaaaccatcttgactgagcagcccattttctgaaacattttttgcaaagttcatatggttccttaaaatcctgtttaaagttgtggtttttatgatagttttgcaaaaagtatgatatcaagaaatgtactaaaagaaaaagaaacatgtatatggttccttagttggacatcttgtagcagaagcaaaacaaccaaaatagggtgtcaacaagaacattatgaccgatcatgtgttataatacaattgaagagaaattgacagcctcttcatgaactcattatagataagttcagagtaatatatatgtaataataggaattcttgttaaccaataaagtaaaattatgccatggctaggacctctatttccattgtaaaacggtatttatctatttgctaaagatattttatagattggcaggatggtttattagtggagcggcgcttgcatagaaggaagtggaaatggtataaacatggagctcctaagagtcaaagacttagttcgatcacagaagtgcaacaagatgaatctaatgatgcaacttcaatgtattttacaacaaccacaggaaaagtattcgagtatcagtttccaaaatatacaggtatagactcctttggagatactgctttctttatgttcatttgctcaaggtcaatcaagtattctcgtagagttctcccctactgttccccttaaaaaggtcaataaaatcaaacaaacaacaaagatgaatttgagaattgaagaaaattttcatagcagatccatatattgatttatttcaatgtgtggtttcagtttgaaatatgaaaacaagaaaaaaaaacgaaggaactgctcttaaagtgatatctccagcaaaacacctttcatctaaaccatatgctcctgattcaatgtcgtatgcacttattctttttttaaaaaaaatattgttcttggttcttagttcttagttcttgctcttgttttatcaacaaaaagtaatgttctatgaaaaaaacaataataaaggtaacacaatagaatcatgcattcaaagcaaaacaactagattaatgcctgtggaacattcttgtgtgaacctttttctttgaacaaattgtcttcattcaatcatttaattattatactagagcaacaacttattattaatatcaagctgaaacagagttgacatgatctatattttcaatggaaaaggtggagctcaaagcaataagatcagaggactctgggtaaatcacatgtctcctgagaatacaaaggtagcaagaaatgtccgaggtgtacaggttcaagttggccgagtaatattcccactggatgatggtaggcttggggagctgcatttgcctggtatgggtggtgatgattttggtccaagtcaacactatagcatgagaaggaaagtgccaaacaagtatgagtggtccattctagatgcaccagaaacagaaggttggaatgcagaatattgcacagaagagcatggtccaacaaattgtattactggagcaaagaatgtagctgcagataccaaatcaaatgacttgggcaatatcccaccttccagatggcgtaaagaagataagcaacaatacctgtacgttaatacccatgagagggatgaaatcgaatcgtataactttctatcaagaagtattgatattaacttccacatgcgggtgatgcatgcagatagatcactttttctcataacagataacggcttaacttttgaatatctaaacaataatggtgtttggttatggctaagacatgagcacactacttccatgaaaggtacagtaggaagctataatggcagcttgtatcttgtcgatgttcacgggaacttacatatcagagaaagaaatggagatgacttattatggatcaactgcacagcaatgaggaagggaaggcaggtcgcaagtgggtctccatgggatggcattccaggtttaccacgcagagtgacaacagatgacgcactcttctttgttaacaagagaggcaggctactacagttcacggtaaaagtttaaacatgctctaatctcattcatgcgattattagccttattagaaataaaaatgatttcgaatgtgcccacttttagttgagctgttcctttgcccaagatttaaacatgtgcatatttagcaggcaaaattgattaattcttgctaaataatgactcaatgaacaaatgatgaatgcattactcaagataatggcatgtctatgcatcatactaatctagagtagttagaaatgagattcactgataggagtttacaggcagagaacagaaacagagtgcttgaaataggtccatattatggcaaatgtagcaaatatctctgctatcatatacttcagtaattcaggataaccatacatcttcctacgttcttagcatttagtatgagcaaagcagtataaaataaaaaggaattcatgtttaggaacatcttgtaattctaaacaatcattactcatattgcttgcagttgagacaagataaacagtaactaaagagtttgacatacttttttaattaataatacaaaccataaacaaagtacaattaaatggtaagcataccaagtaaaccctacatgacaataattaacactccagatatgccaacctctgtgcagaacagcaccaagttgatgcccttctaaaacttttgcaggttgcattaaggaaattcaagtggaaggactgccagagccctcctgataccaagattgcattcatagtggatcaggaagtgttcagaagaaacgtcatctttgcggttggccgcaacggccgcctgtaccagtacaacagaatcacagagctatggcacaagcactaccaatcaccccacctcgtcctctcacggtcaccggggacagcgatgaggccgtcccatctctccctcgccggctccatcttcatggtgtcggagcacggcggcctagtcgagtaccatttcagcccgcaggacgggtgggagtgggtggagcacgggacgccccaccgggacgtggccatcgtcggcgccccggggccgtgcttcgacggctcccagctgttcatcatcgggtccgacggcgacgtctaccggcgacacctcgagaactggacgtggaggtggacgagccacgggcacccgtcggcaccgtccgccgtggcgatgaacgcggccggcggcgacaagagctgcgccaccctgggctccgccgccgacgcgcactacgcggacggcttcgtgggaagctgcgacgagaaggtctgataccccccttccatttcgctgtttcttggtagtaactagggtctagggagtctaaaaggctgctaatggcgctgggggcatttcgtcgaacaggtggcggccgcgcggccggtgccgttctcggaggacgcggtggtcttcgagctacgggacggcagggtaagcaagcgaccggcctcgattcccctcctcatcatcatcatcacatcgcacgaaatcaagaaccgcgcgccctcgctcaaagaatgccaggaagatgagctttgtctaattaccggagcttttttttttggtcgtggactcgtggttgcagctggcggagctgcggcgaggagcggacgggtgcggcggcgggtgggagtgggcgcggatcatcagcacgccggccagcgcctgcatgaccagctactggacggccgtcgccacgtagtccgccgcccggcggcgccgccgccgccgccgtcgaagcggggtcgctgaaatttttggtgtgccgcgtcatagcgggaaacggggaactgtaaaggtatactacacacgtgtcatagatctggtacttgtaccgttgtactgtaccagtacactagtactaggattaatctctttaactagagttacaatgtaaatagaacacttagggctcttgatggggattgtatcatgacatgttattgacactttaacttatcagagcatatgaaattgctctttgaatacttactgttggaaaagaaaaaaagatcaaggtcgatcagctactgttttgaatggatcagagtttgaatggaactcgttgtaagttagtgaccgtttttctttttgggttaattagatccatgccattataatttttatggttttaaaatatgccattgatatttgtctatttgaaaccacgtcattataatttcatacatatctattatatgccactacttgcccattcaacacattttctaaatgtataggaccaaatcatccctatcttcttcctcattctcttccaatctctaccctgttcatcttccatctccttctcccttggagtaggagagcttcttccagataaacatggggaaccccgacgtggaggcccgcatcctgtgaccccggcggaaataaaacggcgcaggagcacggcagccatgggcacggagggttgcgccggcgagagcagcaagtgcgtgaggcggagcgcgagcacatccggccgggtgtgaacatccccgcgcccgtaacctcgcctcgtttgctaggggagagggctatgcgtcggacgtccgatgctttagggaaaaatcggatgctcacatcagcatgacgtcatagtccgatttacgtgcaaaactacttttaaactgatttttctcttaaattacttatctaaatcatgatccgattacaccattaaattcgttgcaattaaatctttaaaacaaaaccacacatggatatattccgatgaaaaaaaatagcttattattgaattatttttaaatgttgcatgatgttccaccaggtatatcggaattgtttcactaagtagattgaaaaatgtttcactcgtttaaatctggtgttgtttcaacttatataaaaacaatgtttcagcaaatagcagaagaatatttcagttcactgcaacattagatctatacataatgaaatattataagtacactaggtggaacatttttcggtgaaacaaaaaataaaacaaatttccttaataggaggtttccaaaatatgtgggttttttttgttgcaatgaaatatttcagttcactgcaacattagatctatacatagtggaacattgtgagtgcactaggtgaaacatttttttgtggaacaaaaaataaactaaattctcttaatagagggtttccaaaatatgtggataatttattgcaacggcgcgttccactgcaatatttgatccgtacacagtgaaacatcatgagtacactagctgaaacattgtaaaactactagttgaaacatcaaaagaaaccacatgcaacattaaaaaaatcaataaaaaattaaaatatttttttgtcgaaatataatcatgtgtggtcttgttgtaaagatttaattgtaacgaatttagtggtgcaatcagatcgtagattagataaatagtttacgataaaaaaaatcttttgaataaataagaaaagaaaagattctttgcatgctgcagtggcagacagcgtccgatttttctccaccccgtcggtcgtccggtgtgagcattttcgtttgctaggatgtcaggttcgacgaacaagatagagatgggaggggatgaagaagaagatatgggtaatttggtcataacatcttggaaaatatgttaaaggggcaagtagtggtgtataatggatagatgtggaattataatggcatgaatccaaatagatgaatattaatggcatatttcaaaactatgatatttataatggcatggttccaattaacccctttttttttacctaaggtttgcattggttgtcaaataattcgactaccaagatttattggaatcatcaatggtatgatggtggttatgcatgggttttgtttggctgggtattttgaatcacctcaaatgttggaggagctagaagatgacaagtacaaggctttccatcgcaaaacatcgttgagtagtcagtgatcggtacttggatcatgtcattcttaaaaatcttgttttgctatctatcataaataaataggggggataattttgcatatataaactttttgcaaaagtcgaaaatcatttaccatccctactattcaaactcttccactttacggctctcaactaatacgagatgattttgatctacatggcatcctagcaaaaaggattaaaaaaatcacgtgggaatgtggaatccacttaacattgtgtcttcccttcttcctctcatgctctctctctctctctactcccatcgtcccattgttaggtggataggcgggtactctctctcactaacatatgggacctatgcttgaggagctctcaatgtcacccaattgccgcttgaacctcttacattctcctgctgcctttgcacacaatccatcttcgccaccattgagatagttcctttgacctctactatttgatgactagaacaccaccatgagctggtgtcatcgcatctggcttaaccgcctcatgctctactctggttgctactctatatccaccgaaccttcaatcgagaccataataccgtcataatttattccgcttcatcaatctctatgttgtcacatatgaatagataagttcacgaggttgatatttactctatggtgcactcactagagctcgttggaccaccgttagtcaacgactagttggaatcatcgtgttgactttgacatgcaagtgaacacgtgtgcaccacgttgacataaaagaaagattgatagcatttagctatgtgagatttcgataagacggaccgggatttccacgtgttagtttagtttagcgatattatcatattgcatatttgtcgccgaaatctcggggcaaagaatggaagggttaaaatgcaaccttcaaggcccatttggatcctataaatcagggtaaaaaacatcattttcgtgatccatctgtccaaggactctaatcctcctttttccatgcactgcgcatcgagatcactctatcctccacacctcttccaaatgcacgccgccgccgccgcaatctacttcctatgcactacgcctacgtctttgtcgatgtccgggcatccttccctcactctactgtctattggaactctatttctttatcgacggctctagcctcaagctccgatggtgctccaaggcctcggggttaggccatcgtattctcctatattttggcatgactccatggtcgttgatccttagatccatttttaagagatgtttagatccatgggtggtgtgacatccttcgtgaaacaaccaacatatcacatcactgaatgacgtgctagatctgatgtgcaccgtgcaacaatggggactgatcgatgacataaacaaatgcggtggaggtggtacgttatgattgttgtggtacgttatgattgttgcttacactagcctctattcaattatgcttaggttgattattttgcttttgcaattctagatggcactgaaaaaaaagaatttaacatttgaactgaacttcatggtttttttccctaaattatattagaaatgaaaatgaaatccatttatcaaaattttagatccaaaatgggcctaaaagaaattgggcaaatgcatactaaatctatgccatcttatctaaatgtctacataattaatcaccctatctaatatcttctttttttcctactaaatgagttctatccacaaaagttaagaacaatgaattgctgacgtcaaatatgtaataccattagtctaattaaaaaaactagactaatattagttataattaaatattcacacaattaccttccaaaagagtactcatatacaaaagtaaaaaaaaaaaatttagaacccaccccatctgcgcttccacttcatcctccaattattcaaatttaaaatccttccccattatacctctctttccacaaacacccccaaaactcaaacatggaatctgtaccaaaatcacagcctgaccagggtttgacttaccgccggtaactgcgcagttaccgcgggggtatggtaatataaataccgcggtaacctccttaaattcaaataaatttaaaaaataatttaaatttttgataatttttacacggtttcatacggtttttcatggttatcacgcggtaaccgtgcttaccgccggggcgtggtaactccggcccggcggtgtggaaaaccatgagcctgacacccaaccccccaaatgtggcaattgtaggacagtagcatggttggcaggtgtagggttggccaccattgaagaaggaaacgcaccggcccagctttcgcctcgccctctctcccccctcatcaaaaaatcctttgcgaaaaccaggccagacaacacgcagagatgcagccaccgctcgtactccctccacaccccgcgttgaatgcgccgcgtccaccgtgaaccgcggagacggctcggatgggagggccgcttgggacccacgtgtcggtgggatggtgtttggtaggctcggtccatgggccatggcccatgggcgcgggttccctcgctcgcgcgcgtgcggggcagccttttctggtggaggaagcgaagagaagagagccgagagggcgtggatgcccggggagtttaacggctcgggggacggcgtgaatatccgacggctgggattgcccgcgtggaggcgactcagccgtcggatcgttcgaagcttcggattcctcgccccctccccctccgtcggacttaacgccgtacgcagcggaggatgggtgggtgggctccaccgctccatacggcgaaagtgtcgttgtcacgtctaccgtgagcgcggaactaccctaggcgaaacgaactgctgtcacttacaggtgggcccagaccttcccccggggcccacggtgagcgagtacgtgtcgccgccgggataccatcggcaagctggaaagaaggctgactgttcggcatccacagccacacaggtcgatgacacgtggggccagaaaccctcgtggtccatacgtcagcgatgtcccagcagtaaagcggatggtttcggttgggtagtggaggagaacacgggggtagaggggggagagccccgggggtaaaagcgtcattccaactgggccgtcgtgcgcgcgggggccatctggcccgtccacgtgtcgccgcgcatccccgtgtgctcgcgggggacacgtgtacgttcccgatccacccccgtgccacggtggcgcgggtggcctcgacgaggtcctgcgaagtgccggttttacccttcgtcccctgccgctgcgtcttctcctcctacaagagagagagagagagtgtgtgtggagaggcgaggcgttcgagtttcgagaggagggaggggggacaaggaggaggagcgcaccaccctctcggagaggtcgcctccgttcttgcatcgttttctttggtaaggcgaggagtcccgcttttcattttgggtggagggaaatctagggttcttggcgggggggtttttgcagattggattgttgtgtatgcgggagcggttgggcttgtgttgtttggtgcggttcttggtggtggtggggtttttcggggaggagaggagggcggattccgtggggttttaccgtggaagtttctgttcttttgtgttcttttgcggttttcctctgttcttggtttaaagatcgctgcattttgatgcattctattaaggagtttgatttggggttttctttctttttttcccctgatttcgttcgttcttcgttgcgttgttctcggggctttttcgtcttttgccgtttatggtggtttgttttagatgttttttttgaagatttatccgaaacagtgtttgtgcgattctttttcatttttgcgttctttcttcgtttgatatttctggtccttgttgttttaaacctttattttttttgtttgggagcacctccttttgatgcttgttttggtggatatctgcctgtgtagttttgttagggtttaggggtttttgggaaggtttatgatactgatcttgactgggaaaagaagatttgctgattaagaaaatggctaagtttcttgtacttaaaaatgggtaggttgtgtttgttgtagttttgaaagtctgtaggctggatagactcttctcctatctttttggaagaaaaattaagaaaatagttttctaattttgcttttcttttctttttctggaggaaaaactcttgacccagagcattttcattgtctggtatctgttagcatgggttttagtttcctttccttttctgttttgatttaccttgttaattgttgaatgagttatgtattttgtgtgcaggatagggcagcgctttgacagctttggggagttagtcggtaagtgtactacgctcttaatttggctattaattaatgttttaatctttgtgagttgactaggaattttctatagttgtggtctcactctcagtagttatacatattttttttgcatgtactactagtttctcaggctttcttgttaatgttgcaatcgtctgacaaacgattagtgtctttgaatacattgttaaaaactggagtaccattttaatgtagatggcaaacaagaagcttagttgttttggcaccggttgaccctcgaagtagtagtaacctcaggtcattctcagtatgacagtgtatttaaagtgtactggcaaactcatgtaggtgtgataagagtttggacttgaacggtgacttgaaacgtttgttgtgtgttcttttgtgtgcatatgcaacatggcagactgactgacataacgtttgtgttagcatattactatattatgcttttagttgaatgttttaaaccttgtggtgtcataataattttcttgtattttacgatttcatttgcatgcaaaatatattagtgagacctaggggttttctgtatgattctagttttgaagattgatttaacttgttatattctagtctgagagaagtgtttatttagttggcttttatgctctatttcagagaagtgtgcacatggagtccaacagtggtgaaatcgaggagttgccacctcccccacctttgccaccaaatgctgagccaattaaaactgatgatacaaaaaagttatcaaaacctaagagggccttgatggctcgctctggttgtggcaaaaaagggcagccgatacagctgctgacgaaccacttcaaggtttcactgaaggcagcagacgaatttttccatcactactatgttcgtctctagcccttgtaacagttctttatttttcttctttgagttccttttgttcatgtctgattgccactactgcttgagttacacaggttaatctgaagtatgaggatgatagaccagtggatggaaagggcataggtagaaaggtgctggacaaactccagcagacctatgcgtctgagctggcaaataaagattttgcatacgatggtgagaagagcctgttcaccattggtgctcttcctcaagtgaacaatgagttcacggtagttctggaagacttcaacactggaaagtaattatctatctcaattctttctgctactttcaatgatgccaacattttttacttcaacattttttgctcacataacttccaatgctattaggtcatctgcaaatggtggcagccctggcaatgacagtccaggaaatgacaggaaaagggttagaaggccatatcagacaaaaacttttaaagttgagctgaactttgcagcaaaaattcctatgagcgccattgctcaggccttgagaggccaggaatctgaaaacacccaagaagcaattcgtgttattgatatcatattaagacagcattccgcaaaacagtatgtttccatatcttttggaagcccctactttgcaaatattctagctatattgtttagaatgtttaacatcatggctgatttgcatttgttcttaacttttcctttttttatgcaggggttgccttttggttcgccaatcctttttccataacaatccttcaaattttgttgacttgggtggtggtgtgatgggctgtaggggattccattcaagcttccgagctacacagagtggactttcactcaatatcggtaaacgattgctattatggccccaatttcatattttgtatgtggtcacatgcacgctgtagctgataatacatgtttgcatgttgctgctttaacttgtgcagatgtgtccacaacgatgattgtgaaacctggtcctgtggtagattttctacttgccaaccagaaggttgatcacccaaacaaaattgactgggcaaaggtattatgtcgtcatttcactgagtaaaacaataatttaagaatgaatgacaagaacaatgtgaaccctttgagatgactgaattgtattgttaacacaaatttgtaggccaagcgtgctctgaagaatttaaggataaaaacaagtccagcaaatactgaatacaagattgttggtttgagtgagagaaactgctatgaacaaatgtgagcttgttcatgtgttgtttttcttatattttatattgttgtgtgcctggatatttgacgtttttgcaattgcaactttggttttttatgtactttgagaaatagctttatttacttagctacacataattatctaggttcactttgaagcaaagaaatggtgatggtgaacctgaaggtgtggaagtatctgtttacgagtactttgtgaagaatcggggcatagagttgagatactctggtgattttccctgtatcaatgtggggaaaccaaaacggccaacttattttccaattgaggtaattgttttccttaatccaacataaatattttccaattaacatcctttgctgattgtggtgaatgttcctatgcttgctagctctgctctcttgtgcctttgcaaaggtataccaaggctttgagtacactacagaggtcttcgcttgttgagaagtccaggcagaaacctgaagaaaggatgtcagttttgtctgatgtgagttgctcctctgtcagcttaagagctgatgtacccctttcctgacagaataatcaaatcatcaatggtgaatttgcaggtgctgaaacgcagcaactatgattcagagcctatgttgaattcttgtggtatttcaattgctcgaggttttacacaagttgctggcagggtgctgcaggcccccaaggtcagtcagaactgtctatgctgcgttttttaattaaccctttgctgtgttctcttatttgtatatggtttagatcaattgtatgtttttctttggcagctaaaagctggaaatggtgaagatctttttgcacgtaatgggcggtggaactttaataataaggttagtgtctcagttctactcccactttactctttagacttccatgttgtgatacatattgtaacttctgttatatcttttttttacagaggctcattaaggctagcagtatcgagaaatgggcagttgttaacttctctgcacggtgtaatattagggatcttgtccgagacatcatcaagtgtggtggcatgaaaggaattgtaggtttttctgttttactcaaaatgttgcatatttcatcaaatgcaattccctcactttagtgttgcatgtttcatcaaatgcgattccctcacttaaaagactggctttgcagaaagtagaagatccatttgatgtcattgaggaggacccttcaatgcgacgagctcctgctgcaagaagggtagatggcatgattgacaagatgcaaaaaaagcttcctggacaaccaaagtttctgctctgtgttcttgctgagaggaagaattcagatatttatggtcagttacactaagattgtgctatgcctattcaaatatgcaacccttctatggcattcacatgttcttctctaatagggccctggaagcggaaatgtcttgctgaatttgggattattacacaatgtgtggcccctactagggtcaatgatcagtatattacaaatgtactgttaaagataaatgcaaaggtttgtggattttcacatccttccttctctcgcattgtaccattttatatctggtctggtcagcactaacatttttgcttgtttattaatcagcttggtggcttgaactccctgcttcaaattgaaacatccccttccattcctcttgtatccaaggtcccgacaataatattgggaatggatgtttcccatggatcacctggacagtctgatataccttcaattgctgcggtaagtaaacttttctaattttctgcactgtaccagaaacgaaaagctttactatacttaatcattagagcaagtttgatagtttagagcttagagagctaactacaagttaataagtataaacccatcttggctaatatttataatagattagctataaggttgccttttttctcctctctctcacttgtatatttaatacatctatcttggagcatgtggagaactagctctttcattagagccaacacataatttttctgtgtctttctccacataagcttatagtgggcttatagtccactattattcttgctcttaccggtccttaattcttaatcgttaacctttttttaggtcgttagttctcgtgaatggcctcttgtatcaaaatacagggcttcagtccgttctcagtcacctaagttagaaatgattgatggactatttaagccacaaggagctcaggaagatgatggcctcattcggtaagcaattttatttggaccgtgatgcaatccttataactttgtggcatgttccattgttcattaaattctcccagtgctaatgatatcttctgccatttgtgctggaaattatttcagggagttattagttgacttctataccagtactggtaaacgtaagcctgatcaagtcattatcttcaggtcagttactctttgaaagcttctcgtaaatgccattaataagcttcagtgaaatacctgaatgcaggattgtaaaagcaaaacttaaattatggacaatgattactttgtgctttgacttaactggttctttgtgtaaccgtttaatttttttcacttatttggtgctttaaatatagggatggggtcagtgagagccagtttacccaggtgctgaacattgagctggatcaaataattgaggtattgttcattataactttctgttctattgtttttagttcttttttattttgtatgcaagactgcaagtatcattactatcatcagctgcacaatcacttttgtatccttaaattgttgcaggcatgcaagtttcttgacgaaaactggtctccaaagtttacactgattgttgcacagaagaatcatcataccaaattttttgtgcctggatctcaaaataacgttcctcctggtaatcccattgttcgatatgttgtgtcaaaacttgcaattgtacatccttaatctaatatctaatgatttgaatgatgtaacttttaggtactgttgtggacaacgcagtctgtcatccaaggaacaatgacttctacatgtgtgcgcacgctggaatgattgtaagtatcgtcttggtgtattttatcggggttggctttaattgggtcacgtataatattccactttcaaggtcgattgtttaggcaagtctttcatattaaaattaagttattgatacatggcacttgtaggctgttgctttgttcaatccttgccctgagttttttatccttcaaaagtgatctagattgatacttaccatgatcccatcaggccaagctttgtactctttgtacataaatgtttgtacgtgtcattgatgaattgaatcagtaactattgacggttgatcaggaatgcattgctacagctggtaacctaactaatgtgcaacttctgatttatgttggatgaattaattcatttatcttgggtgctttatgcaacttgttttaattatgctataaaaccatcttggccagctgtagtattattatgtgaatttctttatagcctaatatcagaaatttctatagtttttttttgtgtgtgttctctgtatgaagtttcactccttttgccagtcccttttttttggtcctacttgaattgatggtggttgtgcctgtgctgtattagggaactacaaggcctacacattatcatatccttcatgatgagataggcttctctgctgacgatcttcaggagttggtccactccctttcctatgtgtaagtttgatatatgccatgattccttttttcacttcttggaaacagacttgttctgacatccaaatgcttgtttgtaccctttcagctaccagaggagcactacagccatatcagtcggtaagtgggcaatacctggtttagtgattgatgtttgcttcgaacttgcatgccagtgtttatttattcatctttatcttgtttccttgcagttgcacccatttgctacgcgcatctcgctgctgctcaggtcagccagttcatcaagttcgacgagatgtcggagacgtcgtcgagccatggtggccatacctcggcgggcagcgctccggtgcccgagctgcctcgcctgcataacaaagtcaggagctccatgttcttctgctgagcagccgcttggctgctatgttatggcctgaacttgtggatgttttggtagtcttgtttatgtcgtgtttgtttaagtaccagctggggggtggatgttattaggctggatgccgcacttctgaacctgttaggataactactgaacctgtccatcttaatcgcagcttgttccatgctctgctttgctgcccttatgggttgggttgccttttttcttttcgattttttgctgaattttgcttgcatccgttggaatcagctcatgttttcttggaacccatgtagccgtgtactccctccctccgtcccaaatttttgacagttcgtcttatttaaaaaaataattacgcataaagtattaatcatgttttattatctaacaacaatgaaaatattaattataaaaatttttttatataagatggatagtcaaacgttggcacggaaacctaggaattgggacggagggagtaggtgacatggttttgctgaattgctagcctctttaacaaattggttttaaaacgttgcaagtcataaattttgctccctactctgacagctgtctcatgaatcaggataatctgcattagaggttctaacgtagagaatgaagtatgaacagtagcgtgcattggtgagcttttttttttgctacgtctgtgcatctaccgtgaatggaaaccagcagcaagcatcaacaagtggagagagctttgcaaaggagatcacatggtgcacactttttagcttgaaactgagatagacaacgagtaccatggattcattccatggcttctgcgccggtgggcccaatcaaatgtctcgcaaagtccatctataaaagctaaaagagcagagtacgattactaggttggttttcatgtaagatgctaaagagcaagtacaatttggttggttttatattagaagctaaaagagcaagacatgctctaaggtaggattaaatagaatataaccatatcttatctattgtatacgtaaactcatttgctggtaggattaaataggatacagctatagcttattatcgatcgtatatgttaactcatttgctataggaggatggagaaaaaactattgtatacgttaattcatttgttggtaggattaaatagaatacaactatagcttattatcttccgtatatgttaactcatttgctacaagaggatggagaaaaaggaaagaaagatagtaaaaaaaaaatgttttggtgcattgaatgttggattatttggatagtctttaaactgattaattattaatacagtaacagtagtaggctcttggtgattcgctaaacatttgaggtcaaatcatttaaaaagcaaacaaagtgggtttttgctctgctctgccgtgtccttttaagcttccttcttcgcttcttcctgctgaagacgaagggggttttgcactgccagaacagtcctctctctggagtccggccacaccaaggtgagatgcctccttctcttcttctttcttctttgaagcgtgtacaaaagagagatgtacagtgaatattggttctttgtatcctaatatatctcaaaagatataccatatgaattgccaatcttattctcgttctcctcatttttcttctatatatgttatatgttttgagttgaaaagctgcttcttcctctctctcctgctgctaccttgtcttggttgagttgcattggcatctcactagcctaccgattttgtgctctctgattcccctcttcaatctcgtccatctcatttctgtctcttcacagtttcatcgtcagagttcgtcgatctctctgctttagttcgtttcggtgcagttacctttgctgatctttgatgttgttgcagagttcttttttggccagggtttgatctgcggttttttgctctgtaaggacggttgggttctttttaattcctgaattttgctattttgatctttctttcgatcggttggtaaaaacaagaaaatgggggcaccatgcaccatttagcaactttgatatcggttaaataaagaagagatgtgcatctatatgaaacacagagacaaaaaccacatcttccgtgtgctgcaatattaactttggttggggttttgcatcatcacctccacagctccacttaggataaaacgccactgtttgcttcttctctttagacttcagagttttttttccaagtcctcaaagatgtatgggaattccacattttgtagcaaactatctttatctcaaaatatagtaattttttagctatgtatttggacagaccattatccaaatgatatgtatctagacacatgtccaaatacgtagctagaaattactatattttgggatggatatagttttttaacaactcatgatgattctcattttaccaaggattgtagaatcactgttttatttcacatttgaatattgcagttttttttatttggtaaccatccatcaactttttttttctaaagaggattactttcacagtttaggttgtgtatgaaggtttgtgcgccaacgacatcgtgatgctcatgactttttttaaaaaagttttaggaggaggcttttagggcctatactcatatgcgggtgcaaggaggagtgatgttaggagtatagccgtacgtacggtaggacaaggtgtaaccgtgtaagtgggttaaccgttaaatccttataagccatttaagtaggtagccctttatatgcgggccaactcacttatattcctctttttttaataataaagaatgatttacttttcgttattgatgtgtgtcaaacttgacttttatttgatgtcatcgagaaaatataacttttttatttacaacttaccaatactacacttttgtgcaaataaggctattttccaaatgtgaaaaggatagctttctggagtcgcctgtctatatacaagtttcctaatctatcatcctcgtggaccctcattgcttatatataggctgtcgaaatatatatagtctcgaattgctttttccaaaatgtactgttttgattcttcatttctgtatacatagttcaccgttttggttccaggatcgcggctatatctatcgattttaatctttatgtatgctagtcctgatcaccataatctattcattgacctggtcttaactttaggaaacttcagtttgtttggttattttcccaatcccatccatcaaatcatcgtgcaatctttcctttttctcttctttttttttttggtctgcagttacaagttgagctgagcttggatggagtctcatggtgacgagggcgaaccttcggccatggccaagccacccaagaagcttccaatgtcgaggaaagggtttggcacgagagggcagtcgatacagcttttgacgaaccacttcagagtctctgtccggcgaatggacggccacttctaccattaccacgtacaccaacacaatccccgcaatttttttcttcttcattgctatcttggtcatttctgcatctgaaattccatgtctgaatccttgcatttcatgtgtgttgttgtgtgtccatggctgcaggtggaggtgaagtacgaggacggcggccccgtggaggcgaaaggcgtgtgccggcgagtcgtcgacaagctgcaggagacctatgcgtcggagctcgccggcagggagttcgcctacaacggcgagaagggcctcttcaccgccggagctctgctgcagacgaagcaccagttcgtcgtcgtcatggaggacgcctcctcatctggaaggtagtatcgatcacaaagcgcttgaaaaataaataataataataattatgggttgatacttgataagccgtttaaaaatgaacaaatcaaccaaaactaaactacgacaaaagaaccctcaaaatcaactttgaaattaagtttcataaattaaattttgttcacggctgataagccaagtaaactatggatatgtaactgttgctatgtccaggtggtgacgtctgttggcagaggccggagatgtaaccattttcctgtatctaaaaaaaaattgtcaaggtggtgagcaccatttctttggtttttttgctgtgtgcaggacgacgacgaggcggagctccggaggagacgatggaagccctggggggagtgacaggaagaggatgaagcggccgatggcggtgaagaagttcatggtggagatctccttcgcggcgaaggaccccatgagcgccattgccgaggtgctaagagggcaggagacagagaactcgatggaggctcttagggttcttgacatcacgctcaggcagcactctgctaagcagtaagttcttgatcctctcgttgcaaggccttgcttgttagaattcaccatgtttcagtgattcagcaatgcttttgtaaataaaataaaataaaaaactctcctcaacgaggtcttaaacttgggtggtctagtcctacatccggtctagtcctacatccacaccatcgggaaaaaaaaactgaatgtagtgctcaaagttacgaagtatgcaaatattcaataccagaatgaattcgacatttatttttttttacttatgtgggaatttttgaaccggattcaatggattttttaaatgagaattgctccggtccttcttttttaccgcaaggtactagtaccgcgaggtactgaaatcccaatcgttgatgatgatagatcgaacggtcaagattagttggtacctcggggtaccggcttggtcatggtgtggcctgtgcgattgagcaagggtggaagggtataatcgtattttcgcgtttgaaatgaagtttggatcggtggatagtttggagaagtgcggcatatacttcttgactagcaaaaccctaccctttctcccgatctggacggcgcggcggtggcccgtgcgcggcgggggcggcggcggccacgctgaaggcctcgttgaaggcacggcggtgacggcagcccctgcgcggcggcggcggcggcggccacgatgaaggcacggcggcgacggcggcccctgcgcggcggcggcgacggcggcccctgcttggcattcgagaagctttggcttgcgctggaccatgctagcacaacaaatccaaccaggcggcagtacgaatggtccagatagagcaaaagttgaggaagacaaaatgaaacttgaatttgaaatggctgccaagattttggcttgtgaagcaacatataagaaaaaaattacaaagctaaaaaaagaggcagaccatgttaaaagttggttcatgggttccctagttgttattgcaattcttatgtacaatatcttggagtatatgtaccagtgttgaataatttatgtacgaactgtattgttatgaatgcaattttttttctcaaatctcaaataaattagaaccatccggctgtcagtctcaagcatatcaagcaatattggctcaattaccaaatttgctagcacaacttcatactcacatacagtaaacaatttagcgcaccaaattgcaatacatcaaacatatcttcatttccagaacgcaccagcaccaaaacacataatttaacacataattttcagattcgcatacaccatgttcacatacagtaaaacacatcaaaattcaaccatgcgagcacaactcaaaatagtagtacatccatcatactacaggaaagcacatcaagatttattacagtccaatgtattcattacgaccaagagcatgacaaaactatgtaaagtgcatagcaaagggctgcttctacttcttatccatctcacacatcttcttctactttcctgaaattgtaggaatgacaaaacaacttagagacatgattgcaaaatgtaatagcctataacttgaagccgtcatcctcagtcttgaatctcatagcagtaatcgtacgatactcctctcacccataaagagtttgcctataaagaaaatttcacaattcattctcagtactcaaatccggtcaaacaaaaatcggcacagtcaaatcacaacagtctacctctacgagagcgatgaaatcacaggagtcggcggcaggggcgacgagcacctgcagcggcggccgcgacgggcgcggggggcggcgttggcgacgtgcccctactgcggcggcggcaacgtccaccggcggtagcccgtgcacctgccgcggcggcgcttccggtcgagcgggtcggtaacccttgatgcctgcttggccgtgggatggctatggcgcttcaggatgaggtcgcccaaaacctgagatggtctatggatagcgcacgcgatacagcctcatgcccatcgtacccctcagcaatggacggctggatgaaaactggggtaccgaaaggaggacgggagaaaatctcttgtcggggatttcactccagctttcgacccactgacagtggcctgtcactgaatgttggtatgttcatcatctacatgtttaatttttgcatgagatcacctatcatcagatccttagcaaagtaaacaacatgtgacaaagtgatattaaatgcagaacattatctgattttgtgcagatgtatccacgacgatgatcgtcagacctggacctgtcatagagtttcttctcttcaaccagaatatcaagaaccctcatgaaattgactggggaaaggtaaatcaaaagcgttgttattgatcatgtttttttttcataattatcaaatgtgttggataagtctttgtggtccttggtcgtgattcttcttttttgctttttgggtagttttaccttttccaggacagcatctacccttcagcatatttttcagttgctaggacaactgcggttagtaggacagcagcagttagcatctcctttatgcctcctttatgctttattcagtttggatgccctctaggacagcatcccattcaaatttcgaattttagactaggagggtgcagcaataggctagcagccagctatggctatatatatatgtatccaacctccctcgggcaggtatggcttttgtgtttagtgaatgaagaaaaccagaaaatcgccccatcttgagtgccatcctcttctcaatgagagtaaccattgaaattctaacatctggtattagagccacactttcctgtaggctaaacatctcttgttccaccccttctcaagctcggttgagctctcagccagcagcagcagcagcaccggttgctcctccttcccctttcccttccccctctccacgcagcagccccccggaggtgcgccatgtccgacgctcggtctcggcgttcggtcgcctcgagcactcggcgtcagcaggacgcagagctcgccgcagcagaagagcgcaggtgagcaacggctcagaccgctgcagcagcagcgagggcggccagactggcggcagcggagttggcagcagccagggcggaggcggaggcggcgaaagatgcggcacgtgcggcggaggtagaggttgagaccttgcgcagcagcatcaacggctccatcgccggcgacatcaccgccgacagggagcttgaggagctggcaagagcaagggcacgggagcgagcagagcggtgggcagcagcccacctccacggcggcggcggcggcccaagggaccgcgcgcccgccgacgggaacccagacgggctcgggcgtgccggcggcagcccggagcccgcacgtggccctcgcaggcagcacggctctctctcccctgaccggcaccatggtcaccacggcgtccagacagtggtcagggactttggtcccggcggtgggtggcctaccctcaccaaaaccaactacatcgagtgggccgcggtgatgagggtgaggctctaggtgcggcatatgtgggaggcagtccggtacggtgacgtcgactacgacgaggatcggcgagcactggatgccctcatcgctgcagtcccgcccgagatgcagttctcgctttcccagaagcggactgccaaggaggcctgggacgccatcgctgcggcacgcatcggcagcgaccgcgcccgcaagtccacactgcaggcactccgcaaggagtgggagaacctggccttcaagccaggtgaggatgttgatgactttgctctccgtctcaacactctcttgcagaaaatggtgcagtacggcgacgacacctacgacgaggagagagctgtcgagaagctcttccgttgcgtccctgagaagtacaggcagatcgctcgctcgatcgaatctctgctggacctctccacgatgtcgatcgaggaggcgttaagtcgcctcaaggtcgtcgatggtgatgagccacagcctctctcggggcccatcaccatcggcgggaagctccatctcactcgggaacagtgggaggcctctcaaggtgacgggaggaagggggagtcatcttccccgataggcggccgtaagccgcgcaaggcacagggaggtgtccagctacggtgggcgcgaagacgtgccgagggtggcgcccgcagaggcgcccagggcgttgccaccggcaaccacaagccggcacgagacgacgcctgccgcaactgtggcaagcttggccattgggccaaagactgtcgacagccacgacgtggccaggcccacgtcgcacgggtggaggaagagccggctctgctcctggctcacgcaagcatcgagctacctccagcggcaccggccgcagcggctttcctccaccttgatgagccgaaggtactcgtctccctctgcaacggctccagcaacgacaaggctgatgggtggtacctcgacaccggcgccacccatcacatgaccagccgacgggagttcttcaccgagttcgactccagcgtccgaggctccgtcaagttcggggacgcctctggcgtggagatcaagggtgttggctccgtcaccttcaccgccaagtccggtgagcacaggctgctcaccggagtctactacatccccgcgttgaggaattctatcatcagcttgggacagctggatgagaacggctcacgcgtgttggtcgaggacggactcatgaggatttgggatcgccgtcgtcgccttcttgccaaggtaaccagaggcactaatcgactctacatcctcagcgcgcaggtcgcacaaccagtttgcctcgccgctcgtcgggatgacgaggcgtggcagtggcacgagcgcttcaggcacctccacttcgaggccctgaagcagctcagtgccaaggagatggtgcgaggcatgccgtgccttgaccacgtggagcagctctgtgacgtctgcgtggtgacgaagcagcggcggctcccctttccccagcagacgagcttccgagccaaggagcggctcgagctcgtgcacggggacttgtgtggcccagtgacaccggccacaccaggaggacgacgttacttcctactgctcgtcgacgacctctcctgctacatgtgggtgatggtcctcggcagcaagggagaggctgcggacgccatcaggcatgcgcaggctgctgcagaggcagagtgcggccgcaagctgcacgtgctgcgcaccgacaacggcggtgaattcacagcggctgaattcgcgtcgtactgcgctgatgagggcattcagcgacactacaccacgccttacagcccgcaacagaacgacgtcgtcgagcggcgcaaccagacggttgtggggatggctcgggccctcctcaagcagagggggatgccggccatcttctggggggaggcggtggtgacggccgcctacatcctcaaccgctcgcctaccaaggccctcgatggcaggacaccgtacgaggcttggcatgggcgcaagccggcggtctcccacctgcgggtcttcggctgcctcgcgttcgccaaggagcttggccacatcggcaagctcgacgacaggagcaccccaggggtgttcatcggctacgcggagggctcgaaggcctaccgcatcctcgacccggagacacagcgtgtgcgcactgcgcgcgacgttgtgtttgatgaagggcgagggtgggtatgggacaaggcggtggacgatggttcgactccgacgtacgacgacttcaccgtcgagtacgtccacttcgagggagctgggggagtaggcagctcttcttcacctagcgtgtctaccccagcccccaaatctccaccgactccaacaccaacacaccctcgggccacgacttcgactacgacgagctcttcgtcgactccacatgctccagcaccaacagccactcctccaagcacgtctactccgacgccagctcgtgttgagcgcagcccggtggagttcgctactccgctctcccacgacggggagcgcatcgacgtgtaccacgacggcgagcagctatggtaccgtacgatggaggatcttctcggcgaccagccggtgccgggactggtgcctcgcgacctagaggcgcagttgcaccttgcgtgcgatgacggtgagcctcggtcttttgcagaggccgagaaacacgcggcatggcgtgccgcgatgcagtcggagatggacgcggttcaggagaaccgcacctgggagcttgctgacctccctcgtggtcaccgcgcgatcacccttaagtgggtgttcaagctgaagagggatgaagccggagccatcgtcaagcacaaggctcgcttggtggcacgcggtttcgtgcagcaggaggggatcgactacgacgatgccttcgctcccgtggcacggatggagtccgtgcgactccttcttgcgctggctgctcaggaaggctggggcgtccatcacatggacgtcaagtcggcgtttctaaacggcgacttgaaggaggaggtctacgtgcaccagccgccgggatttgtgatccccggcaaggagggcaaggtgctacgcctgcacaaggccctctacggcttgcggcaggcatcgagggcgtggaatgccaagttggattctacgctcaaggggatgggcttcgagcaaagcccgcacgaggcggccatctaccggcggggcaatggaggaaatgccttgctggtgggtgtctacgtcgacgacttggtgatcaccggcaccaaggatgcggaggtcgcggcgttcaaggaggagatgaaggccaccttccaaatgagtgatctggggcctctctccttctacctggggattgaagtgcaccaggacaactccgggatcacgcttcgacagaccgcctacgccaagcgcgtcgttgagctggctgggctcaccgattgcaacccagctctcactccgatggaggagagactgaagctgagccgcgacagcacggcggaggaggtggatgctacacagtaccgacgtcttgtggggagccttcgctacctcacccacacacggccggacttggccttctccgtcggctacgtcagtcggttcatgcagcgaccaacgacggagcaccagcaggctgtgaagaggatcatccgctacgttgcggggactctcgaccacggtctctactacccgaagtgtcctggcaaggcacacttcgtcgggtacagcgacagcgaccacgccggtgacatcgacaccagcaagagcacgagcgggattctcttcttcctcggcaagtgcctcgttagctggcagtcagtcaagcagcaggtggtggccctgtccagctgcgaggccgagtacatggcggcctccgccgcttcgacccaggcgctctggcttgctcgactgcttagtgatctcctcggcagagacactggaaaggtggagctcagggtggatagcaagtccgctctagccctggcaaagaaccccgtttttcacgaacggaccaagcacatccgggtgaggtaccacttcatccgaagctacttggaggaatggagcatcaatgcgagctacatcaacaccaaggaccagcttgcggacttgctcaccaagcctcttgggaggatcaagttcctcgagctctgctccaggatcgggatggcccaactttcccacaagacgacgcacaagacttagggggagaatgttggataagtctttgtggtccttggtcgtgattcttcttattgctttttgggtagtttcacctttttcaggacagcatctaccctttagaatatttttcagttgctaggacagttgcggttagtaggacagcagcagttagcatctcctttatgcctcctttatgctttattcagtttggatgccctctaggacagcatcccattcaaattttgaattttagactaggagggtgcagcaataggctagcagccagctatggctatatatatatgtatccaacctcccttggacaggtatggcttttgtgtttagtgaatgaagaaaaccagaaaatcgccccatctcgagtgccatcctcttctcaatgagagtaaccattgaaattctaacaaaatgtactagtcctgaaagagggataaccagtgaacgttcattagatcacatagtttccatgttctttgcttgttttttttttctttttaaggccaagtgtgcactgaagaacctgaggataaaaacgactcacaccggctctgaatttaggatcatcggtttgtctgaagacacttgctattcgcagacgtgaggccatattcctgaattccatttctgagctgcaaacgcgcctcgaccttattctagtttttctttcctgatccaggttccaaataaagagaaaaaatggcaacggtggctcggatacagtggaagaagtgacagtctttgaatactacaggaagaattggaaaatagatttgaagggatctgctcactttccctgtctaaatgttgggaagccaaagcggccaacatatatcccattggaggtatgtcttactttctctgaaacatttttttggtacaaatctctatagctgtttttattgttcatgtcattaactgtgtggaaaatgttctaccagctttgccatttggtgccattgcaaaggtacaaaaaggctttgtcgacgttacagcggtccacgttggttgagagatcaaggcagaatcctcaagagaggatgtttgtcttgtctggtgtaagttgcaatgcttaataccctaaattcagctcagctgatggtatcccgtatccatgattgtcaaaaattcaccatctgtggcaggtgttgagggacagtgattataactctgtgccaatgctgagggagtgtggcatttctatagctcaagaatttacccaggttgctgctagagtccttccggcaccaaaggttggtcataactatccactgctgcctttcagaaacttttcttgatgaactgatgatgtaggaagcattgttgatctaatcaaatcttacattgttaagctgaaatctggagatggcgaagatatttttgcgcgcaatgggaggtggaacttcaataaaaatgtgagtacgtcgcttagttgcactccatttgtataccgtacctactattcatcatcatgttcattgtcgataatgttgccaattctcttcctctagaggctcattcagcccaagagagtgcagagatgggtagttgtcaatttttctgcgcagtgcaatgcccatcatcttgctcagcgtctcatccattgtgggaacttgaagggacttgtaagttcatcctccacccaatcttgtgccttttctgcagattccggtatcgctcaactagtttggcttgcagccagtagatcctgaagatcatgtgtttcaagagagatctcacatgggacgcgagcgtgcggaaacaagggtgaatgacatgtttcagcagttgttgtctggcgacaagccctcttttgtgttgtgtgttctccctgagaggaagaactgtgacatctatggtttgctccacttaactttttaaccctgtaaatgagcttaccatgcctctatcatcaaggatcatttattttcttgtttattttcaggaccatggaagcgtatgtgtctcgtcaaatacggtattgtaacacaatgcttggctcctaccaagatcaacgatcagtacctgactaatgtgcttctaaagataaatgcaaaggtaatctgcactgcagacgtgatcagaaaacaaaattacacagtttcttgttgccacctgttgtgaattttatgttgtttttctgtgttttcaatcagcttggagggttgaattcgctgctgcaaattgaaagaaaccaagccattcctctcttgtcgaagactccaaccattatcttaggcatggatgtttcccatggctcaccgggacgggatgatgtaccgtctgtcgctgcggtaagtttcccccgtatgctatgatcttgcttacttatggagatgttttacgtacctggaggtggaacaacgtgcaccgttgatcaagagaggggtaaggtacagaacaaatttattgtaacatgatggcagtggtgtaattaacttgtaaaatatggccattatactttaattgaatactaacatccatcgatcggtatgccatcagaaaaaagagtaaatctaatatccatcgatcggtatgccatcaaaaaaaaaagaaaatcacggatatccaatcgatctataccagatcgcattgtcttcttttccagatcgcatcgtcttctttccctgctttgttcttgttctagggtttgaacgtttcaccggaaagagacagagggaaaagtgtaggtatggttgagggttgaataggagactagattgtctggtcgacgatataaatctcttgctggaaataaaatgtaattttcaacataattaaggtaggagtttttacgtatttgttggaataaaatgtaaatgtagaaaaaaaatcacataattgggtcaataatgtgttgtaagaacacaatgtaaatctagactcaaatccaacgtaaatctacaagaaaccacgcaaatcaaaaaattaaaccttagtgacgcagtaaacgacttaactccaatacaacgtaaatctacaataaaccacgcaaaacaggaaattaaacagtgcaaagaggttttacggtgttaatacgtaccgttatacctatgcggtaccttttataatttgggagacaattctacccttttctctctactagcaaaattatgtttttacccttagtacctaagtacctatatcaatacttaaatacttttaacatggtacctgtgattgaggagcgttggatctttaccctttttggaatgcaaacaccgtaaaacctctcttacttatgtttctctacttctgaaagtatcagcatatgaagctcagtgacatctggatggttcttgcagctgacaattagctgatgtgctacagtgttttctgttcttatctaggttgttagttccctggagtggcctctcatatcaaaatataaagcctccgtatgcacccagtctcccaggctagaaatgatcgattccttgtttaagctagtggggaatgaggatcatgttatcattaggtgagatgcttctatgacattcaattcggttcatttcgaatagtttgaggtatatcttgcagactgccactattgttccgtaatagttttgcttgctaagaatcggaattgtttaccacagggagtcactaatggacttctacaacagttctcgcggacacaagccagaaaaaaaaaatcattttcaggttggttgttcttctgaaatatatgtttgcaacttctaatttatactgaaatttttctggacctgtctcttacgttaaacaagagtaaatttcacaaaaccactctaattcagtcttggtggaattgtctgacagtaagttttactactttgttatctcggtactattgttttctaactagttttgccatcttaattttagagatggggttagtgaaggccagtttaatcaggtgctgaacattgagctagcccagataatcaaggtaaacatgcccgatctgcacagtctgcatttactgctcagcccctgtgcttttgatacaatgaacatctatcttctgcatattttagttgatactcatgtatttcgaatcgatttaggcatgcgagtttcttgccaatgagaaaaatgacagtgaatggtctccaaagttcacggtgatagttgcgcagaagaaccatcacaccaaattttttcagacagatcgatcgaacaaagttgtcaatgttcctcctggtaacaattacatccttcatctcacttttttttcaggatcctctcttaatcctattctggtcaggtaccatcaacatttttctcctcactcttgaagatgtgccgttgttttgtaggtactgttgttgacaaaggaatctgtcatcccaggaactgtgatttctacatgtgtgctcatgctgggatgattgtaagtgccctatcttaaatatgaattccagttggcttagtaccattggaaagattacataatcgagaaaattaccacatacgcgccactggacacgtgtaactctcagatccacatgtcattcggacaaatgtgatattcttttgagtaaatttcacaaaacttgcatatttgatcaaactatcacaaaactaaagatttaaggcgttataccacaaatctacagatttagacctaatttatcacaaactatagacttaagactgagcatcgtaaaaactacagatttatttctaaagttatcacataactatatgttgtaaaaactatagatttaatcttaaagttatcacataactatatattgtaaaaaactattttagagtttaaatccttagcactgatgttatgctgaagctatcaatgtggtagttttatgattaaattgtgctaaacatgtagtgtttttttttcatataattttgatacaaaatctatagttttgtgatacttcatcttaaatttgtagttccgtggtattttttgctaaattagttttgtgatataccggcttaaatttgtagttttacgataatttgatcaaagtatatagtttgcaaaattcactctatttttttcccaactacatctcaaacaaatgtacatgtactactctctgtcccaaaatttagtaatttttagagatgacataggtactaaaaagagggtaaggagagagagggagggaggtagagagtatgagtagtttagtgataaaagttatacatgtcttagtttgctatatttgggataaaaatttgaacacacttgctacacaattgcaatttgtgctctaatcagattgtctttatatttgacaggggactacaaggccgacgcattaccatgtgctgcatgatgagaacaatttcacccctgatgacttgcaggagcttgtgcacaacctctcatacgtgtaagccacactgaaactctgaaaccgcacagaaaaagaagaaaaaaaattcagtaatctctggtgatcattcgactgcatttcgttcgtctgttctgaaattctaatcaactttgtgatgcttgtgaactctgcctcaggtaccagaggagcacgacggccatctcaggtggtaaatttgatctaaacacagacaaattagaccagtcgatttttctgtcactctgaaaaatcaaaagttcagtagtttcacctgacatgtcattccttttgttcttttcagtcgctccgatctgctacgcgcacctggcggcggcgcaggtgtcgcagttcgtgagactcgacgacgcggcgtcggagggcagcggtgacggcggcgcgccgccgcggccggtgccggagctcccgcgcctgcacccggacgtcaggcagtccatgttcttctgctgagtctgtgagcaatgcaagaagtagctgttgctgtggcgcagctttgctgttcgttgggattgatctctgaaaactgaaactggttgttgctactcaataatcacaagctgtaatgcgacattgttaggctttgtgcgtctttgttcgcagcagacgctagattatcagtctatgatctatctagggaatgtcaaaatggacataagtgccttcttctatctgtttttcatttggatcttattagactgcactgttagtctgcaatgggcttgaatagtttgatctgtgcatttatttgggctgttgttttgcagctttgaatggataacagcatgctaaacgaactgattcctactgattcttgcactgtttaaaatgctttgctgcgtgagcaaacatgctaattgtcgtgttgggcttggtccggcccaggttcagatagctggcccagttgtaccatgtgcactaacgcatggtcatgtgtgccttacgaggtttttcatcataatttatttatttatttcatttttgacttttaaatcactaatggcacaagtaaaagctttacccataaataactttttgttgatttgtttatttttttcacggcttatcagcccattaagcaaacgatggaagaagtggtaaatccaaatgcgctttcttgagtttctcgcccatatttttcctccagtagctcaacgagccagacatagcaacatgtcacctcgcccacgcttatgctatcggctccttctcggccctcctctctagctttcgactctccaattgtactgttcaggtgtcgctgagctctcgttggctggctggctagtgcgcacagcgatcaggttcatgtcgcaatagggtggctgccttgagatggtgtatgagttggctcacctctacgacatcatcatctctaagatacacattttatctatatttttattagcaagtttttcaaactactaaatggtactccctccattccaaattgatatacatatagttttttttgaggttattcctaaatgatctacatatttgtgttcattcagtctattcgttatctgtgcattggagtaaatggacattgatgtatgcatccatgcacacaagtatttataactcacatgcaatatcttgatttgctattggctaggaaattgtgggaatggtgcatacatcgagtttgttgctagagtaaatatagtatgggatagttattagcttttcttggtcttggtgtacctataaaatatatagatcaatttagaatggagggagtatgttccatacagaaacctactacgtagagaagctgttttaaattataaaaaaatatattctttaaaaaaaaactaaaattacttaaactcgattaatcatacgctaatatctttctcgtttcatgtaaccgtacaaaatattcatcttaacacagtgaactcaaacggggctattagtgttagtactgtacaccggccggccatgttgtctcgcccgccgagcgcgcgcttgtccacacacgctcaaagaccgtgcagtccaacagctatacgagtcgtagctaattaagccgccggttaatttctcacacgaggggtctcaacatctgtgcattgctctctctctctccctccccctcgattgctgcctcattgatctttggatttttgacgtactactactcctacattaataatatagcccacttcttactattagcctatcctaaagttaacacatataataaattagctataagattagctataattttcttctcctatctctatctctcacttatacatttaatgtatttgtcttggagcttgtgttaagctagctcttacatgagagccaacatccttctcttctgtatacctctcttctccacataagcttatagtagatttataactcactattatactttctctaagtaaaaacgcggcgggtggtacattggtacgtactcggtcagttgcatatggtgaaggatttgactgaaggtatcctgtgtgttcatgtgcctagcctcgttataaatggaaagggaatggattacaaagacgacttttaggctcagttcgttgcttggtgttggtaaccaatgtctcgcccatgtaaaacggagtgacttattagtacatgattaattaattattaactatttttttaaaaaaaatagattaatacggagtataattttttaaggaacttttatatggatttcaaaaataaaagcaaagcgtgcatgccgaaaaaacatgcaagttgagttagtaacctcaacaaagaactcaacattaagggtgcattcaggaacttaattattctctccgcatggaaaacaagatagattaggtcattagtgtgggattaattaaatattagctaaaaactaaaaataaattaatatgatttttaatttttttaaaaaatatatcgtttagcagtttataaagctaaatagattaatatgataaaagaaggcatgaaagtaaataattaaacgagtcgacaacgatcactatacacatgtgagaagcgccacagacgcaaggtgtacagtgagggatgatggtcattatcgagtgacttaaaaagataatcctagctatatatatggagccacaaattaaacgagttaagtgagagtagcaaattagtttcaagatttcatagtctacctatcaaacataaccattatttgccataaataaataaagtttaaattatgtaataagcacacaaaagctagcgtccgatgtatgttgaacaaaaaattagggggacggtcagaagaatatcatattttgcctttccacacatatacagaccataggacaatgttagttcaagattatcgagatactacctctgtgttttttaatatggtgacactgttatgtttttttataacatttgatcatccatcttatttaaaggtttagtgtaaatataagttaaagtaagagtttgtttgatagtaaaaagtcataacaaaataagtgatatttatataaattttttgagtaacataaatagtcaaacatcacgttaaaaaaaaataacagcatcctatatttaaaaaaaaacgcagggaggatatactatcaatgtgaccgttaaaaaggagcatgcagacaatctacaacaaagagcctgattcaaaacagaatgccattgtaaaattaacagaggacggaggcaaagaatccaaagccccacggcacactttgcattgttctgctactagtaaactttgtttggtacatgtaccataacatttgcctatttggcagcagtagtacaatcacttctccaatgctcagagctttggttgtactgcctcctctacatgaataatccttaattggacatcaacactgcctagtcactaaacaaaactgttagttatggaagtttgggaggtccttggaaatgcaactattggagcttagtggaggcaggtacatactataatacagtactgggagctagcttaattaacaaaatggattgggttagggttttccatacatctgacctgatgactgtgtgcacgagaggcaaagcctttggagcccataaattaaccaacaaaaattagctagtgatactacattgattattaaactaacccgactatgggaattaggagtaatagattaatgagtgcatgcatctacctatgtgagaacagatcatgagctgcaggaccatggatccatcatgcagagattctctctgcagttcttttgttcttgttgttgttcagctagatcatgtggtgtgtgcacattcttccgttagttaggctaggtaattgactaggtactaactattttgtgatctgaatcgtccctgatctctcctggcctgttcccctgttttttcccatgtttgatagttctgctatttggctttgttttaagtggcgtacattctactgtgtctactcctccgcatccatccaatttgtaaaataatgatatgttcatatgatactgtctataattctgtaaagataacctcaaactagcaacataagtgttactctaagcactgggtagcaaattctttgcaacctccaatagataagtagagagccataagtatcaccttggtcccataatgctgttccacccatgaataggtaggctgtcctctctccgttaaaaaaacaattcatgcatttggactagtattttttcatgttcaaagacatgatttgtttttttatagcttattgtggtaccataatgttttcacaaaaatagtcaaatcgtttttacactgtaagttacatacatttatagtataattgcattgtaaatttcaaaacttacagtgttataattacattataagtttcaatactcacattgtaatttttctaatgcataatgtataagaggattaggattagaagtaatttatttcttaaaggaggatatacaagagataaaagcatacttactataggagagagcacaatcgcatacaaaatcaagcgaaaaatatgatgtgataattaagcaatcccttttttcggaggatatatgtacatattaggacacggagaaaatattcatgtgaaatctcaatgcttacacactgcaataggttatcacataattaaaatttgagatgacatgcttagtgaaatgacagaccaaaatgaaaaagaaaaacaatgaaaaagaaccacgtgtcatcctctctctctcttcttgccgtattggcaccggcggtggccacgctacctcacatctgctcgcgaaaaagaccccctaaaaaaactccctccgtcccgtaaacatatttgaccgtttgtcttattaaaaaattaagtaattattaattatttttctatcatctaattcatggttaaatatactactactactctagtttttaataatattcataaaagttttttaaataaaacgaacagttaaatatgctttaaaaaatcaacgacattaaatatttagggacggatagagtataaaaataaaacttagctctagtgtgctcacggcggctggccggtgccggatcttgttctgttccggcgacatgatcgcgcgtccaacataaactctgccaaaagctaatacgtgagtgagcaactacaaaacaatagacacgtccgctaaataactaaacagatctagtggtgcagctctagctaattaatctgaattagcggagatagcctttttagctaaaccagctcaactcaactcactgtccgcgcctgcatatgcgccgactaacacagcaacctttttgaccggacgatcattcattacacactactgactatactactcctatcaacaacaacaacaacaagggcatcaacatcgcagacagattaactgcagattttgtctcgtaccatatcgcatgcacctgcctaattataatccgtccctgtccaactaatatactactcatactactctatcaaggacagattcgaatgacagtggccacgcgccccgtcgcaacattccaagttactcctaacttaaactgttatctactcttcccgtcccatttttcacggttcatattccaaggtctcgtctggctttgattttgttttatgtggcgtgaagacctttgatgttgaaatgtttggttcgtgtatcactcactcactcgcagtctcgtgtagtagtagttcatgtgtacatgcatgcactcgatcgagttgtgtaatctggggagaggattctgtgaatccaccgtcgctttcgctcgtggaatggaggagcgatggtactgaactttctctcccttttgtgactcgagtgaaagctactgatgatcgatgctagaatatcaagttttctggttggttagttagttagttacatgcatacgtgcttaattagtgggcgattcaaacaaatatatactcgatacgtatttagttgaggtgatcctggatcttgactatggtgaccaaccagcaaattgtagtacgtacgtactaggagtagaactactccctccgtcccataatataagagattttaagtttttatttgcactgtttgaccactcgtcttattcaaaattttttgaaattattatttatttttttgacttattttattatccaaagtactttaagcacaactttgtgtttttatatttgcataaattttttaaataagacgagtgttcaaacagtgcaagcaaaaactcaaaatatcttatattatgggacggagggagtagaaaggaagaagaaactattaaggttatgttagagagtaggagaaaacaactctcctatatgaattcttctttaagaaaaaaacataccccgactctttagtactctcttcgtcccatgaaaaaccaacctagtacaaaatgtaacacatcatagtaaaactaatatggatagatatttgtccaggttcattgcagtagaatatgtcatatccagtcatgatttattttttattggatggaggaagtagttcgtaaagcgagcacgcgaaaaacgacggatttatttttttcgaaacgaatgcaacctaaaatctgttgccctaccaattttttttggtgcaaatatgtagacaaattttgatacgataaataatttggtagaacaaagttagctagcgcctactatttgatttgctattaatatgaagccaatttttaatactagtacagtgaataaatttctaaaatgtaacgaactagagcatgggcactcccatgtttggctccaatctaaattaggagcgaattttattgctacttaagttaccaaattttgataatacatgttttcgcctcaatcaagaagaagaagaagaagaagaagaagaagaagaagaagaagaagaagaagaagaagctatatatgtgcattcaaatactagaatctacaatctggattatattcaaatggatgcaaattcgagttcatctccagtttaggagcgagtccatttcaacattttctcttttaaaaaggaaaaagacagagtgggacccacgccggccaaaccaaaccaaaccacaagtgtgtgtgtgcgcgcgcgcgcgcgtgggtgcgtcgggttgcgcgcgcgcacgggtgcggagcaggagcaggagcagaggcggctgggccacgtggcgtgcgaggcggcccacggagggggtcgccaaaagtccaaccccccacacgtgcgcccaaagcctagcctggcctggcacgccgcacgggcgccctcggcccgtgggccccgctgtccgtcgccctgtcggccaccgcacgaatctccacgcgccactgctccacctccactcctaggagtgttttactagttataactctagattagtagctagtaattaacttgtaggggaacagtaacacgaacgatcaggcgagattagattagagtaatcagattgattagtactagtagtttaatccgcctaatacagccaagggattcgttcacattctgttccataaacagcgccgaactagagaacgtggaagaggagtacatatcgctttcggctatctaatcaatcgcgattagcagagctgcgtgtaattaacaacatgaaagcgacaacactcatatgccctgtcgccaaccggatttcagctctaattagaaaaaaaaactgggttttcagtttctaactactgatttattttccgaattgtacaataaatcagatgctgaaagaaactgaacgagaaaactgtactctttagaagagtttctttttgaaagaattatttagaagggtttctggtactgaaaagaagctgcatttgtcaaaagtttctcgaaatatgccgtccatcatatgacagtcaccatgtagctcatgtacacatgcatgcacgctccaagcaggaagccgcggtgaaatgatctgaagccctcgaatcgatcacacccgtgcaatcgttgcagcagcctgctaattaattagtactcatacggttaacaatttatatccctatgtctaaaatacttaaaccctaccatctgatggcgaatttaaaatgagtaataatttaattaattagtaatttgaaatggttgatgggtaggtaaaaagtatccacggaataaaattttttggtttacgggttggttgtatgtaagaagtactaggagttagtattccgtagtttattttataataaattttaaaatctacagtttagtttattttgttacggagtacgttattattgttctcactttgtcatcgttcttatacagtagtagtatgtcatcgactatgactttatttcttcgaatctgtcaaattagttctactgatctctagagttcgacagcttagattcctaggtcgatccaagaggtgcaattaacaaactgaaatacaattaatgttatctcaaagtatgaattaaaacaccttatcctaagcataattacgtgataattgttgtggaactagatactgatcggagtttttgggaattgaagccaattaaaaccgccgataaatgaccagcctgaggacggagacatcagggatctcttgcaatgagccatggaaattaaatgtcattcgatcgatcggatcccttgcaacgttgtgcttacgaggattagttggtcgtgtcaggatttatttgggaggaggttttagataactgctatacgtatgattatttgtgtacgatacttgtacgatgtaacgtctaccagtcaaatcccatggcattttctggccgtttctaacaaaacaacacataacatttaacgtatgttagcaatcatacaatgatcgtacatgtaaatcgtacgcatagtattttcggaggttttaggtttagcgtgtgagatatcattatgaacatacacgagtagatacagagtgtaccccataccctcatgattaggtctctcgaactattaaccgcgagaccgaccaacaataaattactatactctcttgttccaaatataaaatactagcctaaaattatctacttcctctgtcccagtaaacgtgtcgttctacctatctatccatgtcccagtaaacatgtcgttttgctgctcctgcactacttcaaccaatctacagaggtgggactaatctacagaggtgggacctagaaaaaaaatgcatgtggcgaatttttttttctgctcgatttttttctccgatctaagtaccgctcgattttttttccgcaccttatcctctcgcatgacgcaccactcgattcctctgtcgcccgcaaccccctccctgcgccgatccccaatctggcgatccccaatttctcctctcctcggctcctccatcgcccccctgccccccaacgatccccaatctcccccaccccgatccacctcatccgtcgcctcccacctccctagcctcctcacctctcctctcccctcggcggtccgtgtcagcaatggcgcggcggggctgcgccgattctctggccgtcacggtcgtggaggtaactgctcggcggggtagaagggctgtacgcaagcggagggctgtggaaatagatgccgattcacagcaggcaagtggaggaagccgaggaggatgcaggcggcgtggtggtagggtgctcggcgccggcggcgtccactacctcaccgaggagcagcatgcatgtggctacatgtccgatgcggagcgccatcccggcggtggcttcgtcgttgactccgatgacgaggcaagtggcggcgtaccgaactccgatctgccccttggcagcgggtttgtccttgactccgaggatgaggtttgtggcggcgatcctgagtcggagctgcctcctgagggcacctttgtccctgactccgagggtgaggagtacggtgccgtccccaacttcgagctgcctcccggcggcggctttgtccctgactttgaggacgagacgtgtggcggtgaccccgactcctagctgcctcccgacagctgcgtcatccctgactccgaggaggaggcatgtggcggtggcctcgactccgagctacctcccgacagctgcgtcgtccctgattccgaggaggaggcgtgtggcgacgaccctgactccgagctgcctcccgacggctgtgtcgtccctgattccgaggaggaggcgtgtggtggtgaccccgactcccagctgcctcccgacagctgcgtcgtccctgattccgaggaggaggcgtgtggcggcgaccccgactccgagctgcctcccgacggctacgtcgtccctgattccgaggaggaggcgtgtggcggcgaccacgactccgagctgcctcccgacggctgcgtcatccctgactcaaaggacgaggcatgtggcagcgaccacgattctgagctgcctcccgatggtgtagctgctggagatgagggcgtcgacgaatttgctgaaattcgcgaaagtatgttacggattttacttcccctatacttcaccatacctcacaaataatgccatggaagatatgccatctaggagtattagttctaggagtaagacatattagtaatattgcattactaatgatgagatcaaggctagagaaatggaatcctgctttggctaaaccactttgatctctgcatatatgtaaaaaaatgaagaactagcatgactaccaagcctgtttggttcacattcccttttgcgtagtctgtaagcagtatatgcttgatcaatatgtgtaattaactaattaattataaggaccttttaaagtttatttgtgtcatctttggtgaatttgtttacttagctcaatatgtcacttgcacctcaaacctaaaaaaaacttcttgtagtctatgctgcgagattttgattgtaaatacagtattgcaaaatttcgagttgagtatgctaagcatttggtgcacaattgaaccgacattatagtttaggaatattatatgatagtcagccattgatgtatctgttaaggatgaaacgaacagtgaaaatacatatataacacatattatatgaggactgtcgaaaatacatagtggttgttgccaaaacctacggatggcgtagtgatagatgacgtttacatacacagcccaaaataacaccagttagttctccaaaccacaattacatagatagcattagcaatttacatatataacacaaaatagccaccactagttagccaaagactccacgactctctcatatagcccacgatcacaactaagggctttaggcaaaacaccaagtgcctctagcctctccttgttcatgtgagggatcttgtacttattccctccgttagctctcatgacctcaatgtagcagccttgtagtgtaaggaataccctattaagagtattaggattgtagtcacggtattccttgtgaacattctcgattagctcatccatgtttctagatatcctattatgtgttaaggactaaagtgaagcaaagaatccaagatctagacaattcatatccggggaatttggaggttgattcacgaggcgaatatcaagtccggtttgggctactgccacaccaaactgtgcatcatcgatagtgagatgagttctagcattatcctgctgaatccatatggtttttcttgcatcttctcgaggccaacatgctctaatagctggtagcactttagagatcatgaatgatcttatggtgtctctatcaacctttattagcttggttactagtgttcccctttctctattacgacttctcctttgggctggttcctgttagtatatgaaataagttatgtttacccatgaatatcagaaataaatgtacatcaacaacacttgtaataagaagaatattttaccttcctagtaaaaggccaaatgcctatctttccatcaaaagtgcaattaccctcatcaccataccttggtttcgcaactgctgataagaacattactttatcaatggcgttcttgttgtgcactgtgaaatatggctccttttcacccggatacaggtagaaagtcttctccttctttgatgcattgaaccatttctcatctatgtggataatattttccatttcaataaactttgggttgtttggcaatgtatgcggatccaacatagaaacacaccactgcagcctttcctttttatttgcttccttcaaataaggctttagcgagtttgagtgacgccgtatcagtccttctttgaaccacctatgtaatgtgcttttggaaacaccaagggcttgtgctagtgaccggatagtgctcctttgatgcaatggaatagctgcaataactgataagtctatttcgaccttcttgcgtcgagagtttccatgcttccttgaatcaacattcactgttattccctgttcatggcaaatctttgctctcttccaaatacgttggactgtacggatgctaacatggaactcttgagcaactaaacgtgtggtgtgtttttctaattttccatctttacttttctaaagcaacaattgataaatgcatcgcctttgtatgtttgtcaaatcttttgacttacttgccacattatcatttgcatgttcttcttgatcgtcatctgagtcgggcaactcctctacatcaaagacaacattgacaacttcggcgtacactccgtactctcgaagatcatcctccaaggcttccaactcaaattgcaatgcgtcatgatcatctacaaaaaatgtttgacatggtaagttaatctgggttaataagaatgcatacatttattcaaacattaattttacctagttcagtttcttcttgttcctcatttacatgtgcattcccatgcacgacatgcgccgcacagtgcatcacgttgtctgcccaaatacttcttggttagtacacttgtaaatatgtcactgctcatgttgtcatgcacacttgtaaatgttttcaagttgcattttacatgcaggcttatgcatgaatggttagtggtctaataatgcaaattgcaagaggtcagcgactaactaatgcgacctttgttcatgtatacatgcttgaaattttgttgtttaaatatgtagtgtggagtgagagaacattttggagataactaatctgcatatgtataaagaaagattgttagttgctaaataaaaactaatgtaatgtatttcaaaaaaaaaactaatgtactgtaaaaaaattaaagttgattcaacaaaagatttatggagcacttccattcaatgggaaagtaagatcatccatgatggatctgtgaaaagcagtattagctctaatgcactgcataagaaactgaatctatacagttggagcaaatttccagtagtctttgaagatgtaaatttataatccacgtacgcattgtcgcatcctagctgtttggccttgtttcatgcatattgtgagcaatacatacaggccagggaatatgcattggtgtgatatacctttggctgtcattgcctgtactcagcatatacatatcattttataattttctagtatactgataaggatcacttataaggttctagtcattgcttagaattaaagttatgcacttacatatcacttatataagtaaggatcaggaaaaataatactagaaaccaaaatgctcaaattgtacactaactgtaccattcttttccggggaacattatctgtaacattcgaaccttacaacaccagcttatatctgaattatggtatgattctggatcatcaaactggaatggaacacagttactaaatggaattgattgatttatttaactaataggaaactggtgtgtgctagtgtaaatcatccataaaaccatttcaaataaaagcccttgattccatcaagttagtaagtgcttggtccagcgcagatgattgataagtattgaaatcttaccttgttgcatttgttcttcttctatagcctccatgttgagatcaaaaggatgcaagttgagatcaagaaaaccttcatgttcctggccatcaactccaagaaggttatctccaaggataacagcagctcttccatcttcttccatatcagcttctccattgagatcaggtaaagcccctccatctccttcctcttccggtagtaaatttagatctctgatcatttgaattggatgtgagtggtgttcagttggatatgtaggttgatgaaatggaatgaaatggatggccctttcaggatttgtagcatatgaagaggcactcttgggcgccagaactagcaaatgaagaggcagtcctgggcggcaaagattacttaatggttgattcaaatttttgaatatgttaatgatgccttttccctgtatcaatagtgtggccaaggcgccaatttgtaaacttcttgtaacacgtggcactgtgttgtggtttcatcagcaatcaggaaacttccagaaatgataatctgggtgcattaacaaatgctagaaatgatagctcaatcaaatcatggggacaatttggtcattttacacctcagctaattttggttccaaaccttaaaacgtcacgtttactgggacggaggaagtacctaccatctatatttcaccaagcctactgtgttaactagagcagaggcatacttcccccgttttatattacagatcgttttgattttttcttttaaaactactttagattcgataaatatataaaaatttagcaacatcgacgacactaaattagttttgttatatgtaacattgaatatattttggttatatgtttgtcttgtattaaaattgttgctatattctttataaccttaatcaattttttaaaaaattaaatagaaaatcaaaataatttataatatgaaatggagctaggattatctttagttatcctcaagtggatagctaaagatagtgaacaatgaaactaggatgactgaaggtcggtaaaaaaaaaaatggtcgcgtacgaaaattcccgatcaactaagcgtcatttccgtataagaggtatctttttgaccgtaccatttttagctatttttaaattttattttttctaattttttctgcatcgtattaatgtcgacaccgagaaatttaaatgataaatataattaattactagttaattgaggatcattttcgaagagatgctatcaattccgatcgtttacgaccgttttcattcctgcctgctagacaagttaaacttgtgcaccttcttgacgatcttcccgttccgaccgtccgacgtgggattaattaagtaaatgtgcatgtgtcctactaaaggaaaaggcactgttactgtacgtgcatctgtgatggcaagcctttaatttgtcgtgttcatgactcatacagtcatataatacaattatataacctaagcggatttaattattgaagccactcggccagtgacagtaatctgcatcgatcacgtgcgcgaattggaggacagggtaatccaaggttgatgtgatgtgatgttgagtgctcgcttaatttggacgtagtccctcagaaaaaaactaattctgaatttgaagctcaacataataatgtcttagacttatacttaggattaggtttttttgaacggacgtagtacgcagtactactttcttcatcctaaaatatataagaaattagaaccaaatgaaacatttcctacctacgaatctggagttctggacaggttgtttatccaaaatcatagtaataaaaaatttctcatatgattttatgttattatattttgaaacgaaagaagtacgaagaaaaacagtactagaaaaatcaagcgctaattatgcagcttaatttaacagttctctttgtgtgctagtatgtgtttgatggggctgggttgtttgttttttctcctctttctcagacgttacgttcattggtggagaaaccatctttggtcggtcagccaaaattcacaatagtcccggttgcaataaaaaccggaactaaagatatctttagtcccggttcaaaagtttaaagctaccaaccgggactaaagatctatttttagtcttggttggtaataccaaccgaaaaaaaagatccctattatctttagttccggttggtaacacaaaccgggactaaaaatttatttctagtcccggttcccggttggtaataccaaccgggactaaagatcggcatgtgcggtgaagagtacgagacaggcagccttatctcttcctccctagccttatctcttcctcctcccatctcttcctcttcctcctcctcctcctcctcctctcctataactcctctccttctttccctcccccatcatcccatgggccgggcggccggcggccttgcagcggcgcggcggggcggaggcctcgcggcagcgcgccggcgggcggaggcctgggcagcctcgcggcgggcgggcgatgtggcggggc

SEQ ID NO: 20051 - DNA, 56669 bp, Oryza sativa
  unsure (1)..(56669): unsure at all n locations
atttgtaatgcattcggatatggccgatttaggatttgaggatttgaggataatttatttgggattttgggatggggatggagtgataacaatatattaaaaacacaatgaagaaaagaaaataataatagagcaactggatctagctagtctagctctatctttagtcccggttggtaacaccaaccgggactaaaaaggctctatctttagtctttttactcccggttttttcatccgggactaaagatcgctatgtttagtcccagattcgtagtcccggttaaaaaaccgggactataggggggttacgaaccgggagtaaaaaccccttcttcaccagtggttactttcggctaatttgtctatatacagtatatgtgtttttaacaggatatgtgcgtataaattgtactaagatagtgtttgaatcttctgaagatgaagatgaagataaaaattaagtatttcacgcaaaaacgatgtggtaataatgtgtgattaattgagttttaattattacaaacttaaaaaataaattaattgatcaaatattttagagcaacttttatatagaaagttttcgtacgaaatgcatcatttagccgtttaaaaaatatgccatgagtatccaaaatttcatccaactcttgttggagaaacgtacacaacctaagtcatattgattctcttccgcttaatttaacagttggctttactggattgattttgtactacgaacgattataatctctcgatcctttgaatatcttagctaaccatgtcgtcggctacggctagcccccattttctgatttatatgattccgtgtccattttacttagcgtattggtgcgacgtacgtacggtccattttacactagatttcacctaatttagattcatgcttgatagtacgttcttacttagggcattcccaacccaagataatagacgtagttttcataaactccacatcattaaaaaactagtactagacaatactcttctaatgcaaacactactattccatacttaaatttaatgctacttatctcatcttggatgttgtgtagaaaccttgtctcatacaagacatggtttccttctatttcctcatttattcgcttgccacatcatttttcatcctaggtggcagtttatttaatgctatggacaccatcctagtcattggatcgagaatgccccttagcatatgctccgtactccaatacaattattttctacttttacgaactctgattcaatgattatataaaatgaacttattttcgataaatgagcggaacaaaaataaatttattatgggatagaggaagtactacctccgtcccaaaatatagctatttttagcacagtactttgtcccaaaatgaagctatttttctacctaccttctcctctcaaccaatcacaaccattctttttcaactactttctcttttcaaccaatcacacgccttcttaaatcattctcatatactttcttaatacccgtgccaacttaaaaaatgcttatattttgggacggatgaagtagctagcagtaaaatgcacgtgcatacgcacgctcgtcctagcaattaatttgggtgtagctttactactgtagtttaggtttagactgttcaattcaacaatggctgcggtaggccgtaacgtccggatcgatcgatcgatgtcgtcgtcgtcgtcgtcgtcgtctagtacataaacacacagtgtcgttgtgtctctgctcgatcaatccgtgtaccgttagatccaaatcgatcacatctgcaaacgaaaacaaacacacatctactgcacatatactatgctaatacatggaggaggagaatcacaaactagccactacattaatttttccccgatttgtagtatagccatattatacttaggtgaacatcaattcaatattcatgcacatgtacgtcgtggtatgcgtgcaggcatacgattagttaaactaagtgtttccccgctctttgctgcggaaatttctatgtaacttttaatatgttttagtaatcgggctaaaagtaaaaattatattagttattaacaacaaataatgtcaaactatatttagatagaaatacatttaatagactctgtatgagattataggtgaaatatgatatcccgtactttgattatatggatgaatatatgttaaggattataaaaatgatggatatatatacatgttatttattgtgaaaaataatgtgaaggaagatgattggatgttgatttgtagaattcaatgaattatagatgatgttgcatgcttgcataagttttgcatgtaattattgctagtggatgatgatgatgaggacatcctccactattacccgctggcagagacgtaaaagtcgggcggcgaccatgtgagcctctggtaatcccaccttgcttagcttgggaggaggaagccatcttaaaagggagagccacccttctcctgttgtcttttagggagattgggcctttcctcaagtgggtgtgcctaagaactgttggggtccggacaaccttaagttattgggcctcggccgaccccacctaggctggattgttatcatttggtatcagagcttgggcccttgttaagaggttgggaatgatgaggacatcctccactattacctgctggcagagacgcaaaagtcgggctgcgaccgtgtgagcctctgataatcccaccttgcttagcttgggaggaggaagccaccttaaaagggagagccacccttcccctattggactagtcttttagggatattgggcctttccccgagtgggtgtgcctaagaactgttgggtccgggcaaccttaagttattgggcctcggccgaccccacctgggccggattgttatcatttgaggtggcatgtttgcatgttgagctttagaattagtgggttataactttatactagtaagagcaagtataatagtgagctataagcctactataagcttatgtgcctactataagcttatgtggaggagagatgtgacaaaaagttaagagtgttggctctcgtgcaagagccagcttagcacaagcttctagacaaatacaattaatgtataagtgacaaatagagagaggagaagaaaattgtagtcaaccttatagctaatctattatatgtgttggctttaagattggctaatagtagaaagtgagctttgttattatccttgctctaagataggattagtagtaggtgatgatgcattaaactcctgctcttttatgattaagatgcatattcagatattctacctcgatcagctaaatggtgcataacatacggaagctattaatataaagttgctctaaaaatcaaataaactcctttcaaatttatagtaatgattatattttaattaatcattatcttacttaatccttttttttcaggtttgaaccagggccctgtttggttccatgggctaattattagcctgaccttttagccataaattagtccccaaggatccaaacttgtgggctaatttgaggctaaagtgaattaacctctctcaaaacattagcccctccaagaggttctaatgtgactaattttgtatggggaccataaaaaagcagctctctctccccctctctcctctttttctactctcttttcaccttttagccttgaattagtcaatgaatccaaacatgccacctaggtctatgggtgcgctcgttcccgcgggcaactactcccgccacctcgtttttcgcgcgcatgcttcctaagctgttaaacgttgtgttttttaaaaaagtttatatataaaagttacttaaaaaattcatattgatccattttttttaaaaaaaattagttaatacttaattaatcacgtgctaatggcctgcttcgttttatgtgtcggagggattattccccgcccctcactctcgatcgggcctatatatacatgcccggacacatacgtggttgatccaccccagttccctctcgtgttagcccaactcgtatgccatcgaggctcctccttgtattgttgtatgtagtggtggtaatgtgtcataaactctttcacatacctgtttagatccctgacaaaaattttcatcctgtcacatcaaatatttaaatatatgcacagggtattaaatataaacgagaagaataactaattacacaaattgcatgtaatttgcgagacgaatcttttcagcccaattgctccatgatctgacaatgtggtgcgctgctaaaaaacatttgctaatgacggattaattaggcttaataaattcacctcgtagttaacaggcggattatataatttgttttgttattagtttacgtttaatacttcaaacacagcctaaatatttttagctgaaaaatgcactaatttttaatccaactccttttttgacaaaaagttagatctatttttgtactccctccatcccaaaataagtgcagccatagttttccgcgcccaactttgaccattcgtcttatttgaattttttttgaaaaaaattaaaaacataagtcgcgagtaaagtattattcatgttttatcatcttataacaacaaaaaagctaattataaaaaaatttcaaataaaacggacgatcaaagttggacgcggaaactcatggctgcacttactacctccgtcccaaaataagtgcagccgtggatatccgtacccaacgtttgaccgtttatcttatttgaaaaatttatgaaaaatttaaaaatatttagtcacacataaagtactattcatattttatcatctcatagcaataaaaatactaatcataaaaaaatttcaaataagacgaacggtcaaacgttgaacgtgaatagtgcaaaactgtactccctccgtactcgtaaagaaagtcgtttaagacagcgacacggtctctaaaatacaactttgtcttcttgtttctataaaaatatttattaaaaagtgatatatttatacttttatgaaaatatttttcaagacaaatctattcatataacttttacattttcaaactcaacaacttaagagttattgataatttatattcccaaggtttgacttaaacattgtcctaaacgactttctttacgagtatagagggagtacttattttgggacggagggagtacaacgtaggaggatgaggagcaggattgcaacaagtggaccggcaggacaagcaaccccgttgaaaaagaggagcaaagaaaaccactcagtcagtgccaggtggggcccacagcccaacaggtgacccgacccgacccgatcgaatcctgcaaacccgatctttattcctctcctccccgagagagacgagacgggcccgcatcacggccgtccacgtcccgtcggccccgtccagtctgggccgtccacgtggccccaccaccccacccccccacacgtgtggcctcgtaacccccgcacagcacacaccgacgcgacgggtccgcgcctttcctttcccgccatgctacgcgacaacaagataacggcgccgtttagagtggagtactggttcactgtacagtaaagcataggagaggcggagatttacgttgacggcgttaggtgggggtggtgtgtgcgtggcagctcggtcggaaaaagctggcgcctgagcgtgtgtgcgtgcgcggggtcttgtcagtctgtgggacccacacaccttttgtcgcctttcgccgggtcgtctcggtcggtgcccgtaacggtcgccccctctccgttcctggagactgtagactgtactgtacactggagttgtatttgagtcacagtaatgattattttaatcttcacaagatcttttactactccaaggagaaaagaagaaaacacaagagaaaaacggctggattttttaaaattttttggtattttcaaaaatttattttataaataggcattcaaaaaatttattccataaataaaccctttttcatggtgtcaaacgtgacagcgccaaccacgtcaaccacgttaacattgttcccctattctctcagtggaaactaaatcactagtatgaaagtggtcagtatcaataacttcaacatgaatgaccttttttttttcagaaacatgaagaacgtatttataatattttctagaaagagtctatttacaataatcaaaagccactacactaataacgctggtgtcgtcaaaataatccacaatttaaataagtttttttttgagatctactccctttgccaaaaaaaaaaacttaattctggatttaaacctggacacacgattagatttttttttaacgaagagagtactatttataaaataagttttttttagaaaatatataatgtaaaaaagtgcagagaggcaataaatgagggcaagaagaggggagagaagaaaaggatcccatcggatggcctaattagccaaggaaaaagctaaattttaaattttcaaacttaattttgagatattttcaacgtattttcttttataattttggcttttaagtcaccaaaaaatatttataaaagtttcatttacaaattcatttttattttctaataagccgttttggcttattaggaaataagccaaacaataggaccaaagagagggcaaagagaggggaggggggaaaacagttgaggggaaaggagggagcaagttgctttgctgtctccctgacacccgcaataatagagatactcctactgctactaggggccagtggcgtgttgcagcgcaggaacctaacctctgcccatttagccctgtcaaatctttaaccaaaagtactgtacactggcctagctagccaccaccacccacgcccctgctgtaggtgtacacacatccatcttctcatctcatctatccatgccacatagtactactggtaggggtaacaaccacccatcacaccagcatgactgtatacgtgacataaattgttccttgtgttgtgccatttttctctcctctccctttctttttctttctacttttttctttctaaagtatataaacctaatattccatacaaaacatcggtatcatgaatctatacgagaggcatctactcctatgagaaacatattatccctccgtttcaaaatgtttgcaccgttgactttttagcacatgtttgaccgttcatcttattcaaaaaaaaattatgaaatatgtaaaactatatgtgtaaatgaaagtatatttaacaatgaatcaaatgacatgaaaagaataaataattacttaaattttttgaataagacgaatagtcaaacacgtactaaaaagtcaatagtgtcaaacattttaaagggagggagtattatcgtgaatatgaacatgagtattatgatatgttacgctctatactagtagagtatatctagggacggagggaatactcctacttcctctgtctaaaaaaaaccttaatctaggaagagagatgactcactcagtcactcgtattaagggatatgactctcgtattattttgattagttgtactatgagagatcatattctcgtatgggttaagattttttttgatagagggcgtaggccgagtttagttctaaattttttcttcaaacttctaactttttcatcacatcaaaactttcctacactcatcaactttcaacttttccgttatatcattctaattttaaccaaacttttaattttcacgtaaactaaacacacctgtactctcttctctttacctgccaaaagactgctcctccttgctttcttcatcacacatggagtgataccagtacacttttgctcctctttaattacttctgtcttttgcgatcgccggccatgaataccggggatttggtcctgaaattgaatactcccacttcttcatctcttgtattctgtgattgggtgtgccatgcatgcatgcgaatgcatggtatgggtacggtgaaataatgtagaccaatcacaactgtggtacaagaggagattgtgttgtgtgttagcctgcaccttttccctgaccccaaagctactggttgctgtatatggaaacgctctctcatggtatcttgcttgtttttgcgcgtcccttcccctcacttgcactggtgttagcacaaccaccgcaacttgttgctctctctctctctctctactcatttgacatgtactactaattccaaatgttttctaattaaagccgagtttagttctaaattttttcttcaaactttcaacttttccatcacatcaaaactttcctacacacacaaacttccaatttttccgtcatatcgttccaatttcaaccatgaagttgcatttatccttctagtgggttttggtgattaatgatgaataaggttaagggactaatgtgtttattgagatactcaggtaattagtcccgaggtgatcttaggtgatcaagaaatgcttggagaccccccctacaaacttcatttatgcggatttgaagctcgaaggtcaataagatagtttattttttgaaatcgagttttaggaaaatccgtactattaagaggggttccaagtggggttctgagatataaaaagtgatcttagtgggttcctaatgatagaatatttttgggagccatttttgcaaatgggtccagaccggacagagaaggctggctggaagttccgttctctggacctggaacttccggaccctgcactggatgaattttgcctaagtgttggccggaagttccgagggtcaggaacttccggacttcctccagttcaaaaatgtgagtaacggcgaggtgacgtcacctagccgttatatatatccagatcgcacccagctcaccttttggctattccactttagttttttcatcccctacggttgttctagcctctcccaagatcccttggctttctccactcaaaatttagagcatttcttgtgagattgtgagaatagatgagagtgtaggagtgatttggagaagctttgaagactaggtgtggttgagcactttggatatcttgtgggctatcacttggggcttattactcttggagatcttctcctagatggataggtgtcgcccgcgagcttctaaaatcttgtggatgtcccgggaaagtttgtgaaggttttcctcacctccacaaggaaacgaggtaagtgattaaggattcttgtgctgagtttttagaggttctcctagttagagcaacttgcacttgtggtcttttctagaaggatttgtgagttggatcttggtgatcactcaaattctagaaaatgacctaggagtgttgaattgaaagccttggacttcttctgggttctttgcacaagtaaggcaaggggttaattgagatccggctctttggagcacctcaatggagagtaggatttcaagatctgaacttcggtaaaaaatagcccttgtcttttctgtgataattctgtgcacgatgctgtgattgtgtatctgctctgttttcctatagtttatttcgtgcaatttagtttaagtgtctgctagggttacaggtttttttgttgctcggaagttccgatgtttagaacttcggaagttccggacagtctgagcagatcggaagttccggtgttccacacccggaagttctggtcctgctgaattttatcgctgcgatttgtttgtgaatttcaggaaagcctattcacccccctctaggctacatctttgcgcgttcaaaccaaacttccaattttggtgtgaactaaacacagcctaaacacaagcccctgttggatttagattatttaagtaaattattatcatgattatctacttgactttagggataaattgaatattctttttttttaaaaaataaatagattaaaataactaataagtggttcaagtaatacaataaaaacaacattgtgagaaaatgtattttctgaagcgcagagaatccatttcaataatccaatgaataatttaagagaacattttataaaactatggatactttaactaaactattaaaaaaatagatttaagatgttgtatcaaaagactatagatttaacatcagtttatcattaaattatagatttatagctaagtatcataaaactacagatttaatgttgaagttatcacaaaactatagttttttttagtttaaatctcttgtagtaccgttatattgaagtataaacgttatagttttgtgattaaattaacattaaatatatagttttatgataaatttggtattcaatttgtagttttgtggcacttaatcataaataagtaattttgtgataaaaatggcgttaattctgtagtttcatgatggaacatattaaatctataattttgttatagtttgattgaaatatatgtactcttaatgaaaagaacgagacttaaggctgtgttcggcctgttcccaactcatctccctcgtgttcgcactctttttaaattactgaacggtgtgttttttttaaaaagtttatacacgaaagttgcttaaaaatcatattgatctatttttttaaaaaatagctaatatttaattaatcacgtataaaagactgttccgttttctgtacgtagagatgtgtttccaacctacaacaacgaacacagatatagtaactagtacacttttaccgtttagaagttaattttaaactttttcttaaaacttcacgctgatttagcacaagaaaacaaattctacactgcatctacacatctagtacactcagtgacagagggttggtttagtttgtggtctaaataggccttactaaattttgtcagtgccaaattttggcaagttttggcatgactaattttggtaaggtaaagttgtgtttggattgaagtcaaaatagcctaagttcactattgaaatgacctattttcttaggtatgccaaaatttgccttcaaaccaaataaacactaaacagtattaaaattaccaaatattggtaagtctaatttaggcatcaaaccaaaccagcccacagttttggtgatgcttcattgaagggggccaggccgccaggtactccagtacacagtcgcacaaagggcggccatgggcgtttcggggattccagatggagatgacaggagaaaggaaaaaatcactccacttcagccagccaggatatcatcaactgtttagataaaattacgtggaggagaggtaaaaaaaaatcaaaggtgttagctctcacgcaaaagctaacttaacacaagctccaagacaaaaataataaatgtataagtgagagatagagataggagaagaaaaattgtagccaaacttataactaatctattatatgtgttagctttaagatgggctaatactccctccgtttcaaaatgtttgacaccattaactttttagcacatgtttgaccgttcgtcttattcaaaaacttttgtgagatatgtaaaattatatgcctacataaaaatatatttaacaatgaatcaaatgataggaaaagaattaataattaattaaattttttgaataagacgaaaagttaaacatgtgataaaaagtcaatagcgtcaaacgttttaaaacggagggagcagttgatagtgacctctactattatccttgctcttactggagttccttgaaatcttttactactactccagctatgctagtactctcagggtgagtttgaggagagggggattgagaagattgggaaatacgcaaaacgagatgagccattagcacataattaattgagtattaactattttaaattttaaaaatagattaatataattttttaaagcaactttcctatagaaaatttttgcaaaaaatacaccgtttagtagtttgggaagcgtgcgcgtggaatacgatgtccttttctcacccaatcccccagaaactcatcacaacgaacgcagccctagtctcctactagggacgccagccagagggctattgctagctccatgcaagatgatgattgctacctacaatggctacaaccccaaattcacccaaaaggatatcgttgccgatgaagcacttgtggtaaacaaacaccaatggatcgatgcgtgtggaaatatatatatattttaaaaaaaatcagattatgctgcggcatcataacggtcagtagtagtaggaggaggaggaggaggaggagtagggcctattcactttgatgccattttcaaccatatcatttttagtaagttgctaaaaaaatatctatgtttagtttgttgtcaaatttggtcaatacataagaaatcttgctaaaattttaacaatattgctatcttgctaaaaatttagcattgccaaaacttggtaaagtttattttgactacaatctgaacaggcccgtagtatcatgtggacttgaataaaatgaaagaggcaaacatggcaataatactcccttcaattagaaatatttggtattcaagaagaaaattcgggtaaactattgcaactttgatcataccttatataccataagtaaatttaaaaaattatacgtagtatgaggcaataatactatctcttgacactgttgtagtgcacctagcgacacgaaacgttaattattgaatgtaagtgttgttgtaaatgctttcaagggaaatctatgtatactctttttctagtatggccttgagatctgcctctctgtcgattgggcagtgagtggcgggaaaataagcaattctttttctccaatacctttcctctgctcccctccatctttggtagccaccacctacacgacgtgggggtgggggggtgtgtttttgcggaattattatgttatcattgggtttgtcttattgtatgctgactttatcccgtacgagtagttattttctttatagatcaaatgaaatgctaacgtccgtcttctttgtcctgatgctacctttcatgtccatattaagctttgaatcagcgggaccttgcttcaccttatcttgtctggatgattgctgtgggttcttcggctcttcgctattgttaatgtgcaagatctaccctatgatgtgaggttttctcccttcacaatgacaaggtggtgatgaccatccatatccacttcggcgagtttgctgtttctaacttggtgcctttttttcctttgacggagcatcttcaaggttaaactgacatttctcttttcatcaggtcagcttcaacctccacttttgagaatcccctgttgggggtttgtggttaggtactaccttctctagtgaacctcactttcaccatcgtcaccgtcggctttatcatcttggtcaacggatcataagaagagaatcatattaggggttggattgcctcttcattttattttggaaccctttctaacttatcttaaggatctcaatgtaatttgccattctctgaggccggtcctattgtagattatgctgaatgtctacattctttcctactctggccaacattaggctctctcgttttttttgggtgaaagcggcaaggctctcttttttttttctcaccagaattgtgttcattaacttcctgtattggataaatacatgggtcttaatttttttcaaaagtttaactgagttttttaactttaaatatttataacgggaggaaatactactagctagtgtagaacgattatcaattgcaggattagaaaggtatactaaaagtacagacagaatgtgaaatccatcatcaaacctaacagaatcccacatccatttctaggaaagagagtatcagaacctgtaaaaatcaccaccgataaaaaaagaaaaaaaaatatgccgattggatttgtaaaatagcaacggaatggaatcatttagatcgcaggaaagagaaagagacacaccaatgaacggagtgccagggagcaagtggggacatttgggcacgatttaggcagacatttttgacccccgaaaaggcaaaagatgcccccaaaaaggttaatgcgaattttaatgacgttttaagcaccgattattacatcgcccagagaaagagagatggtgtacgtggcgccgcacatgtccaaaatctccaacattaaggaccggtttggtttgaaacctaaattggacttaccaatatttggcaatttcaacagtgtttagtgtctatttggtttgaaaccaaattttgacatgcctaagaaaatagaccatttcaatagttaacttgggctattttggtttcaatccaaacacaactttgccttgccaaaattagctatgccaaaacttgccaaaatttggcatcgacaaaaaatggtaaggccaatttaggtcacaaactaaaccagccctaaattttcaaaaaggctccaattaattttcagtattccaatgttgaggtataaaaaagatgacaccaacaacattgcgtatagttaaatctcaaaatcttttatcattaataaagtaaagaattattatgatttaatatatgaaaatgacattagtagatttataaactttataactgtataattaaaaaataataatgcattggagattatgtcaatattcaaaacaacaactaaatattccctccgtttcaaaatgtttgacaccgttgactttttagtacgtgtttgaccattcgtcttattcaaaaaatttaagtaattatttattctttttatatcatttgattcattgttaaatatacttttatgtatacatatagttttacatatttcacaaattttttttgaataagacgaatggtcaaacatgtgttaaaaagtcaacggtgtcaaatattttgaaacggatggagtaagaattaaaatacttcctcagtttcataatataatttcagaatttcttcacctcgttcatctcaacaaattacaacacctcgtttcttacacacatacggtctcatttcaaccattctctaattatttccatctagttacttaaatcacagcgtaaatccccatttcgagacagaggtggttagtatacataaaaaaatattgtaaaaggacgaacctttgctaggaacaaatacaaaagggacgaactgtactgctatacaaaagggagtaggcggtgtatttgaagtttgcgccatttgaatctccaatagcagaaacaaccataatttgaaaacaccaaaaatctgttgctcagtgcaagacagctcttctctttcaagtttcaaggcagtaccctgaccacggatggttaatcacttaattagtctctgtctgttcccctgtattgaatactacaagtatcctcaattagtagcactactactgtgttgtttgcttattggcttatgagctgtatccaaaatatggatactcatctcgacttttttttttaaccatcttcaatttttcagtcttagattttaaactgctaaaggtaggaatataaaaatcctactctaacattacctcgtttatttttctagaccaattaatatgaaaaacaatccccagctgtttcccatcagagtcatcagcttttaattttgcacctgccgtttaagcagcagcattcaggattgagctaagctaaaccgtcgtcgtggtggagacgtttttgtgaggaatcaaagcggcatgcatgcagcatcatccctggcagcatgacacaggagaaataaagagactttgatgtcattagttgactgtcgttatcaacaaaacaaaacaaaacacaaacacaaccttgaatgcttttctttgctcctttttccctttctctctctgatttgtactacatgtacatgtactactactactacaagtactacttcaagacgttgaactgaacaaacaagccaaaacaaacagcaggagacagcaccggccagccagattcactctcttaagtctctcatgtacttgtgccagtgtgccactgctcattgccccatcgtttagcatatcggacgaaaaaaaattaaacgacatatttacacacaaaaaataatttatgaataaaactttaatatacatgttcttaatgatataaaagcaaaggttaaaaaataaactatgatgaatttttttttaaaaataaactctaaatttaaggtttaaaatttaaattttagctaataaacattagcatatataaaccaaaagatgaggctgtgacattgtagcagcagtaataaagggaagaggagtagttgtattgtatgcagagaacataaagctggccagtggaactgagcaagtgtggaagatgcaggcagagatatctccagatctcttcattatttatttttctcttgttttgatatcttcttctactcggaccaaaattatgaggaggcaggcgaagaaatagtgtattagcctggatgagatgatgatgctgaactaagtcactgtttagattttaacttttttcttcaaactttcaactttttcgtcgcatcgttccaattttttcaaacttctaattttgatgtggaactaaatgctgttgagattatagacatataatgatttaatctattccataaataaatcatgacattacagatgaaaactagcatgaacgcatcattagatctacacatgtaaactacacagtataacatgaacagatcaaatatgcgcaatatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaagacagaggttctggagacctgctctcccgatcgctggtgcacgccggcgagcgggatggagtagtctacgagcgacggcgcagtacagagtaggaggcaaaccctagattgatttttcgtgtgctgcgtgaagacggcaggtcggtttatatagagaagggtcgcttgatcagggcgcccgcacgatctctactgcgcgtaaccgaaccggataagtcgcgcgtaacttatccggactccacgccgtttgcacgcaccggatttttcggaacgtttccaaaacaaaaacgaatccgaatttgcagcaaaacaaaactgtaaaaggaggctgcatctgcgcaagggtgaggagccaatttttcggaccattcgacgcgtacgtcgtgcacgcgcgccgcctgccctgccctgccaggcgaggcgaggcgaggcgagcgagcgcgcgcgtgtgtttcccctcttctctccaccacacatgcttcaagtgactaggagggcatcctcccttttaataaggtccccctctcctagaataagcaaggtggtactaaactccacatgcatgccatcccatgaggtgggcttttgtgattttccaaagaattaatcttcgagtgggctaaggcccattcattaattccaacaatcccccaccaaatctcaaaatcccactgagatttgccttttccaatgtattgtttatataccagcggttcgatggagaccaattaaggttgaacatccacctagaattccaagctacacttactcacaacttgaacaatggactacgccttgaattgcaagtcttgtgcaagcaagtttcactcaaagtcttatctggtactagaccgtctgtagactacccctcgggtggagcgtataagtcatactcctaggtctttagtaagcttcctagaagattcacccaaaatcttcatagactgcgaccaacagtcaagctcacaaaggtgagttctttcaagaatgctatgcaggacaacatctttgctaattaaagtcaacagaactcattaaggcatagccaacctgccttgcagctcacgagagtacatgcatcttcacttggagagggtatatatattgatactctcctctagtttactaatggtttgttcttcccaggatctaattcacgggatctccgatcacatagactgggttaccaccatagtataactcatatgggtctcaaacccatctccttcgatgcattgtctatcacatttcgtgatagtcccttcgtgaagggatctgccaggtttctcgctgtttggatgtaatccaacgttataactccggagtttcttaatttcctgacagacttcaatcgtcttttcacatgtctagacgatttcatattatccttagaactattcactttgacaattaccgtttgattgtcacagttcataaggatagccggcaccggtttttcaacaacaggcagatccattaatagatcacgcagccattctgcctcaacagtagcagtatccagtgccgttagctctgcttccatggttgacctcgtcaaaatggtctgtttgcaagacctccatgaaacagcaccaccacccagtgtgaaaacatatccactagtggctttgatctcatccacatcagagatccagttagaatcactataaccctccagtaccgcaggatacccagtatagtgaagccccaattccacagtacctttcagatagcgcattactcgctcaagcgcacgccagtgatcatctcccggattagaggtaaatcggctcaacttgctcacagcaaaggagatatcaggcctagttgcactagccaggtacatcaacgagccaatgatttgggagtattccagttgattcctagcaattctcttgttcttgcgaagcaacaagctaggatcataaggtgttggagaaggcttactatcaatgtagccaaagcgattcaagatcttctccacataatgggactgcaagagtgtaatcccattctcacctctaattagcttaatgtttaagataacatcagctactcccaaatccttcatatcaaaattttgagacaagaatgatttaacctcatttatcacctcaaggtttgtcccaaatatcagtatgtcgtcaacatacaagcacaaaataactccctcacccccaccatggcgatagtacacacatttatctgcctcattgactgcaaagcctgcagatgtcaatgttttgtcaaatttctcatgccattgcttaggagcttgttttagaccatacaaagacttcaacaatttgcacactttgcgttcttgaccttcaactacaaacccatcaggttgatccatatagatctcctcatccagctctccattaagaaaagctgtcttaacgtccatttgatgaacgagaagaccatgtgaggctgctagggaaagtagcacacgaattgtggtcaatctagcaacaggtgagtaagtgtcaaagaaatcttcgccttctttctgagtatagcccttagcaacaagccgagccttgtacttttcaatagtaccgtcaggcctaagcttcttcttgaacacccacttgcaccccacaggtttacacccatagggtcgctctatcacctcccaagtcccgttagcgataatggaatccatttcactacggacagcctccttccagtagtctgcatcaggagatgcatatgcttctgaaattgacttaggagtgtcatccacgaggtacacagtgaaatcatcaccaaaagacttagccgtcctttgtctcttactccttcgaggagcttcactgacatcctcctcagagacaagttcatgtgtatgttcagtttgttctggtggtgtgattgaactgggaattatttcaaatggttggttcgaaccactatgtgtatccttcattgggaaaaagctctcaaagaagatagcatcacgagactccataattgtaccaacatgcatgtccggtacctcggatttaactattaaaaatctataggcaatgctatgatgagcatatcccagaaaaacacagtccacagtcttaggtccaagtttgcgcttcttcgttattggtacattgactttcgccaagcacccccatgtgcgcaaataagaaagtgatggttttctaccaatccatatctcatatggtgttttgtccttatttctgttaggaactctgtttaacacatgatttgaggtcaacaatgcctccccccaccatgccttaggcagtcccgcggtgtccaacatggcattcaccaagtcagtcagtgtgcgattcttcctttcagcaatcccattagactcgggagaatagggaggcgtcatctcatatatgatgccatgttcctcacagaataagtcaaactcgttcgagaaaaactctccaccacgatcagacctaagcctttttatctttctgtcaagttgattttcaacttctgccttataaattttaaaatagtctagagcctcgtctttcgttttcaacaagtacacatagcaaaatctagtagcatcatcaatgaatgtcatgaaatatcgttttccacccttcgtcaacaccccattcatttcacaaagatctgaatgtaggagttctagtggtgccaagtttctctcctcggcagccttgtgaggcttgcgaggttgctttgattgcacacaactatggcacttagaacctttgacaatggaaaacttaggaattaaacacatgctggaaagccgagacatcaagccaaaattaatatgacataaacgtgaatgccaaacattagcctcatcatccacactgccacaaatatggttcacagacttattgcagaaatcagaaagggaaaagcggaacagtcctccgcactcataacctttaccaataaaatatccatgtttagacacgactactttattagactcaaaaaccaacttaaatccgtctctagtcagacgggagccactaacaagattcctgtcgatagaagggacatgctgcacgttcttcagctgcacgatctttcccgaagtaaacttcagatctaccgtgccaacaccatgaacagaagcatgtgacccattccccattaggacggtggaaccccgtgcgacctgataagaagaaaacaatgagatgtcagcacaaacatgtacattggccccagtatcaacccaccaattagtagattgattaactgaaaaaacagtaggtaaattaccatacccgcttccatctccagtgttgccaatggtcacattagcagacttagaagtttgccctgcaggtgccttcatccccttgcgctgtggacacttcctagccagatgaccaacttggccacacacaaagcaagtcctctcatcctgattaggattgttgttgttcttcttctgcttcttgaagttggtggtctgctgagctttgtatttccccttgctcttgttctgggccttgtgcacaacattggcactggactgcccaccatcgcccttagacgcggcatctttttcccgagctttctcctcaacatcaagagacgcaatcaacccctcaacggagtattcctgtctcttgtgtttgagtgcagtaccgaaactcctccaagatggaggtagttttgcaataatgcacccggccacaaatttgtcgggtaagacacacttaaggagttcgagttccttagccatggtttgtatctcatgagcctgttcgactacagaacggttgtcagccattttgtagtcatgaaactgctccatgatatacagatcattgctaccatcagtagcaccgaatttagtattcagtgcatcccacaactccttagcgtcggtcatatgcatatacacctcgaccagacgattgccaagaacgctaagaatgcatcccacaaagagagtagtggcttcctcgaattgcttctgctgttcagcagtaagaactccttcaggtttgccagtactcacccagaagcatttcatagctgtcagccacagagtgaccctgatctgccatctcttaaaatgcacaccggtgaatttatccggcctcagtgcatcggcaaaactagccatagtaaaatcacagtgcctataataaggtttttggattgttgagattatagacatataatgatttaatctattccataaataaatcatgacattacagatgaaaactagcatgaacgcatcattagatctacacatgtaaactacacagtataacatgaacagatcaaatatgcgcaacatattgaacacgtaccgaggtgacgaaaagaccggctgcttggtcgaaacttttcgcaggtgtctacgaaggcacgaaacacgcgagcgaagaggaaggcgagccgtcgcgaacgaacagggagcagtcgcgcgaagcgcttcccaaaaaccttattgccgccttctcccggtgcaggacgtcaaagacagaggttccggagacctgctctcccgatcgctggtgcacgccggcgagcgggatggagtagtctacgagcgacggcgcagtacagagtaggaggcaaaccctagattgatttttcgtgtgctgcgtgaagacggcaggtcgggactccacgccgtttgcacgcaccggatttttcggaacgttgggatggagtagtctacgagcgacggcgcaatacagagtaggaggcaaaccctagattgatttttcgtgtgctgggtgaagacggcaggtcgggactccacgccgtttgcacgccacgggatttttcggaacgtttccaaaacaaaaacgaatccgaatttgcagcaaaacaaaactgcaaaaggaggttgcatctgtgctagggtgaggagccattttttcggaccattcgacgcgtacgttgtgcacgcgcgccgcctgccctgccaggcgaggcgagcgagcgcgcacgtgtgtttcccttcttctctccaccacacatgcttcaagtgactagaaaggcatcctcccttttaataaggtccccatctcctagaataagcaaggtggtactaaactccacatgcatgccatcccatgaggtgggcttttgtgattttccaaagaattaatcttcgagtgggctaaggcccattcattaattccaacaaatgcagcctaactttaaatgtgaagggtagtacagcgtagtcaaaactctgcaatttttctcccaacctttttgtcagtgattagttgatccatgtggactgctcgtacacacgcgttgcttgactgtttcgatcaaaagcaagaaaaactaaaaaaaaaaaaatctaccgcataggagtagtgcttgagtcttgatgaccttcagagttcagaactgtggaaagtgattaatttgtcattcgtggcagtagtaagtttcagggttcctgaatcctgaatcctgaatcctgaatggccatggcacgaggcgataaaaggaaggagacgagcagatgagatgcgagcaatgcaagcattgcaaatgcagtgatacaaatgccatttatactactattgttcttgttccagtttcatccagctaagtactagctatatcatctgctcgacctatctgctcacgcatcatgtagcagcagcagcagaagaagatgcagaagcagcaagcaaccaaacagttgttgtttgtgatggcactgtactcctcctgctgctgcaaaccggcctaatttctgaatcatcctgtagtaggagtagtatggtttcaggggggccaaagattgggttttccggcagggcacgaactcagggagaatttcccaaatctgtttccgctagctgcgcatatacagatacagtagtacatgacaagccaccggtttggctacatcggttgtattcatttttggtttgcacatgaaatgtttttggttgagttgcattgcatcatgggcaagtaagccggcttcatccatttggtgtggagatgctttgtaacagtactccactatgcaaaatttgcgactccatgggggtaaaaatagtcatccttactatacgtttaacggcggtgtatgagaattataagatggaaagagaaaactggacagacggttaaaacaattatttcggttgcgctaaccaatacccttcgctctaacaataattaacctatgaggatgaatccagacaagtacttatctagtttcgtcgtaaaaacttgagacggagggaattgagtttaggactcgtttagaacggagaaattttgtacgactcaaaaaggttaaacaggttatttgtaaaagtcatgtgaaattcccatgtttgaaagaaactaaatttgaattttcttggcaataaagtgtgtcgataaacggggggcaatgtgatcaatgtgatcatggtttgtgcctagaggaggggaatcaacgaaaaggacagcagtcacagcagtgagagccagggaagagggagcggccaccggctgatataagacaaaagtattttttggcgaataaagatggggagttattactccactaaaaagttactagtcgtagtaaccgcaattttgaccggagaaaaagatgaaaaaaaaaagaaagaaaaggctatgtactccgtaccaaatgtgtgccgcttttagaaacagcaccctactattttcctttattatttttatgtttttgaccatcttttcttcaagcagtaagtacatgtccacttcatgatctcacttttcctttttttttctccctttaattcaacagagatggccgttacactaaattacaatttacagtaccagtaccagattggtttgttacagtaagaatcttttactttacactgaggtagtagcagcagatattttcagaactattttcatgcatgcccttcaattatatacttttattacttatactgatataatgtagtacttgtttttacatggaaaagtgaaactagattgggtagcccacagcaaaaggcactgtaaacatttgcataaatctgtctggtcggattggaccctccatccatgcatccgggttttaccatccgggggtaaaagggttaaaactagaacaaaaagtttggggggcaggggtgctatggtaaaaaaaaaacacagaaaagctgtgcggtttcctttgcaaattcttgctccgaccttcgtcacgtcactgcaaaaaatacctcttttgacaatttcatccatcacccctttctcttcttttttcacttgtctattctgttccctcgctcgcattttaaatggaaaaaaaataagaaagacaacattttcttatcttgataagggctcctttagatcgaaggattttcggagcacacagatattattttttatattgttggtttttagatcgcgggtaagcatgatctgatgaatatgtgcatttttttttcacaagtgagatgtgagatgaaaagatggtagaaaaattgttgttctgatagtttttttggggagaatatagcttagatgaaaagatggtacacgtaaggtttgaagtagaagttaggagatgtttacattttcttcttggggatagaacataatatttcttaaagaattaaatggagcatgaccctaaggtcttgccaatatatgtagtctttggaattccctattgtgtgtttcttaaggtgcacgtgttatttgaatgttggtgtactgtttggtttaaaacataatctatgttcgttaaggaagtagtatttctggctatgcacctagacgagtgttgtccacgtgcatagctagaaatacactatttagaacaaaggcagtatgaagaaaataaacaattaaaatatattttccaatcgtgttgtgtcaattatttgtacatgtcgttggccttttgtgagtgattactaaatcgataagaaaacaagtgaataataaataggccacgactattaccgtgttattgttttgattacatatctgccacatgaccatcctttgctagccctggtacaaaattggtattccatcgatgaattatccaactactcataacaattaaggaaaacatttagttacagttccaacctttacgagtagaacatgtccgatcaatacgctgactactctagttatttaaaatatattatccgctaggagacattaatatcttctttgtacgtacttgatgctgaccttcgggtatatgttaccgaatccactaaaagcctagtgaacgacaaatcacatccgttaccatattattgtttggatcatataattgtcgcacgattatcctttttggctctagtgcaaatttggtattatatagaccgtttcacctatctaacggcttacaatatttaagggacacatttagttacaatcgaaacccctacgagttatttaaagtatattatctgctcaagagcattaatgtcttgtttgttcgtactcgacgctaacctttgggggtacgttacagaatcgactaaaagccaagtaaacgacaaagccgcagccattaccgtattattgtttggatcacataaccgtcacacgattatccttgactggctctggtactaaattggcattatatggactgtttcacctatctaactaatcataatatcaagaaacatatttagtggcaattctaacctatacgagttgtttaaagtatattatccactcaagggcattaatgtctttgtttgtacgtattcaacgctgaccttcagggctacattacaaaatcgattgaaagcctatgaaacgacaaagccacgacagttaccgtattattgtttagatcacgtaaccgtcgtacgattatccttggctagatccggcacaaaattggcattaatatcgaccgtttcacttatccaaatagaaaagaaaacatttaagaaacacatgcagatatttttccaacctttccaactacaaccaatatgatcaacgagcggtgacactctctccaaacaaaaaccagcgacacttttgctcaaccggttagccctaaccaaagcgcataagtggtccccggtcctcgcgctagttttacccgtacaaatcttgactatacaaatcttctttgatcttcaaactaagattcatggccacatagagatgctaacaacaagatgaggaggagtgatggatggagttggaatgatgatagatgcaatgtggtctagtgtggtcacaatgaggaaaatgttgggtgtgaggatggtgtggggggtgcacatagggacaagggagttctggtgggtttgtcaaggctgcaagggacagagttccacccctgatagtggttgggttggagtcccaaacccacacgagcggcctctgaaacccaaaaaaaaaaaaagattcataaaaacaccccaagagaagaacagagatagaaatgaaaagaacacaagacaggaacaacaccatctctcttttccaacccttttgccatcgtcctcaaagtaagtgaaacccctccccacacaaaaaccaaatcctctcacatgaagataaaaaagaagaaccaccctaaccaaaccaaaacaattcagttcagagagagagagataagcacaatacagatagacataaatagagatatacacaaagattgttttttctttcaacaataaaaaaaactctacttttcttttaaggaggcctgtggcatttatgcatttctgttttgtttttgttggttgggagagtcgaagccaaagcccccctctcctctcttattcctatattagccccccctaccccattttgccgttcgctgcagaagcaacaacaccaacaaagctatagctgtctctttccttgcatctcctctcctcttctcttctcttatataggccaccgcgaggtcggtctccatccatccatccattccagcatttcttgaagcttgctgtggatcagagaggatggctcacgagatgatgggtggcttcttcggccatccgccgccgccgcctgcgacggcggcggtgggtgaggaggaggacgaggtggtggaggagacggaggagggtggccatggcggaggagttcaggggaagctttgcgcgaggggacactggcggccggcggaggacgccaagctcaaggacctcgtcgcgcagtacggcccccagaactggaacctcatcgccgagaagctcgacggcagatcaggtaagagctcctccatggcggtgggtgcaatgcccaagaacgacgcgcattgaaggtgtttgtgatgggatggcatggcagggaagagctgcaggctgaggtggttcaaccagctggacccgaggattaaccggagggcgttcacggaggaggaggaggagcggctcatggcggcgcaccgggcgtacggcaacaagtgggcgctcatcgcccgcctcttccccggccgcaccgacaacgccgtcaagaaccactggcacgtcctcatggcgcgccgccaccgcgagcagtccggcgccttccgccgccgcaagccttcctcctcctccgcctcccccgcccccgcccccgcgccgccgccgccgccgcagcccgtcgtcgcgctccaccaccaccaccaccggtactcgcagcagtacagcgggtacagcggcgccgccgagtccgacgagtcggcctccacctgcaccaccgacctctccctcagctccggcagcgccgcggccgccgccgccgccgccgcggcggcgaacatcccctgctgcttctaccagagcacgccgcgcgcctcttcctcttccaccgccgcgtgccgcgcgcctcgcgtcgcggcggcggctgacacggtggcgttcttccccggtgcaggctacgacttcgccgccgccccgcacgccatggctcccgcggcggcgtccacgttcgcgccgagcgcgcgctccgccttctccgccccggcgggccgcggcgagccccccggcgccgtcgaccagcgcggcggcgcccaagccaccaccgacagccacaccatccccttcttcgacttcctcggcgtcggcgcgacatgattaccggcgacgtcctccggtggtggtggtgtacaggaaggaaggaaggaaggaagcagccaagatcaagcgatcaaaaccaagctaaggttagagttagccaagaacaagactaggacgaggaggaggaggaggaacaagacgtgctcgaagctcatcaatggcgttctcaaccaaacaagttttttctgctgctgctgctgctgcaagctagcttagattattcagatgaagaacaataagaagaagatgtagtactagtaaactagtaatggtgtgtgcgtttggaaatcaacaagcttccatgccatgccatgcctcctctgttcatcgatttcttttttttatctctctcctctgtatgaacaagtagaagaagaagaagaacaaattaatccattgctctcgcagatggatcagcaacatcaagcattgccgcattgtctctctctttgtgttcattgtccatgacgccaaagagaaaagaagaaaaattttcattgctctgttcttgaaatcgatcgatctctcttgttgcagtgatcatcaacaagaatagctcttgttttggcatcgaatcggctcatgtcatgttcatcgtccatctatctacctaggaagattggtcatttagtcacctaaaaacaagatatgtcattttcctctctccttaaaccttctcttgatagccacaagaagaaacccatgaagaaaaaaaaaacaaaaaaaaagaagcaatcaatttttttcttttcacatctctatctctctatgatggtttatcttgtcctcttccaagctactatcaaacgaaactgctgttgcgaaacgccgcgactttgctttgctgcttttgctccaggttagttaagtcactgaactttttttgtgtgtgtgtgtgtgtttgtgcgagctctgatgatgttgatgatgatgacgatgtttgttactattccagcttgatttgctgcatttggggtctccttcgccgaccattctctgtagcaaaaaaatgttcagagctactccttgctcagtggtcactggtcgtgatatgcagtagtaaaccattgtctgaatctgaatgaacagcagcagggattgccaagaagcgaccgtgctgcaggctcgcattgatcagtttcatcagatgtaggaaaaacaaaataaactggtccagtttgactggagtgcttgctgttgagaatctacagaatgtgtcagcatatgtgaacatatgttaatcctgaaaattgggctgctgatagattcagattagcagcctgatggtctgcttgagttagtcgtgttcaagttcaatcagcgagtaagttggggactgggtcagggtccaaggtaacaggccccagtttttattatgcctgagttagctgactctgcatatgactgatctgaagataagtttgggtttttctgttaactgaacttactatgtgtgtagaacagtaattaaatccgttttgtccgattgggattaatctgatgaactgggtcatattcaacggccatgtcaaagatggttactgtcagcaaaactaacagcatgtaaatgtttcattcatatcctgatttatgatgttttcacctacctgtactctgtttttcaacaatagaactcccaccgtcctacagatttaggtggaatgtaacatatcctaatactatgaatctggacatgaagcttatccagatttatagtactaaaatgtatcacatccaaccaaaatcccttatattttgggacggagtgagtactacaaaggtgtttacctgaagagaagaattattagagcttaaaacagaactataattagttagggcttgcttgtttcatcggacacagtagttgtactgatttttgtttgtttggttaaatagggtaggcatcattctggcatcaggagttatgccatgctatatgtgtgctgcttggaacagagtagcctctgcttttgctttaacttttttttatagttttgcttacgtgagttaaataggtgcctggaggtttatctttctgataagaaagacatcaagttgttaagagaaaaaggctacaaataggttctggaataaaatcctgcagagaacttataattacatagtaggaaattatgacccttttgaataacacagctcttgattactgtaaccagttgttgtaatcaagttaggctacagccagttattacaggacttgcaatatcgtgaggttacctctttggttacactgtaaccctctcgatttttatcggtaacctctccgttttaatttatgtggttaccattataaccgtgacatcactggctagcgatgaccccctcctgaaacagtaagagaaaccctacttaaccaattgcttctaataatatgttgctcttcttgtttagttatattagaaaaaaacagtcatatatttgggaagggggatggggtggggttaatatttatttggataagacaaacagaaacggaagggtaaaaaagtgactatacaaatgtccaactaagacaaaattggttatatagcaacaaaagtttatgttttttggctaaaggactcatgtttatagaatcaaagaagaaaacggtagctaacctaacttaaatttagtaaaaagttgcgaacgctaaaataatttgcatttagagagtataacggtgacaacccgatagatgtttttaaccagtcaatctcaattaattaatcgcattagcacttcatggcaccactaacatttaactactatctaatcaagcttccactacaattttggcacatgcacctaaaaatcacatgtccaaatattgcatgaatcactgcacattagttaaagaagtaaaaaaaaaataaaatcttgtttcaccccctccaaatttcaacattctctctttggtgtaacaaaaatttcaatcttcaacaaacgaataaaatcatacaaatggatgcctctccacacaaggaatatctccttacctaatgcaaatcttttaccttgtttcttgctacaaggaaaaacaaaaacaagagagattacaacaggttaaaaatgtgacgtcaatgtcaggaaattttaaatttttttttggagcaatgcgtccacctccccgtgcagagtgcaccgacgacggaaattagctgtggactatgatgtttcgatgtatgcacgcgtggacaacttggcagtgctgacatcgcctcgtttgatctcttctctcagcttgcaataaatttgtactaccatttgggctttggctagctgccatgtcatttgatcgattttctctgctagatcggtgatagttacatatatggtttatatatttgctttggttcgtcggtagcagacaatcgataggagatgcacttgatagtgcattgacaagggatgtacaattttaatcttaaaggtactgtgttcaattcccactacgctcacaatttcttctgaaaaaaaatgtttggatggatgtttctctattcaaatctcgtttttttaaggagataatcgacagtgatactgatatgtatttttaggttaattgtccatgaaatttacgctataaccagtatatgtatttttttccgccgtaatgaaatgaagagagggtagcttgggggtttccccgaaagtggttatttcagttgtggactggctcaactttgattaattaatctaaggttaatatatataagtagttttaaaagctgacagaagaatcttgcaatttatattctatcgaggtagttgggaactgtcacatggaacgcatgtagcaacaagtgtgctgctactttgttgctatacggcagctgatgagtcattcgacatatgcaaacattgttaattaattccattcaaagtacagatattctctcttcaaagcacacgcacaggattaaaaaaattaaaagattgagatttaattaatcccaagcatagttaacgttttctaggtttctcaacatgatcgatcagtccatttcatggtagttgttgaaagatttggttgacttgaattaatcgtcggcacctgcaattcttcaagtactatatattatgcaaagcacaggcatattttggcagttgaaatgatggaattgaagcatcatttctatctattctggtatatatatacgacaaggtctaatccacacgtacgcaacgagttagttagcagttggtgacgcgtgttgtgctgatcaattcatggattaattaatattatgaccggatgaggattatggtgatcaagagagggttggttaagaaaaagaataattgtcataggttgttttcatatgtttgcatgcattgatcgggtttatatcaatcactcaattcgtggcgcgatgctgtgcttcaacgaacttaatttgtagtaatcaattgataatagacctaggattgaagttaatcaacctaattgttttaaggtgagtgtggacgatggatgaaactaaatttatgacaactatctgaggttcgaatgaataaattaaatgttagaaaattgagaaaaccgaatttacgccaagtaagtttgtaccttctccattattgtaaaaagctcaaacacaaaacaaaagtcaaattgtagtatcaaagatatgctctatccctccgttcataaatataaatatctgtacgtacgttatttagcaaagattaaggggatatattcccttccaataatcacatcagtgatcacattttgaattacatatggattcccctcctaagcacttcatcggttgaaaatgctttccatccccatgcaataaaaatttgtgtatcagaaatacttatatattatatgtacaccgatgattatatctagaaatgaagatattaattatattggcccattccctaaaaaccctaacagccgtgttcgtcgttgctgcttgcagggaacaacaagaacaacgtaccgtgcgtgtacgtgacaaggaaacaattagaacaataacaatgacatcgtcgacggttaggggatcggatcctcacgcgtatggcgcccggggagcgagatgcatgccagcaaatgcgaggcagccaggctgtgtgggggagaggggagcagctaactagctactacctccgtttccaaaataagcttatttttcactcgtcccacatatacatatgacactacatattactccctccattccaaattgatctacatatagtttttttttgaggttatttctaaatgatctacatatttgtgttcattcattaagtctattcgttatttgtgcatttgagtaaatggacattgatgcatgcatccatgcacacaagtatttataacccacatgcaatatcttgatttgctattggctaggagatagtggggatggtgcatgcatcgagtttgttgctagagtaaatatagtatgagagagttattagcttttcttggtcttgctgtacctatgaaatatgtagatcaatttagaatggagagagtaatattaatacaaaactaaaaaaagctatatactctaattttatcaaatctaaatgtaattattaatttctctcttcatctgctttccctatatatatcctctactttaataaaccccgatacaataattgtttaaaaatatataaatttattttgagataaacagaaagaggtaaaaatataataataaacttattatgggatgaagaactaactaagggtcttatttttttttcttatacttatcagccaaaatttaaattttcaatcttaaatttggagttgattttaaggttttttcatcgaagtttatttttcagcttttgcttttatatcgctaaaaacacgcatataaaagttttatttataaattatttttcgtttgtaaatatgccgttttggctccgtataggcttgttagctgtcgtccggatggacgcatggatgggcatgacgcaggcgtatcgtcctcccccatgtcacgcgatccacacaacggccggccttgctgcttgcaacaattcctcctcctgggaagcaacaacaacaaaccaaacaaacaaattaacaaaccatccttgcgtgtgtgtgtgtgtgatgggggagaagaaacagaaggatgaggattcgatcccttcatgtcctgaaggtcccttttgatttgagaaaaaaaaatctccaatataactatttgcaacaaaggattgcatttttttcctatataattttttttaattcttgataggtaccaaaagatactatatttttagtataattttcgtaccttctattactgaaggtatcaagagatactagattttacaataagaaatatggtacgacgaccttccatacgaccatacctccttaagaactgtaaaaccacttaatttctaatgtcttaatatatataggttttggaggatttttaacatgaggttcaatctcatgtaaagctttctatgagtttatctctctcatccaattcctacggtctaattaaatggtcattcctgtatatttttttctatatgttttactattctctattttatactttaatttctatcaaaattctatgcctctattttttcaatcctacgtttcagagaaaaccaaaacgatatatggatggatggattattggttagttgggtttgatacaaatctctcaccccgggtggggagccaaaacaagcacaaaaccgtactaccaccccaagcagcaacaaacagagtgtgatgcgtgtgtgtgtgcgtgtttgttgcgttcatctatcaatccatgcatgcactttgcatcggattctcttctatgtggtcttgtcacacggcatggtaacttagctatagctagtggttggttggccccggttcttctttgtttggaaaacagaaagcgtgcgttgctgacatgagctaggctatagctcaatataattgtgaggcaatagtagcatttttagttttcattggtttttttttcttagttgagtggagagggacccttggtttgcatgcatgaagagagtcactactacagaaaacatcatcaatgtccaaagtgacataaactgattgttatcaatactccatccattctaaaatatatataaggcacaaccacccttaacccaaagaccaagaaataattattattatattgtagtttgaatcatcctaataaatactataatgcatacatccaatgtgattagataacatgagagtggatgatttaaaaaaaagtaataatttaatagagaagatgtcataattaattgcatgcttgcatacacgccttatattatagaatatctaagaaaaatggttgtgacttatattataaaatagagggagtaatatatttctatagatggtttattttaggaaaccttgtcgagattcaatgttactagtgattgtttttgataagttttcttttctgttactattttttcaataatgtttaatactatctcttataaaatattataggagggtatcaatagacctacttgagggttgtctagatggggccttttatggtaacgatcgagagcacatccaaactagtagacccaaatgcaagcatatctctatgcaaagctagccatgcattaaagccagaaagataggggtattccaagagctctatagctaaactgctaaaggttactcctagctagcattctcaagattctcctccaccaactgaccatccatgctcacatttggcatcaatgaaagaaaaagccactgctagatgtgtcgcaacctaattaggcgccatggcatgcaccacacgtctacacatacaccacacaaccctagctagctatctactgtactactccctctgtcccataatataagagattttgagtttttacttgcaacgtttgaccactcgtcttattcaaatttttttaaaattattaattattttatttatgacttaatttattatctacagtactttaagcataacttttcggtttttatatttgcaaaaaaaaattaaataatacgagtggtcaaaagttgtaagcaaaaactaaaaatcccttatatcgtgggacggagggagtatctatctctacctaacctgcttgctggatgctgcctctctgtagctatagcttaacatcaaataacatgtagtaggagtagtaactattggttgcaaagtgtaccatacgcagagtcatgcagtgaatagtgagaaaaaaaccactgttcacggtcactacactgtgccacggatgttgttcacttcactctcactcactcggtcacctgtaccatgctggaagatatatggctcttgctagctaaagatagctagctgtcaactggtgacttggcagaaaataagctgggaaaatgacaggcgtgcatgcatgcacggccctgatggccaagtgtctttgcatatagctgacactgacaaagctaaggatgagtctataccttctccaaactccaagagtgatctatgagcttatttcatctggattctactcactgttccaaaatttaaaatctactacgagatcgattagacattttataattatacaaaatgtggacaggaatcatatgtttagattcgtaatactatgaaatatctaatttgatagtactaggtgtttacatttggggattaaaggagtagtagattatttagcagaatttaaggttagttgttttgatgtccctaaggtttacttattaagaaagatcacgtataacaatgcaactagcaataaatatagtagttttttttagagctcttcactttgagtacaagatatagtatctgaacatacgtacaaacgcactccaccacacacacactccacacacacctctacacgcatgctagacctatcaactatacacacacctgctaatgagatacacgaagccacctaagcaaacacctgctaatgagatacacgaagccacctaagcaataaatatagtagttggatggattgactaaaaaattagtactccaaaattacttatattttatagataaattttaaacttaaaatctctatatttgtagatgaagggagtatatccctgtgttcagaactaaagtattccctctatatcaaaataacttcagttttagtctagggtgtgttcaaaacaaggtgaatgaaaaaaagaacaaagtatcatcattaatactctctttggcccaatataaattatcttttatatacgaatttgaatataggctattccagaatcaagataaaaagttgatttatttaaaacagagggagcaggtcgatagtaggtaagagtattaaaggaataaaatcgatcaatttacaaaccaagagaggtaagaagatagagttaaatttattatattactccctctgtctattctaaaataagttaacttttatgcatgattcaagtttactgagggagcggtacgtacttttcgccagcgtacgtttgttgcatgaatgttgctgccaaacaaacgcatgagtcatatgtatatggctatgtgcagctcaatttatttatcgtccttccctttatgaaggttgtattgcacgaaaataatgaggacaaccaaggagaaacttggttattagataatttacagaaatagtgagcatgttgagaactgaatacataattttggggttaaaaccaaacccccctaccactacactatcatatatgtagtacatctgtgaaccctacattgcattggtagctagcaatactatagatgtgatagtactgtagtgttaatttgtgtatgtcccggggtgcagtagcgttcgtatgtatgttcttcttcccggggttatatataggatccgggtaaattattcaattctaactgaattatttcatgttaactagcatattagttagttaataattaaataataagtatatatataggacagcggtaatttttgttgtcggctcgtcgttgaagccggcagctgtgtggtacgtgtgtccttgcagggtttggcatgcatgcattcgtgcgtgcgtgcagtaaatgtgagagattctgagtcacattcatgtgagccatagcagcacagggacagctagccataatgcagaagtactgtgtacggctgatgcagtgtgcgtggtgtaccacaaaccaaaacagctttattttacatcaacttccacatatcaaaactgatctgatcttgcagtgatttttatcatcgcacgatcgctttcccttctctcgttcgttctgatcgatatctgtgtgtgaccgtgtgcacatgattcgtggcacatgtaatacagacacacacacgtgtgaatgtatagcagtaaacgtgtgggcataagagcaagtttaatagtatagcccactattaacttcaaatcttctatagccaatgtaatagccaattcatataatagttgcttactatactagtaatatctgatcccacctgtcatacacacattacatcttgaagcccgtgctgcagctggctacagatctatagcatgctgctcttctctctcttcctttatctctttaaaatatgtttatagctggcttataggctgctattgtacctgctctaaatagagtatcaaacctacggattatatatactccctccgtcccaaaaaaacaaaccctgggtttccgtgtccaacgtttgaccgtctgtcttatttgaaaaattatgaaaaaaatttaaaagacaagtcacgcataaaatattaatcatgttttatcatctaacaataataaaaatactaattataaaaaaattcatataagacggacagtcaaatgttggacacgaaaacccatggtttgtcttttttacgagacagaggtagtatatatatagctcttgactgctggttaattgatttggaacctgtactgctgtacacactgtttgtgtcctgtgtatgtttgctacatgtgctgtacaaaccagaaacttcagtgaaaaatggaaggatatggatgcatggatgggcttcaattgaaggaattgagatcacctgcagttgttagtatgactgcaactttagcagtcatacaaccattgttggatcaaataataagagctcagatcacacagaagtactgttcatcagattactgtagcagacgaatcctgtagcgcacactgtagcaagtgataacaaacagtcctgctactaaatcctagccattgaaatctttgatctgatggttgtgaagacctaagactgttaaacttgcagtccctattcaaactgcatgggatccctgtaggatcgaatagcaagaactaagccaaccagaggagggggggggggtgaatggttggtatacctaaaaaccgaaaacttttagcggaaatacaagttaccctcgaattcgacggagatcggtctgaccgagattgatctgcaggtcggaccgagtggatgccgccggtctgaccggtatagatcgtctgaccgccgatgtcgcctgccgcgcctgtcgccgacgccggtctgaccgtcgtgctcccgccggttggaccgccgcgatgccgccggtctaaccgccggtaagtcgccggttggaccgccgaaacccggtgaaacacaaatcgaagaactcttaaagtagatgacgactttattacttctctctgtgtttacaaagtgcatcaacagcactccttacaaaaatttcgactaaactcgaaaccctaactaaaaactcaactcaattgctctcaaaagcgataccgggaagcctcacgctccccctctatttatacccgggtaggcagcctaaagccacgaaccaaactcatgctaggagtcctaaacaccttaggaaaccctctagtacaagaaagaaactttacataaccaatcgtaccaaatttggactccttccaaattcgactccgcatcccatacgcacataataactccatcgtatgccatatggaatctccatcaaccacgtgcatcaactctaacttaagtatcccgcatgatctctgaccaccacggacgtcgtcttatcaccaagccgactcttggtccatcaccgcaaatactctcccgagacatcgagtcatctacacatggaattacaaacaaagaaaccatattccgagaccaagctatctccaacttgactcattagtagcaaacaatagtattacatacgtatagtatccatctagaagtcataatcatgaaataatcatggatatccaaacaaacaacccgaaaccgaaaccgacacagcgtcggccggtcagaccgcgggctgcgccggtctgaccgcgcatatactatcggtctgaccggctaccagagcccggtctaacgggccacataaaatgacagtacctgtgattcacctgtaaatccaatcatctccaaaaccacttcgtgaataaattccaaataacaaaaccaataatctccgatgccaattgttcatcacagaataataataaaaacacctttgattttacaatcccaatcccaattgaagtaggagtagtaattaaggccaatagtgtaatgtactctgagtacattattattaatctaagtcagccaaagtactccgtcagactgtgtccggccgtccatttcgacaagtcaaaagactggaacttttatctaattgaaacagtactgctcgcaattacagaaccgcatgcagtatatatatagtactcttcagacgatgggtcagaaatcaattcacaagtgcatgcaacagtacagaaacaaattaaaattccaatcgacgaattgatgaaaaaaaaggggtctaattaatgtttggcaagctatagcttgctactaggtggccaagcaaatcaaggatatactccatccgtcctactccctatacatttatcaaatcaagtaaaagactagaagatctttattttatcaaatcccaatataattatctatctctttataaactccctatacatttatccactacatttacaaactccaatacaatgactactcacaaataaattattttgtaaaagtcatacataaggatccaaaataatattattttaggacgaaagaatcgagaaagtaacagaaagcgattgcaatttgagggcgtagtacgtctcacaagcagatcatgatgtacgatatcgatcaggccgaccggccgcgtacactgcatgcatgatggttatgtatgtacaagatgtatataatcgatccgtatctttgtgtaatgtgtgccccgagccaggggagcatccagagatcaaagtaagctacgacatatgggtccgatatcaatagttgaccaacgatttatgttttaaggatgacggtaaaggggagggggaggagttggggagagtggaaggtgagggtttccttgggtttagagggatgaccttaggcagtggctggctagaccagcgggcaacgtggttgtgggaccgccattgaagttatggagatggagacaaagcggggttggtggtggggggcaatgaaggtcgtggggttaggaggcggggattgacggccacgaatctaatggagtgggggagaggttgagagggaggtgggggaggaggccagtctggctggcctcgccggtgccgttgatggtttgtaagcatggtttttcgagtagtggtagtggaggaggtagtggaatcggtcacgggagagagacgaagcaactaaggcggcatcagtaattgggggaagaaggaaaggataagctagggttgcttcaagattgatatcctggccatccaaatttgactgaattatttttaccattttcaggcaactgaaggaaatatattactttcatgtatgtatagtagattctaaaaaaaaagttttgtatagctagctaggaaacataataccatttttgcgtgtggaaaatgactaacttttggagcaggggaagccaggttgttaggttgcttcttgtggggatgcatgcaaaatggatgcatgggtacgttggttgttacacaagcaacttgcatgtatatcatatataagttgttgcatgccagagagcgaggagtactaccataccatacgttggctgggaagcccgtgcgcgtaacgtacccttaatttcgctaccgccgtgccccagccgataggtggacattgaatttgatggtgatattaatatgggaatgtgatttttaatctcaatcttctattaggcagagatggtgaaaatcgatagagagtttagatattatggaggctagatcgtaagtaaaaaccgatttttgagatttgtttaggtaatgtataaaggaggaatcctctctgatcaactccttcccctaattaacctatatattgaaaaggagggagtttccccctcaataccccattccccatatcgcaccaaaactcccattcatccaatcacctccacgtactcaaaaactgcaaatttaaaaaatatattaaaaagcagctacaagaatctgatctcccttgggttaaaaaaaagggtcataaccatatgagtgcgatcaccagatgtcatgggaaagtttggcagaaaccctagttgtttatggttaactaatgtactagtactcgagcgatcacctaaggagatagcctaaattaaaataattgaatctgactaattaattggtctaatctgccctagtcctagctccaagtgttgtttagttagggtgacatatgccacttttgcattttgttccgttatgctacaaagctttatgtgctgattagctagttaacggcaaaggtgacttctgctgatgccttttcntagtatgttatcaaaagggtcttcatcaaggatcttaggcatagtatcatgatttggttgttcactaatataatattgagatgaggtttggttgttaactaaacatgctaactagtcacatcaaaccaaacatttaatttttatttcaaatcaagagcatccttctgttacagtgggggttgtttggccttacactcaacggaatatataacggatatactcttgtcgcataacctcgcaaagtgtttatttagttatttacagtctctgaagggataaaatacactatgtttcttttttttttggctagtattagttaatttgtggtaattagtacactagctaggaggttcatttataaaaatcaatctacgaattttagtgttaacatttggtaatacataggtgcatgcagtaccttgcagcacacctccttattgttaataaggaacagtaaatcaccgtctttgcgtaaattttacaaaactaatgatgtttcgataaagctatcaaaaaatataatgcatttaggtgaatttatcataaaactataaattgaaggtataatattgcaaaaaatatagatacaacatatatttttttggtcaaaagctacatgttacatgtatccatataataacgcaagaatgggacctatgaaatttgtagtgttgtaatacattatgtgctaaatttataattttattagaccagcatataaatatgtagtttggtagattcaatgttaaacatgtaatttgtgatacacggcggctttaatatataattttgcgatggttttgtcaaaatatataattttataaaatttactctttcttttaataattcatagtctatatggtacatgcatggctattgggaatgaactttaaacaacgcatgtatttcaacgctgaattataagatattaattaatgaatatattttattaagtaatgaaattacatctgcctctgcatctatactatgctcacagcccaaaaatatcgcgtctctgttatctaaaagatcaagctagctaggtagctattgtgttaagcacatgacccacaacggtagtggttatctcatcaagtccataagaggcgatgatatatatcctatatattaggttaggacttaactagacatgtctcgttacttggaagatagagacttattcgatgtgtacctctgggtcctacttaattggcttaattccaccaaagttgccggaaattaagacactgtatctacaatattaggcgacaggactaatgatggagatgacaaagctagctaacaacaagcatatcgatcaatgatcatcgtggcaaactttgattttagttgtgtcacatgcatcatttcgattaaatttgcattccttttgttcatagcgtctgtcattataaggaaaaaccgatgcactgatgcagataggggcagagcacatcaaaagtctaataatagacccaactaatgttattccattcaagtccaagtaaaattttctgctttctacttcttttttaatgtttttttaagaagattatctaactgtaattcatcatttaacaactgcgcagtatgtgcgtttaccactatttttttattttattaattagaactataggctgagcttgggcacaagttggagcagagtacgtacattatgaaatcgatggagtttgtgctgtacagggtaaaaactgttggtttattgtatcagcccacctccgatatggattggaggagataaaaaccattgtttcttcttaatcaaggaaactaagagaggttatgtctgatcggtaaaaactactactataatcctaatagaattaattagcccccaagccacatcagtattctattgggaactgccacaagttatttcagtaaaaaactttcacatatatctatattatgattaaaatataattacattatataactgcactgtaactatactgtacctacgatataacttatataaaacttgcattcaactatggtttggttagctagtacgaagatcttacgtatgacatgcatgaaaatttctttctatcagttttttcactcatgcacaaatctcgatacaatctgatgattaacaaatatgaaagttttgagagcaaaatacttgcgaaatttttttagcaaatccgtaaacaaaagagaggcaaaggggttgcccaaagcttcgacaaaattctctcaaacctttttttctatgaacatgtacacaaacaactttattaaacaagaacagatcaaactaggggatataccccagtacatatccaaagataagaactgaaagcaaagagccatccctatgataaggagggttaactgaacaagcaaccttctgatgtaaccaaacaacataaaatacaggtcgacagggagctgcgacaataccgcgacgactgctaccttgggtctgatttgtcgtgcactccgctcgacaagccgttaattcccatcggctgcctccacggaatggcacaaaacaaaggtttgttgctaagcgtacattttggtgtgagcatcatcggactcagcaaaggatttccacggagttagtaattgaatctgaggagctctaacattttatcgatctaaagcactaggattcgtatggctattcccagctagtgtcattggcatccagagggtgcttcgctacgtcaacatatagaacaccagcgaccacttcgtgatcaagctagcgccaccgcttccaaatatcatggcttaataaattcacaagcagatccgtagatctattctgaatagcagaagatgagatcatgttaggctaagatcaatgtaaattagactcgatattgtaattcagagaggcacattttttttattcacacattatattgccaaacttaaccgatacatgttaaatatttaaccaggagaagttttaattatcataacataagatgccatatatataagaacaggggtgctagcttattatagcttaggccatgaaaagactcttaattacaggtaatgatggaaaagaaacttgaactgtaagatttgcatattcttttgcagatcaatgtagcattattcatccaatatattatatacgtactctctctgttttatattataaatcattttgactttttttctaagctaaactcgatcaattcatgtacttaaaaattactccatccgtcccctaatataagggatttttgacatttttgcttgcactgtttgatcactcgtcttattcaaaaatttgtgtaaatataaaaaacgaaaagttgtgcttaaagtactttggataataaagtaagtcaaaaaaataaataataattccaaattcttttgaataagagtacaagcaaaatgtcaaaatctcatatattaagggacggagggagtaatacactaaaactcttaacaataataccctaacatttttataaagctaaaacaaaacttcttcctttatggaccgatgcgtatgtaactcgatccatgctaattgaacacaccggcatatttaatttaagaatataaagaaaaccattaaatagctgtcatatatataatgatctcgtacggttttgtgatgccgttgcgttgtcacattacaagctccacgtacgaaatagttgagcctttccgacaatttggttaattgccaatcctttcagattagaaccctatttttttgatgaaaagattagaacactatgatcactaggagctatacgaactaatgaaccgactttataaatatactatatgcaaagattaattagttatcctatgatatctattctgcatgtagtgacggaggattggctagctagctaatcactcaaatccagtgacagcgtgcatttcaatgcataatcgctgaaccatctctagcatctactccctcaaggaacatgtccaggtacattgtctcataagggatcacattttcttctaaattaattttttaaaggacagagggattgagtatatacgaacgtaaatatgtatgcaatgttcatatatatgtcatgtcatgcagatcagacctctttatatgcttgaatgatcttttttttttggtcttaaaaaggtgatcagtagttcatgcatggtgcagtggtgacaaaagccaactaattgccagtatgttaagtaacaaattgacaggatcatctgacggtaattaaaaagaaagataatggagtttgcgccatcagatgccaccagcctccttcctaaaaagtcattgattgcattggatggaaaatcaacaaaactaagtgtgctaaactagtttgcatcaccgcatacacaactttagtttgctcaaataaatactagtatatatttgcatgcatcagagagacccatgcatgcatatagctatcaagcaatctaacctccatgtctaaattaataaatattaatcacaagccctatatgatcaatagttgctccctttatatatatatatatatatatatatatatatatatatatatatatatatatatatatatagcgtatcctatgcacacaggccctcgcgtgtacacaccgtgtacaccaactaaaaattttcacaaaaaattctaggaaaattcatacatgtacttttaatagtattacatctacgtgcaaagtcgcatattcaaattcattctacatagagaataacaaaaaagataaaattctgacaaaattgtaaccttaaaacggtcagattttttgttttttttgttacggctaaaatataatgaatttgacgttaagattttaaccctaggtgtaatacaattgatagtatgtgtatgattttttctagattttttggtgatattttttagttggtgtgcacgtgtgtacacgtgagggcctgtgtgcataggatatgttgcctacatatgtatatgtgtgtgtatatatatatatatatatatatatatatatatatatatatatatatatatatatatatatatatatatatatatattatatttacaagcttatctatctctgatgaagcaagcactatctatagagctatctaaactagctagccaagcaagttaaacgcagcaatccttgacctaagaaaaggaaacaggacaacatattacttaattattataattatagttatgtgcataatgtgacggcgccatgtacttaaattaattagttaaagcaatgaaggggaaagaataattaatggtggcagctctgaccacccatgtgtcgacgcaaagtttggcgtgtcgcacgctaaaatgtctgtcgacgtgtgtgagcatatatatatacatgtcgcttttattctgttatgacttgtgataacggaactacatgcccctttatatgaagtacaaataaattagtactaatagtatgtagatagggaaattaattcagaggacgtgtcgaatcaaaattatttctcttaaaatatactactagtaatatatgaaatataagaggtactaacacatgctacacctagctagtttcggtctattccggtcatgcactttgaacctagctagctacgactaactttgttccaaaatgttgctacctactccaatattaaatgggactaattttgatttgtagtattagtatgtgtctcatccagttttagataatattttttgcgaacgcgtaaaaggattgcacgtcaatatattagcaggaaaagagtttctgttacacaaagcaatcagccagactgacttatgcctaaaaagggtgggggacttgaagctatgaactactacgacggttaaaaacgcaactccaaacagcgggagggggcagagccacgctacactctcaagaaatcccaaaaaaaacaacaccggctaaagaccacagctggcccagttttagataacaatattttagaacgcaggaagtactagttaatcggatgaaaattaatatatgccacaatgaaaattaattggatgttggctgatttgacctatactgctaaaatttgaccttgatggagattcaaattaagcataactcaaattttcaagttcaataagtttttctaagcagacacttacagtacacgtgcacttacctctaagaacacatgtactacgtctataaacacctctaaaaactaagccgacgtatcttgagtttaaattttatagcccacaattgcttatatgctttcaatcagtaagaattctatgagctatatattgagctagttcatatatttatccctctgtatgtacttcatatcgtttgctctactgataaatcgtgaaaaaaaatgaatgaaacaacccaaaaaaaacttatggtaaggcctttatatgtgcattcttaatgatataaatgccaatgcggcaaaataaactacaataaaaaaacttaaaatcaactctaaattaaaatttggttgtggctgataagtcaactatagtaacacaaaataactcttgattaattattgagtagtttaacactggtctgataaatgacaggtagattttcatacttgtggcgcatggttggtatcctccatgttcgacacaaatctatcaaccaaagagataaaaaatattgcaagtttatcagcgattcattaggccaggtaaataacttctgaatccatgcatcgcagtccgtggatagcagaaagaaatatcacatgcatacgtgggccttgggctggcattacaggaagtccaataagttagcaaaacaggccttgtgggcccaactagacagacatcagaaaactggactgtattatgggccacattcctctcccttaacagggcagagaataagtctacattgcgtccctcaactcttgtccttggttgaatcacgtcccacaaccaaagtccctcaaccaaaataccaggtataacacctcctccagttttgaaaactagggcaaatcacctccctgcgccgcatcatcctatgccaccaactctgcgtgcctacctgcgtccatctccgtcgggacgccggggacatgtgccgccgaccacgccccacccgccagggtcgtccacccatggggagggagaagaagaggccgcggcgcagatgaggaggcaaggatagggatgaggaggtgtaggaggggcgtgggaggggaggcagcgatggggagggatgagaggaggcggcgaggcttccttacccctctctctctctctgctcccgccgtcccgccactccgtcaagctcccgtcgccttgccgctcccaccaccccactgccccacggtcatgccgccccgtcgctcctgccactcccgccgagctcccaccgccccgccgctcccactgtcctactgccgccaggctcatgaagctctctccatctcgctcgccatgaggataaagagggaggagaaaggtaactgacatgtgggcccaataatttatttttatcattttactcactgacatgtgggtcccatttaggtttgtctttattttagtgccacgtaagcgctatgtcgatgccatatggaatgatgaccaagtcaactcgccacgtaagtgccatggaggacaaaaccgccgagggagtcgatttgcaatggttttgaaagttaggggatgggttatacctggttttgcagttgaggggtgcgattcaaccaggcacaagagttgagggagtcaaagtagacttattgcacagggcattaagctgggcaatccataggagattaaccacttgatctggcccatttttttctttctggcattttcgtcggcccgtttaccatttccctttttctttattttgtcaccactctttcttgtactattcacactcgagtctacgcatataagcatatctgtgaaaaaaaaaacgaatttgggtgaacaaaaatgttgagatacttataaatcagtctatatataattgctattcctagtatataaatttatttatttcgtgacagttttgctgatctacacaagcttaaaagaagggtatgcttttttttaaaaaaaaagatatttgaaggatttgaatcctatgaaattcctatatgtgtatctttgtaaccaaggaatgttcatctcaaatcctataaaattcatatggattgcctcaattcaattattcacagaattttcgaatggtttctaagatgaggtccaaccacttaggaatcttgttttgtgtttttctcttctctaaattgatcctttgttttctttttcctataaagcatccaaacaattttatttgaaaaggtattgtattgttgagatacttgacgattcatggcttatttcaaacacaaaattcgaaaaaaaatacaagaataaaaaagacacaggaataagatgtcaagacttattaaatcttacaggaaactgatccacatcaatttgtagtaaatgtcatttgtcaacaccaatggaaaatcataggaaaacctaatcaaggttacagaaaacatgatgccaaaccttacgttattttttctccgaaaatcccatgaaatgagttgttacataagaatattctcaaaggatttggtagaagtcaatccttccaaacgaccaagtaggaatattactttctatacgatgttaatcctcaagattccctttgttttttcttttgttccaaagaagatctaaatcagtcgaaaacaaccaggaaaaccccctaacattttcattttcattttttttaaaacggaatcggaacggtagacccgaaaacggtaacgatattggtaatatattgtcggtgacatgggaccgggagtatcatgacttagagacttgaggcagacacgatcacccacgtggcctaaccccctcgggggggggggggtcgggcccgagggtgatacggccgcccttctctttgtctccccgaggggtcggaccgttcccgtctcggccccgagggccgaggcgccccgaccccttgtgggttttgcgccgcgtatatggggtaggtgagcatagcggggcatacctaaccacatttattgcggtttggacgagcgcgtcacgccgcatgtaacgcagtgcagcgcgctcgtttatccggtctgtgaccagtcacagactgatcagatcgtgggttaggtggcgacaggcggtctgacgcacgcctcgccccatcccgtcaggatgagagcctccaagcactcgtccctagccggagccggcgtgttaactcctggagatggcacgttggtcccggtcagatatataccaggcttcatcctaaccattacaagcaagacattgtatgaagaggggcgaacatgcagattgataaactgacgcgtggtgggcaagaatgaccgatttgtgaccggtctgacactgatcatgtcatcagcagacagccatgttcccactcgcgcctgcttccggcggaagtggaggtaggtatgggctgtcccatcagaaggtcattcggacggcaaccatacaagtctccgtctgtttatgaaaagataggataagtccccacaaaaaagagagagatggtgcatgtggtatccccttgaggtataaaaggaggaccttgcccacttagaagggggatggatttttggatccagaacgatcagagagggagagagtaagagctctctggttctccagctcttttgtagcttcttcatacatagatccacaaaaacacaggagtagggtattacgcttctcagcggcccgaacctgtatacatcgcccgtgtcttgtgtgtttccattctcgcgaaccttccacacacagactaggagcttagaatctcacccaggacccccggccgaaccggcaaaggggggcctgcgcggtctcccggtgaggagccccacgctccgtcatctggcgcgccaggtagggggctttgcgtgtgtttttctaagctctcgcattctttcgtgtgcgccaagcttttcctgttcagcccaatggccgaacaagcaaaggcgcacaacctctctccgagtgttagcggtgacgacggggagccgaacccacgccgtcgagctcgtactccaccgccccctccacgccaaagtcctaggcgggaggaggcactcgagagggtcgaaggatccgcgacttcgacatccacgggtgatggggaagggcggcgagatggggagcgtcgcctcctcgtctacggcgacggcagcacgccccagggcgcgctccaagctgcgggcgcgctcctacgtcacccgcccattgtccctgacccggagtctccagcccaacgttggctagacgacgtggccaacttggtcatgacggcacggcagcgcctaggtgctggtgggcggtcctccgccaccaagacctctggcgctgctaccaccggctccgtgtcgtcaaggcggagggcgcggcgagcggcggctgttgctcgccattcagccgccactccttcgtcagcgcctccgacccaggaagatctgcgtggggggccggatgcccgcatcagtatcgagcgccggcgtaatggccggcgtgctgcccacgcaacggagggcgcctcctcgtccggagtgtcacatcaacacggacgcggggatcagccctccgtgcccccggttggtggtgtcggctgtagagcctttgtggcgagccttcggaacgtccgttggcccccaaggttccggcccactatcgccgaaaaatatgacgggagcgtcaaccccgccgagtttctccaggtctacacgaccgggatcgaggccgccgggggtgacgacagggtcatggcgaatttctttcccatggccctgaagggacaggcacggggttggctaatgaacttgccacccgcgtccgtccactcttgggaggatttgtgccaacagttcaccatgaactttcaaggcacatatccgcgcccaggtgaagaagcggacttacatgcagtccagcgaagggatgatgagtcacttcactcatacattcagcggttctgtcaagtccgcaacaccataccatgcatccctgcacacgcggtgatctacgcgttcagggggggtgtgcggcacaaccgcatgctcgaaaagatcgcctccaaagagccctagactaccgcggagctttttcagctcgcggaccgagtggctcgtaaggaagaggcatgaacctggaacccctccggttccggtgtggcagcttcggccgcccccggatccgctgctcggacagggcggcgtgacaggaggaggaagaagaggtcagcccattccgacgacgagggtcatgtcctcgccgtcgagggcgctttgcgggccacccgaaaggggaggcctgcgagcgacaaaaagaaggagaccggcgctcccagtagggagcgcccaaccggcaagtggtgcattgtccacaacacctcccttcacgacctcgcggactgccgcgcagtcaaaagtttggctgagcggacgaggaagtgggaggaggagaggaggcaggagcgccgagagggcaagtccccggcggttccttccggcaatcggcgaagtgaggccaagcagaaggcccccgccgaggacatcgatgacggcgatgatgacctaggtttccaagagcctggggccaccattgccactgtcgatgggggagcgtgtgctcacgtttctcgccggagcctcaaggccatgaagcgagagttctggccgcggcccctactcatgaggcgacgcgccgggcgcggtggtcggaggttgccctcaccttcgaccagaccgaccacccaccgtgcgttgcccggggaggacagatcgcaatggtggtttcccccactgtttgcaacgtgaagctggggcgtgtcctcattgatgggggagcagcctcaacatcctttcccccgcagcctttgacgctatcaaggccccggggatggtgctccggccgtcccagccgattatcggtgtgacgccgggtcacacttggccgctaggtcatatcgacctcccggtcacattcggtggatccgccaacttccgcacggagcgggtgaactttgatgtggcggacctcagtctgccctacaacgcggtcctagggaggcccgcgttggtgaagttcatggcggcaatccactacgcctacctccagatgaagatgccgggccccggtggccccatctctgtccatggcgacctcaaagtcgcgcttgcttgtatggagcagcgcgcggaccacctcaccgccgcgtccaagcccgagggaggcgacgagaggcttggcacctccgcccccgccgccccgaggcagcggatagtcacatgcgacgaggtcccggtcaaggaggttgccctgagcgacggcccgtccaagaccacacggatcggtggtcttctggacggcaaataggaagacgcgctcgtctctttcctgcgggcaaacgctggcgtcttcgcatggagaccggcggatatgcccggggtccccagggaggtgattgagcaccgtctcgccgtgcggtcgggcgcaaggccggtccggcagaaagtacggcggcaggccccggaacgtcaagccttcatccacgaggaggtggcgcgacttctggaggccggattcatccgcgaggtcatccatccggagtggctggcgaacccggtggtcgttcccaaggcgaacggnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgatggactactg

SEQ ID NO: 20052 - DNA, 354 bp, Oryza sativa
gttgctatctaaattccatttaaggtcgtaccttatcgcccagcatcatcttattctctatttgtattccctccatctttcagatacggatgtagccttggatgtgcccgtgcccaatgaagaggaagagcgcaacatgaaacgtaagtacaaaagtaccggacacccacccagatcccaatagaatccgccaaatcctgcgggaaattgtaatcccattcaccagctcctacatttaattaacaagagaactattgtatttatctaacacctggattatctccacctttcatttgatccctatttatagaatacgctgcgttgctaacgggccgcacctcctattttctcaag

SEQ ID NO: 20053 - DNA, 3136 bp, Oryza sativa
acgaatgaatggtttgttggaaggaaacgtggtgggaggaaaccaaggcgatatttgggccacctgctaagctctaacatgccgaaattaactatactactctctccattttaaaatatactactatcagttacggagtatatacacacttatggacgaaattgcaaagggcggaccacggacgggccaaatataccagcatttacgagttgaatataacaaacgatatgggacaaattgtattgcccctgtggccgaactatttaccgcatactaggtgataccttgcactttgctgcgatattcataaatgattatatgttaaatattgtcgaaatgatgaaaagttgaaatattgagaaaataatgtgaggaagattatttgacatatgcttattgatgatgtgtcatgcttgcatgggatttaaaataggctagaacagtaattgctagtgagtgaagatgttgcatgatgcttgcataggattttaaatgggctagaataataattgctagtgggtgatgatgtggcatatgcttgcatgttgagccttagcttctaataattgttagtgggtaccaactatatagaaagtatagatgggctacaaaaattagggaaatattcatattacatccctcaactataggacgccaactgtaaaacgagagagaagccctccttcaacttataggggaaccaatcaaaattgtcatgggtagcggttctaaattgatacaccaattttttacgagtgctaaaaaattcatttttttccaagaatactaccagtatagttatatatatattagaaaaaaagtagttatttacaatatcaaaaggataaagcatgaaaaggagaaaaagaagagaaaaaaaaaaggacagcgagctagcagcccagcagcagcagcagcagccagcaggcctggccttggggccttggccggtccatacaagcaagacagcagcagcagcagtaaagtgcagtagaagcactgcggcagcagcagcgctacagtaccatcgcggtactgtagctagaagataccctatgtatctacctaacatgtgaccttacctagtactatgaatctggacgggaggatgtctagattcgtagtactagataacgtcacatctaatactaggtagctatattttaggacgaaggaagtagggagcaacttaaataggaaaggttgctcgattcccagaattttggtgttaaagcgaagacggaaaacgtagtgagttactccctcactacgagatatacctttgaccttatttttctattataatatatacaataaataaatgcatgtttacttttattatagtgttttgaaagacaaatgtatatatatttttctaggttctttaaactaaatatttttaaagttattaatggtcaaagttataaaagtttaacctcaatcttgtccaaaaggtcaattaatatagaaccagagaaagtatagtgttagatgtggtccaactgaatgagatggacctaatacagttttcggaccgtgggcgtcacaaggaattacaaaagatcgtaaccagtcaaaaacaaggattgtaactctcattcatcctattttaccaatatatggtcacacctctactcttatactctctccgtccccaaaataaaaaaaaacccacttttgggtagtggggttttttttttacggaaggagtagctcacaagatttagaaactggtacacccttttttatttgaaaaagtctgaattatgctcttaaactattgagtgagtacgaattatccccccccccggcgcaaatacctgaaaacttgatttctttcacactcaactatcaataccggatttctttcacactatcaaaactagatttctttcacactcaactatccaaccggagaggttttggtcttacctggcagtccagtcacaaattcctttttctaattggcgggccttacctataagcctctcaccctctctatctctttcccctctgctctctatctctctctttcccaaatacccctctctctctctcttctccctcccctcatctatatctctctttcccaaatcctctgtcaatttctcaacacgagagggagagccggatgacggtgggcgggggttggagtggaggcagctcggggcggcggcgagtgaggccagaggcagcttggggtggcgggacagcgatgtgcagagaaggagggacggcggtgggattgaggcgggtgagggcgacgggacggttgtgggcgagggtggcaggactacggtggacgcagggcgtgggaccggggggaggggggtagatgcagctcgggcgcggaggacagcgacgggcgggggtgggggcatctcgtcttggatcaggtagaggccctatgtctcgccgccaacgaccactgtctcaacggcactacagtagctcgccgaagacaaccaccgtctcaacacggccaatgctctcctcgatctggatgtgcagcaccttccatgttggccaccgtctgcttcgtgttgcgggcaatgagcgtgcgagagagagagaggggtgagaggggaagagagagatgaaagagatctaacaggtgcgccctattgatttttttaataaaagaattgttcactggattgccgcgtaggacctaaaccgcttgtaaactgctcgggggagggagggggcactggtggagaaatcatctttggtcggttgcccaaaaacaacaatagttccggatgcttaaaaaaccgggactaaaaagcatttttagtcccggtttaaaagtgcaatgatctttagtcccggttagtgttaccaaccgggactaaagatcatcttttgtcccggtttatttattggcacgacgtggcaggtttcctaatatttttagtcccggttgtttataccaaccgggactacaaatcagtttcccacgtatctctctcttccctcgttctctccgcgcgcagagtagttagtactcaatcctcacccttatctcttcctcccctccactctttatctctcccttacgccttatctctttctcaccttcctctttcactctcatctcttactatgcacttcctctttcacacatctgagcgag

SEQ ID NO: 20054 - DNA, 14466 bp, Oryza sativa
ggatgatttgggatgttgagatgtgtggatttgggatgtttgagatattggttgttgctgtggatgatttgggatgttgagatgtgtgatcgatatgtgatgagtgatgtgtgaacacaaatctatgatatttggcgccagaaaagaaaaaaagaaaaaaaataacttttgtaccggttggtaccatcaaccgggagtaaagattctaaatctttagtctcggttggtgttacgaaccggaactaaagatatatttttagtcccggttatttcaatcaggactaaaaatagacatttttagtcccggattcgtagtcccggttgggaaaccgggactatagggggttcccaaccgggactaaaaagcgattctccagtagtggggggtcatccggtatcgatagttgagggtaaaagatgtctgatttttagagggtaattcgtactcactcaatagtttagggtgtgattcggactttagacttttccctttttatttttatgggtgcgaaaaaaaccgaaaaaatattttgtatattactaggcaatacatggttacacttctattctcacaacacacaaaattataacaccatttttatgcgctcgggattacaagtgtttaaatccgagatctctgcatccaaagcttacttaccatctcacctagtaacaatcgttgtttttaagcaaatactatcattcaaaacttataataaacatcatagataacttcgaatgaaaaatttgtcaactataaaattgtaggtctcattaagatcgacaattttcatataaatgttatctttgtccgagattgtttagaaatattaaaaattcacttatcccaatagatctgagaacttataacacaatttcagacatccagacaacctcaaataaaaaaaatttcagacatccagacaacctcaaataaaaaatttatgaactacaacgttgtagttttcattgagctctataaatttcatgtaaaatatattttatatgacttgatacgaaaactttaggtaaaaacacatgtataggagcgatgtaatcatatgtaccggtttaccactcataggtgccgtttttattaagaaacggtatatttgtgatgcctatatgtgccattccataataaaaactgcaccaattaggccgtactagaagataccggttattataagaaccagtacatatgtgatgtctattagcgccggtttattataaaattcagcacgtatgaagactattggtatcgggttttttaataaaccaatactattgagtagttatagatatcggttgttaattttatcctgtcgaaaggtagaaaacgcatcataaaacacactaacgaaaatcgagctaaaatttgtatcccatgtatccgattatcacgtttaaacgaggactagtgacgaagttgccgagacagttcgtcgggcgtgcactacaccagtccgtacacgttcagacgttctccacgccatgcgccccaacagagatctggccggttgcgtaccgactcgttgagttggccacgtagttgacacttgggctgtgtttagttcagcgaaaagtttagattttggttgaaattgaagatgatgtgactgaaaagttgtgtctatgatagattgatgtgatggaaaatggctgaagtttggatccaaactttggatctaaatgttggatagtatagggagaggtatacttcgtaacgtgggacacattgtattgagcctcgggggccggtatatataggagtacatgggaaggagataaggaaggattacagatatggaagaaatccaaacaaaccaatcatatcctaatatgactctaactaccatatactctaacatcccccgcagtccaagcgtgagcagcgcagacacttcgactgtagaagaaaccggcaagagtgctcaatacggatgatagcactttgtgccattgtcgacgtagccaaagcgaaggagccgagagagccgtggtcgatgaagccgtgcgtagagtagccgtggtcgatgtagccgaagtcaggaagctgatgtcgagatagccgagccacagggagcacatgaggcgccgtagagtggttgtggacgcacaggagggcgtcgtggaccaatggcgcgcgaagacgtgctagagacgaagacggtgacacaatcgcggcgatcgtggaggaagatgacgccgaagagctgatgtagtagaaccgtgaaggacgagacgtcacaccgggtttaccagacccggggacaactcgggacgaacgcgcgcaatggtgttgccaataccgcgcggacgaggtaggggaccaccatgaaccatacgccaatattggaggagactagcaaagaaggcctccgagacggtcgcggcgcaagaacggcgtagagggagaattgccggagcagcacgcggttgccgaagaagatcgaagtgtagtcgaggaagatacggcgatactggcgatgagacatgttggacgaagaagaagacgatgtagcgggaccaacggcctggacggcaacgttggaagctatgtagaggtagctggaccaccggccaagagtggctacggtggcaacttggagatgcggcggcgatgctcgaagtagaggaagaagaccctgagcggctgacgatgaccagtgcggacgacgaggatgtcgatgcgcaggcgacgatgatgacgacgagagcggcgaaactgcggtccgagaggacaatacagctacagctccatgtcgatgcagcgacgagaagtccaccgatgatgtagctatgctgagaggagggcacctctcagcactgcaacaaccagtggaggtgtggaccataggcagcggcactgtggcccaagagggcgacgcagcggcaaccataagcttgatggcgtagacgcgtgctcgatgacgatcggttgcagaagtcgttgttgccgggcgcctgaacgggtgatcaagccgaagatgcgtcgggctaaacgatgaagtcgaagtagagtcgatgccgatgtcggagacgcgtagatgtcgatgaggcagtgggcgacgcaaacccgttctctgaacgggaagaaaagagacaagcagcaggaaagcacagtaaccagcccaaagtgctcaatgctccatagaccaagtccattgccatagactaagtccacggacactcttaccccttctatccctgctccttatccagaagaactgaagcagagtgagacaaagcaaagaggagcatggacggctggtccatagcggcgaatttttttgagaattaatattatttttatggaaaatcgcaaaagtagtggccaaccggggaaaatcgcgaaagtaggtccctgtcgaacgggtgcaattcgatagggcacctatcgaacgacgagcagtcgatagagccctgtcgaacggctggcgttcgacacggtcacctgtcgaacggagggagttcgacagggcccaccaccccgcgccgccaggcctgtcgaaccgggggcgttcgacaggtccctccaccgaccctgtcgaacaatgggcgttcgacaggccggtttaaagccccgtccccccagcccgtgatgcttgttcgatttgtttgaggaccacatcgccagccgccgccgagagtcgccacatcgtcgccgtgagcgccggagggagcgagggtaggggatagcaggccggagaggaggccgaggaggcgccggccgggaggaaagggttggcgacgccctccagcagtgaagttaaggtatacattagtaatccctaagtacaatgcatatgaaagtttaataaaaaattggtttaagagttgttaattgtttcgcattgttcgatgttagtatgtatggttagcatacatttgttattgctaaatgttggtagaggtatttaagtaattgtacggttaaattagttcttagttagtacatattattgatatgttgtgtgttaaaatatgtacaaaggtgttatattttatttggattattaaactagttgtttgttactaatagttgtaaattagtacacggcaatgtagtataagttgtaatagggtaattatcgaatgattaaatgattaaacgtgagactatttgtcatgttttatcaggatgtcaggtgatatgcccattcgtctgtattatggcgatgctcctatacaaatatgtgatagcggggtggatttgactgtatatgccttccatgatactagtctgaatgcaccggagcatatgggtttgaacgacgtgttagggtggttgtataatatgtttggggtagatccagtgcacgataaatttgtcataaatgccgtgtggccagtgaggggtcaacatggatggcagtggagagtagtggaggttgcgtcaactaggagttggaggaagtttgttagtaaagtaagggagaaaggctatagcctggcaatagtggtgcagaagacaacatgtgttgatcgatcgggggagtcaagtcatgccgtggtggaagaaactccgttggaaggtggacaagctgaaaatgtttggcggactgagcaaggtcgaggggaagaagtagtagagggtaatacacaaggagaggtcattgttcgtggtactaatcgtgaggccaacgactcggacgatgaagaaccggattcgcctatgcgtgttgatgcagcggaggagaatgaggcggtagtggatcagatggaagtggaaaacgaggaatacattgcgcttgtagtggaaggagaagatacaacactgtgggacaacgaaactaacatacccgatgattggacgaccatatcaatgagtcgtatgaaggtaaacgatggtttagatgcccactggtgttatgatagtaagcaggtgaaagttggacagatgtttcatgacaaaggtcacttacaagatgcggtgaagaggtgggcatttgtccagaagcgtgagttcagggtgaaggtttcaaataggacgacgtatgacgtgaagtgcatacagggtggatgtccttggagagtgcatggttacaagccacaacatgacactttatgggtagcttcgagggttgagcaacatacgtgtttgttggagaatacccgtctggtgcacagaaacctgacagcggcatttgtggcacaaatggtatattcaaaggtggttagaaaaacatctttgtcccctttcaccataatgcatgacgttgagaaagagtacggatatgagatatcgtacgacaaggcttggagggcaaaacagaaagcattggagatgaggtttgaaacttatgaggattcttatcacaatcttcccccactattggaggtgatgcaggcaagaaacccaggcacacacatggctattctcgatgaggtgaatgaatatggggagaatgttcttcgtcgggctttctggtcatttgggtgcatgatagaggcctttaaaaattgcattcctttgctctgtgttgatggcactttcatgacaggcaagtacagaggaacaattctaaccgcgatcggagtcaacgcggatagccatgtcgttcatgttgcttttgcatttgttgaaaggagaacacatcaagctgggtatggtttttgcggcacattaaaatgtgtgttgttgaaaacagaccaaatgtgtgtgttctgcatgaccgacacgccggtttggtatcagcgatacagaagctttgagaagatgtcgaacagtcccggctatggtcagaggtacatagaaaatggagcatgcgagattgtggggctaatctttatagacaattcaggcgaaaaagattgatggacctgttcaagaagttatgcttggagaatcaacaaagaaaggttgatggcatatgggagcacctggatccgttggacacttcacacattggatgggctaggaaaaaacccatagttgccagacaggaggagccggagggacttgaacccattcctaatgaagcaccaagtattactcggcgcaggaagcgtggaagggccacgaagtgcttcacggagtgggtagaatttgagccaagggagaaatggtcgttgttgtacgatacagatggatcgaggtatggtgtgatgacaacaaatcttgctgaagtgtataactggtttatgaagaatacacgacctctaccacttgttgctatcctggagggcatcacgaggggtacacagaagtatctctgtaaaaggtattccatggctagtctgaacctcagcaaacccagtgttaagtatagccccgctattacacagtacatggatgagaaaagtaagaagggaggaatccacagagtgtggcctgctgggaatagagagttgttatttgagatacgatttcgtgacaagagtggtgtcggtattgggactactgacatcacattggaatgcacgttgtggccagagtatcacgcttgctaatgcaattgcaacaagccttacctgttacatcggccatgttcccatgttctttgctgtttcgcaaaagggggtgttgatggaaacatttttgtttctccctactttagaaaggaatcgtgggaggcaacttggcgtggtgaattgcgtggttggcgtgccgtgtgtgatttcactcgtcctcctccagggcaagccaattgggttcctgactcaaatttattagttgatactaagggtcgtcgccagtcgcgcaggatcaagaaccttatggatgaagctgaagtgaaagatcgttctcgtcgtaagaaagcttgcattctttgcggggagaaccattcccgtaaagattgcagcatgtacaatgtagggcaagatgccacaggcgctgatgttcgtcgcgttccaaaggggaagtcgaagaagaaaaataatccttagttcgctattatccttggtggactccctactttgaagatcgttatcgttcaatttatgtttagtgcgtctgtaattttaatttgaactttcttgcacttttattacccgaatctatttgtaatggccttgtaattttcattttgaactgcactgcacttttaatatcgccatgtatttggattgggattggtatttaaatttcgaactgcactgcacttgtaatatcataatatatgtgtcgtgggcttgtaattttaaattgaaatgtactgaactgctcttatcttgatctatgtgtgctggtactgtaattgtaaattgaaatggcatgcaaatgtgttatttgaattatgttgcatacatttattgtactgttaccatacgtgcattgtactaatgtggttttcgatctgcaggtatggctgatcaaaatgatgggcagctgatagacaaggagatcgataggaaccatcgatcgcgacgtcttagtacaggaactttctgcaatgtgctaaagatgcgaggaccggatcaatattggcatattgatcctcgttgggttccaaggtgtgtgaaaatatattgtttttactaatacaaggtgtttatattttcatgtattaataacttgcgctctgtcatgttgtaggctgagagcagctgggttattgacgtttgcacggttggtcgagccttcacgtgcaaggtccgaacgaatccacattgacgcggcgcttatgagtgctcttgtcgatagatggaggcctgagacccacactttccacctcacagttggagagatggtgcccactctgcaggatgtgtcttatttgttggggctgccgatagctaggccagcagttggcccaacaatggtgaatgctggatgggcggatgaccttctggccagttttggtggtgtgctgcctgttgcactggaggatctcacagatgggcacgggcctacgaaaagttggttgaatcagtttcgacaggatgtcttccctgatgaccaggaggagtggatcgtgcagcggcacttagtcgcttacctgttgtggttgtttggatgggtgatgttcacgggaactcacgctgactccgtggacaagcacttcatccactttgcggagcagattgcagagttacctattgcggagattccacagtacagttgggggtcggcggtacttgcggcgacatatgccggactgtgtgatgcttgcgtgaggaacagcaagcaaagttcactccctggatgcccgttgctacttatgttgtgggcgcacgagcgcttcgacattgggaggcctcagcttgactcgtacgcaaactacggtttgcgagagatgtacaggtctggtgttgatgacatcgacgatcgtcccactatgggatccttgtggacacaccgtgaggtaatttttgttaaattcgtttatgttatcattatgaatactagttcacaaactttccttatatgactaatgaaaactactacttgttacagccgcagtgggttagcgggacgacacgtcgtgtctacactcagtttgtagctgactttgatcagcttacgcctgaccgtgttcggtggactccctacactcagcacgatgtcaatgatcgtgcaccgcacggtctcgcggatctttgcacgcgagatatgcaactctggaggacgacttgtcaccttgtggtggacgtgcacgtcgagccacacaatgtccacagggttctcaaacagttgggcatgtatcaggacttccctccgagagatggtcgtcctttggctgatagtcttcataggttagttcacatcacagttgtttaatcctacattttttaaaataaatcattgcacaacattttttctgatgtgtgaatttgttgttgtgcaggtactccagaaaggggctcgggctttcctacgagctagttattgtgaccacggttcagccgacgatacaagagtgggagcacgcagctgataacttggcacttcagacacctccagacgatgggagttattatggagcttaccttcgttggtaccgcagtgttacacgatggaggtgttttcctccacaaggagatagcaccgtcccccaccaggcagcgattactgacacgtttgcccctcagcctagatcagcttacaactcaatggtacgtgtttatttgtggaatttgagcaactagttcaatatttttaaaaagttagcaagtagttcagtatgtctaataaatgtgcaattggttcacctagttccttttcttacataaatgtggaactagttcagtatttataaatgatgtgcaactggttcattatttctaacaaatgtgcatcttgttaaatactcttaataaatgtgcaactggttaaataattttaattgccttgattatttgtggaacaggcggaatttgttgagcacgttcacgtggagtccgacaccctgctgcaaagactagaggcgagacctccagtcgtcaggcctgacgacgtggcgagtgtccttcgcaacttccgtgcacgtgctgccgcactactacgtcgtgtctcctgtcggagcgcggcagatgtggtgcagacgtcgggccgacggccatcaccaccactaccccgacgttccagcgtggatcggagtggtccatcctcttcacgtcgcgggtacgaagcggcccacacatctcacggtcatccttcctttcagcacaccccaacaccggagtacaccagggggtcagccggatcaggggtacccacgtcgagcacggcaccaccacgtccgcaggtattccaaactccgccttatgttcacccctcacagggagtatctgggtcggcacacttcccttacatgccaacgggggacaacgtgttgaacacaccagcatggggacttcatatcactccgcgtgcgccagagcagggccacacacagcacacatgtaagtcattttaaacaataacacgttttagtttctaattatatgtatcgttactaactacgccatattttttggtttctccctcttgtacaaacagacgatgagtacggttcggcgtcgacgcatcacggagtgcctgcttactcccctcgcacagcattcattgaggacttcttttccactgatcctccccagggggaagtagggatggattactggcacgcagcacctcaggtcacacagccgacgcaggagacggaggccggtcaggggccagacgtgacaccacagcaggcagctagagataggcaccccctgataatttgacatatcccactgagcagattaggcgtaggaagaagggaggacctagcaagcgtgcgaagggcactgatcgtccttgacttatctatttgtattaaacttttagtcatttatgttctgtccgtactatttgagaaacactttacgattaacttagtactatcagtactatttcataaacttcttcggataattactcagtagcatacccttcgaatgaatcatgacaaattatcattcaaatatacaaataatgaaactaaataattcaaatattttaaccaacaaataaatactacaatttctgaccaaacattatcataatatatgtcacatacatataacattacaaaaatattttcctttcttacacactaaaataaattacatattattaaaaaaaataacttattacaaataaatggagaacacgaccctgtcgaactgctgtcgaactgcggcagttcgacagcccagcctgtcgaacgggggctgttcgacagccctgcctgtcgaacgggggctgttcgacaggtcctgtcgaacggcagccttccgatctcctcgccagtcgcgctctggccgttcgataggcgccctatcgaactgcacccgttcgacagggacctattttcgcgattttccccggttgaccactacttttgcgattttccataaaaataatattaattctcaaaaaaattccatagcggccatcccccgatggcagtagagtccagatgacgcatccacgagcgcaggcctgcggcgcgggccggcagtgtggggagcacaccggtggagtcggtagccggcggtgggcgcaagtggtggagaagagccctccccgtcaatggcgtcggcacagccaccagatgccggcggggaggtagcagccggcagcgaccagcagcgccggcggggcgacgatgttggtgacggaggccgcgtccccccggcagcggcagaaggagagcgtcgtggccggctggcagcttgccaggcggtcacgaaggcgggccggcgtggacggggtaagtggaggcggtgacggccttagagccgaagggcgtcagggggcgccggcgacggggaccacggcagcgcggaagacagcaacaccggtgggtggcctaacggtgacccgcgagtgctggcgacggagccgcgacctcctcctccagatcccgtcaacaacgacaatggcaggtggccgtgtgttcctttactgctgcttgacgatgaagacaccaagacgtccaggagatcgatttctcgacaatagatgatgacgaagacggaccgcgcgagtggatcgggattgatcttctcggcggcgaactacgacgacgaaaaagaaaagaaaaaaacgggttggccgcccccgggagatcaaaacccccaggggtgacaagcggaagcttgagagaggcgactagggaagcttgagagaggcgactagatcgcccgctctgataccatgttggatagcatagggagaggtatactgcgtaacgtgggacacattgtattgagcctcgggggccgatatatataggagtacatgggaaggatataagaaaggattacagatatggaaggaatccaaacaaaccaatcatatcctaatatgactctaactgccatatactctaacactaaacacagccttggtagtcgcgctgatcactgatcagccaagctttatggtcgcatcccggggttcgtccgctgaaggctcaaggtcgcagaccaacaacagatggatccgcgagctccatgtggttctttgggatgcatgcgatcctgcagtatatgttgatttggctgatggttcgggccactatactgtcagaaggctagcctgagtgcctgattccttcctctggaagtgggatagctcaaggtcgtactccacttgctaagcctatcttgctctttcctctggtaggatccctttctagcacttgctgatctggaaatctttcgctctccctcggtgccgctactttctttggttggtcgctcaccgaccttgctggatgaccgaccatctggagaagcgtgacctcccgcacccaacccattgtgtcttttgcgactagagggattataaaagaacgaagggattaccttgattcacggtcttagctttagagtaaaataggtgagcagtgcctccgggctccagcgtcggtggcagcgaatgccgccgccacgttcaggactccacctcaacatcaagcacaccatatcaacctatgcctccgccagcatcagcttgccgccgatgcacgccgtcgtaacgacatcatcccagggacccttgagcgtcatcgctagggttccacatttcggactgaaatttttgaaattttggtaatttgggacccctctgatacgatattatttcagccggaattttcaattttttaattttttcgtgaattttggtaatatttgttcacatttgactaaattttgttccaaatttcaggatcgaaattttcaagattttaccatatcggagccgcccaatctctagaaccgatttcaaggaccaaactctagcttcctattgggccacgtggagccctctaaatttggcaataccccctccaggaatccgccacgtgtccatttggaggaaagagcctggacgtttcatcgtgaaatgaaaaaaaataataaacgaaagaaaaggtgcattggcgtgtacagccgagtcacccgtgcatgccatggggcatggtggtccagtgcggttgctacagcagcacttgcattgttgccttctcaagctaatggtgcacacaaagccaagcataaataggataaaggaaagtaaagaaataacaaagagaaaagtataaataattttgcaaaatttatctgaataaataaaatacattatggttaaaaccgaaaattgagtcatattgatatcctatatttctacaaaataaatattaagaaaactatatacagaaatatggtgaaagtttggatgaaaaatttgcaatactaagaaataatatttcttcgaatgtgcattttattattgataccatatgcacgattttttggttaataaaattgccacaattttgaggaaacgttacgttttttttctaatagcatctctaatcatttgtccaattattggcaaacactaattacatcatactttggtttttctcatttatctgggacaaacattaaattaaattccattcttctgggacaaacacaaaattagtttccattcttttgaaagattttttttatgggttaaactaacttgtgtaaacatatattacttcatcagttccaaagttccaaattactggtcattctcatatttcaatttttagatcatgatcccatatctccacctttcatcaatgccacatatatccagtaatcaaagttaacattactattactagaaagggtttgcgcgctacgccgcgcagcaaaaaaaattaaacagaaaatattacagaacgattaggtgattaatgcatatacatgtactccgtcagtgatcatttacattgattaataaacaatatactaatatacaggacaaataaagtagctgcctttttctagtgagaactcgtggctaccggaaatggtccatttataagttcatgtgcattcttctctcctgctagttcaatccacaacaaaagcacagcagtatgaatggcagctttggtcctgcaaacatgaaatggttatacttatgtcggacgatataatgcacataatagtttcgttataaagcagcaccgactgaagagtgggagcaccaaactaaatggatcaaacataaaagaagaatatatattatgaaatatagcgcagtctccagctcttatcagtcaaaataaataagtaaataaaagaatatataatatatagaaatatgtaagagcagcaggaaaatgattatccgtaggcatcgccatcgtttggaaagcctttgtgtcatattaaactctgaaaagtgctctagaatgacataagaccaacatcccgtgagctgtttgtttataaacaagttgcccgttaaaagagtaaactatgcctgacaaaaaaaatcatgctagctagctacttacagggaaaccaagatttgcaaccattaaaattaaaccaccatacatagtactccctccgtcccacaatataagagattttgagtttttgattgtaacgtttgaccactcgtcttattcaaattttttttgcaaatataaaaaacgaaaagttgtgcttaaa

SEQ ID NO: 20055 - DNA, 1108 bp, Oryza sativa
ttccggccagagccgactcggcctgctgtttgttgccccagaggaggacaacatggagacgatcgttttgcaggatgcgcttgtaatcacgtggaactcgtcgccagacaccgcagatcttgcccgtggcattctgatagacactgagagtgcccgccaaggtggtctccagttgatgctcctccaggattacacccgcatcatcaacgaattgaatggcacgcggacgaccgattcgcgatgaggtgtagaaggagtagtatagattcttcttgtggaacaggaaacgggcggtggccaccacattctgcggattgtaggtggtgtacatggacttcatttcctcacccttgaggaaataggaggtgcggcccgttagcaacgcagcgtaatctataaatagggatcaaatgaaaggtggagataatccaggtgttagataaatacaatagttctcttgttaattaaatgtaggagctggtgaatgggattacaatttcccgcaggatttggcggattctattgggatctgggtgggtgtccggtacttttgtacttacgtttcatgttgcgctcttcctcttcattgggcacgggcacatccaaggctacatccgtatctgaaagatggagggaatacaaatagagaataagatgatgctgggcgataaggtacgaccttaaatggaatttagatagcaacaaatgcttcaaagcaaccgaaccgccgccagccattcaccatccatccagccagccatccagccagccatccagccagccaaccaactatccatccacaatttgtggacacaattccggcattcaaccaaaattccagttgaatgggtgaatggtgaatggctgaatggacgaatgccaggggatcatcatgaatggcaatgcaactatcaggtagagatcccacctccgaactaagaccttccatttccacctctcgcttccacccaggtggcattcattaatcgtgcataaattgagggcaggtagaaggtagagtttctcgaacgggaagtctaacctacatctaactagggaagtgctttgtatttgaggatgtgcggactctggggttctgaattcatgg

SEQ ID NO: 20056 - DNA, 33842 bp, Oryza sativa
  unsure (1)..(33842): unsure at all n locations
aattgtagcttttgtcatcacctacacaaatatcacttcacttttatcagaagtaaagaacattcacaaccctcgcggcaacacctagccataatgtgggaccttattttaagaaaaaatgatataatagtcactaaccaaaactactgcaccaaaatcgaaagtagtcacaataagttggcaacaaagagccggctaggtagtgggcttaactctcttatgctgaatgtacgttaactgatgcttggtgcagtctattttccctgcacggagaagtaaagcgatagaaatgaaattgctatggatccagatgtgatactgaagaggcaaccatcttaaacatcaaaggggataataaaatattatctggaacttatgctaatcaggtgtgaatgatgctatgtaaatcctaaatggtaaatgtaatacgcactaaacaccttgtttcatctccaggaactatgtgtcctgtaactgaatctgtatatagcactgaaaagtaagtaagattcagaggccccgcaaaaaaagtaagattcagaggcaatgcaatggcctgaacaaaaaaggaaaactgcaataagctagtattggtcagcagcagcacatccacatgacagcaagcatgaggcagagcaaagcagtacagagcagaggaggaaatacatatggagggatggaggaggctcatttcctcaaggcgacggagttgtccatgaagcctgggataacacctgcacaatcaggcaatagcagaaaggggaggaattgataagaatagctacattgccataactggaaaaaagaagccgtcgacagactacctgccagcaaaattaaaggtggaagctaatcatttaattgctgcttcttggcaaactcctgaatccaataaccgtggtgctggtgtgtcaccctgctgcagccctattgatgcactaccattccgtggtctggaagaccagtgtgggtcttgcactggcaaaatgaagaaatataccagcaacaaggctttcattgaaagcaagactgccattttgtctcatgtgattcacctcagcttggatgcctgaaagtagtgtttgcaattttgaaacttatgtaatacaatcaacgtaggttgtatccattgtaaagaaagtcaacccggctttttctttatgaatgtaggaaacatgcatggacttaatgaaattccttttttatgctggttttagatgaatttgtgtttcactctgtttcagaacaaagaattgcatcacaacaggctaaatttgtttcgagcagtgcaagaacatgtttgcaggaataggaccatgaagattgttgttggcaagatttctatatgcaaaatttggtcaacaattgcacagaataaaaataaagcatacaatgtaattcttagacacgataaaatttcttatagttcaaaaagctcaagtttgccaagttcagctggaattcgagctttgcacaggcacagctcttttcatgattgttacagggaggagggttgtcagttgatgacaggaggtcaggattagttgctttggaggtgacaggctaatggtcgcatttgctttagcacatctacatctttaagtttctattgaaaattagacttgtgatggtgatgacaaattcaatttcccttaaagttattttgagactcctccagtctttccactattcattcataaaaaacataaaagattggcatgtggtaatccatggcaaatgattacaaaaccacagaacacatcaaccatgaaactcaaaagtacctgcggagctagtccataacctccatcaatttcttgttcgaagaaaagtagctgtagagaaatatttggcaattgagagaattataaataatattccaaaattcaaaagagatgcagaacataaaagcttcaattccagagcaaccgaaggaataatcaacctcatatcttaaatttactttgtgcggctgaggtgactctgactacaatgcctgaccgagcttgttcttcacttattgttacaccataaaaaaaagagcacatttcttgtcaacctataaatagaaaaatatatgtggtagccatcccattataaacaagatcataacactggtagtggcggaacctttcctgctgctgatgatccaactgggagcgatctcaatgtatctgttccacttatagcttcttcaagaacattcaagacaaaaggagaactggaaggataagaactgaacctttgttgctcgaccaaaatttttttgttgacctgaaccattgctgaaagaatagaacaggaaggagagaactgaatcctttctaattcttcattataccaagctgtcacagaccatgcgcagaggatgtcggacccggatgcttgaaggggacaggtttgacggagatctcaacggccaacttctgccaatccgcttcctccatcctcgcgggccgcccgcttcttccttctccaccggtcaaactgtcagatccggcgaggaattgagctgccgaccacggagcggcgccgtagatttgggtaggagggaagagtggagcggatgggcagagtggagggggccggaggaggtgctggcagaggacggcggtggccggaggacgacgactgtaggagacggataggagagagacgagcggagaaggctgccgccactgcaggtccctcgccgccgctgccagaaggggagggagaagaagggaggggacacggcgggtcggcggcaacaccaacgacgggcgccgcatctgtcctccctcgtcgcaaccgccgccgccggcgcaagtgaagggagaaggaggaagggagcacctgtgccggctccgacgggcgcctcgtccgtcctgcccccggcggcgctgccacaaggtgaggtaggagggagaggagagggagaaaaggggggagggaagacaacggcgtcggctcgaacgcgccatccgccccgacgccgccgtgagggaatgtcatatcggaggatattcagacttgagattaccgaagaaacagagcaatacgtatttgtaaaatgcgctttagcttatgaaaagcgtaaacaagggtgtggggttgatatgttgggcccagtgggcagtagcgtgtggcgtgtatataagccactactgtagcaaatcggaaaactcgtcaaggaagaagaaaaagaaacacgaaacatctctctctcgtcttcttcctctgattcctttcccctttctcaagtctctcgttcttcctcaacgacggcgacttgtgctcgccggcggcgaggtcgtaacaatctggtatcagagccgaacgatccgtcgggcgtttcctcatattctctcggatcggcggtaaaatttttcccatagttcagtttgtggcttcccttttgggtgagctgcagtaaatctgtccataggattcgctgattttggaggagggacaccacggctccggcaaagcaaggcgttcaagtgcggcaagtggtggcggcgatgggcgatatggaggagaggctgatggcggcggtgcaagctctgacggtgaaggtggacaaggttgatgcgttgggtcaacagctgacgcagattgatagcaagttggagaagcagggtgcgcgcttagatgctgtgcagagcaaggtggatctctccatggcatcgttggggcaggtccagtgcgagcaagcgttgatgacgaaggctctcaaggcggcggcaacaccttcttcaccgctacttccgacgccgaggccgactttgtctcaggatgcggcatcgacatcaacacaaccaccacctgaagttgaggtacctgttcgttctggtcaacctccggttcgtgataattcggatgtgcaggggagacgctcttgggtgccaaagatggatttcccaaaattcgatggcacagatgtttgtgtttgggtggataattgtgagacttattttgcgctgtatcaaatcacagaagggtttaaggtttcagcagcttctctgaatatgattggtgatgcagcacattggtatcaggcttggaaacaggagaggggttggcctacttgggagcaattacgtgaggctgtactgaatgagtttgagatcaatatcaaacgtgctaagatggaagaattgctgttgttgactcaaacaggaacagtctctgaatatcgctctaagtttctgcagctggtatatcatattcggctgtatgatcctgctactagtggtttatttttggtgtcccgttttgtgatgggtctgaaagatgaattgagatgctttgtggctgctcaagaacctgaaacagtgcatcaagctgcccgagttgctttagcttttgaggtgccttttgcaatcggaaagtggccttcaagaaggatgtggggaatgtgaaatttggggataaaggaaaagttcctgtgggggatttgtggaaggctcaacagcttaaagagtataggagaactcatggactgtgctttaaatgcggtgaaaaatatagtcctgctcatacttgtggaaagacagagggtgctcagttaaaaactatggaagtttcttcttctgatgatgtgttaactgatgaaattttggatgtggtcactgcttttgaacagttaccggatgataacatgttattatctttgcaagcagtggctggtactagtgctactcattccttgcaattgagagcacttgctgggaatcaagttgttatcattttggtggattcaggcagttctcatagttttatcaatgcagatctctgttcgaaactgaatctatccactgatccaattcctgtttccacagtgaaggtggctaatggtgaaactttacagtgtgaggctcaggtttctgaattttcttggtggatacaggggtgcacatttgtttcttcattgaaagttttatccatgggggggcatgatatagttttgggtatggattggctttctaagttcagtcctatgacttgcaattgggctgacaggtggttggagttcacttatcaaggcaagttggttaaacttcagggtattcagtctcatcaactgcagtatctttctgaagtatcttctgaccaaatgatgaaatggcaagtgggtaatgatatttgggctttagctgtggtcgactgtctttcctctccattgtgtgattctgctgtacctgcatcgattcaggacgtattgcagaaatattcttcagtatttcagcctagtgctggactgcctcctcatagggaattagatcattctattcctttggttcctggtgccatacctgttaatagcaggccatacagatattctcctgcacaaaaagatgaaatcgagaaacaggttcaggaaatgttggaatcgggtttaatttctcgcagctgcagcccttttgcttccccagttttattagttaagaagaaagataacacatggcgtttttgtgttgattacagaaggctaaatgcaatcacaattaagaataagtttcctcttcctattgttgatgaactattggatgaattggctggcacccgtttcttttctaaattggatttgcgcagtggttatcatcaaatcaggatgaaggaaactgatgaggaaaagacagcctttaagacacatcatggtcattttcagtttaaggttatgccatttggtttaaccaatgcgccagccacatttcagtgtttaatgaattccatttttgagccatatttgaggaaatttgttctggtattcatggacgatatattggtttatagtccttccttggagactcatgcaattcatttggatacagttcttcaagtgttgcagcaacatcagttaagcgctaagttgagcaagtgctcttttgcagcttctcagctggaatatttgggccacattatttcagctgatggggtggctaccgatcctgagaaaactcgcattatgagagattggcctgttccaaccaatgttactgagttgaggggttttcttggcttaactggatattatcgaaagtttgttaagaactatggtgttattgctaaacccctgactgttttgttgcagaagaatgcaaagtttatatggacagactcagctaattctgcttttcttcagctgaaacatgctatgtgttctaccccagtgttagccttgccagatttcactaaaacttttgtattggagactgatgcttgtgcaactggtattggagctgttttgtctcaagaagggcaccccattgctttttacagtaaagctttaggcatggctaatcaaaaattgtccatctatgagaaggagttcttggctattatgatggctattgacaagtggagatcttacttattgagaggccctttcactattaagactgatcatcaatctttgtgtcatttagatgatcagatactaggaagtgaattgcaacgtaaagctatgactaagttgattgggttgcaatacaagtttcagtataaacgaggtgttgataataagtcagctgatgctttatctcgtgtgggacacttatttgctacggtttctggtccttatcctaaatggattcaagaagtggttaattcttatgcaacggatgctgatgctcagcaacttcttactgagttggctgtgagtagtcccaatgacaagggattcatgctttctgggggtcttattaaaaaacatgacaagatttgggtaggagctaactctggattacagtctaaattgattgctgtctttcactcttcccctattggaggtcattcaggcattcatgccacttatcatcgtctgaagaagctctttgtttggactggtatgaaacaagctgtggaggagtttgtgcaacaatgtggggtatgtcaacaggccaaacatgagcactgtaaatatcctggtttgctccaacctttacccattcctgagggttcttggcaagacatttcgatggattttattgaggggcttcctctctctaaaggagctaatacaattctggttgttgtggatcgttttaccaaatatgctcatttcctttccttgaagcatcctttttcggcttctcaagtggctgaattgtttctggaccgagtggctcagttatatggaatgcccaagtcaatcgtatctgatcgagacagggttttcactagctcattttggaagactttatttgctagatttggcattcctttgaacatgagtacagcttatcatcctcagtccgatggccaaactgaacgtgtcaatcaatgcttggaaatgtatcttaggtgtgctgtggcgaatactccaagtaaatgggctagctggttaccattagctcagttttggtataatacatctttccatacttcgcttaagtgcagtcctcataaagctctgtatgggtcagatcctagttatggtcttttgccgtctttgtcagttgaggcctcagatgaatcttcctcttctaaagatgccactgcattattgaaggctcgttccttttactccagtacgttacagcaccatttggctcgagctcagaatcatatgaagcaggtggctgattctaaacgtactttacgggtgtttcaagttggggattcagtttttctgaagttacaaccatatgctcaaacatctgtggtgaatcgaccttgtcacaagttggctatgaagtatttcggtccctttcctattttggagcgtgtgggatcggtggcttataagttgcagcttccaccagccagtcaagttcattctgttttccatgtttctcagttgaagccatctgttccttctcatgtgcccgtttatacttctctacctgatgtggttgctttagatgtggaggatctgatccctactgaaattctggattgccgtatggtcaagaaagggaatgctgccattgtgcaagtgcgagttcgctggggttcattgccagataatatggcgacatgggaggattatgatgtgattcgtactcgttttccagcagtttcagctttgggacaagctggatctccggcgggcggcactgtcatatcggaggatattcagacttgagattactgaagaaacagagcaatacgtatttgtaaaatgcgctttagcttatgaaaagcgtaaacaagggtgtggggttgatatgttgggcccagtgggcagtagcgtgtggcgtgtatataagccactactgtagcaaatcggaaaactcgtcaaggaagaagaaaaagaaatcacgaaacatctctctctcgtcttcttcctctgattcctttcccctttctcaagtctctcgttcttcctcaacgacggcgacttgtgctcgccggcggcgaggtcgtaacagggaagggagaagaaggggggagcggggaaccggcgacggctccaacgccgccgacgaatcgccgatcggaagggggagcgaaaggggatcggggagggcgacgtggggaggggagcgctcgtcgattccacgaccaggtaaggacggaaccacctaggaaacgaacggccagattttgtccacgcgtgggaaagaaaagctctgatcacgtggactcaatttgaaatatgaaaataacgaggggttttgtgcaaaatttgatgacgtggatcggctgggcttgcggcgactctagcacctttaagatatctagtactagtattagaatgtactaaatgagcatgataaggtaatttgccgcatctcctcatttgagacgaaattgtctagagtgataaataatctaaaataagaggtaagcaaaatttatatattccatatgagccctaaataagataatacatataccagcacgccaacaggcgtgtagattttctagctttgtaaatttggcattgccccctcaaagaaactgccacatgttcatgtggaggaaattagcctaacgtttcaccgtgaaataaaaaaaaaacattggcgtgtacagtccagcacgcatgcctgcactgggcctggttgtccagcaccgctgctacagcatttcttgttgccttctcaggctaattgtgcacacagtaccaagcagaaataggataaaggaaagtaaaagaataacaaagaaaaatatataaatattcttttgcaaattttatctgaataaataaaatacattatggttaaaaccggaaattgagtcacataccaaaccatattgataccctatatttctacaaaataaataataaaaaaactaaataatagaaatagggtaaaagattggatgaaaatttgcaatagtaagaaccaatatgttttcgaatgtgcagttttactgttgatattgtatgcacaaatttttggttaataaaattgccacagttttgagggaacataactttaacattttttttctaatagcatctctaatcatttgttcaatcaggtttgctataggatactcaaaatattgtataatttgctaatagagattgtaaaatatgtcacggtttaaatatgcctaaaaaaccgataatttgctagatgacacttccatttcaattggagagagaaaatattcaaatagacaataatacccttgaggccacatgcttcaaacatgggcttggagtaatactttaaaaattatgcaactctaaacttgccaatacctccaattacatcgcgaacatacatcgtatttctatcttcacaacatccccaggttagaagcttttgttcctagaaaaattctcatctttttgaaaagtacaaaaaaaaattaggtgttttatagcaaaatttgccatcaaattattggcaatcactaattacactcctacttttgttcttctcattcttccgggacaaacataaaattaaattccattcttctaggacaaacacaaaattaaattccattaaccttttgaaagattttttatgggtgttagagtaactcatgtaaaaatatattacttcatcagttccaaattaccggtcattctcacatttcaattgccctatctccacctttcatcaatgccacatatatctggcaatcaaagttaacattacttttcaaaactattagaatgtagtaaatgagcataacaatgtaatttgccgcatctccttatttgatatgaaatttggtagagtgataaataatctaaaacaagaggtagataaactttttatattccatatgagccctaaataagatatacatgctataaatttactggtgcgccaacgggcgcgcatattttctagtacaactgaaaacgagaaattgaaccctgtcatcgcgccccaccaccgccgcctgcatccgtgtagtgtatccgtcgtagacagagtgtaccaccggcatgaatgcaccgccgcgtcgaaccatccatccccgccgttgcgaccggtcgggtaggtatttccgccattttccggcgtaggcacggaacagggcttcgacggttgacccgtacgtattttgacgcatacgtacgggccaaaattaccaacgccatgtgggccgaaattactgcaacctatgggccgaaagtacaagaagctacaggccgaatttaatctcgccaatcggccgatgagctcaaactactagcgcgtacggccccaattacaagcaatagtgggccaaaattaccagctcctctaggggcgaaactacctccatctatgggttgaaaggaaaaagtagaccgaaggtcccaaacttgtcatcggcataaaaaacgtccttagaccaaaaaatcagatatgcaggtcccttaagtatataaaaccggtcacccgagatccttcagtgatttcaaccccgattttgatctacgtggcggctgagtcagctttagacccacgtgggctccacatgtcaggtgtccacatcaccctctctctttcccctttatgtttctttgtttctctcctcccttcctctcactctttgctcttgcactcgcaggacatggggatgctggcgctaggacgcccacagcggcgcgcggcgccggaggatggtgcggccagcgacggcggctcctagggcagcgcgagcttcccccaggcggcgcacgtgctcagggagggagcaccgagaaccaatcccgcagcagcctccaccggctcatggtccagcacgacaacgtgctcgccacggatctcctcgctgtgctcgccacggacctccccgcccagcgccgccgcatctctttgtcatgggccgctacctcggcggtgccgacgcgtgcgccaagcttgtcgagagcgacaagctgccggtgatggcgaagatgctgggggaggaggggctgatgcaggagctcgctagtggggtccggatgctcatggacccggcatggacgatgccgtggaggtggccgggagggagaagcgggtcacgccatcgatgcggaggcggaggaggaggaggacgccagcaaccgcgccgtggcgggatccggcgggggcgagggggacgctgacgccgacgaggaggagaggatcctgtcggaaggagcgggcgcggggcacgccgnnnnnnnnnnnnnnnnnnnnnncgccgacgaccaccgggagaagcggggcacgccgacgccgacgaccaccatgcccgccgctagggggctgccacctccacagccttcgtctccgcctccgccaccaccacctactggccgccgctccccatccaccggcctccgcacgctcgcccgcctgccgccaccgctgctccgcgcctccactccactccgcttcgctggccgccgcactcgcacgccgcctccgctggccgccgtcgcggcgctgtcctccttctctcccgcctcgccccgtccagcttgcagagaagtgagagagagagatgaggaagggagagaagaggggaaagatagagaagaggctgacatggataaccctgatatgtggggcccacgtgggtcccacggtgactcagccgccacgtagactaaaaccgaggtcaaaatcaccgaaggacctcgggtgaccggttttttatagttaagggacctcgcatatctggtttgcggttcgaggacgttttttatcccgatgacaagttgaggaacctttggtgtactttttccttgttgaaaatacctgcaactacgggactaaattagcagcgactatgggaatcatgaagaaagcacgtacaaaaaggatcgagctagcctgattaggaaattaaggtgaccctattttggtgctataatgtaatctgtcactacttggtctgctaccaaattttgaaacacaaaagaaatattttttttataataccaatttcagtactttattcgtcaccatttcagtattcaaacaatgtggtggcctattgcctatgttcatacaatgatgtgtagcaaatacgtaagaactaaaaagtaatttacatgtaattgaccgcactgttttctcgactctattatgtacttttcaagaatctgaaatctagcgaataccattaattctttgaaggacggagattacatggagaagaaacagcgaatgtgattatggacgcgacattgaggtatatacttttcttcatgacttcatttcaatggatttttcttgctccccatccgccatgtacatcggaagagaagaagaatgctaatttcaagatcaaaacactgagatcgatcaataggctcggttgttgaatgagtccgacttttgcagcctaaattgctcgtagaatttcgcgatgaactcctcggcctgcatgtcgatcggattcgggctgcatccaccgtcctccgtctccagagaattcttttcttcttcctcgtcttcttttccatggccattgacaagctcctgcaggtcctgggcggacgagtagctgctggtcatgctcgtgccatcgctcctgtccggcgacggcggcgggtagtactccaggtggccgtggaggcggagcgggcgcatgccgtcgacgaggttcttccacgacgcgacgtcgctggacgacctctccacgtcagccgccgcgccgccgccggccgcctcggccttcttctgatagcccatggtggcggcggcggcggcggccctcttcttgatgctggcgctgccgttgaaggacatgaacatcgcccggaagaggccgaacgcgccccgcttcttgtcttgctgccggcttccgttggaggaggcgctcctggcgatggcgatgccgtccgtctcctcctccttcatcgtcctgtcgtcgccgtcggttctgtccatggaagcagcggtgatcatcacaacatgatttgtctctgcagctccattgatgtgctccttctcctccgtgctcacactagggatgatgatcacattgtcgccattggtgatactgtctaccttggggttggaggtgatagatagaacttgttctacctccatgggaggaggtagaacaaggtaggggagggctcgaggccttcgagggctaaggttctcctccaaagcgaagaggatcgccaagaacgggagttttatagacaacatttgtcgaggcagttgaggccttgagggtgtagtttgcgtaggttatttttagctctatattttgtggtcagtgtggcattctgttggagagtgagaggttaattctaggtgcattttgagaggttcccaactcccaagcatggctcaattttgttgagagaatatgcctcaaattgggcctctgatctcgtctacaggcctattcactttatcgctattttcaatgctatcaaaatttggtggtactgcaacaaactaagcatgagcttatcaatgtcattctaccaaaatttggtagttcccaaaaattcctctaacaaaaacgtcatcaatgtttggaaaggtatccaaccaaacacattcaacgctatcaaaatttggtaatgccaaaacgcgataaagtgaacaagccctatacattcatgcgccaaagtaagatatatatagtaggggttgacattcaattagatcaatctttattttatttttgacattccggtcataaagaccgagtgatcttgaaaaataataaagaccaaacatttcagtctctatcctgaccaaagttttagaaaattcaaaagaattacacaattcccttataaattttagatcaaaacaaattaggcacacaaaaatcgcatatcctccaatgttggccggtgtcgtcatcgtcgttggagaggctgagtgaaggaagagcctctagaggagatgcagctggcgggcatgcctcaagctttggatgacgttcgagtgtaggccgggttggaggatagtggcgctgactcgggctcgggttcttcggcatcgcagtagaatgcaacgctagctcggtcctcaggcagatgcggagaagcggtggcgcaacttccaggaggtgacacatggcttggttgtcaggtagaggcggagtaggcagcgcgggatcgctcgtcaggcaatgccaagaggtggcgctccgtgtggtgtctaggtgagtggagaagtggggttgattgggatgggtaagaaagtaggatttcctctgttgggcttagagtgcgttctaaacaactatgtgaaacaactacttcatcactttctattaacaatcttctcgaattgctaaacttcttaacatagaagtttctttaaaaaatcaatcccagcacatcctctttctgaacgaaaccttggtggtctattgtgttgttaagttatttcaatcaatttggttagctgagggtgatgatcaaatcgacaaaattttgaataaaattcggttagtgacatgttgagaccgtattagtaactgaattgctctatctcggttccaatcttttcagtttggttttttttttttacccaccctagctagtaaaactagtgtgggagaaagaagaattgcatctactcagcctaagtatggcctacaatgttatggaaaagcattactcagccggctaggcggctataaatatttagcatgtaagaaaaagttgatagtattttcaaactttgattatcaatttagatggtgcatttttaatttcaaatgctttatatgactgcttttttttatttatttgtaagtccttttgcagatttcaggactttgtgtctatgtgcttatcttttatgagccttcctgtaaaacgaactgcccttgcatttcaactatcagtctatcactaaactgtattgaggcgttagcctcaatgtgtttttcagaaacgaaggaacaaaagcattcgaaaataattaataagtacagcttttttatacttgtgttattagttgtttgccaaggcttacaaataaactacgttgaaggacactctaaaaattaagttttaaacttcaatttttagttgtggtacataaaacaacaagcaaacaataataaggaacaaaagttaaggaaaaaaaagaaaacgatttaagaaaggtggttttgaaaaggtaagaaaatttactgtttatcatccttcgaaaatactagtttccagatatcactctaccaaattttcgttttcatttgcccctcaatccgaaccaattctcttccgcaagccactcctagccccattctcactcacgtggttgttttttcatattggtcccgtccaacgtggaagcacgataggaagacattattttttaaaaaaagaacgtgggtgacaataggagtaaaaatgattgttggcaactttttttagcaagaagacaatcacgatcgagacacctaaacgtcttacagtgatatggagtcgccaaccacctcgatctagccaaaaggccaaatcaagatgggttttgtagaaaacggctaaaccggctagcggagccgatttagatatcaaaatcagcctctaggccgatggccgatttaaatcgatatgaggataaatacccgtctcatgggaaacggaaggtttacgggacaaacctacaaaaggggtaatcgcactctcgtagcgacaacagacgatttacggtgtaaatcgataaagatggataaaaactagggtaaagtagaaaacatggctgaaaagtaaaagataagaaaacgattcgattgatctgtgtatagactgtgtgatacattgtttgaaccggccttatctcttaaacaggggttggtctttccctctacaggccctcctatacgtccaacttgggtagacactaatggaaacccgaaacataccttcccgagcaagaaaacatgagacctgacgaaaacagactcgggctcggattccggtctgactggccctttggcggcggtctaaccggcccacacatgacgatcagaccggcccttctagagaaaaccagcagagttcctatatttggattttttcctatttcgacccttaaatgtcaaatttgggtgtaaatagtgatgtgcgggagagagttagtgaggatcggccgagtggtaagtttgaacgaaaatttgggtgagtggcagttgagggaggatggcaagatagtaattttttccacgaagggaagaaaggtttgcatcaaatttgcgaggtaagtaaggtacctacttttaaaaaggtgttgtttgtgtgtaaacgtcgagaggaaatcttcttaagaactgtgaaatacaactacatgataatataatcaagatgtcatggggtaattacagtaaaactaacatttaattattgcaatataagttgaaaacacagccacctagtggagagctgtgcccttgcccgcacatgatattttgattttcccaaactctcaaacgctttatgaaactttatattcatgatattcatgtgacatgtgtttttataactaagattttaatatcttagggcaggtgaaatatctactattataaaaattaaaaatgtttttatcggtataagtcaatccgtgtttaagtcagattttaacttcattcatttttataaaaacagatccatgtttaagtcagtttttaagttcgttctttttaaaactcatatgacaatcgattttgcaaaaaaaaaaaaaatcaaacaaaatcctacagtgatttcaccttgctaaaccgtataataataataagattaaaatagttttatcctttgcaacacacagatatttttaatagtttaataaaaagaattagaagaagcaactattaatttttttttgtcagcagatagtccgtataacttcgtttcgaaaatacgcgccggccgaagattctcggaatgggaactgcgattactgttcgccgccaacctttccagcaaatggcccgccacttgctgacacgacatgacccgcgcaccaaattaaagtagcctcgggaagaaaagaaggtccattggaactggcagcaaagctcgccgagtacgagtagaaaggccagtctccactcccctctccacttctccaggcctctcagattctcacgaactcacagtagcacttatctctccacagggaggaaggagaagctagctagccgccatggtggccctcgctgactcagcagcggctaggaagctcctcctgcatggcgccgccaccgacgccgccgccgtcggcatgagcttcggcctcgacggcctgtggcagctcatcgccggactcttctccggcctcgtccacctcctcctcctcccgttccaggccatcgcccacggcttccaggccctgggccacgccatccaggcgctcttcgctgggctcgggaccgtggcgcacctgctcgtccaggcggccgtcgccggcattggccatggattcgacggcatgtggcatgccatacagggcttcttcgccagcatcgtcgccgcgctcgccggcgcggcccatgggctcgtcctgccgttcgaggcgttctggcggtggctgcagacggcggcgggcggcaccggctctggtttccaaggattgtggcagaacgtgttggccttcttcgccacgctcgccggcgccgctcacgacctcgtccacccgttcgaggcgttctggaagtggctcaggaccgcggccgccgacgccgccgccgacatcagcttcaggctcgacggcctgtggcccctcgtcaagcgcctctacgccagcctcctcgccacgctcgcgagcgccgcccacgggctcgtcccgctcctcgagtcgctctggcgggggctccgcgccgcggccgccgcggcgctcccctacgtgctagtgatcgccgccgtcctatgcgtcgtcgcgcttgtctggctcgcctggccgttcctgttccccgccgcggcggtgatcgggctggcgctcgtcggcgtcgcgggctgctgcgcgttcttactgctcgccgccgccgtcctgatcgggcgggcgctcgtctacgccgtctgcttcggcgttgtcctcttattcgtcgccgccaaggtggtcggcaaggtgctcgaccgggtcctccccgcctgcgcgcggtgctgctacgacgaccgcgtcaccaccaccgccaccaccatgagcgctccggacgccgccggcatggacatctcgcgagcagcgtacgagtcactcccggagctctacgcccagatactgcgctccgccggccccgtcgtggccgcagccgtcttctgctcgcatcccgtcgcgtgggcgtgcgcggcgccggtcgccgccctcttcctcttccgcgccctggataaacgcctccctccaagcgaaccctgcgtcctccctgcggctgcataccctgacactgtcactgacgtgtcggactcacgttccattggccagcatgtcagcgaagatgatgacatgtccgactcatgttccatagtagacccataccacggcgagcacgtcattctgactatacgccagaggattcacctgcgtatacatgtcgtaaataatgtctgtcccgtgtgtgcgctagcttaacgatggttaatgtaaaccggtgctatcgatcaggtgatcaatgttggtttgttggcatgtttggttgtctcggattaccacaactcaacttgtcttgtcataatgttaaaaaaaatggactaagtgtagaatatacggagaaccctacatttatggggagcggattctaatccctcgaggagatatccccccgtatatctttttctttcaaatttaatgcaaatagttggaaaaattctaaaaaaaattgacaatgtagagtataatgatacctactaatccaccaaaattcaagttcaaattcgatctacacatcgagaaacaaaaaagataaatttagatataaacagtacgggactattcatatgctgaatttatcttttttatatctcgacgtgagagttgagtttggacttaagattttgtggagttgtatatatgtgttgtatgaatgttgtcaaatttttccagaatttttcataaccgtttagatggtttttaggtaaacgagggaatatcccctcgagggattagaatagttccccatatttatgttactatatttttcataatgaatattatttaacgtatttacatgataagtcttaaaaagtacattgtaaatttaatgtatttatattgtataagccaaaaatcatattgtaaattcaaatcttatattgggaaaaaaacaagcaaaagcagatagcaaggtgcggcttgccgcaacagaagaaatcaaacggaactaaaaggctcctgtacccgcagagcaatcggacggacagtgaaatagatagagattcgagatcaacctagaaagctatcaaaaacattttaacgtttccaaacttaaatctattataaattaatcaacaaaccgtggctcgactacatttggtatcgaaatgtggttcttaatttactagtataatgttattatcagtattaatttactctttttagtgccaaagtgtggtgcggcgcacttttaacaaaaaaaaaagtgatgaaacgaggtagcaaatttagcaatcacttcatcgaactataagcggaagatcgatagataaattcgatcttaacgggagcaaaccaagcagcttatttttgcttattggatgatcatcccgggtacttttttttttttgccggcggggttttggctctgaattacatgtccgcctgtgaaaatcgatcccctacgatgtcgaaaatgagttttctagtagtgtgaatgcgtatgtttttcaaatttttaaatggtgcgacttcttgaaaaccttcgataagagtaaattttccagagactgttttgaatcctttatagtaacagtttaattcactattcatgtgtaccctaagagcaagtttaatagtatagccaactgttagctccaattcaactatagctaatctaatagctcatccatacaatagttacatactacactagtaatacctggtcccacctgtcatacacatactgcgtcttggagtccgtgctatagctggctacaaatctatagcccgctgctcttctctctccttatttatctccttaaaatatgtttgcagctggcttatagcctgctattgtacctgctctaaataactatcacagatgatttatctattcaatcgttcgtcacaaaacaacacagttatactatagaaaaaatatatcctaaatgcttagaaagcctctttatatttgtattgtagtaagtcagtcattatttacaaactgatatggagtaaacagttctaataggcttatactccgtctgttacaaagtacagattaattatttctaccattcaagttttgtcctaacatataatacaactgtttttccttataccccatatctcaaccaatcataattctttcatactcctatttagtttcaactatactttctttaatacttgtgtcctacttcataatgcttgtgctaactctgtcccaaaataagtgcagtcgtaggtgtccgtgtccgtgtccaacgttgtttgactctccatcttatttaaaaaatttataaaaaaattaaaaagaattagtcacacataaaatattattcatgttttatcatctaataacaacaaaaatactaatcattaaaaattttaaaataagacgaatggttaaatattagatatgaacagtgcaaaactgtatttatattgggacggagggaatactttcgggtcactgagttagagcagcagagattttagtaaaatttacggttttatcactggcagggcagtcctgttcaactgtgtatgagtacaatagacgaatcttccaaagtttcagcaggcactttacttacaagttaagctaacaacatgcgccgaatcaatgcagtctaaagaattaaagttacttttcccccttctttttcattttttcgaaagcggacagtatacttcttttatggttcgtagtactccagttgccactgattcattctttccattatatgttgaagacacatacatacacacacaattgcatacgtagatacccatcgatacgttctctaacactaatgaagaaaccatctataatcggttgcttaaaaaccacgataatcccagctgcttaaaaatttgggactataaatatttttagttccggtttacaagcacaatgggattatgtgatatttagtgccggttagtaacaccaaccgggactaaagacctaactttattcccaattggtattactaaccgggaataaaaatcaaaacacactatataatcactagtacttatcctcttctcccgttcatatagactcctctctgtctcttttttccttgtctctttttgtcctctaactgagagctgagccttatctttttccagccttgtctccttacttcattctcagcgaaggagcggatgggagcgagcattggaggaggacgccgagcaaccggcagcggtggcgggcggcggcatgcgcggcggggaggggaggaggggatgcgtgcgcggtggcgcggagggccgcacggcgctggctggcacggcggcggctggccgacgtggaggggaggcgggtagcggccggccagcgcctctaccggaggggagacggcagcggcatttttttttttttgagaatttttgattcattgtataatcctatgatgtatttgatttgtgtgtgatgtgaatatctgatgtatttgtgatgaatttttagaacttgtgatgtaattttattaagaatttgtgatgtatttggagatgatccttttgatatgtgatctgtgatgatttgggatgtatttgaagattatcgatttgaggatttgggatttcacgatttaaggatgatttgaggatggagtgaaatcaatattcaatgttaaaaacaatgaaataaaaaaaggaacaactggacctggcctaaaatggatttttactcctagttatttcacccgggactaaagatggccatttttagtcccggattcgtggtcccggttatataaccataactataaggggttactaatcgggactaaagcccctttctccagtagtgtatcatacctacgtagacaaaaaaaaaaaaaaaaccagcagcaaccctatagcttactagtaaaatttatacggagtatatagagagacaaacgtcaacttcctatagcatcacagagcgcatgtacaccagcatcactgatttgagaagtgtgtggaatcgtgcacccttaactccaccactacactgtgcttcttagagcaggtacaatagcagctataaacatattttaaagggataaagaaagagagaaaaacagcgggctacagatctatagccagctgcaacacggactccaatacgtaatgtgtgtatgacatgtacccagatattaatagtatagtaagcaactattgtatgaattggctatagataatttggagctagcagtgggctgtactaaactttctcttaggatgtcaatgattttcgttgcatgttttctctacatatagcagttcctcgcttgtcttcttcttcgttggaaatggatcgaatgcccttcagagtagatcataagtcttcccattttcacatggtcaaagtagttatttttttttaaaaaaaatagataaattattgtgtgacacatcttctgtaaatatgtaagattaaatttgatttatgcaaaagaaataaaaaaaattagactaattggtacaggatatagtatattctagaattacgaatttggataattatatcacatcacatattaggtttattaatttattttacgacgtagttgtatacatacatacgtggtccgtgtgatagagtagtggtgatgggctctcgggccactggacctgtagcgtgcgtttagtttgtccgcaaggtcatcatcatagtgtgtttatttgtaatgctagctccattctctgtgatatacaacttcggggctccacatagagtcctactacctccgtcccaaaaaaagacaaaccctggtttccgtgcccaatgtttgaccgtccgtcttatttgaaaaaattatgaaaaaaattaaaaaaacaagtcacgcacaaagtattaatcatgttttatcatctaacaccaataaaaatacggattataaaaaaattttatataaaacggacagtcaaagttggacacgcaaacccagggtttgcctttttttaggacggagggagtaagggtgaaaaatattgacccgtcccgcgcatagagttgggcctcgccctacattacctgcgtgtgtatatttggctcagacttggccttgttggggcgaggatgcagcctcagccaagaaattgccaccgctctaccatccattcatccaccatctaacagctcaacacaaatcaagcaaatcgatcagagaggcttctagccttccactatctttttccatcaagtaacagcatgcaggcaacaaccttctgtttctcttgtgaattaattcaggtattcgcctccactctccgccgatcatctcatccatatagttggaacatgttgctcaatggttattattatttggtctttgttcagtttgctaccatttttaaccttaccaagttttggcaaagttaaaaaaaaagtggctacatttagtttgttgctaaattttagtaagcacatataaaatgttgccaaaattttggcaaccttacgaaaatttggtaatgtcaaaatttggtaaggttgaaaatggtagcaaagtaaacaggtcatttgtctattttaagatccacagctgctactcgctcatcgcatttacggttcatctatttatcctcttgcccaatcccatgtactggaattgatgtcaaggagtttttatttcagtttggatggtgtaagtttttatttcagtttggatggtgtagtacctacagaattttgtgctaaaatctatgtgattttaaaaacattatttcagttgatttttttactagcggaagttgaggatttgtcccatcatgtctttttttaattcctttcttttctacttctgagacttgttagctatgtgcccatgggcagaagcaggtgatctaatctatttccattattaaaaaaaatacgtacaagcaagagatgagcacaattatttacctggctctctctccccctcccctttgatctctttaggctgcacatttatttactaaatagatattgcacgtatattcgctactatagaaaaggcaataggtgtcggttgggaaccccacagacacctagaaagcgacactgatgtgaagagaaaatatgtgccggttctggtgtctgtttagaatcgacacctttaaggtgccacgaataaaaaaaaagacagctcgatgagccgagcaattccccttcatcccaactaatccaagaacattcaagcacacaaagaaccctaagaatatccaacaacatctgctgttgccccctccactccagtcgctgccaacgcctcctctcccctactctggcggaggggaggacgtcgccatgccaccgcctcccctcctgccggatctggcggaggggagggtgtcgccactaccatggatgggtgtgttggatggagtaggaggagaggagaaggaagaagaggagaagccttacttattttttaattaggtgtaggtatatggtaaaatctatttggagagacctctcgcttttaccacgtccatatatagatatagatgtataaaaaaaaaggggtcaatccgtttccctgtgaatgtttacaagccgttgggtacggctgcctctgcctttacaggactaaattaaggaagaggatacggtttccatggagaaaggttgtgcttttttccgagctcttggcgtttctcctgtgggaagaatgaataatcgatgccggcttgcagggccccatttctgttattagtcaaggctattgatcattctacttaactagctagacatttatatagataattagatattgccaatggctgtggttgattgaactctccagttaagcgcatgtacaatggtgcttattaatatactatctctgttgtcatggaagtaaatttgatagttaacatgaaagaaagagaaatattgttgctacgcatgacagcaactcagagtcagctcttagtatttctctatataggctacatgactatagaggctgcttatagagaaatgccctatctgtaggctacatgactctatccgttaagatttagatataatttaatgtcattaaatttacttgcataataagagactctgataacaagtatactttaatatgattttacatatatatactagctagatgcttgtcacattcgctgttcagtctgtgagtgagtttagtgtacgttcgtacgtcttttatgcgattgagtgaaaaagaaataccgtagagggcagactaatatcaagttactaccttgcaagcttgcatccgacgtgcaaaattgattttgtgataatattttgaaaattcaaacaaatgaattgactaatataaagttaaaaagttattttagaattactgttctgagaaacttatgtacagagaatttttacaaaaatcgcatagcttattatttggaaagtgtgggtgataatctacgagagaaaaagaacgggaagatggtccatcccacctaggggtgaaaacggtacggaaatttccgagaattccggctaccgtttccggtttgcaccgaccgtttcaatcggtatcggtaattgtcggtatcggaaatggaaacggtaatctttttcggaaatggtagcggaaataatatggggttttttccgaccgttttgtcggtaaccgttttttatcggtaatttccgtcaaatttccgacaaaattccgaagaaggaagtcggctgggcctggctagcaggaggaggagcccattaggcattaaggagcagcccattccgaataaagaagccaactaggcctgaccgcatcgtcgtcttcatcggcgctggggcaccgccgcgccgtgttgggcgccgccaccaggtcgccgacgccggccgcaacttccttcgccccgacggcctccgtcgcagccggccacctttccctcccccatgctccaccgccggcttccgtgccaccaagccaagcgccgagcgccgccgcaccgccccagcctcctcctccccaccgatgccgcccctttctcctctctccttccccccaccgccgccctgcgccaggccgccatctccggcgcctctctcctctcgggcgcgcgtgaaggagccaaaggcagagaagagaacaagagagaaaacagagaagaaatcgagagagcaggaaaaggaaccgagagaagggaaggataagagagagagaaaataaaagaaagagaggaaaagaaaggctgtgggatccaccggcgggccccaccatcttgactcctctctgtgatcgacctggaaataccaaaaagtctagtttagcatgaaacttaattacaacggtagttatacagtgtcaacataaaagttcttatgcaatgtgccactgtaggacgacgatatagctatgtcaattgatgatgaaataatgaatgatatttgacaaggagctgatcagctgaagccatgccagcttgtgagcttggtgttctcgaagacttcaaatctatatcctaaaaaaagtcggacaatattagttatgctgtaatcctatcatgtaagccacattgtatgctttagccacattgatgttgaagtatcattgaactttatttatattatttgtcaatcttattgtcaacttattaatcatcatataaaggtgttgtgtggcagcataatgatgcaagggtgaaattataaggttatcttcatacatagttaaatgcgggatgataccacagttcgctgtttccgacatgaattttcgacttccgtccgatatcggtatattcccgttccgacggttccgtttccgagataccgatataaccgatatccttaccgtttccgagtatacgttccgattccattttcgagaaaataaaatgaaaatggaaatggtagagggtttttccgaccgtttccgaccgttttcatccctaatcccacccatgacgtatctataagatcatacacattgcatcatatttgttgcgtcaccgccgtatataaactttataatatattaaagtaagtttgatgctcttactatagggatgatgtggctttcgatcttagcaccctcctttttgggtattttctggttttgccaaagcaaaggaatcattagtgcgattaccagtcaatgaaaggtgacctccaacaaccgccaggcatatgattactgtcactcctattaaaattcacatgttctttttatgtgttataaatggaccctttgccattacaaatttaccaatttggaaaaatatcactactattcttgaaaacctactatatgtcactgattttttctaaaattcaaatcatgctattgccgtcaagtttgctatcatcttctctccgagaccatattccatctatgcttacgacgagcgtggagaggccgatgctgtagcgctgggagcaggagagatcaacgacggagagtaatggtgcaaaagagagtacggtgaaagcagcgtcgggagggcgtatgagagtcaacgcgatgacttggatttatcatggacacgagtacatataggcacaatacgtccttatctctataaccgacttataggaacaaaatcgctaaaaaatcagggaaaccggcccggaaaagatagttagcgtgcgcgccgccaacgcgcatttccagcccacgcggcccacgcgcgcgcccttcttttataaagttttatctctctatttgaagatgttatattaaaataatgaactaggtgtcttatagtaaagtgccacaacactagagtaccatatgataaagccgtaaaagtagaatgtcctagaaagttagtgttctaaagtaaattttgccttagtataatttccttttgtctcattttgtctagagcagccaccatcagatcaggtacacccatcacttccatttccacttctgctctgcgatggaaatcctgatggtggcaggagggccggaggggcaacggtagataacataagaagatactagacatacaaggtttagagtggagatgaagctagactgttgctaaaagagagggcgatgaagtgtctactagagccatattttctccggcctattgtcgcgtgcgcgggtgtggacatcggctgcgcgatcgtgtgcggtgacgtcgagggcgctagcacttcgcgcaccgaatgacgcggcacgccctgcgagcagcgtgctcgggtagggcatgggtgacgcacgtcgagacatggtgttaggcccttcgcagtgcaccatgctggtgagttacttcttgcctccacctaggctgcgtgatgccgtggagaagagagggtataggccctcatcccttgacataggttttcctctttcaacaaagatgccagttactcacatgaataaggtggcgaggggggaaatgcatgggagagccgccggagcaagcaggccgcgtagagctcgtcgccctccattgccgacaccactctgcctcactggctcacaccttctttgcctcaggcagatgccgttcctcctcaaaccgccttgtcatctcctactcccgcgtcgccgacctcgccgctgcttcggggaaggagagaaaaggtggtggtgcgctagtggatctaaccgccgcttcgcccggtgtcattgtcgcttgggtcgccgcccctccgcccaacactgtctctactcgacgccttggcttcctctgcccggtgccatcgccgcttgggtcactgccgttccacccgacacaaggattttgattagcctagaagggtgattgagaatgaaacattggatctgttggttactcacgtggagagtacggatgcgctaagtgggaggagaggataaaggaattaaggacatgttgcgctcaatggagatagtagagaaaggcaagtgcataacatataattgcaaataagaaacacaagaaagaaaaataaaagaacgacatttgaatagttcacatgaaaaactaaggatcagacaaaacagactgagtcaaaacccagaggttagagctcttcctaacttgtcataagagtatatatgatacaattctttattccaaagggctaggatttttcccacaaaataaaatcatctaagttttctttatttttcctacaaataaaaggaggcttttaatttaaaatttaaggacttacacgataaggcatccatgcccaccctttcaacccaactgttgttttgcctctctactttttagagtttacatttttgcactatttttttgaaaacaaaccagccatttgcgctcacttttgacgcctcttgggtgggtcccatggtttttagtaacataaatacaaacggaaataaattttttttctacaatgttgaattcccatactcccgttcctggcccgtcaccacccaaaaaccctagaggtggcggtggttctctggtgagcacgcaacgaaggcggtagtttagacgaatgcatggtgttggcaagcgcggtgggcctccgggaggcgcatcgaggctggtatccagcgggggtgcattgaggtggtagccgcagggcttccgcgtggcaagcaacgactaggcgcgtggaggttggcggcggttgcggtgcatgttgcaccttggcacgacgaggcacaaccaggcgccctgaactaggcgacggccgggggggtgtgccacgccatgccacggtgagtggcggccaagtgcgccaaggcagctggcagccatggggctcccagcatggcgagcagcagccatgggcttcccgcgccacggtgctggcggctcagtggcaagcattcggaatggaggtgtaggtgctttcgccaagggtaaaaatgtcgtttcgtcctaaaataacacggttaaacctaccgtcgaaatctgtcatatgcttagaacttatcgatagaaatggaattcaaaacttgggaatagttttgaggagagcctttttctttccaaccaactgatctttcattccatcattctttctttcctcttcgaactttgtgcttgactgtattagtggaagagtggaagggcggttaatagcttgaagaatggaaagagtcttttcgtccctctaagagcagggtataatagcatactataagccagctataaatatattttaagaagataaaatatgagagataagagtagcgggctctagatttgtagccagctgcagcacagactccaaaatgtatgtatgtatgacgggtgggaccagacattaattatgtaatatatgtttatagataattattgtatgaattggctattaaattgactataggtgatttggagccaatagttggctatactgttaaacttgctctaaaagagggaggggagcagtgaggacaaacatctggttcattttcaaaaaatggggaagaaacaaaccctaaaagtaagagtaaaatagcagttgtggttaaaagtgagtgtatgatacaattatccctataatatattaacaagagtaaattaaccctcggtacatgtactgtccgcaggaagttccgcccggaacctttgaagcaaaagcttcccctcacggtggcgtgacatgcaccaatctcgccccaaaaggagtctagtagtagcggaactgtgggaatggagtagctagccggcgagttgccctagtggccgagtcctctcttcttctccccttcttcacccatagtcacagtagtcagttgtcactccacactgctacctgctacattgcagctagctagccatggtggtcctcgccgactcagcagcaaggaagctccttcatggcgccgtcggccgagcccgcaccctcgccggcgacgccgccgtcggcatgagcttcggcctcgacggcctgtggcagctcatcgctggcctcttcggcggcctcatccacctgcttctcctcccgttccaggcgctcgccggggccatcgcccacgtcttcgaggccctggggcatgccatccagtggctcctcgccggcgtcgtcgcggggctcgggagcttggtgcacctgcttgtgatgccgttcgagatgctgtggcgcggggtccaggcggccgtcgccggcatcggccatggattcgagtccctggggcacgccgtccaggtgttcttcgccggcatcgtggctgggctcgggagcttggcgcacctgctcgtcctgccgttcgagatgctgtggcgcgggctccaggcggccgtcgccggcatcggccatggattcgagggcatgtggcagggaatacaagggttcttcgccagcatcgtggctgggctcgggagcgccgcgcacctgtttgtgctgccgttcgaggcgttctggcggtggatccaggcggccgccgccggcatcagccatggcttcgacggcatgtggcatggcatacagggcttcttcgccgacgccgtcgcggcgctcgtcagcgtggcccacgggctcgtcctgccgtccgaggcgttatggcggtggctgcagacggcggccagcggcatcggctctggcttccaaggattgtggcagagcatacaaggcctcttcgccagcgtcatcgcatcgctcgccggcgctgctcacgacctcgtccacccgtttcaggcgttttggaagtggatccagacagccgtcgccgacgcaggcgccggcatcagcttcggtttcgacggcttttggcagtacatccggtccttcttcgccagcgtcgtggccatgctcgccggcgcagctcacgagctcgtccaaccactcgaggcgttctggaagtggctcaagaccgcggccgccgacgccgccactggcatcagcttcggcttcgacggcttttggcagaacacccggtccttcttcgccagcgtcctcgccacgctcgctggcgcagctcatgagctcgtccaaccattcgaggcgttctggaagtggctcaagaccgcggccgccgacgccgccgccgacatcagcttcaggctcgacggcctgtggcccctcgtcaagcgcctctacgccagcctcctcgccacgctcgccggcgccgcccacgagctcgcgccgcgcctcgagtcgttctggcgctggctccgcgccgcggccggcgcggcgctcccgtacgtgctggtgatcgccgccgtgctgtgcgtcgcggcgctcgtctggctctcctggccgttcttgctccacgccgccgtccagatcgggcaggcgcttgtctccgccgtgtcaagcggcgcgcactacctgttcgtccccttcgggcagtgctgcgtcccgctcaccatgatgagggccccgggcgccgccggcctgatgatttcgcgagcagcattcgaatcactcccggagctctacttccagatactgcggtccgccggacgcgtggtggccgccgccgtcttccgcgcgccgtccatcgcgagggcatgcgcggcgccggtcgccgccctcttcggcgcatcatcatgatcaatactacctctctgtcgtcagtaatgtctggcactctggcctctatttgtgatactagctgttaactatgtgagctgtgctaccgatcagcgtgtgtgttgggttaatatggagtactgtatttaatttccaggaatgatattacattactgttaaccagagtacctctctctgtttacaaaatttaaaacttattaaaatataacatatgaaattgttttttttgacaaatatatcaatataattttcatatattaactactgatttttattataggaaaaagtacgaattaccccatgaactatcacggtcgttcgaattaccctcctgaatcacaaaaccggacattcttcatctccaactatgcaaaccggacgaattacccccttcgacccaatccgcagtggttttggtccacgtggcgtacgcgtggcagtccagtcagcaatttatttattagaaaataggcgggccccacctgtcatacacttttcctctctcttctcttctctcactctctcacgaatcacagcggtaggcggggggcggcgagcggcagcggcggcgggggatgaggcggcgagcggcagcggcgacgaggaatgaggcggcgagcggcagcggaggagacgagcggcggcggcggcgagggatgaggcggcgagcagcggcggaggaggtgagcagcggaggaggcggcggcggcagaggaggcggaggaggaggcggcggcggcagtggtggttatgcgactgcgaggtgtggcgga

SEQ ID NO: 20057 - DNA, 5718 bp, Oryza sativa
cccacccgccctagacgccaccgcttcccccggccaccctggacgccgccatccggttccccctcctcgtctcacaccgcgcgccgccatgcatcctccgccacgagagagagaccgagagagattaggaagagagagatagagggggtatgacatgtgggtcccaccatttaaaaaaataaaatgctgactggactgccatgtagaccaaaaccaccacggattggatcgagggggtaattcgtccggtttgcattgttggaggtgaaaaatgtccggttttgtggttcaggggtaattctgacgactgcgatagttcggggggtaattcgtactttttcctttattatattaataatttaaaatattgtggtttgactgcactcattttagtgttagagtatagagatagtatcgtattatacccagttgttatggtacatagaattagtttctatcaatatatttttagagttaattgagattaaagtcttgtgcgcttagctacacatgctcccgaggcggcatacaatggcataaagattgtcatagggcgttgctagttggcgcgtctgcgccactacggcagatcgcacgcgttgcggatgtgcttgggactaagggcctgttttgtagagctccaacttcaatttagctttaggagttgggtctggagtggagtcgtggagctgcctaaacccagctccacctctctaattcattttgtgagagagctccacccagctccgctcccattttaggtggagctaaaactgtttggctgagctccagctgagaggtggaaccggagttgtgccaaacaagccttaagcctggtgcataatgcttaagtgctattcgcaataagtttttataatagaataaaaaataaatagttgagtctagagttttcaaatctggacataactaatattttaaaattctgaaagttttaaaaattaatttaaagattttaaattttgagttaacagtttttaaatttaatttgaaacttttgaatagaatttttttgaatttcgagttgttagtttcaaaatttggagtgaaagttttaaaatagggagatcttttgaaaattgatttgaaagttttaaatttaaatcgacaacagactatgtatgtaaatttaaaactttcaactcctctacaattcctattgatgttgttgaatcaaagcagtccttcaagtcttaacacatactccgtccattccaagaaaaagccaacttctgactatgaatctgtatataacgtatttccagatttatagctagaagttactattttgttttaatagaacagagggtgtaagtttgataaaataaggatacaaaccaagcaatcacatcattgtacttgaactatgagtggaattgattaaatctatagttcaagttacatgtaatactcctttgaaacgttagattctaaaaacgcaggattaaaatgtaatggctttttaattctataggaaaaatcatagaaattgtgcaaagtagccatttagatgcctcacaggataggtaggggaaatttaagattatgcgttgatttgttagagagagaaagaaagaaagtgcgttgaaacttttcaaataaggagtaggcctcttttgaggaaagaggatatatatgcctcttgttagagtaacggtacaatagacaaaattagctagcgatagtgtgtccacggtagtaaatgtggtgaggtgacagagaaacgagtggagagagagaggtagcgagcgactaagtggtgtttacatccaacgactttagtccctgtctttagacactaatttagagtattaaatatagactacttacaaaactaattacataaataaaagctaattcacgagacaaattttttaagcctaattaatctataattagagaatgtttactgtagcattacataggctaatcatggattaattaggctcattagattcgtctcgcaaattagtccaagattatggatgagttttattaatagtctacgtttaatatttataattaattttcaaacatccgatgtgatagggacttaaaagttttaggtggtgtttagatccagggacttaactttagtccctgtctttagacactaatttagagtattaaatatagactacttacaaaactaattacataaataaaagctaattcacgagacaaattttttaagcctaattaatctataattagagaatgtttactgtagcatcacataggctaatcatggattaattaggctcattagattcgtctcgcaaattagtccaagattatggatgggttttattaatagtctacgtttaatatttataattaattttcaaacatccgatgtgatagggacttaaaagttttagtcccatctaaacagggcctaaggtggtgtttagatccagcgacttaactttagtccctgtctttagacactaatttagagtattaaatatagactacttacaaaactaattacataaataaaagctaattcacaagacaaattttttaagcctaattaacctataattagagaatgtttactgtagcatcacataggctaatcatggattaattaggcttattagattcgtctcgcaaattagtccaagattatggatgggttttattaatagtctacgtttaatatttataattaattttcaaacatccaatgtgatagggacttaaaagttttagtcccatgtaaacagggccttagtcccatctaaacagagcctaaatagccactgacgacacactctctccaagacgtgagaagcggcaccaggcctgctgctactggccaacgtgattgtggggtccacatgaggcgatgcgagaccggcaaggcatctaaacggagcttggaggcgaagcgttcgacggcgatacgatagaagctagcagagagctcgttgctggtgatgagagctgcgtcgctcgaggagatggccggctgccacggtttgtggagccccaccggcgacgctgagatttgatatctctgggacggggagcacgggagcgaaaagacatcgacatgtccaagacgacaagaacgagagaaacgagcaaagaaatcaagagccaaccaagagggaggaggagatgcacccgagatcgccggtggtgtcctgctcaacaccgggcgacggccgacggtcttgtcctttctttgagacttggagcattcttgtcctggccatggaaggaaggccgctggcctcccaagcaactcgcttggttttgctctgctttgagaacaagtgggcagaaaaatggtgaagaacattggaagaagaagatataataaaaaaattcataaaaacatgtgggttattgatgcaatagctaactattgtatgcactagctcttatcaagttaactctaatgctgacatagatgtttttggagccaactgttggctgcactattgcccttgctcttagaatcccttaaaaatttagaggcaaatcctatgaaattcctataaagcaagcctaccatccaaaggttctcataggattttatttccaatggattcaattccttcaaatttcccaaggagccctaagacaaccggtgcatgattactacggccgagtttagttctaaactttttcttcaaacttttaacttttccatcacattcaaactttcatatacatacaaacttccaacttttccgtcacatcattttaatttcaaccaaacttctaattttaaggtgaacttaacacatcctatgtatatctccgaggcatgcatgcatttactacttcactacttaactgtagtgtcttccaatggattcaatgccctaggaagcatatcagaatcctaataaatactttcagagatcctttggctgtgtttagttcagcgcaaagtttggattttggttgaaattggagatgatgtgattgaaaagttgtgtgtgtatgacaggttgatgtgatggaaaatgactgaagtttggatccaaactttggatctaaacacagcctttgtggtgttgtggtacaactgtgtccgtatcgtctaacattacatggtaatggcaggggtagcattattcccatcctgaccatccataaaaaatcaagggctaaaaacacaggttgtactaatcgtgctagttagttatccaaaacctcatgcttctttgagacggtatgcattccttagttttagttggcattgccatcattaaacactaggtaaaaccccacgtattgctgcgagaatttagtatgataacaataaaaaaataacgcgtaagatagctagataacattggattaagtaaattaatgtggtttatgataatttaaatttaaatagtatacagaatggtgattcaaacgtaaaaggtaaggtggtataactttatggaagaagaaaagtagggagatagtttggaccgtagattaatcatgtaaaggctaaaaacaattgatctgatatgacttaattagagaaaaaaaaggagaaagataatttggaccatagattaatcatttaagcactaactaagtgagaatgaactatataagtatataggatatcataaaacataataaagatatacattgaaacaatatgtgaatcatgttggatggtaattcaacatgtttgtatttgaaaagctcttaaattataaaaactataaagatatagcatgtttgcatgatatttaaatgtgatgattattagtggatgatgatgtgccatcttgttaattagtggatgatgatgtggcatcttgttagtggatgataatgtggcatccttgcatgttatgtttaaggagttagtgggggatattgtagtgttgtggtacaaccgtgtccgtatcgtctaacattacatggtaatgataggggtagcattatccccatcctgaccatccataaaaaatcaatggctaaaaacacaggttgtactaatcgtgctagtagttatccaaaacctcatgcttctttgcttctttgagacggtctgcattccttagttttagttggcattgccatcattagacactaggtaaaaccccacgtattgctgcgagaatttagtatgataacaataaaaaaataacgtataagatagctagataacattggattaagtaaattaatgtggtttatgataatttaaatttaaatagtatgtagaatggtgattcaaacgtaaaaggtaaggttgtataactttatggaagaagaaaagtaggaagatagtttggaccgtagattaatcatgtaaaggctaaaaataattgatctgatatgacttaattagagaaaaaaaggagaaagataatttggaccatagattaatcatttaagcactaactaagtgagaatgaactatataagtatataggatatcataaaacataataaagatatacattgaaacaatatgtgaattatgttggatggtaatttaacatgtttgtatttgaaaagctcttaaattataaaaactattaagatatagcatgtttgcatgatatttaaatgtgataattgttagtggatgatgatgtggcatcttgttaattagtggatgatgatgtggtatctttgtagtggatgaatgatgtggcatccctgcattgtatgtttaaggagtaatgggggaaattgtattggtttggtacaaccgggtcc

SEQ ID NO: 20058 - DNA, 5700 bp, Oryza sativa
tacatatttgttagttatacgagaccataagttgcatgcctttctatcagcaatgtaaaaatatttttaatgctatattttctatagagaacacataatacctaattgggtaccacaaattgaaatgacatttagtagcgttgttgaggctcaacaattttcgaaccattatggcggtcaaattggttttgatgttagaaaacgatttgagaatactagcaaacttgatggcaaggctatatcagctgaatttgtttgcaacaaggaaggctttagaacgaacgataaaagagatcctttgataaagactcctcgagctgtgactagaactggatgcaaagttcatatgggagttaccctaaatcgagtgctaggaaaatatgagatacatgatttggttcttgagcataatcaaatacttcaaacccttgaaacctgtcacttgttgccatcacaacgacggataactgaagtgcatgattactacgttcagactccctttgaacaaaggatgaacgaaggatttcttctttctttttgcatttaaatcatgtagaaattattcctaaatgactcttggaacaaaggattgcattctattagaatttctttgaaattccacggtccatagatattttggaagaaaaataacttcatgtttaacctttgaaattttctttgactgctatctctcatccaaatactactatttttactactggagaaatgatcttcgccgggttgccaaaaatctacgatagtcccggttcaactaaaaaccggaactaaaaaccatttttagtcatggtttaaaagtgcagcgggactccagaatctttagtcccggttggtggttctatttgtgtcagacgatgtcaggacgccagagatttattgtcccggtaagtaacactaaccagaactaaaaatccatctttagtcctggttggagttaccaaccgggagtaaatatttatctcccatctccgatcggttaagtccaagacgagattttcttcctcaccgagatatttagataagatcggatcatcccctctcctcctacccttcagatccccttcctcctcctcctcccctccctcctcccctaccatccggtggccggtggcagcgggcaggccgtcggcgccggtagggccgcgagtggcagcggccggcggggccgcgtccggcatcggccgacggggtcgcaagcggcaggcgccggccgtggcgagcggcggcaggcagcggccgtggcgggcggctgcggtggcagccggcgggaggggaggcgggggcgcgcatgcatggaggccgggtgccctctcctctgccggcgtccttttttttatataatttgtgattcactgagatgtataatttatttttttagaatttgtgattcattgcatggatctgagatgtataatccgtaatgtatttgatttatgcgtattttttttaagatttatgatatattttatttgtgtgtataagtaacttaggatttgtgatgtgaatgatttgggatgttattttgatttggggatttggggtttgatttggaaatatgcatggcactcgatttgggagaaaatacatggattaactatagcaagtagcaaacaaacaatgacaaagaaaagaagaccaaccgggaatgccgctaccctaccaagactaaagattcaactttactcccggttatttcatccgagattaaaaatgggcatctttagtctcggatttgtatccccagtttgaaaatcgggactacatggggttcccaactgggattacaaacagtttctccagtagtggtttcttgcctatggtttgtccaaataatcttttatgtgttgttgtcctctattttgcatatatgttcgtaccaaaatcctgtaattgttttctattactgtgttttattgtttgtacgttccaaaggagacctcaatcagaatttagataacgatactcatacatttttaatagggatttagtaaaatttacggttttatcactggcagaatttacaaatgtcagcacatagagtcatcaaattaaaagatgacttacaaattaagctaacaattaagatgactgcacacacagtcaaaagcggaaagtagttatcttgtggttttccttcttttcaagtagttatgtgttacctttatacttttcattctttttaaaagcggaaagtagtactatatgtttatggttcgtacaaaggttgtcaatgattttgcttgcatgtttcctctgcattattgctcgctcaggtggttgtgattcgccttgttgccaactcctgggtagtatagcgatctctgacatctgttttgaaagcgcgaatcacagaggcatcggtgatatcggagatcgtatttctgcactcattaaagcgccaaacgtagtccctcaaagattcgcccggattctgtgttaatgcgtgtaaatcgtcttcgatcgcgtggcgcttgtaagttccttggaagttagtgacgaattgttgccacaaatctggccatgaagaaatcgagtagggcgggaggtgcatcagccacgaattgcagaacctttcaacgctgttggcaaatagtttgctaacgcgttgtcgtctgccccggcagtgtatagtaccgtggagtagacctggaggaattcttctggatcagtactcccatcgtacttctctattgctccgggtcggaatctctcgggccatcggacatcatgtagagaacggttgaaagctctacacctggcgctaggggcggtgggttgtcggcgatcgtgtgtcctccgtggatgtctatcggatgacgaggatgaagacgatgacgatgatgatgatgggtcactcagctccggtgtccgattccgagggcgacgttcagtttctcgagaattctgtcgtcgtccaccattgttgtcctggcaccgatccccattatcatcaccgtcatgtcggtgtcctcgtccagcatcgtctggcgtccgctgttcgcgagcgtcacggtcgtggcggttatgacgatatggtggtgttggtcttcgttcgagtggcctcctcgctcttcgttctcgcgacgtcgtgaagagacacgatgtcgggaacgattctcattatctcgcgcacgtcgtgcttctcggcggccattcagatggtcgcggagatcgccgatgccgcgaggtggaggggtagctcgtctaggcgacatccattgctccggtgcttcgccgtcggcaccgccagctgtcggatgttctggttgtgctctggtagcggcctcctcgaacgcgttactgagattggctaccgattcccatagtcgttctgtccatcgtgcgagatcatcgttaagtacagggtaatagggagcttctctcagtattgcgttgacggtgccgaagtgttgggccggcatgaccgcctggttctccgcctctgcgttagcgtgcgcagacgtgctagtcccaccgatgccaaacacgtcgcgtggtgtactggaagatgatgagccatagtcttcgagcaagtgtagtactgatggctcatggggatcgatgtcgattactccaacgaatcgatccgaggtcaacgtcgctccttattccttgtctgtatccttaagagaggttcctgactgctggaccttaggaagtggcgttttcatggcgcggagaaagaccttgcagcttgagaagtcgtgatttttcgtcttgtgaataggacaatagacatcacgagttggagaagtacgctggattccacgctctttgcaagcacgaatttcagcttgtacgttgagaaaaacccagcaagcttgcaagttatgcttcctggacttgtggataggataccaggactttgttacctcgaaagttgtccttgtcggctcgtggttcttgtcggaaggacaaggtttagccgcactagcaaccttctcgagttcgtatgacatcgatgttccgttctccactacggcgggaggatccttcgacacggggtcgtccggggttatagccacggcgctctcgtttccggtcattgatggaccagccgagattggtaccgtggtgtaaaccgggaagacaatttcgccgacttgagtccacaccagcattgttgaagtagggactccttgaatggggccggtgttgatgccgttgtcgacgaagcttgatgtcatagtagtagaaccttgagcaccaagttcccctacctggcgcgccactgtcgacggtgggtacccgtagaccggatatagagggtattggggtacgctggtacgaggatctacgtagtatgatatcaagaaaacaagagacaaagattatactggttcaggccccttaataggtaatagccctaatccagttgatatgggattatatggagataaccacaaattacaaagggaataatagaactcaatgataccgacgagatcgtagtcgagttgattcgactagatcacccggcgacttggctcctgtagactccgacttcataggctgtggtcgttgtgttggctatgagattcgatgccttaggtccttccgggggtcccttttatatcgcaggtcaggtggtctccaagtaggactcagagacatcggaccctgcacgatatagtaacaacccagtcctatacgggtaggaacctttccattggtgaacttcgtgatgaatttccttagcgtatacagagaacgtccgtacacgcgcagatgtaccatattgccgtatagcgtatatccaagggtagagggtataccttattcgtaaccctgacagcaattacatttttttcatttattctattggggtgctcgtcaagtagtgggagagttcatcgaattgggatacccactgcaacttaagctgtcatataggcaccggtggattggaaagtaacggccaagattttccttggaacttttctgacaaatactgtagctggatgtttcctgtagcgaacaccgtagcaaatactctttagaaccgatgtggcacagattttaaccgtggtcgtatcaaggtgaaaaatgattccgactgcttaagttggagtccctactatagctgcagtcgatccttattcgagttcatcacggtttcgagagacaaacaaattagttattataaagttaacaaactgattaatagctcaactggttaagtttttttaaggaaccaactcacctggttcaagtttaagatttgacacgagtacttttatttgtggctaattatttttttataggtgatgtatccgtcgatagtgatacacctgtgattacttcgtcaatctcaagatataccggtgtagtcttccggaggtgcatacagggatgatgtgtgcatgtgtgcattcatagggtgagtatacgcgtgttgtgagtatttgtgtttgtactatgttaaaaaaagtttaacaagttgatttaatattgttttttaagaaaatactgccgaacaaagttttaggacaaggcacatcatttagtagcatgttaagtactgtgactatgataattcataattaaagtgaacgcgcctggaggttgcaatcaaccaagttctagccaacggcaatatctatgtctaagctatagccttgactattaacagaactgctggtcatgtcaaagaattagttaataataatggaaagctgagag

SEQ ID NO: 20059 - DNA, 8425 bp, Oryza sativa
aataattttgtatagattgtttacttatattttgggcaaagctagaaaggacgaagacaaaactgaggataagaaaccccctaaaatcaattccaaaaccaaatctaaaattcaaaaattttcaattgcagacaacgatactgatctgtgctgctatcgactaattctagttcgtgctctcttgagaaaaaaaaactttattttaggagggactcatgtgacactggtagtctataaatagcagaaccctcccaatatgtagcattggattaataacaaaagtaaactaaacatactatcaacccaacaatgattgagcgatataccattgaattattgatagcacatatcacatgattatttacgcgcgctatacttcttaattataactagatgataccccgcgcgttgctgcggaaattgctagataaaaatataagtttatagcaattagcatgctaaaaaaatttatgactaacgacttgaaaattttgaacatacaactccaatgcagtaaaattttatctcgcgaattgaataaaccatacgtaattatatttgtagtaaaatgaaaaaataaaattgattaaaaataataaataccaaaaaggcaatggagcttaaagcttcactgagccataggcccatagctatgcaggatctcttggatttgatgcatcaacagctagtgccatatgtgttcctacaaagaagttttttccaggagaaattgtgttcctacaaagaagctttttcgaggagaaattcggcatcaattgcgcagtccaaaaggatgtatgtacagaagtaattaactgttagcagtaaaagcaaagagaaattatgccgaatctttatttgatataacatatctcttttcgtgtctggcatatgtagctgtatatatggacagagacgctaaaactttactgatctgaattcagaacgtgacacacctgaaggagcaggactctctcacatatcagttggattttatgtagcagacgatagcctagaaaactttgagctgaaatgagcatttcaggtagtgaattgcaacctgcactattgaagtattgagactaaggaatgttgacctgtttcacagaacatggttagttagcaaacttacagcagcaagtttaaaatgtgacaaactaaaggaaaatggtataagatggaaatgtcagataagatatgaacaaataatatttcaatggaaggtagcgtctagtgagacacatacttatgtgaacctaattaatggtccgtaaacatatgaggtataaaatgagcattataaaagcaaacagagtctgcattagttaaacagatcgagattatggttggaacaacagatacctattagtgttatcttacatttgaacccaatatcttggaagcaaggcagtaacatgagctatatatgcacagcagagagacaattaagaaggatttgagcaaatttccatagagcagaaaatgattcactcgttgcaacaatttgtctcaaggacatgaatataagaatgttagatctctatcataccttgggtacaatctggtcagaaatctgcatactataaagacatttgcccacttaaattaaataaataccttcagatattaggagaaaaacaattgtgtatgcagaagtataaaattgtgctgaaagcagcaattaccacccataagaacgtaccagcaaatcgcatcatatcatcaaccaaaaatactgttcttcttaccactttcttaccggataactgaaacatttggtccatatctaagatcagatatgccataggccaggcctggtgactacatggtgcagtactttacaaaataatatcattgatcttgcattggccaccgatgagcaagaagaaaaaggcaagattgggatccatggtgcatggtgatgccgcagacgaacattggagagagagagaggtaaggactcaaggtccttgaagtactccattatcatgtcttggcaataaatctgatgacagaggtcagagaagactggcatcgagtgaggggggttaaaagaagataaagtggaggagcgtcgagttgaatgctccttccatttgtagaagtggaggcagggcatgcgccatcagtttcacgcgagggagatggaagggggaaggtgaaacgaattagcaaaagattgggtggaagcgaggaagggaaacagccctgacggtcagggggaggggggggtggcgtgggtggggaggagaagcggcgctggcagagtgcgccagggatgggggaagcgcgacgcggcgacgatgctgggcccgcggctggctcgcgctagggatgagaggagacgcgatcgtggccggctagcgggcccgcgctggcgcgcatgatgggggagaccgggagaggaagcgaggacgtcggcggagggcctgcgtctggcacgcgcgcgatggggagaggaagcagcgcgtgatggaggaggcgaagcgggacgcagcgtggatgcggtggaggggcggcgacgcgagatgcgggagaggagatgtcatgcctagaaattcactagtaatttttcgaacttatttgtgcattaaatcctcgtccagaaatcagccgaggtatacaaactgacaatttaatatacagattcatcaaaataataacgttacatacttacaaaagaaaagaaaactgcatcggaattacggtctagcgaagctccggctccactcccacaggcagctcaactggggtataagccaaacgtcttctccttcgcaacttgtcttcaactgaggtttgattgattattgcaaggtgagcatatgacatactcagcaagccacacaacaaatatgcaagtgcacaaggataccaaaggatggcataatatagggctcatttgtaaaagcagcatttagcaaacatttgagaattgtaaaacagtagagtacttaatcatcaatattaatcaacactgaacagcacatccatactgcttaggcccaaccatcctgaacaaccatacccggttgcacagatctatctccaaactagaaatgtaccattccaaaccaggagctaaattaattaccatcaattatcacgttattattaatgagtagtgtgggactaatcacgaaagatattgttagacccgcccaaaaccgcgggcacggctattcaaatagttttactctggctagaggtgtaccactgtacccacaagacacaacccaccgtcatgtcaccgcatccgtgcagacacgtcaccatggcgagtgattgtgacaagacccctcgcataactcaactcaaagcagtgcaccgttcctggatcataatcacccccttaaacaaggcatggactccccagcgatccccatgggcttatctccgccacttcttagtctggtgctccgcaatgagccttgttatacaaagtgtctagccgttgcccactctggcttgtggttggcacggttaatgtttcacaaccgaaactcgtgaaccggtccttaattgtcatgagcacgaccatcgaaaccatgtgctcacaacccaccattatcaagttttagttggcacattaattaattaaccaatcacgattaaccatcgtgagctatcattaaatatctatcattaagtaatagtgaaacattagtcatcccaatcgtgtgctaatgtttctaagcatggctaagcaattatgtctaacatctagctgaaccaatatataaagttcaactagtcaaattataataacccaaggtatcaaggaatagagtaatcaatgcaaattggccatacaaaggaataattcacaccacccggtgacattcgaaaataaatgcacagttgaaataaatagagaatttaaatataggatcaacatgctcaaaggaattgtgtttgggatctgtgtaacttgccttgcaataatgggtcttcaattaatcttcttgaacacttccgacgcactcgcgaaccttcgaaacgacgaaaacgacaagctaaaacgcaaaacgaggaaaaagactaataaaaccaaataaacaaaacaaacatgtagatcatgattttagatgaattatgagtcttgaacggcctcattctgacttcatatgaattaattacgaattttacaagatttaatctaattaaagcccatttaaaaaggattaaataaatttaattcaatttatggataattttaatatgtagatctttattttatagaacttttgcaacttgaaccacattaaaccgagttacaatgaattagttatgaatttttaaagattaaaccggattaaagcatttatatggattttaattgaattatgacgcaataaagaattatttttgaaaggaaaaagggatttattgcgccatcaaagacggtccacggtagaccgggtgcacagaggcggtctgcgaaaccaatggccgagatctaatctaagccaaacggacggccgagatcgatccggtccaccacgggtctacggctgactaagcactgacgtcgatgatgacgtcatcaccggcggtggctcggcacaccatgctcgacggcgaacggcggcgaggcggcgcaaacggagggcaccaacgcgtagagctcggcccggcgaactcaccagcggcttggacgacggcaaacgatgacggatgacgacggcggcgaggttgaagcggcggcggtcttcaggtcggcggtgacggcggtgctccggcgggaaacggtggcgacggaggggtggacgaggtgctgctcctcctcgcgatgccgatggtggcgacgacgaccgaaggcggcggctgcaacggcggcgtggcgcggctggatcgacggtagcagtggagagctttgggtcaacggagtcggcggcgctccgacgtgctacggtggcagcgaagcggtggacggggaaggcgacgacctcgcgatgctaaagaaggagacggcgatcgacggcgacgaccgaagcgacggcggcgcccgactggactcccgccggcggcggcgacgcaaagaaccacgcggagacggcgctagagaaggcggcaagctagggcgaaggtggcggcggatagaggaggtcccggggatccatttttaggggctaggaggcggcgacggaggcccatggccggcggcaaggagatggaaagttttagggttagaagagagagattgatccgaatcgagctcaaatccgtcggtttccaaacgaaattagcccgggattcctaaagagaaaaggaagaggagatcgaggagattatttcccctcaatcaattcggccgaaggaggaaggagacggccggattttagaaggagatcggcggcttgcggcgcggctaggagcggccgaaggttgaagacgaatgacaggtgggccccacctgtcagcggcaccgagagagagaggagggagggacggcggactgggccggctaggccggacgcaagcaggccgaggagaggaagagagacttgggctgactttcggcccaaagctaaaagagagattttaaaacctttttctatttaaattattcatgaaatgatattccattgattaaaaatacttccttggctcaaataaatcccagaaaaatctatgaactacagaaacaagagaagtatttaacaaaattttatctaacccacttttatattgagatttaacaaattaaaaattagatcttctcttttaggcttttaagattatttctaaataattccttttagacaacaatttatattttaaggatttttaaacaagaaaagcactgaacataattataattagatcattaattgattaattaattaatttagggattgagctctgaaaaatccgagaaaatttcagagagtataattaatcatggagaatttaataaaatttaaatccatccatgttttaaatttaggaaattttatttcccacatttaacttcacttgtaaattaatgaacatttaatataatttctattaatagtttattaaataatttataaatcctaaaacggaaattcaggctgtgagaggagaggaacgatgcggagaggagcgatgtgcgcgtggggccggcgaagccaagatgcgggagaggagaggaggggagcgatgcggggaggggaggggagcgacgcgggatcaatgcgcgtggggccggcgccgcaacgagatgcgggaggggagaggagaggagcgatgcggaggaagggctcgatgcgaatctaacggtggggacaaaaaggggtgacgtggaagcaccaggaagcagagaattgtagtagtggggatgatttgtataggtatataggattccttgtaaatacactacagtgaagtagtaaatgcatgtctcagttgtaaataagtttccttgacactaaattaattattcaaattagaaaatatggccccataactataaatatataacgcactgttggtaacgcacaagatcttgttagacattagatctatgttagaatataaaaattaatgctctttagcattcgataatatttttatgttgtgttgcaatggttgatcccactcatattcaaaagaggaaattgaatttaagcagtatgtcctctatttcatactataaaatgttttggttttttaaatagattcatacatggatcaatgtatgtgcttcatatgtgtgttcaaaaaaactcatgtgatgttggtgaatatagacaagggatgaagaagataaaattaaaaaaatgtttctctaccctataccacaaataatggggtcaagacttcaaagacaaatgccacttatgtcacatcattgtattttctatctatataatcacatggaacacctaaacaccctctagaatccttcgcatccatataccccaattcatctgtgtcctccccacaacggtcgtcatggatatatcaatgcagagcttggtacactgttgtgagtatcggacgttgggcacaatggctgaaccgacatgggccctagtggggagtcggcgttggtgacagaggtcaactagatatatactggctcattgatgcagtcctctatgagtgtgatgacgatggactaggcacccgatgcgaaccccggcaggaacttaacaaatctcactgaggaagttggtccccaataatattttgattctagcattataaatttttaaaatgcatttaagtgaatttataatatttcattaaaaatattagatgcacctgcatataatgtggaataatgtgaagataatgtgaggatgatgattgacacgatatgaaatgcttggagtaataaattgtaaataatgtgtcatggttgcgtgagctttaaaattctctaagacaaataattgctagtgtgtgatgatgtgccatatttagtgatgaaaacagattagaaacatatagaaactagctctaccatatccgttgtcatattgtttttctgaattggaataaaaaaacatggatacaaaaatggaagtgaatattatcaaatactgatactgagcgaatacaaaacaaaaacagaatgaatacagtaacaagtatttgacaggatataaaacccgttaattgagcttccttaatctaggaagagatatcgctggttattttctttgaaataaaaggtcactatctccaaaatttatatcgtcaaatttataggtgattgtaaatatgattatccacttcatagtcccaagatgtcttatttgatgcatagcttacttaccatatcatgtatgttcttgttgtatagattgaaaatgttattcactttattccgtttcaagtttttacactttaaatattttaaattataaatgtcataaactatcccattcaactctacaactttcatatagagtttgtttccatcaaatgtcatttgaattgtacattacagattttgtaaaagcagatatgatattttgtaatgaatatttagaccccctaaatgatctcaaataataaagtcttcagcaacaaagttgtagatctctcgtcgagctctacaattttgatgtaaagtttgtattcatctaacttcatatgataaagttatgtatatctatgtgttttttaattaattaatacttgcggtctacggatatctagagaaaaatccaggatactttccgaccgtttttcaattccgatggatagtgtccttactgtattcggttctattctgagaaaatactcagaatttgtttctatatccgaaaatatttggaactatctaacgaacctatttgttttaaaaacaaggtccgaactgacgaaaaatatgtaccaatttcatctctagtcgttacatgttaagatttaaaagtagtgggtactaattatatagaaggtatagatagattgagtatggggggtg

SEQ ID NO: 20060 - DNA, 5585 bp, Oryza sativa
caaaaaatgtctacgtttagtttgtttccaaaattagcaaatacataggaaatcctgccaaaatttggtaaggtttattttagctacaatctaaacatgccctaaattattaaaaaaataaaatttgcatttatttaatttttaaagcaacttctataaattcttttttgcaagaaacgctaatgagaaccgaggaagaagccaacccgctcttcacttttgaacataccctatgtatggttaatgctaatttatcctctcgtgagatcacattaccttaatcgttttaagcccttagattattcatatatgctatgaaatgtccttcttctctcttgaaaccatggacatcatctcatctatattatttttaccaaaccatcccaattattttaaacatttggatcactgatctattatcactcttatcttattgatctacactatcttaatatttctagcattggaggatctacggaagatgtaattttgtgtaaagcacatgaagttaatttgtctagatacaaagcaaattcattttgtgcttcaacttgttatcatacaattttccaattaatgggaagatgcgatattttgtagtatctctagtattttaaacaaaattaaaaataatgcttctgcgtgtgagtgggttttcttcctagtggtttaaatacttgcgaaaattcaaaaaacaagataagtcattgtgtgacatgtcctttggtaaatttctaaggtcaaaatgactttatacacggagacaaacaagacaataaaaagtgctgttgtatttacaattgaatttgttttttttctccatgtgggtaacgaatctaaccttctatatttttgtgaatagatatatgatcacttatatgttttctaaggccttttcatcttgcttttgaggcactagctgatttctcggctgctcgctactgtgaaaattttgaggcaaagatcctgtttagatctcaccctaaaatttttcaccctatcatatcgaacgtttaaaaacctgcatgaagtattcaatataggctaaaaaataattaattgtacagattgcgactaatttgcgagacaaatcttttaagcctaattgctccatgatttgacaatgtggtgctacagtaaacatttgctaatgacggattaattagacttaataaattcgtctcgtggtttactaacaaattctataattaggttttttttattagtgctcgaacatcctatacgataccctatataatattcaatgtgacaggtcaaaactttacccccatgaacacccccaaagttgcaaagacctcatctcacacagtcaccgactcacagtactcgtacttgtcagttgtcaatctcgacacggaggaagaaggtagctgataccttggcgcgctatccatggctgtccttgccgactcagcagccaggaagctcctccatggcgcctctgctcagggcgtcgccgccggcatgagccttggcctcgatggcctgttgcagctcgtcgccgacctcttcgcgagcctcgtccacctgttcgtcctcccgttccgggccatggggcatgccatccagtggttcttcgccggcgtcgtcgctggtctcgggggcgccgcgcgcgtgctcgtcctgccgctcgagacgctgtcgcgctggctgcaggcggccgtcgccggaatcgcgagcgccgcgcacctgctcgtcctgccgttcgaggcgttctggcggtggctgcgcgacgcggccgccgcggcgctcccgtacgtgctcgccatcgtcgccgtcgtgtgcgtcgtagcgcttctctggctctcctgcacgttcctgtgctccgccgccgcgctaatcgggccgccgctcgccggcgccgccatctcctgcggggcgttcctgctccccgccgccgtgaggaccgggcaggcgctcgtctacgccgtctgctacgccgccaggggtgccggcgtggtgctcgcctgggtgctcccccgctgcgggcggtgctgcgtcgtcctcgtcaccatgaaggcccccggcgccgccggcatggtgatctcgcggggagcgttcgaatcgctcccgcggctctacttccttcctgatactgcgctccgctggcgccgtcgtggccgccgccgtgttctgcgcgcggcccgtcgcgtgggtgttcgctgcgccggtcgccgccctcttccgcgcgttgtgatcaacaaacttctctctgtgcttgttgccggtaatgcctgacatgacatctacgtacttgtgctatctaccgctagtatattataagaagtatagcaccgcgtaaatagtcgtgtgaactgtgctatcaataattcaatggtatatcgctcaatcattgttgagttgatagtatgtttagtttacttttgttattaatccaatgctacatattgggagggttctgctatttatagactaccagtgtcacatgcgtccctcctaaaataaagtttttttttctcaagagagcacgaactagaatcagttgatagcagcacagatcagtatcgttgtctgcaattgaaaatttttgaattttagatttggttttggaattgattttagggggtttcttatcctcagttttgtcttcgtcctttctagctttgcccaaaatataagtaaacaatctgtacaaaattattcttaactaattaaatattcaaattattttacaccaattgattatgggcctatagcttcatgtatggagtactaaggttgtcatcatttgccataaaagcttactaaacttgagtaaggttaggatttgaacaccttggcaagcttaagcctcatttgaattggaggattaccatatatagttcaacttcgtatcaaaataagaaagagatccaatctcttgaaaacatccatttgctttgttttttttccctatgatgctatcaaatggaccattttctgttttcttacgcttttcattcttgtagaattagagtaacacgtaacttcaatttccgtgttttttctatttcaatgtgtttcctatcatacattatatttcaaaggaggcataagagaaatttactagtagtaagtcatttaggatgaggatagtatttattgttggcctttcctaactaagtgtacgttaaaaataaaggtatggtcaattgtataagtacatagcagagaaactgaggatgcgactacgtaaggcgataggtaatagtagtgaacctggcttcccgggtcctgtgccaccaagagcttcatcggccaaatcctcatgcatagtacactgacgcgctgggtgatgatgaggggagggagatgctgcggtcaaacttgttgcatcggcttgatccagttatccccaagctcccgggggctagatccagtaccccgcatagccgcaggcagccaaatctagtggtccctaggggaggtagataccattgtcgagcggtgcatattggctagatctaaccagcccccgagttcatgacggccagatctagcggtggtggagaaggagaattgaaagaggaagaggaggaggcgcagcagtggtagggacgttggagtgggggttagagaggaaaaggcaaaacggctgttggcggcaaggaggcgcatgcatccgaagaaagagagcaagagagagcagagagacgtgcatccttaaaatcctgatgcccattgcccatcggctcaattcccattgatcagctccgcagccagttttttctacagcttccttaaagtagcacatatatgacatatgtagtgagcttttttttaataaactagcacatatcttataagtgttggtttttaattttagccttccatggggcttgagtgaatgggaaatatgttatgtgtgtaattttaggtgaactagtacataggtgccatgtatctgttcttatatatgtatagtcatgtactctctccgtttcacaatgcaagtcattctagcatttacatatttatattgatgttaatgcatctagacatatatatatctatttagattcattaacattaatataaatatgagaaatattagaatgacttacattgtgaaacggaggaagtatgtgttgttatgtggtagtcttaggttgcttagtttcaacaagtggtacttatcttcttaggtagtttattagcatatgattaattaagtattagaaaaacttgaaaaaagattaatatgtttttttacaataagttttcaatagaaaagtttttaaaatatacattgtttactaatttggaaaccgtgcacgtaaaaaacgagagagtaaaaaatggaaaagtgtagaaaaaaacacaacctttatacttcctggttttttttgtccctttcctttttcgagcgaacttgcctaatctacatatcgcaagtggcatgcgagcatcccatgcaatttttacgtacgatactgatacgatttttcccgtgctaattggtctcacatgcacactgaaaggtagtcctggctttagattgggcctcttttcttcgagggagaatgaataatcgatgcatggacccggcaaattatgtttcgtatctctcagctttccattattattaactaattctttgacatgaccagcagttctgttatagtcaaggctatagcttagacgtacatacagatattgccgtcggaacttggttgattgcaacctccaggcgcgttcactttaattaggaattattatagtcacagcatttaacatgctactaaatgatgtgccttctcctaaaactttgttcgacagtattttcttaaaaaacattattaaatcaacttgttaaactatttttttaacatagtacaaacacaaatactcacaacgcgcgcatactcaccctataaatgcacacatccacacatcattctcatgtgtgcacctccgaaagactacaccggtatatcttgagattgacgaagtaattataggtgtatcactatcgacggatacatcacctaaaaaaaataattgccataaatatgagtactcgtgtcaaatctaaaacttgaacctggtgagttggttccttaaaaaaaaacttaaccagttgagctattaatcaatttgttaactttgtaataactaatttgtttgtctctcgaaaccgtgatgaactcgaataaggatcgactgcagctatagtagggactccaacttaagcagtcggaatcatttttcaccttgatacgaccaacggttaaaatctgtgccacatcggttctaaaaagtttttgctacagtgttcgcgctacaggaaacatccagctacagtatttgtcaaaaaagttccaaggaaaatcttggccgttactttccaatccaccggtgcctatatgacagtttaagttgcagtggctatcccaatttgatgaactctcccactacatgacgagcaccccaatagaataaatgaaaaaaatgtaattgcagtggcaaactcctatgacatgttagcaatggttgttcatggagttgaaaaatggctatggtaacctcagaagaaatgaaaaaagatatataaattcgttttt

SEQ ID NO: 20061 - DNA, 12890 bp, Oryza sativa
  unsure (1)..(12890): unsure at all n locations
tgagtgaagtgataggctggctctcaccaagtcgaggaggatgttagatggcttgaagttagtagatggccagcgtgtgagcgtaatggaggaagtcgagccccttcgccatgtcggcagtggtctgcatcctcctcatccgttagaatgctgaccctcctctctctagccccacaaaggcagatggtagcaaagtgtggtattgtccaacccaagaattccaccgtggatatgtaaatgtggaagaaaactaaagaagcagagaaaataagaaacaaaaatactgtgcagcagacagcaagaagcctcaaataaaggaaaataataagctagaatgctccaaccaacctaagtttttagtaaacacattgagtatttttctgcaaattattgcacccaaatgaaactaaccagatcgttgttgttagcacgtagtaatggtggcatcgatgtcgtagccagtcacccaatgtcagccacgatcatcaccccccccctcccaccttcccactacgtcggatgccaggatgggtggcgaacaactgcgttggatgctccttcccggcctcacctcagcacggctggttggaggcacaggctggttggagggtgggcgcagggtggaggtaagggcaggcgccggaggtggcaaagaggctcgggcggtctggagagcaggcaccggcggcgggaatgggcgatgatgctccttcccggcctcagctaagcatgccggcagtaagggtggcacgggctggatgggcggatggggtggaggacgagtgccggcagcggagaggcacgggcggttgggatgaaaacggtacggaatatttctagattccgggcatgttttcggaaacagaataagccggtcggaatttttcggaaacggaaatgaattcagaaatattttgtcagatacggaatcgaatataataagaacagtttccattggaactcggaatcggccggaaacttttttgaaatttccgaagtttcaggcccatacagtacaatagtccataatacattaatacctccctatcccaacccaattcagcataatacctcccatagtccataatatctcccctaacttagagacttagagagtagagagtgagggactgagagagacatcgaagattcctgagccgggcggcggagcaacgcatccagatctcacgttgcctcgtcccccgaagtctgattggagtttttgtccatcgaagtttaaagctcggtttgagggttttttttaattccgataaattttcgttatcgtatccgtgctggttcattttcgctctgttttcggtttcgataatatttaattccgtttttgtatctggggtttccgattccgattccaattccgaaaaaattatgaaaacgaaaacgataaggtggtttccgtccgtttccgtaccgttttcatccctagcgggcagtctgggtggacgcgtgggtgacggttttttttaagagaaggattagagaagcgttaatcagtgttaatcgcagtgttaatccaacttgcaatgtacattgttagattagaggatccaatggttaggaatcttctggttacactttcttaggtggatgtggaaagaaacaaccagtacttttatattagtactagcaaattgacacgctcagttcatcgttcgtatatattttgtagggcacatttaaaaatagggaatgtttcaattggaacatgttaatttgttttataatgtattattgtattacttagatagctcgaaaaaagttatcatgtttactctggatgatagaaatttccacattagtcactaagaaataaaaaagatttggactattagatcatgatgggtttatagattaaaacatcgtagatacaaaagtacaattgtagttatagaaacaaaagctagctgttgtatatgaaatccaatcatattgaaatatatattgcttagaaaataaaactatatttcggaaaataagatttaagtgttgtatattgaatataattctacttttaaaatttagcactatgcaatttgcaaaatgatcccctggtttttaattaaacccaaagtaaattgtattgttatgaaaatccttcgaattccactatttttatccaaattgtttaaggcttctttgtttgtgtaaaaccataattgaactgtctactaaattgaattctgtaatacatgaattttttaaacacttgcaaacaaaaatatcttggatataatataaatcacaaatctatcattagagcccatatatttctaacccacattattgataatttagaccagaccatatatttttcttcctttttccttttctatgggccgtactgccaatgaactctatcacctgcaacctgcaagttataatgtactcatatatgtttcttcttgaaatcacctgagccctcccaacagtaaatacaccatgaaaaaaatgatattttttggtgaacttagtgcatcgtatggcattcattggctgtactcttaggatttttttttctcaccaatgatttagagacaagtgtcaacaattagaggggaagctaagcaccaatcagcccgcagtaaataaattaaactgctagcttagagacctagatatatatgtgcatccagatgttcgggatgacgtactaaacaatatggtgatccatgatttcctgaataaacgtggaatcaatcatgttcgggatgacctacttaacgattccatgatcgatcatgacaaataatttatattttttttattccgttgctatgtaataaaataacaatttagatttttttcatgattgaccaatgcaataattttatttttaccggtgcctgtgataattttttaataatcagtatatgatcaataataatatatatttactagttaaaataaaaaggggagagcgagagagctggagccttgagggagatgttagatgtgtgcacgtaggggaggcagcggtatgtacgtacggacttatcatacctagctacgggatagatacgcacaggagggaggtggaggttgaagggattttttttcttaaagactaatatgatggttcatactaattgattaatcgatttaaataaaaatatatgattagattttcttaatcgatttaaataaaaatatatgattagattttcttaatcgatttaaataaaaatatatgattagattttcttaatcgatttaaataaaaatatatgattagattttcttaatcgatttaaataaaaatatatgattagattttcttaatcgatttaaataaaaatatatgattagattttcttattgccacatgacagtttaagagtatttttaggaagcgtgtgtgacggtttgagagtgtttttaggaaatttaatggatataagagatactccctatgtcccaaaataagcacagcaatgagttcctatctccaactttaattgtctgtcttatttaaatttttttaaaaaaaataaaaaaaaacataagtctcgcataaaatactattcatattttataatctaataataattaaaatacttccagtcaaaaaaataataattaaaatactaatcagaaaaaaatttaaataagttggacacgaaaactcatgattacgcttattttgggacggagacagaacgtaacaaacttttaagcttttgagttgatcactgttgcaaatatgtaccgtaaaacttaaacggtctttatttttctctacgccatatgctaagtctaattgacaggggtttgtattccctctgttctcactttttgtttttcactagtaggtaaatactttatgataattcgtgtccagaatggattggtatgccctctgttctcagaaaggattgtctattggggattgagctgttgataatgccacgatgttccgatcctggtgaggccggagagtacatccctctttcctcagtcttgtgaacttcacttttgtgcactgcacatactgttgtatgtgtcgtgctgttaaacatttggcttgggccttgtttagatactaaaatattttggccaaaaaaatcatatcaaatgtttggacacatgtatggaacattaaatgtgaaaaaaaaaccaatcacacagtttgcatgtaaattgcgagacgaatcttttgagcctaattatgccatgatttgacaatgtgatgctatagtaaatatttgttaatgattaactaggcttaataaattcatctcgcagtttacaggcggaatctgtaatttattttgttattagtctacgtttaatacttcaaatgtgcgttcgtatacttcaaaaaatttatacccaaaaaactaaacacacccttggtatatttcttaaaaaaaaacatgtggcttggttataggtgctgattcccacacaaactggttctatctctaggaataacggtgtgcctcatttatttgaagtacatatacatacgtgttgaataaaacgatcaaacgatggacctatatagctttttttttccaaatttctctggctttgatgtgcacaagtctgtgtgagagtggttcatgtcgtatggacctttgtagcgtgtgtgctagaacaagtataataggggctgaagagccggtgataacaaattcaaagactgagttaatctcacataaagactgagttcgcactaaactttctccaaactctcaactttccatcacatcacatcacatgtattcaaaacttttttactcacataaactcttaactttttttccaaactaccaactttcctcaaatttctcccaatttcagaaactaaacacagcctagccaaaaagctgatgagagaggatcactcggcgactaattagtcgctagcgtcacacactctctaaaaatgtgggacccgatgcatgctttctacaccatacaaaatgaagatatgatgtagaatgtgagagaatatagaataaataaataatagactatattgcaactacttgttgtatctattaactttttaccatggctatagcacacgtggcaattactggagtaagcagcgagcgcttctgatgcctacaaaatagtactccctccatttcataatataagacacaaccacttttttttatgttctataatataaggcatgcatgcatgtagtcaattaactataaccccttctccattaaattattacttttttaaatcctccactctcatgttccctaattatattggatgcatgcattgtatttattaggatgattcaaactacaagatgataataattattttgtggcaaatgcttaccatcagctgtccgacacgaaagaaaaaaatcggacgcctcagtccaaacgagcagcaggtgcatagcaagtctgagcgtgcatgcaagcatattttaaacttaaaaattttttttctctcaaactatttatctgaatttcaaactaattatatcgttggatttgttataattaaatctttataataagatatcacatgactatattatgatgactttttttttactttttaaatgttgcacacattgttaatgtatgttccaacaagtatttattaatgtttcactaatgcattagcaatgttgcacattattttttatatgtttcagcaaacattttttttatgtttcaacaattacaattcgatgcaagctaaatacaaaaatattttaacaaaatcaaatatttgcaaatgtattgtatcatacgatttcttttcaatgtttcactagttgggacataatgtttcatgtagtgataattactgttgcagtcaatactttttatatgttgcatctttggaacattttatgaattgggttgatgcatctgcacaagtgatgaaactttttttagacggtgcaacataagtttgatttttttaataaatattttttatcaaaatatatccatgtgagatcttgttataaagatctaattatgatgaataaaatggtgtaatagaattatatattgaacacatattttagaaaaaggaaaagggagagaaagtagagaaatacatgcatgtgacatacgccatgcatgcgccacaagccaacatgcaaacgacatacgatgcgcatcctgacggatgtgccagacgccaaggatgggcggtcgtccgatatttgataaaatatctgaaaattcttgaacctgagcgcccgatccggcgccaaacaatcgggcgatccctccatgtgccgcgcttcccgcgtgcgcccgcgcccgtgcatgtgtccccaccactgcgccgctcctgccacgtgtccctaccacgcacaacgttgcaacaaatcacccacatattttgaaaatactctattaagagaattcgttttatttgttgttccacataaaatgtttcacctagtgtacttacaatgtttcactatgtatagatctaatgttgcagtgaactgaaacattctttcgctatttactgaaacattgtttttatataaggtgaaacaatgcccgatttaaacgactaaaacattttcgatctacttagtgaaacaattccgatatacttggtgtaacatcgtgcaacatttaaaaataattcaataataagctaaaaaaattttcgtcggaatatatccatgtgtggtcttgttttaaagatttaattgcaacgaatttaatggtgcaattggatcatgatttggattaataatttaagagaaaaaatagtttaaagttacaaaacattaactatccctgtcacacatgcaattctgtatgcaggaaaagttgcatgcatgcatatagctgcgcgggagaagtttgcatctaacagtgacgacacgctatcaatggttgggatttaatccctcgatccgatggctgggatgggcgtccgatttttttctcctgatcggacgtccgatccgtagttctctccttattttgctggtctttgggttaggggtggttatgccttatattttggaatggagggagtactactaaggccattcccaacccaatgactaggatgatgtacatagtattaaataagctgccatctaggatggaaaatgatgtggcaagtgaataaatgaggaaagaagaaaagaagagttcaagtagaagtacaatctaaaaataactgaaattcagaattaaaaataggcaatattggaggaaggtccatataggaaccgaatacgagattaatcaaaattcggaataaaaataaaataaaatccaaaaattagcaaaaaaaaagaagaagtgtccaagtaggaaaataatttaaaaataactggaattcagaattaaaaataagaaatattgaaagaagagtccataccagaatccaatacgaaaataaaattcagaataaaaaataaacgaattgaaattagagaaataaaagaaacgaagagttaaagtaggaatacaatttaaagttacctgaaattcggaattaaatataaagcaatattaaaataagagtacatataagaacccaacagtagatcaactaaaattcagaataaaaaaaataaaattcaaaattaggcaaattaaaaagagagttaaagtagtaatataattttgaaataattgaaattgaaaataaaaaataaaaatatcaaaagagcacaatacgaaaaataaaataaattctaaaattagataaagaaaaataagctttcaactaggaatacaatttatgaataactaaaattggtgataaaaaaaataaagactattaaaagaaaagaccatctaaaacatatgacgagataaattaagtaacaggcctataagggagtagagtggcggcgattgatgggacatctaaaaactattaataaaacaccaaatagaaaatcctaatgacggttaaaagtaaggatgacgggtaggtcgtgaagcaatcggtcaaggcggttggcgggacttctagaaagtaaaaaaataaaccccaatgataatcatatttgatttttaaaatctcaattacgataaaaatgagaggcagcgggcggatcatataggagtataatgggagagccgtcgatggttggcgggtcttctataaagtaaaaaagaattccaacgatagttatatttgatttttacaatcccaatgacaataaagagtatgcggcagacaggtcatagagaagtatagtggcagcgtttgacgggatttctaaatattataaaaaataaaaccgaacaagacaataaactctaaaactacaaggtctaatttttaaaggctcggaacttctaaaaagtaaaaaaaaacaatgataatcacaatgacaataaagaatggaggcagcgagcgagccgtagaggagtacagtagcaaagtcgctgacggtttggcgggacttctagcaaataaaaataaacccaaacgataataatgttcaatttttaaaatcccaatgacaataaaaaaaagaggtagtggacgggccgtaaaggagtataatggtaacgtttgacgggacatctaggaatataaaaatgaaactcaacgtgacaataaactctaaaaattataagatccattttttaaagattctaaggagaatgaatagaaatagtggtagatcgagcaagcaaataaaaaaggggaatttgcaaatttgccaccgattttttcaattttgcaaggatgccactcgaatgacagttccactggtatttttgcaattttctagtggcagttttgcaataacgattcagagcagcaaatttgcaattgccccaataaaaaaggagatgacataactaaggggtagtaactggtgtgacttttaaaaactatataattggaaacacgaggatgataaggtttggtctttcaaagtctcaagtcaaagtaagattatataaaaaaaaatatatgattttgtttaggtgctagtcacgcaattgcgtaggccacccagctagttttacaaaatttccaggaaaaatctgcaggcaaaaattcaaaattgccttctctcacctccgactaagcttgaggagaaggggattgagaagattgggaagatacacaaaacgaggtgaaccattagcgcataattaattgagtattaactattttaaattttaaaaatatattaatatattttttaaagcaactttcctataaaatttttttaaaaaaacacatagttccctcaatctcaccagaacgaacgcaggtaaatttgaatttctggaagaactgttacaaatcgtctgttaacttctggaagatgaacagtatacgatcaggctgagaaattattacctgatgcacacaatggcacaactctcctactcctatcaatcatatcttaattcattgagatttgttatggtccagcagatatagtaccttgaggtactggtaccaccagataccaaataaaatcatgccgttgaattacaatgggcacgattggaaacgggctgaaaaggggcggagaagacccgcgacacatttgcgtacagacgttgccgcaatctcctcgttctcacctgccaacgccaatctcctagccgtcgtgcgcaggtctcctccgtcatcgccgccaaatcctcgattccacgccgccccctctggtgccgagggcaaatactgctgccacatagcgcagcagggaccgaatactctctagttggcctcaacttcacccggtgattttgggaaaatttcaattcaaggttcatacatcggcaaggtgtacggcaatatcgcatcattgaggtggtcagcttgattgctccgccgatgttgctgctcacgccgggccgtgactttttctagtggcaaatcaaactatcaatacagagttgtgtatatgtccgcttaatgaagaagttgcagcgccgttggcagggaaacaatggaggtcagtcggttaggagattcctcccaagtccgttgccagcgtagaacgaggggtctccgctgctgttggccgctcccatggtcaccgcctccgctgtactagtgctggccatcggggaggagggaggaggaggagttcaggagatctcgatttggtgctgctactctggacgacggtgaggaagtgaggtgatctagcacgacgacggttggactcggcgagactccgccacccaccccggcgtccagctcgcaggcaaagaagaggtcctcccctagagatggcaagcctcgaatggacggccgcgggagggtaggcagcttcatcttccctgcttcgtctccactcgtcgtcggcttgcttcagcttatatccagcggcctccctatcacgatgcagggaggagacggcgaggccgcccccatggcttcgcctactggtcttccggcctgcctgaccgtgcggggcgagccctcggtgccgcgcggagacgagggaagggcgatgaggacggggctggaacggtggcggcaacaggtccagtcgctagcttgcattgactccaacaatcgctaatgcgaaaagacaaccttaccctctcacctctcaatcatgatgcggtaccctcccaagtacctggcggtaccgacggatgatagctgttggatctgatccaatcgatggctaagatttagtaccgccccaatctattggactgtaaaaaaaactctaatttattttataacctaagactaagatttcgtctccgtacgtcgatggttggacggtacatttgctcggaatcggccgtggcgcaacggcaacatgaactgaatcgcaattcgcaatgtcttgcacctaactaggagtgtaggactttctaatgcatctatggagaatgccgagccaccgactaggtaatgtatctgatcgaggttggccatggttggcgtccccgagctggaacccatcggccgagcactgcgctgagtagtcgccgacttgatgaggctgccaccgacgtccatggcgaggaagccgttgggcgcgtcggcgaagtcagcgccagtgctggaggcgatgggctgagcctgcgcggcgagacagctgccgtcggctcgtgggtggttgtggcagcggcggcaacggcagcgttgcgtgagaacgactggtcgtcggagtagttgatgtcatctccagccggcgttgtctgcggctggttgccgccgccgccgctgctgccgacgtacatggctgatgacaggcacaacgacggagtcgggagcgcccggctggatcgggatgtgcagcagatcgggtccgccgccgtcgccgttcacggcgttgccgtcgtccagtagacccagcgcagcgcctcccgcctcgcggtcgcggccaccatcgccgcgtccatggactcgagcagcgcccgcgcctcctccgccgtactgatgtagctgaccgtgtcatcccacaggtgcacgcagagatcgcggcactgccgcaccatggcgagcttggccctctccctggcgagcttcaactcgaggcactctcggagcgtgtgcgcctccggcctaggcaggatggcgcggtacgaggcgaggacgccctcctccgactcccacaccgccacctccgccgtcgacaccgcaccgccgccgtctccgtctccggtgccggggccgccggcacagaggagagcgacgtcgacgccgcagaggatggagagctccctcgcctcctccatcagggactcctgcatcttcccgtacgtggcgtcctcctccatcttcatctccccgtacgcggtgttcgccacggggaccgcctatgcatcacttggagggaccgcctatacatcactggggtgatttttgagaaaaaatcatccagattttttcttcctttggatttgcatccaacggactacaaaataaaataactaatataaatttacttacacaacattttcatcaaaattacagtgcacttatatgtcatatcaactaaatttacatatgtaattttagttatataagactgtaattttatatttgaaataaaataactaatgcaaatttacttacacaatatttttatcctcaaaattacagtgcacttacatatcatatcaactaaatttacatatgtaattttatttatataagactgtaattttatattttaaagaaaataataagtacatatttacttacacattatttttattaaaattacagtgcactcacatatcaaatcaactaaatttataaatgtaattttagttatataggactgtaattttatatttcacgacaacgatgagagggacggtgtctctcgccgatcagtgttggccgtgctaccggcggctggctcgccggtcagaggccaccgtgtcactgtgcttctccaatctccgttatcgtgtgcgcttggggtagctagacccgaaggccgacgtgctggtgtccgacgcgccggctaacaaggctgcaaaaaaaacgtgaaatgtcagcaaaagaatcacgcgagtgatcgatagcaaaatcgttggcgacgtatgaaaatttggccacgcacgaaaatacgaatatcaagaaaggatctaatatcaaataattagaaggggtgaggcttcgaatttaggtcgtctaacccatcacaccttgatcgcccacgtacgcttcggtcggcagtggtcgttgctcctccgatccggccgtatagttgtttcaaaagcttccaacaagtccggcgcgtttgcccggcggcgggcggtggcgaggaggatatatatagagagcgagaaggagacgcgcggactcgtccatctctagggggctnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20062 - DNA, 692 bp, Oryza sativa
  unsure (1)..(692): unsure at all n locations
aaagaagagagagaagggagagggaagaagagatgaattaggctgacatgtggggcccatgtgggccccaccatttttaattatttttggncgngcagctgacatgtggggccacgctttttattatttttccgagatataattgccacgtaagcgccacgtcaatggcacgtgggacgaaaaccaagtcaaacaagccacgtagacgccacgtcagccaaaaccaccttcaaaaccggcgagggaccacgtttacccggttttcgtaagttgggggacgggtcatacccgggttttgtggtcaagggacgaaaatcggactgggcgacaaatagagggacccaaagtgatcttattcgatagatagaacctaagccgaactgggcctctcacaacgcgcaccaagccagcccaatctgtagcgcgcagcccatcaagcccactacttccgccccctcgcgcggcccatcatcgagtccgaaacatggtggaaggggatcacatcagcaaccagctcggacacgtactacgtgcacgcgcgcaggtgcacgtgcactcacccctgcatatgccgctgctataaatcaaagtcaaggccggaatcggcaggtggtttgccgcgacgacggacgagcgaccggagcgacatggcttttccttctccttctccggcgggcgacgacctcggcgcg

SEQ ID NO: 20063 - DNA, 6473 bp, Oryza sativa
tgatttcgtagttagcaaaattaatctttgcagcacacaggtctgggcatcgaacatatattcattttttttagggtagaacatatattcatattgaagtagcacttcctccattttaaattacttgtcgttttaattctaagagtattttttttcagcttaggattattataatatgaattattcgcaataatctaaaacaaacaagtagattattatgatagattatcataatatataaactagaaaagtataatctggcaatctcctctaaacatgctttttttatatattattgggtagctaaagacccactacctttacaaattttatgtaaatttacccaccaccgccatcgaacccaatagatctgcatctgcttcctctttctctctgccacgcgcacatccgcttcctctccagtcacccagccacgtgtgcataggcttcctctctccctagtcagtggcggacgcagctttataaaaaagatggggcggatatgttcgctcgataagtacaaccaaacacggcacgtattatatttatatattttaatcacataaaaagtacaatacaatcaataaattaagataaataagaacattcaagatattaccttttactagttgtgtgcccgtgcattgcaacgggaatcaaaagaaatcatgttcaaagctcgatatttaccccgccgatagccctttcatgattcatcaaagataaatatgagccctgagagctactgagctagtattttgttaccaaatgatattttgtttacaaattaaaagatataaagtattaaatgaattatatggcatgattaattttggataatccagacacaactaagcctttgtagccgaggtacaccttttcgatttaggtcatacgccaaccctgagctatatgacatttttcaccaaattttgatacatttttttatcaaatttagatcgatattactatttcaaatttgaattcttgaataccatgtgaaatttcactcatgcgttgcaatgggaacacattttatatcatattacgttattattttgttaggccaaatcgattgcataaatatacagccaacgacacaccagggccctggagggaggaccctgattcttgtttctccaacattctgcatcacataaactgaagcaagagcctgtgcctcgaataaatcttaacacggccaacagaatcaatctttaacaaaaatgagtggatccaacacagtcacaaagaatcatggggaggaggacctgaatagacatcacacaagagagaactttacataaactttacatgggcagaaggagcttacagaaggtcagaacccgaggcgccaccacaacctcctcgctccagatctggaggccatgacaccaccatcacactgcttgagctgtcgctaaggcatcaagttgcggccatcataaaccctttcgccctccaacctccttcttcctggcgtctgtcgtgaaaccaggccatgcccgctctcctcctgcttggccctcccttctccccctcacggtggatgcggcagcacaagggacatatcctatggtccctgaggtcaaaccctctgaatcttatgagtaccaccagaataacattttgagatacttgctatagaacttacctgccaaaatgcactcctgattacattgtggatgctgctggggaagtcaaccaagcatcaaccatggaccttcatacttcatatgtataaccatagccatcaaacacctgtaaaataccccaaaaatttgaaaccattaaccatctgctgtgaaaactcccatactgaacaaaaaattgaagaacttaacatctcagataagaacacactcctttaatacagaatgcaacatacatattttttttgaagagaacatacagaatttgacatctcaacccaataatggttatgtttatatcaatacagcctactgtttacagttgttgctcactaaaaaagcattaaatgataagttgataaaacgtacctcaggtgagtaggtgtgaaccaaaaaaaagtttttttttatatttttaacagcaattgaaacaatgcttttgaaaataattttgcttctttttaacatcaacgaccaaagtgatgtttggaagtaattttgcttatagatgaatgttatttcaaaaatttactgctggtgatgttaggtcccagtttgagcaaagtaatttatcaaaatgctcggtgttataactttattgcctagttttcacgtgcgtcaacagaatttgattgtgattagatctcaactaatcgtaatcattcttcatttaatttcctcgcctacttgctcttcttaaccaatcacaaccttcctccaatcattttcaccaattttcatttaatttcctcacctacttcctcttcttaaccaatcacaactttcctctaattattttcaccaattttcttaatactcatggtcacctcaaaaatatctacattttgggacaatatatgttaatgtaataatttaatacaaattgagataatcttattaaagactgtaataatttaatcttattaaacggttataaaagggcacgctgatcttcactgcaatagaagtcgtcgcagctatggtgtaggtgacacacaacatttaacatttaacgaacggcacataccgcggccaaagcccatggatgcctaggtgttctgccgactcctcaaccgccgccactaccgtctattttactgtgtcacctctattgatcgaatgattgtgtcacctctactgatcgaatcaagatcgaatgattatgtcagatctaataagggtagataatatggcgagatctaataaggataaataatatgacgaggtataatattgtaacatgactcgaagttatgtatcctacctaagtggttaatgcggtaagtatgggggcgaatatttagcattgccgtctcctcactcgctacattgattttgtgttactagccacacggtttaaaatatgtaatatttatatagacatgtaattgagctatcagtaatatatatataataaacaaattaaatatatcgtatttatcttattggatattccctttttttaacattaaactatgttttttctaagacaatgatgtcaaattgtatagtttttcagtttgggtaaccatttatttgtgatttctattgtctttttcactaaactatactaactaatattatcatttgggtttcccattttgataatcactttcatcgctataattttatttcttacattattatttgcgttgcttatatcaaattatcgatgttaaaaattaatagatgtacttattttattaccgttgagtactctaataccaaaatagtggtgcacatcctctaatttgctctagctcctttactgcgctcgcaacctctatcacatgaatatactaatatataagaaggcaacctacacggacagctcgtactagtatccatgggatcaatggcacgaggcatccacaatgtggtagaagaggaggcaatagggattaaagtattcctactactactaggtaagacacactatgcacagcggcaacgggaggagctgtcgtgggggcacgacgacgatgggatggcaacagcgacgaggggcgggggcgcgatgacgggacgacaatggcgacagggggcgtggcgagctcctccccctcccccccacggtctcgctagtggctgggctgctcggtcggcgacggcgccgacaacctccttcctcttttctattgatgctgtttttctttttattttcatgttcaaaatgcttgtatgctgtgctcacttccatgttaattgaatctaatgaactctggatgaggatttgaatcgatgctcgaaaatttggatgtggatttgaatccgtacatgctgcgaaaatctgatttattttctttttttttggcaaaaagagattttggggattagttttttttatggaaaataattttcactggcggcccacataatgaagccgccagcgaagactattttttgctggaggagcacataaggcagccgccatcgaaggctatttttgctggcggcccacataaggcagccgccagtgaagatgattttctctagcggctgtctttagctagctgccagcgaaaagttatctcctttagcggtttatcgccgtcagcgaagatgctacattttcactggcctttgctttgtggcagcgccaaatgccgcaagcgaaagcccaaaatagccgccacgaaaaatggtttttgtagtagtgtgggaaagcactagtagtgtggtggtagagtggtgggtgcatgactctacccaccagagttcaaatcctaatggccacaaatattaaaagcttggctcatgtttacgacattccacaaaatatttacaaattagttccagatattgaaccacgtgtcttaattagttctatacggtggcggaacttaacaaaagcaaacaggagtgaaaaatgagtacttcagtaaaaaaaaataaaaaaagagagacaaaagccattgcaatgaaggcaagtcacggtaatatgaaccttcaaatttatttttgcagcaaggtgttgaaaattctccccctttatatcaacatgttctctcatgactcttaattacacagcaacatcatcctgtagccttgatttcttcttcacgattcttacacagcaacgtcgtcatcctacagccttgatttcttcttcatgaagctataacaattatatatgtgaatatatagcaggtttcttttgttgtaagagaagcattggacctacaacagccatctaaaaaccatgatatttttcatgctctaactgaaaagatctactaaaatctacacaatttatatatgtgaatatataccaggaaatctggaaaaagaaagtatatatgatgaaaatatgatgttcatcaaatagcagaagtgatgttcagatattacctcctagctcagatctaatgctggatcataaattatggcagcgcataaggcattgttgttcatggctggatcagttatttttaattacttcataagacatgcatatgcagctatgcagttatgtttatgccatagtccattgcaaaggaaagaaaattttaatggccatgctactgaggtatacttttagcagaaaatggaccatcagtattgatattatattgaggaaaaagaagtgcgctgagtaaaaaaatgagctcattattgcccatctttactatccaaatgcactatctcattctcatataaagcagaaacagatatatatccatttgatctgatcatcaacccgatgagattctcaacagtttgaattgaacacgtagaatatattcaccgatggtgtgcacaaattttacccccaaaaggcaagaagcgtgcggatcaatcggtcaggcatatgcacaacactgctaagtcacagatccaatcaattacagagtacagaccaaaactctgtgggttctggttattagttgtgctaattaattactagcaggcatcgaagcatgcatgtagtgtttccttttctcccatgctagtccttgtcctcgtatgcatgtagattgatctcatgcatatgcctgtatattgcgcagctgcatatgccgcaactgttcgaacagccgtgcccatggtcatgggcggatgtgaggtgtttcctgtagcgtagatttgtttgtctgtgctttgtgaaaagttgttgtggtttgggaatcgttaccagaatcagcttatgtggcagatggataacctgagtggtcaagaaacgaatctgtgtgattcgggatgtttacgggcatcatagactaggcttcccgagtggaagcggattgttgtgctgctgggcagctgggctctaggagtcccagaaaatgaaaaaggctctgggagccgactaatcaagtgaaatggctctgggagccgagaagtaatgatctgacctgggaggtcggtacattacctaatgagttgttgaaaaacatctcttaaagtcgaatcgagacgcaagtctcttttcggcccaaacttagaaagaagtaaaccacttagtgatttcaaaatgatttcaaaataaaggatttgcaaaacaaccttgcctctcttccaagcttgcatcaaacacctaaattcccgtgacttgctgagtacgaaagtactcacccttgctctatataaatatatatagttcctctgccttgaagtgacgatgaagtgaattgaagattagggtttcgtcctggttcccagccgtcgcctgtggtgttgggtgttagttcgttggttccgctgctgctgctgctgttggtgtttcctcgtccgcatcgtcggttatattctcaggctgtcctgcgctgcaacctaagttaaggtaaataagtcctctattaaatttaaggattgcaatgt

SEQ ID NO: 20064 - DNA, 5613 bp, Oryza sativa
ggtgtgacagcacgacaatgccctcaggaggggaatgtcatttaagcgccattgattgtcagtatggccgaggctgtcctaagttttcacccgccgttcaccacctgccaatctaccactgaaaactccattgctccaccgccatcaaaaactccgccggtgtgtgggcacactgcaccggcgccccccaccagccagtctccgcgtgcagccacctcaccgggctccgcctccgccaacatcacctcccgctgtgcatccatcacgcgccggccgtcctcaacgccgccggccatgcctactcgcgctgcacggctgccagccgcaactccttcggcaagccggtgctacctctgccgtcgcgagctgtcggccgagcctctacctctccggccaaccgcagccaccagcgcacgcgcatggcgccacctccgccgctgacgtggcctcctatccccctctccccaccactggcgcggtctccagggcctccacgccgtcgcacgtgcctccacgccgtcgcatcatcgccgccagccgcttcctccgtcgcccacagcaccggctgtcacatccataggagctcccgccgccgtgtgtcgtcgaccagccagatccagccgatgcggagacagacctcgcccgccgccgaccccgcctccgaccgcctccctgctagatctaggcgtggatttggtgttataaagattcaaacaaatagaatgttgtagttggatcgtagatcagataagtagttataagaaaaacattttttttgaacggaaaacagcactagagtgccttttcattgaatagagcaggagaaaatacaaacccctaagggtaaaaggaaaacggagaaccactatagctgtacactagtacactatacagagtgcaggattaactcacgcaaccgcttagctcctgctaaagcccaaaggctcgcctcctctttgattttcattagtaggaagttcgttgccacctctttgtgatcaaaaatccgccgattcctctctttccaaatttcccagacgactaacagaatgagcgatcgaagtccttttttcgggacactaggcgtgtttgcaatgttctcccaccactgtttgactgaccgggcttcctcccattccgttgggtccatctgctgatagcccacccatgcagagacgaggtgccagatcctcttggtgtatctacaagtggcaacgaggtgcaatgccgtctcagtctcgcggcggcaaagagggcaacaaccattgttctgccatcccctggtcgcaagccggtctgaagtccagactctgttctgaatgatgagccaagcatgaaatttgcatttccccggcgcccaggctttccaaatcaaggaattgaagtttgtactcggcgccccgcagcactgcgcatggtaagccgaggaggccgtgtagtgcccgttgtttgtgaacttccaagtaatctgatccggttctccaacgtctaagtgcacatttcggaccgcttcccacagtgcgactagctgttcgacgaggtcgactgtgatagatgattgtgaatcaagcttcaaatcttgcacccaggcgtcctccttctttccttgccgaagggattttcctctgttttttgagatcgcaaagacaagtggcatgaggtctttgggtcttcacccaccaatccacgcagactcccaaaatcgcaccgtgtttccgtcccttattgttatgtttgttgaggcggcgaagaggttcctatctatttcatcacatggcgtctccagccccacccaaggtttggtctggtccttccattcatgccacagccatctcaacctcaaggccctcgtgaatttgtccagatttaggacccccaatcctccttggctggtcggcatgcacgtctttgtccaattgaccttgcatttccctccggtaatatcacccgtgcctgcccagaggaagcggcgccgctgcttgtctagctgctcgagggattcctttgtgattttcagagcggtcagaaggtagattggttgcgccgttagcacagatttgatgagcgtagttcttccagccgctgccatgttttttcctctccagcttgctacccttctggaaattttgtcaaagacaggttgcaagtccaccttccgcagtcttcccagagctagggggaggcccaagtacttgatggggaaatttgccctcaccacagggacgccctcaagaacctcattcaactcgatgccgccgcatctgatggccgccacttgggatttctgaaaattggtgacgagcccagttgcagtgccgaagtgctgcaggatgtccgtgaaggccgtaacatcgcctcgggtgggattaatgaagatgatggcgtcgtctgcgtacattgagatccttagcctagttgttctcccccgaatttttgagattgcgccgagctctatagccttgaaaaggattcgctgaagggggtcaatcgcaagtatgaaaaggagtggcgatagggggtccccctgcctaaggccccttccgtgcttgatccgctgccctggcaagccgttgagaagtacttgggaggtggaagttgatagcaaagcccccagccaatctatccactttgttgggaaaccccttcgctgcagcaaggctagcaggtaatcccagtgaactgaatcaaaggccttagttatgtctaacttgaatagcagcatcgcccgcctcaatcgatggtatcttctggtcatgtttctcacgaagaggaagttgtcatgtatgcttctcccttttatgaaggcactttggttgatcgaaatcaagctgtgcatatgaggccttagtcgcaacgcaagcatcttggagaagatcttagcgatactgtggattaggctgattggcctgaagtctgaaacgccctcggccccctctttttttggaattaggacgatgttcgcagagttgatcagattcaggtgtgcacatctgagattgtaaatggagttgaagaccagaaggacgtcctcctttatgatttcccagcagactttaaagaaaatcctggtgaagccgtctggccctggagctttgtcacttggcatttccttgattgcttgatgtacttcctgttcagagaagggctcccctagggtggctaggtcaatcagtgagatgtcaagggcatcccaatttagctcatttggtcttggcgccggccgctccattatgctcgcaaaatggtcatggatcgttgcttccttctcctcatgtgtcacagcccaaccattgtctttttttcagccgatgaatggtgttctttcttcttcgcgcattcattttgagatgaaaaaactttgtgttcgcatctccctcacggatatgtgttactctggaggcttgctttttccttgcccgctcaatggaagcgaggccaaggatcttacgcttgagggctgctcttagtcttgtttcctgggcagagaggtctctatgttcttgtgccacatctagtcttttaatgacgtcgaccgccatgtgaaactgcagtttggcctcggtgcagattccttttgcccattctctaagacaggtcgcggtgcgatgaagcttttcatttaggtggtgcataggctctgtgtgtgacgaaggctgacaccaggcatccttgaccttgtctttgaatcctggaattcttgtccagaagttctcaaacttgaaggcactcggcctacatggacattgggggtcggagaggactagagggcagtggtcagaaggccctgtgggtagggcgtgaaggacatggtgggggaaggccaagtcccaagtctcgttgcaaaagtagcgatctaacttaacaagtgtagcccttcgtcgttcattgctccaggtgaacttcctattttgcaagggaatctcatgcagttcacatcgatcgattgttgagcgaaagcgtctcatgcgtgcaaggttgacgttgctgttgtttttgtcccttgctcgatagatcatgttaaaatctccaaggataagccatccatcctcggggccgggccttattcttctgatgtgccgaaggaaggcgcttttgaggtggtgccttgtgggcccataaactccggtgagcagaaatgtggcccctgtgagtatgaccgtcacttgcgccgaaatcaagaagcggccgactcggacctcttggacgtcaaagactgcgctattccataagaggaggatcccccctctcgtgcctcttgctggcttaaaggcaaatttgtcgagcttgtagcctcctaaaaagtgggcgagaccgtcatctatattctgtagctttgtctcttggaagcatgccaagctgcacttcgtgtctgccataagctcatggatcgtgttacagcgcgcagccgaattgagccccctcacgttccaggaaataatatctaggctttgcatcattttagtaaaattgttctccgtattcgtggcccacgcagggggtgggctgcttggtcttatatatatatatgtattgttggagcaaaagatagagcagtggtactagtacattagttgttagtagtacacatggattggttcaccgatcagggtcttcattctcccaaatcctcaagatttttcgaaattagttgagggaaaaaggaaaggagatcaaggggatttggtttccgtgatcaattttagaggataagcaatagagaggccgaatcgagtcggattgcctggagatggggtcgggtgctataaggactccatcccgagcttaaagacgacgcactgtgggtgtggggcccaaacgccagagagaggaggggctgagggaagccggctggacttttgggagggagaggaggcgactaggtcggttggaggagggacgaaaagcatacttttccagttctgacccgaaaggagagggagttttaattacttctctgattaaattaatcctcaaaatgatcttctaaagtttgaaaaatacttctagtgctcaaataatttcaagaaaatttctaaaaatacttggacacaaagtatttactttgataaaattttatttagctcaatttgatgattaatttttattttaaataatcattgaaatcgatagcatgttgtaatcgtatttattaacttattaaaggaatagaaaaaggagcctccacgttcgctctcatggcctacaaattctcatattaatcggagaaaaagaaaaaacagagtctatatagaaatacaatttagaactagttgaaattcggaattaaaaaataagaaatattggaagagtagactagaatctatatagaaatacaattaagaaataatagaaattcagcattaatatagagtccatataagaatttaaaactaactaaaatttagaataaacataataaaattaaaagtagagtttagaattcatataaaaatacaatttacaaataactaaattttaaaatttaaaattaaagaatattgaaagatgagtttagagtacacgtataaaatttagaataaacataataaaataaaaaaaaggggttagaattcatataaaaatacaatttacaaataactaaatttcaaattt

SEQ ID NO: 20065 - DNA, 30996 bp, Oryza sativa
  unsure (1)..(30996): unsure at all n locations
aaaattcgaaattaaaaaaaattgaaagacgagtatagaatccatataggaatataatttacaaataactaaaatttgatattacaaataattaataactaatacgtatataaaatacaatatgaatattatacattagtagtttcgtaaaggtagtacaaaatttaaaattatgttgtgaatttaatatatttaaataatacattgagaatatatatatatatatatatatattattatacgagagaaaatataataatactggcccgcgcaaccatgctagtttcaattgaaaacatatactgcatccgtccaaaaaaaaaaaagagccaacctagaaatagagaggtctgtccatattggcctttgtttttttttttttgggggggggacggaaggagtaaggggaaaaaaatacaaattcataggtcacctatctttaaaaaactgataccagttcatgaataaatttatcttcattataacgagttgagctgaaattccgtacattacactatatgatagttctatgattatatcatattggacatataagttgttttctccaaaagaaaaaaaaaagatatttggtgaagactcatcagctcggcgtcctcggaagagtcgagagactcaagaagactcaactactcaaggcctcaagggcgcgggcttgccggccccagatctgccgcggtggctgtgcagcagccagggccgagcccagttaaccgggactgtcttcgtcagctggcctgccttcgcccctgctccgccgccctctccggaccttatcgatcattcgatcaccatcctccggttcgatccttgttcgatttctgctacctccatgttaggttcccgtccacgatgctgccgtagagcctccacggccgtcatcttgtcgcggtgtcctcccgcacgtggtcaaacagaaggtgcgcctgcctcgatagggtggaggttgatgctgctgggggttgacacggagggatcgaccaggtggagacacgccgacggacttccacatggtgagggcgagggggttgaacaatagcgcggagaggtagtcgacggagagccgaagggattgggctggttgggccagtcgaggcggccaggcccgcgcatgtagctagcaggcggtaaggctgtgctagcttggtacgacagtggtagtcagccgatcgcggaggaggccagtggcgaggacgcggacgcggcgaaggacatcgcgataagatgactgcggcggaggccctgcggcgacatcgtcaccacggcaacggtgaggacctccccgtctcggcgtcccacctgacgtctgcctcagcgtcggcttcccagtgctagtgcaaagctagttcgaggatattcaggggctgtttggatcggatttttagtcatgtcacgtcggatgtttgacactaattagagtgttaaacatagactattaacaaaaactcattccataaccctggactaattcacgagacaaatctattgagattaattaatccataattagcatatgtaatactacagtaaatatgtgctaattatagattaattaggcttaaaaaatttatcacacgaattagctctcatttatgtaattagttttgtaagtaatctatgtttaatactccaaattaatgtctaaatattcaatgtgatagagactaaagtttagtctatgtatccaaacaccacctcagtcgtttgtggtctagattattatcagttacttttctttagataatgtattatcagttaatagcagtttagtacctgcaatcagttagtactttgtttgtagtctatgttattgtgcaagttcaatggtatgatttgtaagcgagatgcttgttcaacctcaattttcatgtttcagcttgcaaaatgagatagttctgaacatgacctgtggttggctgtgcttctcctgcacctgacaatggtcatttcttctggtaggagattttaccagatctatcctagtaccatgcatgtacacggacgcacacaacgcatgcttgtgcgtaattcgcgttcggcccagaggcgggacgacggcggatgaggaggccagtggaattctaatttgcaggttagctaggagctaacacatgcgtgacaagaaaacctcagaactctgaccaagaccactagaccaggtgggtggcgatgcgccggccaattccatggcccttgtccggaggaaacgaagcaacgaggcggcgactgcaattggagattgggaaggaatggatggcgtcggcggcggtgacgacggctccgatcgaggggagtggatggtgttcatacattgtggattcacatcctgcaatataatggtattatcattacagaaactgacatgtagtacaataaaaaaatatgacacacatattaatgactgtaatgataataacattagggtagaagatccttacttgtgcattgctagttttcaaaagagtagtacaaatttagctttccgcgttcatattttatttaacagttatgccctttcatatttctattattaataggtggtatcctaaataaaactagatataaatttagatttctactggcagagaacaccgggactctcttctaaaaggcggcgatggcgggatggagcgaggagtcgtccggtggatggcgggcggcttacttcggtagtccgacggcgcgtgggtaggtgcactcggcgcaagcgtcgggggtgggcagtggcacggctccacttccttgcggttgcctctccggcctccgacgcggcaggtgagccgtgcccaccaatcgctcgacgaaatgctctcgcctccctttccatttaaccttgcctgttggatggcaggttttgcgtgggctgaggatcgaccattccgaatgctcagacgtgacggtcaattggactccgacgggcgggctggcggtggcggcggctgaggccacggctctccctgacatgacgaacgccgaaaggctgaggtacgccacgctatttgcgcatctcatgtttcgccagtgcacccttcttcgtgggtcagggttgaatgttgttggaatttccggattttccttgttcatgctggtgaactggatctttttcatggtaaattgtagttagcaaattgcagaggaaagagaaaataaaaaaaaattcaaacgatgttactgccctgctcaaaacaatggaacacattatcttccacctcctgcaaatgttcgaactgattgttaagagatgtgaagccaaatgtgggcaaattcactaatctatgcatctaggcaataaatcaacagtaatatgctcgtcagaagaaacaattcaacatttattttttgaccgtcccttagttagattcacttggaatgttgtgatttgtgcttttggtatgaatcagattaaagacttgagacatgctttaagttcctggattcaaccttgtgacaaattacaaaacaactaatgctagttggtgtggctgctataatttgggcatttggaaagcaagaaataaggcttgttttgatcaaatcttaccaaataacccaactgacattatatacaatgcttgttcctttttgtcggattgggctgttttgcagaattcgggggaaagacaaggaaggttgcaatggggagcacaactgctaaaacaagtggcaaatgaggtcttcaactcgcagttcggatggcgcatcaggcaaagaagattagctggtagttgaggacacaatggtgaattggagagaaatgagatgagttgtggagagatagcttaaactctaaggcctgtgctagctggctttcgttttgtttttgtttcttttgtgagcacctgggggttcttcccctctggttttccaagactcctttttttgtaagaactcatgcgtttctttaatggaaatggagggctctgccctttgctcaaaaaaaaaaaatgctcgtcagagaagggcagattcacactttcacagatgaaggaatctagaccaaattagcactagttgggttgtcagagtgaaaaagtgcaaattcacagatctaggcattttttgtactaaatttatactagttatataagaggataagacgataacaagaccgcagtccgcagctagccagcaactactttgtttaaactatttttcaatgcataaaaaaatggattgcaaacagcaaaccttcttcattcaacttcttgatacttttcatctttgttgcacttctcagctctaattcattgtaatgaacataactacaaatcggaggcaacacgatgcacattttgcacctttacctactaaaatgtgcagcatttgttgcaagtgctgatcggagccagaaccttaataagcagaattcttaatcagcatccctaatgaactaatgcttaataagtaccctagaatttgataagttctgtccggcctggctatcaacatggaaaaacctacttgaagtgattcaacaaaacctaaatcctccactttagcctcttaaaatccaacatgttcctcctagatcaccctgcagaagcaccttatgttcaacaagctcacctatacaaattttagcttgtataatgagagtgaacccactaaagtatgccctaaaagcagtagcataaactttctttcatccttgctaactttgcatcagaccaacttgtttcaggaaactgaagatgcttcaaaattccatttgttaagaaagcatgaagacaagtagtgataccctgaaaatataaaacaattcaaagaagctttagtctatacttccaaggtctaaaccaataatatagacacaggaatataaaagatactatttcataaattatttgtccaaagtaattttggacaaagaaataattgaacataccttcagaaagtttaagaactaacagctctgtactgattgctttcgattcatccaaattcaattcatgaacatcatttgttacagtcctcctcaatttcattaaatgttctttacctccctggaaataaacttcacatctttggagattcaaaacttcaattgactccaacaatcgacatggaagataaattttgcccaaacaatggtggatcttcaagcgcacaagggaagtcaatctatctaaacagcttggattacaggcaaatatttcattacaaccagagatctcaagctcctcaagtgacgcttttaaacaacatactggcatgtcaattaagacctcacaattcttgatttggacctttctaagctgtggaaatggaggaatttgcaaatcttgtagttcttctatgcctgaccacttcctccaatttggcatatcaagaaatgtcacctccttaagagatggaaataccctgtatccttttccacaaaattcatatccaattttctcaattgctgttaggccttgaagaattaaaactacaagggatgggagctgtccaagaggtggaagtgttaataattgtttgcattcaataagatggatgcgccgcagattgatgaagtactgctcttccgccatccatgatggaaatccaactcccatgtagcactgaattttcagttcttcaagatttgtatttggttttaagccagcaagagttctcatgaaaccatcagcttcggctaatggtttgcatgctgtcaacccccatctgaataccaacttctttaagtgcctttttttgaataattcagcatcactcactacatctgtgcttgctactttgtccagatttccaatacatagttgtccactgatttcattcaggttctttagttctgttattttgtgcccatccattctaccaacaagaaattcatctaacccttggagattagtaagcttccctatcttgtatatcaaggaaaccgtgtgagcttctgcatataagaaccggaggttcactaactcatttatagctctaggtaactccttgaactgacatcctcgtaatccaagaacttgtagtaggtgcagcttacagagggagtctggaagtactgtcatcccagtaaaggagagatccagaaaccttaggtgtgtgaatttgttaatgaaatcaggagccttctccaatttagcttcactgtaagagaaatctaatactcgcaggccacttaggtgtgacagaatattagcaaatgcttcgtgtggtttgattgttttgcgaccatcaaaaagcaaaatggtccgcaacttgttgtcctttctcaagtctaggtgcacattaaaatcaggaaaactgatggctaggtggcggtaatcttggagccgtcttttctgttctcccaactcactagcagcatggcattcttttccagcaatggaacataatggctttctaatcatatcaggcatgatgtacctatttttccagattgtgggctgaaagaatgatcggcggaaaagctcatcaaaccattccttttccatttctttcatcccaatcccgtcatgttgttgcatgaaactagctatccacatgtgaatcaacatattcttttcaaacaaataaccagatgggaatattgaacaatagcacaaacactttctaagatgatcacatagatgctcacacataattgccactgaaggtagcgcaacatcgtcttcatcttcagaaaagagccaccagggactcgaggaaattttttgccaatgcgccttatctaatctttgtctcagaagccttccaattgcttctgccagcaaaggcaatccatgcaagttttggagcacctttttaccaattgactcgagggaagctcttttctgattcccaaatgcatggtgctcaaatactctccagagcactggagatggcaggtaacccattggaacctgagctgtcgctcccaaactatttgcgacttctttcgattgacatactagcaatacaacactgccatttgctcctcttgccagtgtcgaccttagggaatcccattggctgtgcagattatgctgcacatcatctaggactaggaagaacttcttgtttcgtacgacatcaatcaaactgctttctgatgaaaccgactttctttgcagattttcctcttgctcagacgcaaaagactcgatgatatcttgttcgagacccgttcgactgcagctacgagaggtaaacacccatcccctcaacaggaaagcctccttgacgtttggatcactgtaaatcagctgagcaagagtggttttgcccacaccagctgctcccacaactgatatgacagaaacaccagagcaggattcagctccatcctgaggacacggcggtgcgccggggcgtaaaatcatcttcacaagctgctgctgctcctcgtcccggccgatgaccgccggcggggtggctggcaccggaaggaccgatcgcatcgcccccacgtcgtcgtcggccagtttcagtatgtcgtggaagccggtcgcgtcgctggtgatcctgttcagcttggccaggacgtccttgagcctctggagatccccatcggagaggacgaggttcctgaggaacctgagcgcgagggacgtggcggagccgagcttgctgcccctggccctgagcgccgcccggatcctccgcgtctcgaggtcgtcgagcaggtcctcggcctcggcgacggcgttcttgaactgctgcacccacgcggggaagctggccctggagatggccctgcgctcggtcgcctcgacgaggatcctgatccgggggagcgcggcctccacgccgtacagcatgtcgccggcggcggcccggagggcggcgtggtgctccatggcggaccgcaccttcgccaccaagttggagatcacggcgccggcgaaccacccgccgaccgtcagctccggcccgaccattcctcgagctctcggcggtggtcgaagtgggcagttgaccaaagcaggcagccgcgagcccgcgacgcagtggatgctatggttggattcaagtcggcaccaccatggtttgggtttttcgctttcaataccatttttcccacgatcgagcccgtaccgaatggctccgtgcaaaaccatgggcgaatccgagtttttcttttcgattttactctctacgatctaaatagtggcgaagccgaaaattactgatttctacagaatttatgaataaacataggtcttgtttagttcgggatgagaaaatttttgggtgtcacgttagaagtttgatcggatgtcggaaaagtttttcgaacacaaatgaaaaaaacctaatttcataactcgtctagaaaccacgagacgaatttattaagcctaattaatccgtcattagcacatgtggattaccgtagcacttaggactaatcatggactatttaatctcaaaagattcgtcccatgcttttccatacaaactgtacaattagtttttttattttatctatatttaatgttccatgcatgtgtctaatgatttttttttaaaaaagaggaaactaaacaaggccataattttggagataggagtagggttcgagttatgtactaggcctacctccctccctagttctccaaaacacttcatccctcttatagtataagagattatgtgccttttcgtttatatgaaatataagaaactttgttaaacatttagtaacttttatattagttttttttcctatttatttctcacttgtcaacttttgtaccatgacttacttatactattttcttaattttttgcacagaagaaaaacatatccaatatattatgaaacaaagtgagtaaaagggttgtttagcacctattacgattgaatttgaatttgaattaaaaatgtgtggacttttcttgtattgaaataagtgccgtagaaatatttttattgaggtataaattttaaatcctaaaaatatttatattttaaaacgaatggggtattatttatggctaatttaagggattgtcttcctaatggtacgagcaaattgttcaaatccataagtaaaaatgaagtcttttaaagatgagggtagtggcttgcgtaactcaaacaagtactgataataaacattaaattgaatacacatgtattaacagctccttcaattggtactattaattgttttagtaaaatatttcttctgtcccacaatataaggattatgtcgttttaaacataaattaaggatatagtaaaaggatataacatagtataaattatgatagatggaagaataaaatagtataagatttgatagatggagaataagttaatacaagagttgattggtgaaaaaataaactaatataacagttgatatattcaatcacaaccctcgaccactcagttctagctactttcttaataagcgtgtccaatcctaaaatttcttatattctacaacggagggagtatattattttgggatccaaatccctaaaattgtaggacatattatatgggcaaaatcccttatattatgagatggactcattcttttaacgacacactaagagtctatgacacttttccatattttcgttacgaaaaaaagttcaaaggtgagttctttttattggttttagttccgtcgacagtaaggcattcgtgatgactccatcaattttaaaatatatcggttcagtattttggagatatatggtagtgtatgcgttacgagtgtgtttgtaatttcttaaaaaaaaagggtaaatagccaatatggtccctgaagtttcgcttcgggctcaatttagtcctggatgttctaaattgtccaaacaagtcctctaaaataattatttgggttaatatagcccttgggcccaaaaaaatgcaacgtgagcatgccaagtcatcctcgcatgtagcaatatgaatgaaatgaccattctacccttatataccacaataaaaaaaaagacacaaatagaaaaaaaaataacaggctagtccaggcccaacattgttgcggagggtgaccgacaaaggaatttatacaactaggtgaaaccccgcgcattgctgcggaaatttagtatgataataataaaaaaataacgtgtaagatagctagataacatcagattaagtgaggatgaactatataagtatataggatatcataaaacataataaagatatacattgaaacattatgtgaattatgttggatgataatttaacatgtttctatttgaaaagctcttaaattataaaaactataaagatatagcttgtttgcatgatgtttaaatatgatgattgttagtggatgatgatgtggcatcttgttaattagtggatgatgatgtgacatctttgcatgttaagcttaaggaccccactaactttatagtaagataggattagtggttagctgcagcaatcgtaagtgacaattctaaaacgatcatacatgtgtgagacatttatctttttttcttttcttttctatatagtatataagagtagaatggccatttcatttatatcactgcatatgaggatgacttggcatacgcacgtgtcactttttgtggtccaaggactatattaacacaaatgattattttggaggactttctttggacgatttgaaacctcaaggattgaactgaacccaaagcactttaggaaccatattagggcacccccaatggtatctataggctctctataagagatccatgtcagcatattttcctacttggaaggtattaaatgaagagagagagagcaaaactatctactaacttagagatagtctatagagaaaaacgaggcaatgcatgagagagctatagataccaatgtagacatactattaaggtggtttactattaatcgagtttattgctgagatgtacatgttttatagagagcaccttactttaccattgcgggtgctcttagctattcaccctttaaaaaaaataaagtctcgctgtcaacgccggtcataccgcaatccaacatttttagggcccctttgatttgaaggaaaaacataggaattttagaggttttcaatcctatagaaaaatttcctatgaagccctttgaaacaaaggattgaatcctatccaatcctttgaaattcctatggaatggacaatcctatagagattttggaggaaatttagcaagagcttcaacctcttgctaactttcctttgagtctatctctctcatccaattcctgtgtttttcctgtggttcaatcaaacagtcattcttgtatttttcctgtgttttgcaatcctttgttttacacttacattcctatcaaaatcctacgtttttcctattcctacgttttctcaatcctgcgattcaaaggggcccttacctttggggccagtttagttcccaaaagttttccccttcacctattacatcgaatctttggacacatgcatggagcattaaatgtggacaaaaagaaaaaccaattgcacagtttagctataaatcgcgagacgaatcttttgagcctaattaggccatgattagccataaatgctacagtaacccacatgtgctaatgacggcttaagtaggctcaaaagattcgtctcgcggtttccaggcgagttctgaaattagttttttcattcgtgtccgaaaaccccttccaacatccggtcaaacgtctgatgtgacacccaaaaattttcttttcccctactaaacacagccttgctctctctctctctcccggtgacgcagcctcactctgtcgttatcactgtcaccccgcccaaattccccattcccctgcaactcgcgaatcgcgagaatggaggagctagtagaagataacggatggccgctgccggcggcgatcgccagggtggtcggcaagctgcgtctccacctgggaggcagcagcgacgcccacaagtacaggggcaccatgaagatgctcgatctgctggaggacaagctcagcatcctccgcggcgagagcctgcagggcgtcgacgccgacagggaggaagaggcggccgcgtggctgcggcaggtgaaggaggccgccgacgaggcggaggagctggtcaacgccatggaggcttccgcggcggccgcagcttccgatagtagcagcctcctcctcggggtgaagtacaccgtcggcaagctcgtcagcgcgtgctccgaggtcgaatcgcttcttcccgtgccgggcctggacgaggatggactggaaaccccgggggatgacgtcgccgctttgccccctggccctgaccaaccctttgtgttggcgagatgaggaaataggtgtcatattggagatgatactggatgatgcccgtttcgtggcggatgaatcggttgaaaaaaggaaaagtgctgatggatcacagatttctcggaaaggatggatcatcgatgccctccggagcatagatctatctgaccagagaaaccancttgcagaatcagcagcagcatcccagaaagaaatgggcagcagagtgaaatacaccagggtgcagagcagcactgtcagttcaatgtgcaatccaactgtcattccaattgttggagtgggtggagtggggaaaacagctcttgctcagttcatcttcgacgacgaaagggtgcgggagcacttccgcggtaattccgcatgggtgtatttcactgacaacatcaggaaagaagaaccgatggcgcagatctttgtatcgatgcaacctgagcataatatgctggaccatgctttcagtctaaacagcctccgtgtccaacttcagagcgtcatagaaggcaagaggttcttgcttgtgcttgatgatgtatctgatgagatacgtgcaatgtggggcgatttaaggagtgcactgaagaagggagcacctggaagtgttgtcttagtaacaaccaatctgtatagtgtggccagctttgtgggaactacaactccagtatttttggattatctacattatgatgacctgtggaagctttttaagcatcatgcatttgccagttatcaaagtacagaagctctagaaccaattggtagaaaaattgtagataaagtacatggatctcctttggcagcgaaattcattggggcatcattaagaaattgtttggatgaagcgtattggaagagagtcttagaaagttggtggtggaatgtttcaagctgcagcttcgacattcacataatatcatctttcggaatttgtcacagtgaattacctgcatatttgaggcaatgcctggtattttgttcaatctttcctagaaattatttatttgaaaaatatgagttgatccaaatgtggatagctaatggttttgttgaactggacaacactactgttgcaagaaaactggaggatgtagctggtgaatggtttgatgaactagtcaataagtgcttcttacaaccgacagtttggaaagcttggtatattatgcatagttgggttagagactttgcaatcgccttatcttctaatgaatatcagggtgttgattgtacaatgggaaatctcccacgaagtgtacgtcacttgtccgtagatatggatgctatgaatataccatggaccgagtatagcattaaacagttgcgatcattaatattattcggtggcttccgtcataacaactctagcaaaggtttcaacaacatttacaacattttggagggcagttatgatgctgctgatagcatttctgagaggtcttataacactactgacaaggacactgctgataacatttctgagtggtcctctttcagttttgatgatggggaagttgatatcgttgctatcattttgaaaaggtattgtgacattattggtagcattctaaataggtcaacaagcttgcgcttgttgagcttatctaacttgagagcaaattcagcaacagcatgcattggtgattatccacttgaagaagatggcattgcacaatttgtggagttcaccacaacacatcagatgctgccctatttgactcacctcagatacttggatttttcacacagtgggataaccaaactccctgattcattatgtagcttgtgcaatctccaagttcttggtttgagaggttgtagattcacacaattaccaagaagaatgaactcactagttggcctacggcacttgcatgcagatgcagatacggttgctttaattcatggcattggacagcttaccaggctccaagacttatatgaataccgtgttaaagcagaggatggtcacacgttaattgagttaaaggacatgaggtatatccaagggtccctttgtatatcagatctacagagggtggctaatcgagaagaggcaattcaggctaacttaggaaggaaggagtatgttacctgtttagctctgaagtgggatagaaatcagtcttctagaggtaaatataatctatatggaaaggagttgagtcaattcgacagaggtcaaaagcagccacttcaagctagcttagttgagaagaattatacttcagatatatcaggatatctgatgaatccaccagaggtaattaaacctgatcaagacatggagatattagagtgtttgtccccaccaagaaatctgcagacgataaaattttttggctacacaggtttggcttttccagattgggtcgtacaactccggtatataaaagttattgagataagccattgtacagaactccaggtgcttcctccttttggacagcttgagcatcttaggaaactaattttgcatgagctgccctccatgaaggatgttagttctgatgtctatggaacctcaaatgtggcctttaaatctttggaaatcctgtgttttgagtctatggggaagttggaaaattgggcagattcacagaacgaagaaagcttttcaaacctgcaaaatctgcagattaatagatgtgataacttgagggaactacctttgatgtccttgggcttagctatcagaaaactctctcttacgggttgtggatcatatgctgaaacagtcttcaggtatttgcaaaaactaactagcctcacacacttgagcataaatgattgctcccagaagttaatccttccatgtcaaaacctgatatcattggagaatctgcatctttcaaattgtaaggagctatactttgagggtggaattcttcgtcttaacaaccttaaaaatctacatatttctggctgccgcaaaatcatatcgacagttgaggaagagattaaccgactgttttctaactgggaaataaggttgggcaaagaccagtcacttgttctcaaaagtggactcctcaatatagccaaagagctgggtacaaaaaggagagaactcccccttcccggttctccgcaaaaagaagaatttatgcatactttacaatatctcactgaccttacaatggataacctttcccagtcttcagatcttgataattttctttgcaagctttcagcacttcgaactctgtgtctccacaagatcgatgtgatctctcttcaccaagagaagtggcttgagcagattacatccctacaagagcttgagttctcttgttgctacctgctaaggcagctcccatcaaacttggtcactctgtcatccctgaagaagttaaatatgcagtcatgtttccaaattcactcgctaccattgaaaggcctaccaggtaacctaagagagttacaaatattaggatgctcacctatactagaggcacgatgccagaaggaagatggagagacatgggtgaagaagaagagaggggaatggcataaagagacgataaacgagtaccgacagaagaaaacatgtgagttctgggaagggtggttaaagtatgaggaagagtgggtggagagtgctacagatcatctgaacgataagggagagtggttagagaatgaagaagaggactggctgaagaataattcagatgaactggaaaataatgaagatgtgtggctcaagagtaggggcgaagactggccaaagattgctcatattccttatatccgtgtgaatggagatattatacagaatttttatctgtgaaacttcagcgtgcagctttccgaaatctgtgtaaaggtattcttgtgtagaagtgtttgaccattttttctagtacgttttctttctttttaacttcctttaatttgctcatgctactgtagtactgcttgattcagtcttattcaatttgtcactgactacttctgttgttgtccctcttattactgcggtaaatcaaagcaaactattcatacatgctgtaccatttatcatgccaatcctaattacgtggtcatcaaataaatttgaaaaaaaatccccaaataattgcatcaatggagtttgacttggatgtatattataaggcattgacaatgaaccaactttagcctgatttttcattttccagaagaaacatggaatacatccaatgatccaatgatatgttgctttgataatttgataaatttttagtttggggtagagtttgatgatttgtttacatctctctgtgtgtgtgtgtgtgtgtgtgtgtgtgtgtgtattccaatgacaatcaaattatccagcgatataccaatgacaattcacattataggcttgtatttgtgtagattctggaatttggattgtgcttgtcgcgtgtcaagtgagctgatattaaccttagtgctttctgctgttgtagttatatcacacaacttgttcaaaaataacaaaacagagagcaggtaaaatgggtgctagtgttggtgaacagtatcgatactcctgtaaaagagagagtagtggtgagtggtgaatctgccaccactctcaacaccaactccctactatttggaaaaaaaaaaggaaatgtatggtccatatgtcaaccaccaccaccaccaactccttattttttatggaaaggaaaaaaagatagtgtggagcctagagaatacatatgtcggtaacaaatatatatatatatatatatatatatatatatatatatgtaaattaaaagatgatatatgttaataatgggttaataataattttctttaattaaaatatccttgcaactcatgggcaatatgctagtaatctaatgcgtttctttggatgaattcttagcttatcttaaacacatgatcaagtaacatttggccttcaagatttgtaggtgccttttatttcgtttgaaggagattgttgatgctaaatgctaattaacttgtaattgatgttgtaccaggtccaggacaaccaacggtgtctttgtgcgttgcagcagaggaactaatatgatgcagctacgtaacgtgactgatatccggagtgtcaaaggcattgtccagactgaactggtgaaatgggcttctgaaaatgagatagccggcagttggctcctctctcaagctatatcgacgcatcatgctagctagttgttggttcttgctcggttaatctttctccacagaaatcggaggagatcgggggttaatttcacacctgaagcacttggaaagcgtcaggaaaaaagttcccatgtaacatctgacatgtctcctgccgcattcgcctgtaaaattggtgatcatgatccagcatctaactgatagcgctgatggttgttccaggagtgatttaaaagccaaagaatcgatgaagagcaatggaattgactgcggtttgcagagctgttgtacttgtattaagtggcggagccagaaattttctacgcctagggcttaagtagggctcatctaataggatattggctttctaaaaaaaatacatggtgatttaaaaggatttaggcaagtttatggtggcaagcctagggcttatgcccaagctgccctaggcttgcctccttgcctccgccccttaaaagttgtacatgactgaggaaacatcaggctgagagatcacctaaatggcgttttgtaaattgtaatcgatgttagcatgcctttgattgtgatgatttctaaatcaacttggacaagcccggcgaagattttgacttgcacaaactttcgacgattcagatatgaatctggaatcagtaaaagtgagcgtgcacggtgatcctaaacttctataaatgcacacatgtatattttatctttataagtatctttaaaaaccgagctagatatcttaatatttatgaagtcaccagacattcgatctcaacgggcgtgttgtccagtacttataacatataaaattagctgtaaatacaagtcaagtttaggttggaatgagtacttgccatattaatcacctcaacttataatctgataaaaataacctagaaatgcttatattgttggacctaagaagtagccgaaatttctcagtatgtagttcaattactacaaattttatgtatataattgtcttttctttatagtcgaccatcagttcgtctagaactgattatccaaaagatttattagcgataaaatattatttataggaacaacttttataggtgtttttaacgacttaaaacatcaatgtgaaatttaactttaatttcaaattttaaattttggatacggctaaatgagctgaagcaatgcaactccgtcaagtaaagttaaaagaaagaaatcctaagggtgtgtttagtgctttgggtataaagtttttaagtatacggatacacatttgaagtattaaacgtagactaataataaaacaaattacagattccgcacgtaaactacaagacgaatttattaagcttaatcaatccatcattggcaaatatttactatagtaccatattatcaaatcatgacataattaggctcaaaagattcgtctcgcaaaagttccttaggttccttgtggtggaaccagcccatccaagttcaaatcctagatttgacacgggtgctcgcatttacggctaattattctttcagtggtaggcgacgaacccgtcgacagcgaggcgcctgtggtgacttcgtcaatttcaagacatgtcggctcagtctttcggaggtgctcataggggtagggtgtacgtgtgtgcgtttataggggtgagtgtgcgcacgttgtgagcgtctgcgtttgtattgtgtttctaaaaaaaagaagattcgtctcgcaatttacatgtaaactgtgaaattggtttttttttctatttaatatcacacatttgatgtgacattttttgccacaatttttttttatctgaacaaggcctaacccctgctgcgtgagacgtgtcaataaaggtcagaacagaaaaataaaataaaaattctgcatcttccccgaagggcgcgaggcggcgagcctcacgccctctcccgagtcccgagtgaggacacgccggcggaggccgatggccctagccgctctacctctacctctacgggctcctgaaccgtgtcggcgttcacgaggcaggcggtgcctaggtgatgcaggcgagctccccctcctctcctccgctggttgcttctgcgggccgtctctttgcccaggtgagtggtgctcgccacttgctcgacgaaatgcgcacttctccctgactccgctcttcgctctgcaccaggtgcggacagatgaaggcgtcgatttgatcatctgaagtggcccggaatccgcaatcatgcggtggcatgcagccgtcctattcgatgacaatgcagtggtatctttctgatggagtaactcggaattaaggtacgccccccatcgcgcgcctgccgttctcagtattaaatatgattgtcctcttcggctctttgtgtataatatagcattgcagcattctgtgtggtaatacgggctatgtttatctttcttgtggcatggctaatctccgcgtgaaccctgttcatgttgctagaaggtcccatgtttcaagtgggcgaattcttcaaatcatagatagttcaaacattcaggtctatttgtgcagcctctgaatacataacgaacaatctacagactagcagttcccatgtacattgtacctcactctgtcaatgattctgaaaaaagggtaactctgagagctaaaaggttgatagaaaatataatactccctctcttccatattattagacattttggcttctccatctctcgtctagagtcgcacatatacatattaatttggacacataaatgaagaacggagtacatacataaatccatgcatgaatctattcaaaacctaaaacatcttatattgtgaaacaaaggaagtacatagtatttttttttcgaaaatccagtggagtgcttttgctatattaataggagcaataagaaacctgtagatatcagattacagcataatgtaaaaagaacataaacagaagtggactatctgatggtaaaaggtttgcctttcctcttgctcttcctatggtccgagattgcaattagtcagggaacttgtttacctgctacaccgtggcctcttcactcaattgttttgttcttcaagattagccaccaacttcttaatatattatacacagtaacctgaaaactgcaaaattcaagaaaatcattgctcctgaaatggatgataggtgtggtggaaatgggaaagccaaccaaaatatagcactgtagtttctaagtttttgagaagaaactgacatatccatcttgaccattgtaaactgcaaggggccttgattttttttttgttgaaaaattactggtgaaaccttatagtatgcattaagatgctaacctgcaaaatatggttttgtgaagacatattttgttaaaccaatccttctaaaatacttcatatgtcccaaaatatagcaagttttatcccttggtacggctattaaggagatcggtaaacatacttgtttgcctccttggggtgggtgaggtgtgggcccgaactagttggggtgaaaatgaagccaagggggtagtcgatagctttgaaaccttttttgcattcctcatagaccactaattgtcttaaaaactaggattcacaccagaaatctggttgttgaacgatccgcaccagacatcgcgaagattcattgaatagagcaggagaaaaattacaaggctagagtcctaggagacaatagccaggaaagaagaaaaaatacaatcaataatcaataaaatcaataatgatcaagattcaagaaagaagacaaggctagctttttttttcttttcttcctctgtctcacttcaatacaatcaataatggtcaagattcaagaacctcccttagttgcttatgttcttactctccttggaagcacacttcacagatttgaagattccatacctcggttgacgccaacaaatggtttgggagatcaatcatgattgccaaacaatcatgaacttttaaacatgtcatgttttcctcctcggcttcttctgttcttacaattctaccagttcgtgggatcctacaagaacaaatttggggagatcaactagctttctgcaattctttatcacaatctttctgatccgtggaataatttgtgttggtgctatatccatccacctcctccaattttccatgtcacggaacgtcagttcttcaagggatggaaataccctgtcataactgccataaaattcctttccgatatcttttatttgttccaagccttgtagaattagaaccgcaaggtgagaaagatttccaagaggtggaagttctaccaattttttacagccactgaatttaatgtatcgcagtgtggtgaagtgctggtcatctgctatccatcctggaaacttcactcccatgtagcagtggatctcgagatccttaagttgtccatttggttttaggtgtgaaacagtttccgtgcaaccatcaagtgttgctggctgtgaattccatttagagccaacttctgggggtacatttttttagacagctcagcatgacgcgcgtcacacacctcattcacacatgccactttctcaagattcgtaatacaaagatggccaccaaggtaattcaaatccttcagttctgttatcctatacccctccttttcactgacagcaaattcttccaagtattgaagcttggatagctggcctatactatgtatcaaagagagtgtgcaagcttctgcatataaatatcgcaggttgactagcttattcatatccctaggtaactctgtgaatctacatcctcgcatacctagaacttgtaaaaggagtagcttacagaatgagtctggaaacattgtgatcccagtgaaggataggtccaagtaccttaggtgagagcatgtactgatgacatcagggggcctttccatcttagtttcaatgcaagacaggtctaacaccctcagggaacttgaaacaggcaatatgctattaagggctgtattcagcatggttgttctctggccatcaaaaaataaaatgctccgtaccttgctttgttttcttaggtccaatgacacttcgaaatcatatttgtcaactgccatgtggatgatattggaaaggttttgtctgggactgtgtaaatcgtctattgtgtaacatcctgtttgatttatggaggccacaacttttttgatcatttcattcactgtatatttacccttccatacagttgactggataagtgacctgttcaagagctcatcaagccatcgaatgtctgtgatctcatatgcggattcttgatgttgttgcatagaattacacacccacatttgagtcatttttcttttgtcaaataaataactggatgggaacatggaacagtaacccaaacatttctttaggtcatttctgaggaattccagtgcaatcgttactgaaggtaaagcaggattagtgatgaccagatcttcatagtcattccaccaattgctttcacaaacatttcgccagtggtcttcatctaacttcgttctgagaagcctcccgattacctctgccgataagggcaggccatgcaacttaccagctattttgtcaccaattgattccagagaatcttttctggtgagtccaaacgcgtggtgcttcagaatcatcgagagaacagatgttggaattttatccaaagttataactatacctcctggaatggcatgagtcacttctgatctagttgtcaccagtactatgctccctgctgctgctccagttaattttgctctcacagtcttccattcacgttgcaggttatcctttgcattgtcaaggacaaggaagaatctcttgttctgtatggtcctggagagatcatgttccgaactagcttggagtgtttccagacccatttcagaatcaaaaggatgctgttctgctgcaaaagaacaaaatattttcttgatgaaatcctctgagtcagacctttgagagagagagacccatcctctctgattgaaggccttcttgacattagggtggttatagattacttgagcaagtgctgttttgcctaccccagcctcgcctacgatacatacaactttcacagttgcagttccccgtgtctcttcctgcattctggatgctggaaaatgttcagcttgtgcttcatttggaaatatgatgctcattaattggtccttctctttctcacgaccatggaacactacttgtatttctggaagaaaccctaccatatcctctttagaatcattcaattttaacaagtcaaaaaaatttccagacttactggcaatcttgtcgagccttgccaggagagtcttcagtctgtatatgtcatcatcaacaaaacccagattcttcatcatgtatgccagaaaaccgctaaccttgttctggtggctcttttgtattctcttgatctcaaagtcatccagcagctcttccgcctcagaagcaattttcttgatcaactccagccagccggtgaaattatcatcgacgacgggccttcgctccgcgacatcaagcactggttgcagatgaacaagggaagcctccacgttaaacacccgcaacgtcaccatgcagctcatggcgctcctccaggatggaacgcgccttgcccacgaagttggcgatcacagctcctgcgaaccatccgccgatggtcaatccgcctccaaccatgtcgaggtcgcccctccaactccaaggcttcaactagtagcacggaacaggaaagagagttcagaattgcatcctagtagaagaggactggcagatgttctcataagctaatagaatctgagtgcgaatgggtcatggccagctaattggtgtgttcagtcattgacctaaatgtgggcatgtgtgcgaatgggtcatagccagctaatggaatctgagtgggagcattcttaatgctacagtagtcgaccttcgttgttagtggcataaggtacatttgttttttctcaatagggattaaatacacattcagacaatgaattaagatgaatctgacttttctttttttttccccgcaatgacatcagagttgtcaattaattaaaaaaaatatgtatctagctcctttcactataaacttgtctgattttgatcccttaattataaaaccaactactattggtactttaaatctcaaaaccattaacatcttatccatgggtttaaataaggatggttttttatgacatgttgggttatggcaagttgtgttatagcaagctaaggtgaatctagcttctagtttatctttgaattacgcaactacatcagctttagaatgtggacaaaagctgtaatatttgaggagcttttgattttagagaagctgctataagctttcccaaataagcccacttctctctatccacaaatataagtacttttagactttcacatgatcgatcttcaatgtactattttgaccaataatatatataaaaataatttatttttttaaaaaagttgcatgttaggatagtttgtttaatgataaatctaacaacatcctttttatgccatgaatttttatgattttttttttttgctattgatagttaagtcaaaacttagcactcttataataaaactagaggattgccccaaaagatatcattgcatgtagaaatctatttggatttcatatacaacccttggcttatatttctatgagcatctgaattttatatacaactcttagattctattttttataatccgtagattttacatacaactcttagcttctatttatatgagcctttggatttcatatacaactcgtagattatatttttgtaacccctaaatttcatatacagctcttagcttctatttttatgagcatctggatttcatatacaactcttaaattctatttttgtaacccctaaatttcatatacaactcttagcttctatttctatgagcatttggatttcatatacaactcttagattctatttttataatccataaatttcatatacaacttttagcttccactccctccgttccataaaaaaacaacctaatactggatgtgacacattctagtacaacaaatctagacatacatctgtccagattcgttgtactagaatatgtcgcatccattcactgtttttttggacggagggagtatttctataattcatggatttcatatataactcttaactcttaaattctatttttatagagagtttgaggagaaggggattgagaagattgggaagatacgcaaaacgaggtgagccattagcatataattaattgagtattacttattttaaatttaaaaaatggattaatatgattttttaaagcaacttttctatagaaaatttttgaaaaaaaacgcaccgtttagtagtttgggaaatgtgtgcgcggaaaacgaaataaactctctctttctccacccaacgaacgcagtagactttatatataactctcaacttatatttttgtagatataattgtattttatagctatatcaatcaatctataccattataatccaaacccaatatgatctgacgactaagatatttttcttttttttctccaactaatgtgagaattttctagtctctataacgaatggtgtgtcttctttcaaggctttttttaataatatataatagatagatgcttatacgggtggatagaggggtatatgtttatgtaaaaataaattatgctatgtcttggacaatgtgctggtccagctcagcctaacacaagcaggccccacgccccctctaattctctaaataaaaagtttggttccatcagatactagaggtaaggtcaacacggcagcttagccctgcacccccaactcttgcctcaaaagttcgacaaacacgtttccgcatcaatggatcttggatatgagcatcctgctgtgcttctctcggtggagatcagcgaagtggtccagaagctccgccgctctctgggcaaaagtagcgactccttcaagagaactacgaagaagctggatgtggtggaggataagcttcgcttcctccgtctggacagcctgcagcgggtcaagcctgcccctgcatggctgcaggacctgaacaaggctgcacaagatgcaaagggacttcttgacgacatggaatctgaggtgaaagctcctgactcttcaatctctgatgttatgaattggctctcctctgatgacagaaacatgattagaatggtatacgtcattagtaaacttgccagtgcatgttctcaaggcaaatctatagttgacacaccacccctgaatgagagtgccttaggagatgaaaaggaagataagatagcttcatcttctgttgccatgactcgccaagacaaatctttccttggtgatgactttcttattggtcgcgatgaggaaatagctatgataagagacatggtattggacaatgcccaatatgtaccaacagaaataacacttaagattagggaagaagctgagaagttacatgttcctcataagggttggattactgaaactcttcataaaattgatatgtctaaatggacacagcaagcaatagaagtatccccacaccccgaaaatgaaaagagcaacaaggtagaatatattcgtcatccacatgacagtgctgttacataccttcggaatccggcagttattcccattgttggaatcagtggagtgggcaaatcagctcttgccaaattcatattcgatgacgcaaatgttcgggagcactttggtgatatatctgcatgggtctatatgactgacagaactgaccagttggttacaatagaacagatcatctattcttttaatcccaaggataacatcagttatatgacaagcctggacagtgcctactctcaacttcaggatatcatagaaggtaaaagattcctcctggtacttgatgatgtatggaatgagatatgtgtgctatggaatgatttaaggagtgtactaagcaaaggagcacctggaagtgtagttttagttacaactcaattgtacagtgtagctaactttgtagggactgcaggccctgtaattctggatcctttacaatccgatgactcatgggcacttctcaggagatatgcatttgttgaaccctgcagaagtttgtccacggaaggtctcaaagaaattggtagaaaaatatcacacaggttacatggattgcctctatccataaaggtaactggggcaacattgagaagtcagttggaagaagctgattggagggaaatcttaaatagttggtggtggaatgtttcagatgataactttgcaatcagaattatatcttctcttggaagttgttacagtgcgttacctggatatttgcgcagtgctttgtctattgttcaatatttcctaggaactatgtgtttgaaaaagataaattggttcagatgtggatagctaatggttttattcagctggacagttctagtggagtcaaaaggttggaggatgtaggtggggaatggttctacgaacttgtcaatagggcctttcttcagccatcagcaaggaaaactgaatacattatgcatgatttggtctgggattttgcaagtgcactgtcttctgatgaataccatggtaacgataataaggtgagaggtgtttcacaggatgtccgctatttatcagttgacatggatgccctagatacactaccagataaatttaaaactgaacaattgcgcacttttatgttgcttgacggcagtcatcaacccagcaataatgaaactcatctccctcttagtaattttttgtgtaattccaaaagcctacgcttactggccttctcttcaaggagttacaaatggctgggacggacgtccgctctttcaaatgttattagctcaacgaaacacctcagatatttagacctctcgtttactgggatcgcgaaactgcctaattcagtatgcagcttgtgccaccttcaggttcttggcttgagaggctgtacatttggtaaattacctggagacatgaatttcttaatcaacctacgtcacttgcatgctagctcaggcacaattgctcaaattaatggcattgggaagctaactaaattgcaagagctacatgaattccatattaaagcagaagaaggtcacgggataactgagctaagtgacatgaacgatttgggtggttccctttgtatttcacaccttgagatggtgactgatcctgcagaggcacttcaagctaacatagttgagaaggactatataacagctttagaattaagatggtcttatactttgcctgatctgtccaagtcgatacttgggtgtttgtctcctccaagatatctgcaggagctaaaactgtatggttactcaggatttgaacttccagattgggtggggcagctcaagcatgtacgggttgtagagataagttggtgcaaaaacttgaacgttctccctccacttggacagcttgagcatctgcaaaaactcaagttggatggtttgccgtcaataaaggatataaactctgatatttgtggaacctcaaacgtggtcttttggtccttggaggagctaagctttgaatatatggagaattgggagagctggacatatgcagggagtagtgacttcattcggaacctaaaaaagctgaagatactttcatgtgaaaaattgagaaaggtgccttttgagtcgttgggtttagccacgaaagagataataattaagtggtgtgatccatatgatgatacgttctcgaggtatttgcaagggctaaacggtctgacacgtttagaggtaggtggtagccggaggtgcaaattaatcattccatgtaaacaattgatgtccttggagtacctacatatccaaggttttggagatgtgtgcattaaaagtggactgtggtatatcaaaaacctgaagaatatactgattattgattgttctacagtagttacagattcaaatgaagagtcagcacaagaagacaagcaatccccaactcaaatcgatcgcactatgcattctctcacccaccttaccttgggtggcgatacaatgcaaaaagtaggtctggaatttgttattccccaaactccctccctccgaaacctgcgccttgacatagtacagggccatacaagcattactaagaagtggcttcagtatctcacatctctacaggagctggagatttattcgtgccatgcactcccatcgagcttgtcctctctgtcatccttgaggaggtgcactctgaagtactgccactggatgtattcaataccacccaacagcctgccaggtaacctaaaagagttgcaaatagaggagtgctcatttgaactagaggcacgatgccagaatccaacaggagatgcgcggccagaggggcgtaagattgagttgtggcaaaagaggaagatgggcgagtggcgagagaggaagctggagcatgggcggacgaagcttattgaaatgcagcaaaagaacgagtcactaggaataccgatgagctggagggaaaaatcgccgaagagttctaaaggggagtcgttgtatcaaagtgataaatattggtcgcgtgggcagaggatgcaggagggacacgagtggccgaggaagcagcacatggaagaacagtcgtttatagaaaaggagaagtcgtcgagtctgaacgagcaagcagaggaagacgaatccaagaaggaaccactagaagagtggctgcagcagagtgaaggagatcaatggcctgagcgagagtgggagctgtactcatgggtggagaggaagctgaagaaagaattggacagaaacaaagatgatccgtctagtctgatgaaagagagagaagaatggctgaaggaagaggagcgcaaattccacagtgagacattgggaaaggactggcccaacatttgtcacgttccatatctgtgtggagggaaagattgtacagaatctttatacctgaagctgcagattctccagacgtggactcattttctgtgtacgttgcaccaactcatttcttgcattgtaaaatgcaatattttggctggctctgataactcctttctttctccgctgcttgtagttcacgattcacatgctctggtaaaggaaattttgcatctaaatcaagagtcaagacaatgcttttgctttcggcatcatctatctgcccagcgcacttgaggttagtacaaatatttttaatctgtttttagacaaactaaggctctttttagataatggaagcttttattgaactcagtcaattacatcaagatgatacaattatactaagaacactttcggcctctgcataactaagatgcacacagccgaacatacaaaaccacactcaaaaggaaaaaagaatggcatggagtactgaggaccatcaatctaaagattaaattgccacccatgaacaactccttggccatctcctccaaaagcatagagttttaagggccacaaattctaagattagatcg

SEQ ID NO: 20066 - DNA, 4541 bp, Oryza sativa
acaggcgaacatacaaaaccacactcaaaaggaaaaaagaatggcatggagtactgaggaccatcaatctaaagattaaattgccacccatgaacaactccttggccatctcctccaaaagcatagagttttaagggccacaaattctaagattagatcgccacccatatccctgagtaaaaaactccttgaccaccttctccaaatgttgacatgccacaactaccatatcccgcgaaccaggcttcaggcttctgtaggatagcccatgtacgaagtcaatggataagagaatatataacctgcaaaggtaaagatatcactttttttttataaaaaaaccacattattcctacatagccaaagcgaccaacaagtagcagctgctcctaacaaaacatgtgctttcaaattattataaattccatcaagccagctcccaaatatatgcgctacacaatgtggtggaggaaatccagatgctacttggatgatggaccaagcaaaatgggaaaaacgacatttgaagaaaagatgtctaattgtctcgtcattgcaacaaaaacaacaattcttattcccttgccattttctttttgtcaaattgtcctttgttaacaccactccacggtgcaagtaccagagaaaaatcttaacttttaagagtatctttaatttccaaatacgcttattaatgttgggaacattgctgtgaattagagctagataatgagacttcatcgagaactcctcatttgaggttaagttcctatgaaactcatcttgctcctgagttaattgaaaaccagtgatacgtggtaataaattattccacgctgctagttttgatcctataaggtctcttctccatgaaaaagatagaggattgttttcgaagatttgtgcaactgtagccttcttatacctaactatgttgtaaaggcaaggatactgttctttcaagattgaattgcccaaccattcatcttcccaaaacctcaaactaaggcaaggatattgtttccaaagttttttgagacaaaaaatatttacaatcgttgtttctccatcaggtgtgcttctgcatttctgcaagctagaaaacctacattcctacaatgctacacttgcaacatttattttgttttttctttgaactttgtttatattctgtaaattaaggaggatgctcgatacccatttaatccattgtgttgtcatacgctggtacttctatgagaagtctaaacttctcaaccacaactaacttttttcatttcattttctcagcatgtccttgtaaacgcatggtaacacttaatttgatggagctgtttcctccatgaagaagctgttattttcctatgaatatctcatcaggttaacaggtttcttgcaagttcagaacaagaaagttgcctgagatgatgcaaactgactgcacaaacagaaaggcaaccagttggttacttcatcggatattacaggctagatcgatgtagcctggagactctgcaagtatgcatagaaacagagtggtctttactcttgttcattaatcaggatagccttgctgatgctgaagcagcaaaacggaagccggttagagattgcagcataaattggattcagtaatgctttgcacttctttcgtgggaccgcactttaatctgtactacttcctccgtttcacaatataagtcattctagcatttcccacatctatctatctattatattattaaaacagctttgaaaggaggcaccacgttcgctgtgggggctagaaattcccacattaatcgaagaaaaagtgaaaaaagaaaaaggagagtccaaatagaagtccaatttaaaaatagctgaaattcggaattaaaaataagcaatattgaaaaaagtttccatataagaacctaatacgagattaatcaaaattcaaaataaaaataaaataaaatccaaaattagaagaggaaaggagagtccaagtagaaatacaatttaaaaatagctgaaattcggaattaaaaataagcaatattgaaagaagtttccatataagaacccaatacgagattaatcaaaattctaaataaaaataaaataaaatccaaaattagaaaagtaaagaagagtccaagtaggaatacaattttaaaatagctgaaatttggaattaaaaataaggaatattaaaagaagagtccatataagaatccaatacaagattaattaaaattcggaataaaaacaaaaataaatctgaaattagcaaaagaaaataaaagaagagttcaagtaggaatacaatttaaaattagctagaattcagaattaaatttaagcaatattgaaagaagaatccatataagaatccaatacgagattaattaaaattttgattaaaaaataaaataatatccaaaattataaaaattaaaagagatttcaagtaggaataccattttgaaacaactgaaattgaaaataaaaaataaaaacattaaaagaacacaatacggtattaactaaaaattttttaaaaataaattctgaaattagaaaaggaaataagatttcaattagtaatacaatttataaataactaaaatttgtgataaaaataaagactattgaaaaaagaccatctaaaacacatgacgagataaattaagtaacatgcctataaaggagtagagtggtggcggttgatacgacatataaaaattgttaataaaacacaaaaaagaatcctaatgactattaaaaggagggacgtcaggcaagtcgtgaagcaaacaagtaaggcggttgccgggatttctagacagtaaaaaaataaaccccattaataatcatattcgatttttaaaatctcaatgacaataaaagggagaagcagcgggcggggtatataagagtatagttgcagagccgccgacggttgacgggacttctagaaaataaaaaatgaattccaacgatagttatgtttgatttttaaaatcatagtgtaataaagagtaggcggcggacgggctgtagaggggcattgtggcatcgttcgatgggacttctaaaaattataaaaaatgaaaatacaagtccaatttttaaaggttcggaacttccaaaaattaaaaaaacccaatgataatcatgttcgatttaaaaatctcaatgacaataaagaacggaggcagtgcgcgagccgtagaagagtacagtggcaaagccgctgacggtttggcgggacttctagaaagtaaaaatgaacccaaacgataattatgttcgatttttgaaatctcaatgataataaagagaagaaacagtggacgggccatagaggagtataatggcaacgtttgacgggacatctagaaattataaaaacaaaacccaatgtgacaataaactctaaaaactataaaatccaatttttaaaggttccaagaagaatgaatagaaatagtggtagatcaagcaagcaaataaagaaggggtagcaactggtgtgacttttaaaaactatatgtagaaacacgaggatgataaagtttggtcttttaaagtcttaagataataagatagctatttaataaattttaagtaaaatcatcctaaaaaatatatgaatttgtttgggtgctagccgcgcaattgcgcgggccacccagctagtttatattgattttagtgaatctagatagatatatatgtctagattcattaacatcaatatgaatgtaggaaatgttagaatgacttatattgtaaaacggagagagtagatgttatcttgtgaggcggtctggtgattgtgtttacacagtaataaaactgtagctctgtatgctatctcaggtactgtagtttgctgtttgcagttgttccaatcttgccaaatcttttgttacgatgtacatacactgtccgcatatctttgtccaatgtgatctgtatgagtttccacggactgtatctactgatatacagtaattgtgagcgccgctatttgaatcttcagcgacttgattggaagtaaaatcaacgatcttttttttagctcaagccaggccagcattgatagttactcccttcgtttcaaaatgtttgacaccgttgactttttagcctatgtttgaccgttcgtcttatttaaaaaaaatttgtgaaatatgaaaaattatatatgtacatgaaagtttatttaacaatgaatcaaatgatatgaaaagaataaataattacttaatttttttaataagacgaatggtcaaacacgtattaaaaagtcaatggtgtcaaacattttgaaacggagggagtaacttaccatctgacagaaccaccagctagagaaacgcaaggccgatgcaagtatgcaaaacatcttccgtcgtaactgttgtctgttgatcgtacagcccattacccagaggcgaaacccatgacgcgctgggcgaacactcccctctcctccgttccaatctgtagccgtgaagaccggacgaggtgaggggggggggggggag

SEQ ID NO: 20067 - DNA, 10779 bp, Oryza sativa
cctccccgtgatgggacatcggaggcggcttgggggcgcctacgtccgtgcgggtacgcgcatgggtgcagcagtgctgcgctttgcttgcttgcgggcttcttttctcctccagatgaggtgtgccatccacctgctcgacgaaatgcgccccccacccccacccccggctgataaccatatgtatgtccttcggcaggcaatggatggcgtcatggcgcaggacgaacctccgtggactaaccatgttgaaccttctcctcccggacctctggtgcccgtcctgatggcctcatggctcaacgaagtgttaaggtacacgtcagttgtgggcacgctgcctttcttttattatttaactaggaaggtggcccgcgcgcatgcgaattattgtttgtttaaaaattttgtcataatagattaagagcaaactaaagttcggataatgttattttataatattttaagggttctatttttcttaaggtatgacttttaaatcattttttctcgagtaaataagaaactattgctagttaattatcatacaacataccgtgtagtatggccacggatgaaaaatgtgaaagcaagatactcaaaattcttatgattaaatcatctaagaaggcgcatgatgtagtaaaaagggagggaagtgtatgcatggaaaaaaaagaagaaagggaaaaataaaaaagggaggggaagcatacgtacccatgtacgtaggtgcatacctatgccacgggacgagaggtgagaccttatagtatttagttttttcaaagatcaatttaatctaacagtttataatattggacatactgattaagtgaatactttgctcttttttcccttagaatttctaatatttgctctaatttattagagcaccacgtggcagtttgagagcattttaagaaattttaaaggacttaacaatgcaattagaatattaaccgcttaatatatatgtatagggcatataataatatttgttccagtttcgtgcatgtttatatacatgttgagagaaattaattatgtggttagcaagctattagatgtctaattagtagcaattaattttgacacctatttacaattgttcatagtagctcttacatattcatcttacgactttgattatccgttgattcccaatttactgatcaccatgactcgcataaaataatatgtactacttagggtctagggcagctgaaattgatgaattatctgatttatctgatagctatttgagggtataaacgaatgaattgacttttaaaaagttaaaatgttgtttaaaaaagacaccattttaaaacttggaaagcgtgcaaacgaaaatccaactatggaatcgggaaaaaagcggatcttaaactcccttataacaccctagtctttgtaagagtgctattgatatttgttaatattgtgctcacatttataacataatgatttctttcacctatacgaacaaatagtacaaaatccaaatacgacatatataacacaatacattataattattctgtaattaactctcggtttcagtttaaacagagctaagtattggaaaaaaatacacaacccatagtgcttaattcatctctcgctgcatcacacttttaattttcttttcatgttattaacaaaattaatcatctccatatatgatttgatatgtggcaaagtggtagtgctgcggtagtcgtgatcaccttagatgcctcagacacgacgctttgtcaagcgtgcaaaaggcaaagctgcagacgtgcattgtgcagcgggcaaaaaagagaacttcggacgctttatttattagcaaataatatatcagatgatttaaataatgggtccaccggttctagtgtaagtgtacatttgttaatatagattttaaattgttaatttaatgggtacataatataatataatggtgtagactttattttgaaaccatgcattatttgagaataatagtccaatgtaacaaaaaatagttccgatgatttaaataatgggtcctcggtttaagtgcacgtataaatcaattaatatagatcttaaactgtttatttgataggtacacaatataattgtgtaaaattatttgaaaataatagtacaaaataatgagtacccatgtttaagtggaaactatattacattattaatttaatggtcacatataatagtttaaattttatttttaaaaatggtagagctaatttaattacccgagagttgcatgatggtagattctttgtgttgtaaatttatgattatttaaaaaagtatatatccatattatataaatggaaaaggaagaaaaaaagaaaaaaaaaagaaaagaagggcgtacgtacatggtacgtacgtatatatacccatgtacacatgcacgggagaaggagagctggggtccatagtatttggtttgtttaaagatcaatttcatctaatggtgtgtaataatggacccactaatttaagtgaaaatcaagggtagatgttttgctttttttcttatttctaagattttctataatttattagagtgccacgtgacagcttgagagtgtttgtatgaagtgtaatggacttttagtatataatagatagattggagccatgtcctaataactttactaatttgggatagaaggaaatactgtgatgttgttgtagcctattgttaatccggtctggagcaggtctgtgccgtgaactagtattgttcaattgtttgtgagtaaattctatactataaaacctcacttattatgatccaaattatacaaaatcatacagattttggtatgtgatacgtaagctcaggttttatggtcataatgtttcacaaaccacgttattgatcattttgattttaatctttcacacttttgggttctaccatcacatctcaaatttataagaattttattcatcatataaatattacatccattttcttaaattttgatatatgagtatatcaaaatggttaacattgtgattttgtgaaactttagatataatacccgtggttatgtgttagaacaaagtccaacaagtatggcaaacgcacccccttctcttgcagggagccttagtttagatccatgggggataagataagaggaagagagtgctgctaaatgaatgtaatgggaagatgcctccgccttcttgctcttggaggactccttttattcatatgtaatggaaaattgcagtattacccttgatcggttgcatcataggggcattgtcctaggggcgtttgagcccattattacattaatttatacaacaccctagatgtgaggggtcctttccaaccgtacacgctggcatggggttattccccaacattatgtgtcacgtgtcaaaatcgctgtggttttgtaaaatttggatcataataggtggggtcattgttttatagatattttttttattagtgtaatcaaatatatataatcaggttttctattggcaagcagaaatcaaactatcgagaacccgcgtcttggttaaaggagagatagtgagagaattttttttatttttaatttttttattaaaagttttacaaaaataatttttcattttgaaaattgacggatgtagtcgcctaccgccctctgggagggcgatttttaaaaatcgccatcccagagggcggcgaaagtgacgtggcagacggccgttcgctctcgggcgaccggcgtcaacgaaatttgcaggcggcccccttgccgccctttgatagggcgattttgtactgtggggggggccgcctgcaaatgggcggcggggggcctggaattttgcaggcggcccccttgccgccctccgctacggcgattttgtactgtgggggggggccgcctacaaatgggcggcggggggcctggaattttgcaggcggcccccttgccgcccttggggagggcgattttatactgtgctttatatttttgtataaatattaatagttatcaaatctttttatattgaaaactatacaagattaaaatctccaagactggtaaaatacaattttattatttttagggcctatttggaatgttaccgtacaaatattttgttagtgccaaaatataagctgttctagcaccatatgaatgaaaagaactatgtagacgagacaaacacaagtagtactgcagtagtaatagcaaaagtagtactgctttacaagtttgtaagccaaaagaaacggtcacataaggtctgaagaggtagaacactactgacgaggcctcttacccctgtccctcctaccctgcgccctaatgtgcccctgggagtacgtgagtcggtccgggggtacggcacggccaacccgtcctgcctgtacaggtgtgacctctggctgctcctgagtgtgcgcctctggagctcctccaagctgagaggagcctagtacgtcgtggtggtgtgcaccgtgcaagtcgtcgtcgtagaactggctagtaggaccagtcctaccggcgtgagacgaagaggccccagtaccgaagatcccggctgcaaatcctgctggacaaggaccatcagtttcatacaggtatttaatagtattaataaaaagtaaagtaccgtgtgggcgagggatcgacgctccgtgagaggaagagctggcgaacgcgcccgaagaggtggcgaacgcccctgcggagctcgcggaagcgccggtcgtgcctgcgaacgcgctcgaaggcagacgaggtcctgcgatgaggaaacgtgcagttaaaacatggtgacatattcgtgcaaaagctgaaacaaaaatgaactaatctctgggctgaactgtaccgtgcggaaccggtgctgtaggtcgcactgctccgaagctaggggcgctcgaaggcaaacgaggtcctgcgaggatggaacatcaagttacgacggggtgatgttttcgtacaaaaacagaaacaaaacttaagaaacctctgggctgagcagtaccgtgcgaaaaaggtgccgtaggtcgaggtcctgctccgacagtaggcgcgcgaggccgtggttgtaccggaccagctggaggtacgacgtccacggcgctgctacaggagaagacgcgcatgaccgcacgcatcttctcctgcatccggttgaaggtcaccctctgctcaacgtcagtcaagtgcaaacctctgttcaacctcacttggactgcggtgatatcggcactgatatcccatgcggcatcagcctatgcaagatggaaataaaaaaattcagtagttgtcctatattatgcaagataaatgaaataattgtgagaactaatacaaattcgacgtacccccacgaagtagtctcggtcacggtgcgtgggatacgcgtccgtgacagcggcaacgtgcggctctagggcgtctggagtgaaggtcacacgcgcacgagtgcgaggaaggtaccagcgaaggtagtcacggtagttctcctccgtgtgtgggaagagctcgttgatcacctcctctgtagctaacacccagtcgtcaacgtactgctgtacacgtggagcccaaagtgcgcctgctagctgtccccgtcgagtcaacctgtgaagagaggtaaattatatggctcgatgaagtaattatcataaaaatttagaaatgaacactccgaactcacgagtggtcggcagggaggacggtcggctgcacgttgcccggaaacacctgcctaagtccgaactgtctcatcacacgctgcgggcagtgaggctcaacgaaaatgtcgaacaccatcggcaggatggtgagccagtaagcctggtcgcgtgtgcacaaggacgaaagtcctagcggtgctctcgcagcgacggcctcttctgtgtacggctcccagatgatgtcgctcggctggagacggtcaaacttgaacacgaagtccgggtagcctcgtctcacttggacgtgagcgtaacgacgctgcaataaacatgatcggaattagacatgttatgtgaagaaaaaaaaagaagacgactgataaacttataacgcagcgaagttgcactaaccccacgtcgacaccagtaagtccccatcgtgggaccgtcctctggccactgcgcgctgcgaccaaccccgtagggtgcgctgtccaccactggtcgacctatggcaaacctctcggctgcccaaagctgaagcaacatagggcagccagcgatgatcgctcccgcgtcagtcttcgtgcacgcctcacagagggcacgatacgtggctgctagcacggcagaaccccagctccactgcggcacgtcctgtggctgagcatccgcgatggaccgttagtggaccagccggaagtccacagcgtgcccgtgggtgctagtgaacatcacccacccgaacaaccacaacaggtacgcctcaagggagcgtcggaccgagtaatcatcagcgtcagggtgcagaaggtccgcctacaattaagaatgaaatgttagtacaaaacactctgttgatcgcaaataagcatgtatgataataacaacttatttacttacagtgaactagagcaaccaagccttgctagggccgactatagagtacggaggaagggtgttggccggtcctaggtgtggaaggcgcatcaccttctcgaagcgcgcagtgatatcctccttccacccaaaaacaccgtccacgggaccaactggtgctcccgccagcggtagcccgagcaggtacgacacgtcctgtagtgtcggagccatctccccacagggaaggtggaacgtgtgcgtctcaggtctccagcggtctaccagagcggcaagaagtgaccggtctgcatcccaccgcttcgctgggtcacggtcgtccgccgccgcctcaacaagcctacaaagtggtagaaggcctgccgcacgcaacctgtatagagcaaacttcaaacataagtacaacacaaagcaaagttgagttgaaatgtgaacatacgcgtaccaaggaacgtgacgggggtcgacacgcaaccactcgcgcgacgtgcgtggacggaaggtgccgagctgtgcaccctcgactgctgacaggaacgagcggtggttcctgtcaatcccacggttcaacagcgccggtgtgtcgtacgccatacctgcatcaaatagattgatcagaaacatataaataattagttcaacataagtaataaatgttcataagcgaattagtaacacatattaaacaagagttcaaacaaacaaaattgtcaccagacggaatatttctgattacaacaataactgcagttacacgatatgagtacttagtccgaacactcatcacgataacattatgatacaacaccgaatagttcgcaatactactagtacaacaatagtcggaggtactcattacaacaacattcaattgaaattacacgatagaagtatttagtccgaacactcatcacatcacaacagcattttatttcctaaatcgataacattgttacaccatggaatcgcctgctgcgcgacgacgccttggccttgcgcgcctgcttgttgttccttcaccaggtggtcgcctaccatcacttgcctgtccagatggactagcatctgcgccgcttggaacttctgcattcttcgggcatttcttgtaagtatggccgcgcagatcacacttgctgcatcgtaaagtcctcccacctgcttctgactcatccatatcatttctgatgcgtcgagtttggcgtcgaccctttttcacccttaacttagatggatctggaatataaaaaacttgggcactcagcgttgtgtaagatcctgagatcccgaacccatatatctcctcactccatgtatgaaagattgcttctttcctgaaataatttgagacgtacacagcagcaagaacgtgtgagcaaggaaggtgatgaagcttcggcttcatacaactgcaggtacatccaccatccgccttcaagacaccgatgcacttgtgtgccttgagcaacaactctatgtctccgtgcctttttgattttatcttccatgtactttgtcactacgttgccaaacactatgttgttatcggccatggacggaccaattttcttgtatcgatccctaaagtacgcttgtgtgccgtgaaggatgaattcaacaatagcaaccaatggaagtacccgaactcctcgcattacccagttgtacacctctgccaaattggttgtcattatgccataccgagatccatcggtgtcgaacaatagagaccacttctccttaggctcattctcaatccactgagtgaaatttctgatggacgaccctgacctccttctcattgttggtgggtcatcatgtaatgcaccaagaggtatgggaggctcgtcaccttcaacttgtggtctgcgagattgctcatctgtttgcttcgttgtcaactcatccaacttgtcccacaactcattaaatttcttctcttggttctgtgcacagagcctcttaaagagctccataagatgcttgttcttgaattgtttgtagaaatttgcacccatgtgacgcatgcaccaccgactccgaacatcaggccacttagctagaagtcccttctcatcccaaccgttctgcaagtagtcaatagcccgcaacatacccgcatgacgatcatgtataaggcaaacgttgggcctcatacgcaccactgcaatgtgcactctctctaggaaccagtaccagctttcagtgttctcactctctacaaatgcaaaagccataggtagaacctggttgttcccatcacacccaattgctgtcaatatctgacctcggtatttacctgtcataaaagttccatctatgcatagaacaggtcgacaatgcacaaaagcattgatgcaagcacccaatgagaaaaaggctctttgcagcacactctttgttcgatcatcaaccgatgtaagtgtatgtaggtcatagtaagtattattattcctctgggcaatggtggctaacaaacgaggcaaattatcataagaagcttcaaatgtgccatacctcatctcaataatcttttgtttggctctccagacctttgcatagcttatggtgtacttgaatttgttctcgatgtgcctaataattgattttggttcaaaaccaatgttactaacaacactgctgtacatctcacttgccacaaaagctgaagtgatgtttcggtgacacttctccaccccttgtaagtagcacttgtgctcggtcacaatgctaactttccaataatcattccatttacccttatatgcatggacacgccacggacaatcttccttcatgcacctcacttcatacacataatttgttgacttgaccaccctaaactctctctgcaaggaaactgcccaatgcttcaccgcctccttcatctcatccttatgagcataccttgcaccctcaattacctcgttctccttatactcccagggtacatgatcaccctctgatataacaagtccagagaagtcctcatttgcccaatcagtggccattacatcaccttcctcatcggatgatgcgtcgtcgtccgcttcctcattatccgaatcttccctctccatttcatcaacaattataccgactctctccccctcatccgccatgcccatggcctgctcctcccttggttgattttcctcattttgcatcgatggtccaacaacatcccctgcattgataggaccctctacatcttcggtttgcattgaaacatttatatctttctcttgtaccgacacaaatataacgaggggccatgaccgttcaaaagccatttccacataccgtctccaagcagcagtgctgtccatcggcattagttcccaaaaataaccttctgttgcacgactcactacaactgatactgacattgtgtagacttcttggtctattctaaatcctctcaacaaccaactataaattgactgaaatgttctctccgcaggcctatcgatgcccttagatgtcattacaaaatctgacagatcaacaccatctggaccaaatctaatatttccttcaccatgaactatctgaaatgtgaccttatttgacattgtgcctgatgaaaacaataactgcgttaacctcgcatttctgtactacgccctaagttacattctctacaatattgttctccaaaattctaaaagtatgttacattctccatatcaaactaaactacatcttacaattaacactactgtctatgtctcaattcatactattatattctatgctctggatctacacatatgtgctgtgtgctacagatctgctaaaatatatggaactaaaactaaaacgcaacatatatactcaaacataacatattagtacaaatgcaaaagatgtatgggagcaaacctgtgatgaagtgagcgaaccagcagggcttcgccgctccccttctgctgccctcccctctctctctttcgttttttttggatttttagtgaatataatgaaatttcagagaggggggactgggctttataggggggaggcaaaaatcgccctcccccagggcggcaagggggccgcctgcaaaattccatgccccctcgccgcccatttgcaggcgccccccccccacagtacaaaatcgccctagcggagggcggcaagggggccgcctgcaaaattccatgccccctcgccgcccatttgcaggcggcccc

SEQ ID NO: 20068 - DNA, 2562 bp, Oryza sativa
attcgcaactgggccggcctaggaacgaagtaggaattgggcctccagcaacttccccccggcgtatcttgccgcgctctcggccaccgccacgcctcccgctccgatgctccaccgcgcagaccttgcgccggcgagaaacggcgaaacccaaatcctctctcgaatccccgcgcccgcgcttgctcgatgcaccaatggcagcaggggggggtggggggggcgcggctcgggatcctggggacctgcgccatctggcagccacgaagcgaacccaccgtccactcgccgagttcaggcggcttcgtcctgggcgaggaacgcacgccgcctgctcgacgaaatgcgcgggaaagacgggagcggaccatatgtcccacgagatcgaggaaaaggtgcgcgcgcgtcgcagacgcagatctactcccccgccgcgcccgcgcccctgccgtgaggcaagggagttgaacagtacacaggaaatgggaggaagacccgtctcgcctagcgctccaagacccaagtgagtcaactcttgtgctctgtaaatttccggtacacgttcgttggttgtccaggcctgggaattgcttgtatctgaagaaaagttgctcgtctgatccacgaatttctgtccttatctttgtggtatagtttcacacacgggtgaggtgataggactccaagaagaactggagaatggattatcataatttctggtatacgtttactcgaatgcgtgactacaatttggaaatttccttgtttcacactaaggtctggtttagttcccaactttttcttcaaacttccaactttttcatcgcatcaaaactttcctacacacacaaacttccaacttttccatcacatcgttccaatttcaatcaaacttctaattttggcgtgaactaaacacaccctaaggtatggaatacccccaaactttttataagaaaatgaacatctaacagcacacgcttttgttttggatgaaagctcatgtgaagtttctaatcaagacaccagacacatctaaagtgtgcctggaaggtttgatcttatttaagaaccattagttacatagggtccagtgacttggacttatgtcacccaaataatcttatcttatgttccagtggtggttagtgccatataccaaaaacacaatttccccgccactacctccagtcctccaccagtccaaccctccaactatattgtcatctacatcatacgttttcacagttttgcagtctgacttgctcttagttgttgcagagaattggatttacaaactgagcatagcctagaaggatctccaccacctttcccttggcaaaacagaaggtcagttcaatgtttctactccatatgtccatatgtgtggatgtccactaaatttgtgctttggtcatgcctattctgctctattcttacgtatttgctcttctacaataaaattaggatggcaggagtaggactggtagttggaggatggattgcaaaggcagtgattgccaatatcttgtccagagtacgctccctcctccacgataatttcagtctgcaaaaggacactgaaaaaatgctgaatgacttggaggttgcgcttcctcgcattgaggcggtgattgaagcagcggagcggagatcaattgaaagcagtgccctttccacatggttgcagcagttgaaggatgctgtttcccatgcaggagatgttgttgatgattttgaagccaagacaattaaagatcaggtcgaaagcaagagcaaggtcagtgcaaaggcatactctaccgtcaaggctttaaaggctttggtcttttctgatagtgaattgaagaagctgaagcatgctgtaagaagacttgaaaatgtatcagcgagagttgattctttcattgaattgatcaggctaaatgatgatgatacagtgggaaggattggccatagcttgcatagtgagaccagctctttacttggtgacaccaaagtaattggtcgggatgaagaaattaacctgatattggacatcatattgggttaccgctaccacttgccaagaactagtgagcatgcacgacctgatgatcaaccaaaatttggtcaaaggggaacactttttgataaattacggaagattttccttactggaactgctgaatctagtaaatcgagtgataaggctaaacttgaagaattagaagcaagaaagaaggggaacaaaattgaagaagaagatcctagcaaagattgcatagaaattggagaatacgaacctaatcagaagggacaaactgaaagattagattataatagttctgatgtacatgaaaccagtggttcatctcaaaaccttggcatccttcccatagttggcattaatggagtgggaaaaacaactgtggctcaagctgtcttcaacaataagagggtaaaaatgtgctttgatctaacagcatgggtttatgtgtcagacaacataagtgggaaacaaattatacaaaggatcatcatgtctttggaaccatggagtggactaactgatgatgcact

SEQ ID NO: 20069 - DNA, 77 bp, Oryza sativa
tgcgccgacgctcaccactgtaagggagagagagggggatagagagtagagggggctgacatgtgggaccacagggg

SEQ ID NO: 20070 - DNA, 623 bp, Oryza sativa
ttctgaaataaggaggatgctcgatacccatttaatccattgtgttgcatacgctggtacttcattttttaagtctaaacttctcaaccacaactaacttttttcatttcattttctcagcatgtccttgtaaacgcatggtaacacttaatttgatggagctgtttcctccatgaagaagctgttattttcctatgaatatctcatcaggttaacaggtttcttgcaagttcagaacaagaaagttgcctgagatgatgcaaactgactgcacaaacagaaaggcaaccagttggttacttcatcgatattacaggctagatcgatgtagcctggagactctgcaagtatgcatagaaacagagtggtctttactcttgttcattaatcaggatagccttgctgatgctgaagcagcaaaacggaagccggttagagattgcagcataaattggttccagtaatgctttgcacttcttttgtgggaccggaacttttttttaaaaaaattattcccctttggtgggtgtgtaaaacctcttttaacacaccccttttttttttccgtgtagaaatataagtgattctagcatttcccacatctatctatctattatattatt

SEQ ID NO: 20071 - DNA, 5853 bp, Oryza sativa
taaatcactactaacttagttcaataaatggttaatgaatgacaactagtaatttatcagctagataaaatacacatatttaatccttaacaaagttaaatatctaagtgcaacaggggacacaagagaaccccgtgccatcacaatcactatgtacagtatgataccaatccaatgatataataaggaaaacagtcagacaatctagattatatgataaaggacattgttaatttcaacaacgtatagctactacatatttctgtagaacaatagaactaagtaaagcaagtagaattacaaactttctatgttgaattgcaaaaagaaatcactgcaagaactagtagtaatctataagaagaataaagtgaaattaattacaatattgaggtatgttttgtcccgtaagctttgcaaacttcctatgttgaattgcaaaaagaaatcactgcaagaactagtagtaatctataagaagaataaagtgaaattaattacgatattgaggtatgttttgtcccgtaagctttgcaaacatggttatgtaagttgggatatatttttaggatatcaacttacagcaggcatgtcaacgtagtagttcatatggttgaaagaaagggaaagaggctggaatggcaagaccattcctctctggcttcttctgttttctgttccattcgtacctaagataatgatgtgggtgcaggataaattatgagatgtcaaatacacattaaaataataaacaaacaacatgcttcatgatgctagaatcaactgctatgaaatttgtagcagaatccatctataacacaattcaggacccatttgaattctcataaaatctcataataaatcaaacatccagcaatatagatgttctgtttctgtaagcttcctgatgaatgttcatccaaacagggccgacaacaagaacaatttgatacgaatggacaataccgatgatgaaatgtgagacacattgactgctgtattaccattaataacctctgacatttgttcctgattagattctgcttcgagctcacttttggtgtcatcatcagaaacaacagtgcttgcactgccaatagctgtagaagtattgtgtaagtgctaaaggcatgcattacagacaagtgacaataccatgtaagggaaaagtgcttacgtcttaggaatgtaagagcacaaaggtagagaatgttaaaaacaatcataaatcctatcatggctccaatggaaagccaatacccccattctcctgtgaagtagcctttggattgaagaaaagccttccctattgttggtgcactgatacttgagtcattgtttggctgcagttaaaagttgatattgtcaaatgtctaggaattagaggcgatcaaacttagttgatgttgagaatatatactaaaaaaatctagacttgcaaatgaaccaattattttttctatgcaaagaaaatactatgcttctggaaagaaaagggttgtgttgacagaaaacttacaatggcccacctactggcaaggaattcattaactgataaggcattattgctatacatcatgggagatgtccagtagccccatatccaccacggtttaatgtcctcttttaacataaatgtcaaaaacgaaaataagaaacataagttagtagttcagactggaatatttcgaatattcagagaaaataagatataaaccttagggaaaacgttataatgaatcttccagggtttcacaatgcttctaactaatcatatggacaaaagaattaaaatacacttcaaacgacaatacacttacttctggaaacgagaaatcctccaaagaggaaaataagtagcagcacaaacatgccaaatgtattagctaccaccattgatcttaaaattgcacctagcaaccggaacaaggccaaggccatctggtgtgtccaaaagtatgcaagaaactgcttgaagaacctgaaatcagtagacagatcacagacaaacccatcaagtcaatcactagtagaaaattctgtttatagaaaatattaaaaataatatacctaggaaagcaaaagaaaatagaaaagttaccttcctgcagcaggtgcaaaacccacaacataatatgtcaaaactatccaaagagatgattccataagggataaaggcaccttcagaatgatgtttgcaagtccataggtccatgctggaaagaacaggaagtctctttgtttgtagaatatcgggagtttatctatagtcaattgaagttcaccaaaaccattgaacatgattgtaatcaaagaagcagttaaagcaccaacatatttagaggtatcagaaaatttctcgtggggcatctttgttctcaaaaacagagtcatggttataaatccaaggacaaacagttgaaaggccttgaatatgaagaggaatgaattccgcttcattagcaaccactctcttgacatcactgccttaagggactctagactagataacccatacttcttggtagtcaatgcagcaggatgtgtcttagatttgtcatagggaacttgaagctctttctgcagcttttgcccaacatgaaatttcttgaaattctgagcaaactcttcgactgacacataacgataatgatcctgctcaaggaaccagtattgctgttgatctttcctagaagtcacctcttgaagaaagtcggccactcctttccgttcaggacaccgaaaaccagcactctcaaagaattcaagtatgttctcccgtggtccatggtagactatgtaaccttctgctataagaacgatgtcatcgaataaagcataggtctcaggtggaggctgtaggagagacatcatcactgtagcattcatcacatgggtcacctgtctgatgtatttgacaatctgaaatgtgctagaactatcaagcccagtagatatttcatccatgaacaaagctgttgctggtccagtgagcatctcccctgcaacaaaacaatgacagaactccaatcttaggatgtaaatgtgtcagtaatgtaatatcaagattcctcatgcagctgtaaattattgaatgctgaatattatcgttgatttacaagaccatcaatatttatgatcagtactacaacatgactctactatcaatcaccattcaccaagcatcgacagtaatagatctatgtgcttgctcgttactgttaggcccactccgaacatgttcccaacaggtccatgggctagtggggatccattttgtacatggtctatgtgcacaagacgacaagcttagagtacaaaaaagaccatgtacgaaaaagaacaaaatttgttcctgccaggatctcatgaacattttatctagaaaattttaggtaccggttagtgtaaaaggtttaaagaggaaaacagtggctgagttgtctttcagtcttggattctgttatagtatattgataaatctaacgatttagcataaaaaaggttaaggtgtagaccccacaaggctaaggctaaatccaggctccacaggagaaaaggaacacgactgacttctgaacaatatgatttgagacaaataacttttccagttagaaaatccattatccctatttaagttataattattatgattatgatgtagtgattgaagtaaatttcatggagaacatgattaattactgatatatttaatgtatgtcatatgcatgcataccagtagtcacacgtttcttttgaccaccagaaatgcctcttatcatagcaccaccaacaatagtatcggcacaaatgtccagtccaagcggcctgtgaagatttataaactcaatcagcacagcaaatattgacttagaattcatactcagttttcatcataaacagaagtattaaggtttcacttgtgtatcacagtcaaagtaaatacatacatgtatattacttcctgtaaaaaaggtgtactagaaaatagattctcacatagcttccttttaatatttcaacaaaaagaagaagcagatggataattgaggctagaaggcctaaataaccattttttaacatgtaaaaagtcaaacagtgttaccttcagaacaagatctgtgacaatattgttctgttttccttctactacagttgccttcatcaaagcatcaatctcagggtcaggtttaatgcctgcattacgttcccgtcttgttaattctgacagcatatcatatctggcaccacttccaaggcatcgtctcgagaaatccagtgtctctcttactgtcatctcaggattgtgcagatcatgctgactgacgtaagcactagtcctctcaggatagaactctttaaacgtatgaccacagtatgtgatctcgccagacacctgtagccatcgagtgattagtcatgtggtacgactctactgttagaggtggctacattaaactaaataagaaatatcaaaaccttgagatttttatcaggcttgccggttagtgctcgcataagtgtgctttttccagacgatggaggcccgagaagaagagtcatcctgacacaagtagtttaatgcaacaattgtaaataactcttattgtctgcttgatggtttatcatccatagccaaaattgaattttgaaacataattttataggtgattttgaggtttttcttcattgcagtctattttccagcatggcttttaaaccatgaataatacagacaaaaagttcaaaatatttttggtttcttcttttatatttctacggcttatcagccatagttcaaccaatcatttagcaagaatgctagaggggacagggggaacttgttgttaggaaggatatagtaggtctgtagcaatagcaattggaacaatatgatatgtattaatgtatgagatagttcattttgttactgatgggaaaagggatggccaatataagagaaaccatttagttatcactaatttaaaattaattaatgaccatatctgcactgcacaaataagacagataatgtttgcagtagacataggatcatatttttacactgttttttgtgggtaattactacagtatgatgtttgcatgtatacgttttttctttctgaattttcaggccatgcttcaaatctattatgaaggggaaaaaagttaaattgcagagtaaccatgtctgcataaatcatagagatcatatctatatctgtatcacttgggaatagaaattacttaataaattacagatagtttatcaaactagttagaattagaatgcagcttaaaaacataaagttccatttaagactagaaatgattaacgattggattaaaacgttccatagctgagtatcaaagaatttccaagtaccttgatggcttgataatgccattaacatcgttgagtatcttaagcttcctcttgttcgacgagataaataggctaacgagaccctgtcatgaagcataaaaaacaacgtttgagccagagcaagtaacaagtaagcgacgctaagcattaggtagcatctcatcgaacttctgccactacaaccacaaatcagcaaaatcgagtctgctcgtcaaaacttaacaactggagattaaaaaaaaattaccaatgaactttgctagtcagattactagtattagtaccaacgaaacgccctctccaaaccgatagccacatcgtgtgggaatgttcgatggcatcaatcaaccaaaccctaactaggccttttggtggcgccgtctgcctctacggagttagcaaccgggccccccccctccccccttccgcatggagaagggaacggatcgagagcggaatggggggag

SEQ ID NO: 20072 - DNA, 7802 bp, Oryza sativa
aaaacttaaacccagcaccagaaacttaccacatctgaaagatctcgtgagtacactataacttctagaagatctcgagccgagtacaactcgatctatccttaccagggtttacattaccatcggttaccggcttaccgcggggtacagtaataaaaaaccacgataacccccttaaatttaaataaatttgaaaaataatttgaatttttgataaattttacacggttttttacggttaccgcgtgataatcgtgcttaccgccggcggtctgggaaacctgatccttactgactagtactaactaattctacgtacgtaccatgcgtgtgcagttttgtgggacttttcgtcgggtgtgcgacgacctgctagccgcgaaattctatcacgcattgtgtattctataggcgtcgttgtctgtcagaaattctatcacgcattgtgatcagggcgtgggcattaacagactaacagctagctggtcaaaggtcgaaaccacccaaacttttctcccgtttttctgtacgcacgatttttaaactattaaacaatacaattttaaaaaaagttacatacgaaagttgtttttaaaaaatcatattaatttattttttaaaaaaataactaataattaattaattataagctaaggagtcactagaactgttctacatgtgtgagggctttaaattccaaacactaccgaccgaacacagctccaaaaacgtgctttgactaaccggcgactaatcgccactcatcagcatgaacacatgagcttccttccaaatttgcaggccgcgagaacccgcgaccggccgttttacgcattactatttatcaagattctacggtggaccccacagtcatacgtgagctaagctagtggacatcgtacaagaatctactagctccaaattaagctaatctctctctccagagtcggacaataaaatggtcttgatttttgtactgcgcatgcttgacttgtttcgattgatgtacttatctagtggcttcatccaatgactttttttttaagagacaaaaatgttttcatacccttcagttttcttaattaatccctttaaaatttcagtaaaatccatcgtacgccccaaattaagtattaaggcgccactgatcttcacatccaacttgttgagtgatcacactagagagctgagctgagctgagcgatgtacatgtgtatatacctctagcgtgttgatggtggcgttgagcagcgtgggcagcgcgcgcttgccgacgtgcacgtccgcctcgatgtccagatgctggtacctcacctcgatcttcggcagctcaatcccaaccctacaaatcaacgaagcaaattcacaataaattttgattcaaatagttaaaattcacagggatgcaagcgggccgactcacgaatttacttatatgttaaataaagagtaatctacgggttttcgtgtcatgactcagcttgccgcgtcatagagaagcaagtggatcaactataaacccatttatatatcaaattagtaggtaacccgcaagccagccagcgggttatccactcattttgcctataaacgggttcgtgagttgacccgctcgtatcccctccacagtcctcacgtaaatatggtctctgagaagaagaagaaaagtttttatgcttactggtcgaggcggtcgcggaagcggcggaggaagcgctcgttgtcgtcctcgacggccttgaagacgcgctccatgagctcgcggccctcgcgcgggtcgaggttggcgatgtccacctcgtcggccttgaacagcgacccggccccctcgccgtcgccgccgccgtccaccgccttgcggaggatgccgcggcgcatgcggtcgtacgtcggcagcttctccagcgccgcccaccgcaggttctcctcgtcgtccccggcgtcgcgccggctcgcccgccgaccgccggaacgggtcgtccccgtcgcgcagcgaccgcgccagcgacgccgcccccgacgacagccagctccgccggctccccgacggggttatctcccccgccatcgcgccgccgctcagctcagctcagatgatgcttttgataccttcgatcgattactttgcgagatagttccggccgccggcgatcgacggcggcgaggcgttcgttctgaccgtcgccgtgtggttgctaggcttggcgggagatggggggtttatatatgtagggagttggattaatcagccgcaccgtatgactgggtacagtgaccttacgtacgtcgacgtcagcatttgtccgtgtgaattttccggatgtgttatataatacgctgcagatttgaagccttgaagggaaggttcctggtcctggagaacgaactaattaacgggaagataaatgcacgttgtcgttatttaattgatcaaatcaattgaattataattaattggctcgaggcgacgtaggaaggttcagtggttaattagaatgatttacaggaggtgagtgccaaggactaggagtagcatgagaaagatgttttgatgatattggaaatgcaaggaatgccgatcgttgacgcagttaacttttgaacatgaatttgatcattcgtctcgttcaatgtaatcaatgtaaatatgaaaaatataaatcatgtttaaagcacatttaatgataactcaactcacaacaaaataaataataatacaatttattattttgaataatacgatatgatcaaaggttcgtttaaaagtcaacgacaccaattattaaaatcggggatagtacttagttgtgatggactactgaatgatatattgctggatttatctcgccaaataattttataaaaatacgtgatgttattgcttaaactgtggtagtgcattaattaattattaatgcatatgttaaattcataatgaaaacctcatgagtcagagatcgatcttacttatagtacatctagctttgaaagatgtcgtaatatacgagattacgtacacaaaaatttatgaatccatgctctagataaaccatccatcccgcgcatcttggagttaatagtagttaagaacgtgtgtgtaggggaatccgctgttcttaattaattttgaccttctagaatggtgcttttaattaattacaagagctagcttgtagattgtttctactattctggatgcttgggacgtaatcaaaattttgactcttgatattaactatttttttctagagttcatatatagcgagtaattaagcttaactagcttgcatgtacgtactgaacgtacacttctatcttggccgttgatcagtcatgcatgaccatttttttttcaaaaaaaaataaatctgttgaaactaggtcaggttttctttcttagtttcttcagtcaagacctatgctgttttgcatacaacaatataattaatataagaattaagaaggttttttttagataaagataagaattaagaagatgccggggacacatgactagataaaacctaacttatctaacaggcatgccatatattctcaatacacgctattctaagtccaattttccagggtctgcttctagaaatggctcctataatttagcaacaatgaaggaagaagaatagctggagacttgtcaacgtatggaaaagctattacttcttcacactagctagactccacggaataagctatatattcaccgttgaaattaattaacttgaaagcgaccgaaatgtattttgtaatactggctagctaactaacgtacgtttgctgtatgtttggccacaccatcaaaagtgttgaattatttcagctctcactttgacggctggcgttcacagctgaaggcctcgatctcgatccccagtcgtcactgcaaaaaagggtctttctcttgttagatcggacgaacagtagtgagccacacccatctattcctcctttcgccaacgacgatgatagattgaggaatctattccccccccccccccaaccaatgtctcacgtttttgtttactgggtggctttcgaatgttcacaatgatttcaaaccacatcttcatgttgagaaaccgctagctaattgtcgcaatggttcactactacagaaatgattttcttgtacaaggacctctttatattgcagacgaaccgtaactggtcgggtctacaaaaatcgtcctcccatttttacgtgtggacccttaagagaaccgcacgtgaaattcgatttttgcaagcgggtctcttaagggtatgcacacaaaaattagcctatttttacaggcagatatcttaaagggctgcacacaaaattgaattttcgcatgcggacctcttgagagaaccgcacgcgaaaataccctccctcctctctagattttttcctcccatcacttcaaaattttcatccttatcctctccatctctctcacctactcatccttatccccactctcatttgtctcttactttctcctctttctctctctctctctccctctctcaaactctcctagccgggagagtggcggcggccggcggaagggcagtgcaggcgacgaggggtgacggcagaagaggctggcgcgcagcggccggcggaaggacggtgaaggtggcgtggggtgacggcggcagaggcacgcagtggccggcagaagtgatgaggacatcctccactattatccactggcaaagacgacaaagtcgggcggcgaccgtgtgagcctctgaactgaataatcccaccttacttagcttgggaggaggaagccaccttaaaagggagagccacccttcccctattgaactagtcttttagggagattgggcctttccccgagtgggtgtgccaaagaattgttggggtccgggcaaccttaatttgttgggcctcggccgaccccacctgggccagattgttatcaggaagggtggcgtggggtgacggctgtagaggctggcgcgcgcggcagccaacaggagagcgacgaaggcagcatggggcgcgcggtggtgggcaacgggctgccggctatcccccatgcagatccagtgggcggcggtgtcgggaggagcacggccgcggcggcgagaggagcctgtcggtggcagcgggaggacgacagcagctcaatttttgcgatttttattttttttcgtatttttgttttcgcgtgcgggcaacataagcatcaacacgcgaaaaactaattttcgcgtgcgggtgtgccacttgcacggaaaatttggattttcgcagaccttttcgggtagacggaccggaggtccgcacgcgaaaaccacttttggcctcttggaaaatcgttttttagcagtgactatttagaaatgatatgttttccggtagatacattttcttcttatttataggattctttttgtcaattatccattggctgtgtacctaggttatattccctccatcccaaaatatagcaaactagaatcggatagaacgtattctagtactacgaatatgcaagtactgggatacgtcttatctggttctaggttattatatgtagttgaatttaaagtagtttaactttgaccaaagttaaaacgacttataatctgaaacggaaggattacagttaactggacagcagtatatatttattcaacgacagaacttgtttactttgaccaccctaaaagatacatagatgacggcagtgcatcataaagcaatgactcgattcaactactgctggggttcagagctaggcggctacgcgggtggtgatccccaaggtaatcggaaagattagtcaatgattgttccagacatgatgcgtgttcagagggtttcggatacaacgaacgggatgcaaagtgcacacgtgtcacgtgagcgcatcaaaaacaactttgtgactgtttttcaacgagagaaaatataatacagtactctctttgctttaaaacattgagtattttgtctcgttagaaaccaatagttactctattgattataaactactggagtactaatgaagtgatgatcttcgttaatttgcacaattaatttcgttaaaacgtgtgtacacactaatcatcttctagcaacatgcatatatgccctgcgtagccaccaagttagctactacagtactactcctactaaaacaaacaacctagctagtagatgaaaccccaatacttttccaagtaacccaaggtggtcaaagacgaaaaatcagcatatcaatagctttgaatactactcaatctcggaatatctcccaaccgttttatctcgatcaacagaagtcgtcgtcgtcgtcgagatcaactcaacttaactgggctctcatggggttctggaattctagaaagcatgtgcttggaattcaacagcaagaaccggtggtgtttccgtgcctctctggtagtcatcaatcccatgaacctgcggagcttcttccattattccatttcatttccaatgtcgtatgcgacgagaattcttctctctctagctgtttcctgctatagctggccttagcataaaatatcagtagtcacttgtcggtatcagtcacaaatttgacgtattaatttttctattcgctcaaaaaataaaatttttgacgtattttctccgttagaaaattatcctgatctgttagggcaagtgtaatagggaaaatatgcctactattagccgttgatatcaacttattttgcattgctagaagaaagagggagtggagatatgagaaggggtcgactaaattgattggtgaaaaaaattaggtgcgagataattcaggtgggcccacatgaaaagatcatctgtgattggtagatagcctacgagagagaaccaaggcttggcccacgtcgagaaaaaaaataatggctcggttaatttttatattatctttaattatataaaaataacatgtaagcatctaatagatggctgcttaattactcttttattagacttgtcctcagaaggcgatggttttattgatcttaattaccaattgcagttcaagttgctccacatggaccattaatatatatacactctgcctagaagaagcaacgatcaattgatcaatctcgttaattaattaaattgcacgagcagattgctgtcgtttttaatcgcatcacattcgttgcgttatttggttttcacgtagagttagtggagacgacttgggcgcccttgcatgcatggcgctatggtaattccaaacattgccacgtgtggagtacggtttaattacttgccaagacggacgggagtggattctaatccctcgatgggacatccctcgtatatctttttcttctaaattcgatgcaaatagttgtgaaaaattctgaaaaaaattgacaatgtagagtataatgatacctactagtccaccaaaattcatgttcaaattcgatctacacattgagaaacaaaaaagataaatttatatataaacagtacgctactattcatatgctgaatttgtcttttttatatctcgacgtgtgagttgagtttggacttaagattttgtggagttatatatatgtgttgtatgaatgttgtcaaatttttccaaaatttttcataattgtttagatggtttttgagcaaacgagggaacatcccctcgagggattagaatagtttcccaagacggacaccttgaactgtgaaaaaaaaagaagaagaagatggacaccttagaattttttaaaataatattattttaatagaaaaattgtaaagtagaaat

SEQ ID NO: 20073 - DNA, 196 bp, Oryza sativa
cctcactcccatcgaccggcgcgcgcggccttttctcccgccggccgccccgacaagttcgcctcctccctcgcagcgctctcgccacgccgcaccgccgcccgtcgtcgctccaccaaccgcccatctgctccgccctccgcccgtcgtcgctccaccaaccgcccatttgctccagccctccgcccgccgctcc

SEQ ID NO: 20074 - DNA, 539 bp, Oryza sativa
atttttttatttttaattttttttattaaaagttttacaaaaataatttttcattttgaaaattgacggatgtagtcgcctaccgccctctgggagggcgatttttaaaaatcgccatcccagagggcggcgaaaatgacgtggcagacggccgttcgctctcgggcgacggccgtcaacgaaatttgcaggcggcccccttgccgccctccgctagggcgattttgtactgtggggggggccgcctgcaaatgggcgattttgtactgtggggggccgcctgcaaatgggcggcggggggcctggaattttgcaggcggcccccttgccgccctccgctacggcgattttgtactgtgggggggggccgcctacaaatgggcggcggggggcctggaattttgcaggcggcccccttgccgcccttggggagggcgattttatactgtgctttatatttttgtataaatattaatagttatcaaatctttttatattgaaaactatacaagattaaaatctccaagactggtaaaata

SEQ ID NO: 20075 - DNA, 4328 bp, Oryza sativa
  unsure (1)..(4328): unsure at all n locations
atcatggtttgggaataaacgttctgccagccctaggaattggctgcctatatccagcgctaaggcagtgtcttctgttctgctcaatatttccaaggaattatgtctttgaaaaggaaagagtggtccagatgtgggtggcacatgggttcattcagtctagtgatagaagggatatcgttccagagaatgttgctaaaaattggtttgatgaactagttgataggtccttcttgcaaccaacagtctggcaagccgttacgtcatgcatgatttgataagagagttctcagttgctgtttcttccaatgaatattatgtctttcacaggaattccaaggttcttccacaatttgctaatcatatttctgttgataatgataatttcgatcttcaatggggtcattatgatcataaaagattacaaactctgatgtttttggtcatcacagggttgacaaaaattatggcactcttggtagcatagtgagaaagtaactagtctacgtgtcctggatttgtctacatttgcatgagtaatgtcagtcaggcttcagatgttctctgcaagtggcacatcttcgatatcttgatctctcttttactgggatcaaaaatcttccggaggcatttggtaatctataccatctccaggtacttgatctggggggttgtataattgagaagctgccaaagaacatgaacaatttgatcaatctaggcatttatatgctgattcacaaaccaccgcactgatctatgctggaggccagctgacaaaacttaggagttacaggaattcagagttaggttggaggatggtacaagataaatgagtttagggacatgaaagacctgaggaaattgtacattacaaatcttgagaaagtctcaagttggcaagaggctacagatgcaaagctggtggagaaaaagtcccttgactatctgcaattgaaatgggtgtaccaggtacctgaaagtaggtctacctctcagttgaacaaggatattctcgatggcctacaccctcacttccagttgaaaaggttgaaaattctgaactatatgggaattgattttccttactgggtgcagcgtctcacagacctcgttgctgttaacataattaactgccgatggttgagtgttctgccaccattgggagagctcccacgtctcaagaaactatctctttttggtctatcctctataactcatattaatgatcaagtatacggaaccaatgatgtgatctttccatatttagaggagctgcacttctagaattgtttagctgggagcaatggtccgaggcagaatataaactgcttattcctcacctacggaaacttggtataaatgcctgcagcaaattaagtctattgccgattgaaactttgagttcatcagtcaaagagcttcatctttcttcatgcacatcatatatcagtatgctgcccgcttatttgaaaagactgacgtccctcaccaaattgagcatacaggactgctctgccacattactaatcccgtgccattccttgacattactggagcacttgcagctggaaagctgtttcgatgtacattttgaagggggcatgcagtactttaccaaactgaagaagctagaagtacatcgctgctttgatgtcactcagaacatatatgaacaaacatcactagtggagagatattctctgatggggggtcttcagtccctcatccatcttgttatcgacgacagattcatgtattacagatactaccatatgctgaacactctttgttcaattcgaactatgaagttttgtgcctttgatctttccgagttcaccacggaagacgaggaatggctccagcaactacagtccctacaggagatccagtttgcttcatgtcgcaatctcttacgccttccttctaacctgaataatatgtgtaacctgaagaaggtcgttctgaacgattgctgcaagctccagtcactgccgctgaatggcttgccagataacctaaaagaattccatgtctcaggaggttctgaagtactggagcaacaatgtcagaaaacagatggggatgaatggcagaaaatttctcatgtgccatacgttcggataaatggcagaactatccagatgatttcacatgatcttggaagttagcaacacatgtataacaaggttactctaggttaagttatgtgtaggcattttgtgggatatcattgttggtacttcatcggtaggaattaggagtttctgaaaacttcaaaggtatggtttcaaaaaaccaaattcacattaactgctccggcttctgtcacatatctggatatacaagccactagattgtcagcgatctgctcaaagagggaaatgaaccaatcaaaaactgggaagtagccattttttaaaaaaaatggagagtgctctgattattttctgatgttatcacgtttgaacagaagccaatttttcatcgttntccagtgcagactaacgtgatctttattcatggctattacatttttattatgttctatgatatataaatccaatttttggtaaacagctgaatttgtctcgtgatgacagattggtattcggagcgatgcagaattgcagataccatcagacgcactatgactgtatactaatatactgtactactgaattcgcacatcacactgagcgttgtgtgttgtctggtagattgctagtctctggtatgagatgcacactacatatatagttacgagttatgacttcatattcattctcctatcgaatagtaaaagagcttttaaatgattatactctatactgtgcagcttgcacctgcgcagttctgcgttgcacctcttcagaaatgataaccaccgaggtttcaaaataaatgttcaaacgaatgatatgtttcattcgctgtacttgtgcttgcaaagggcaacgcaaaatttgtctaagagcaagtttaatagtcatacaatagttggctataaaaatatactataccattaatgctcgatctcacatcgcatacactcataatgtcttggagtccgtgttgcagccgactataaatctgtagcccgctttcttctctctcttctctttttttctcgatatgtggttatagctggcttatagcttgctattgtacctgctctaatgagttggtttggtttgtggtctaaataggccttaccaaattttgtcaatgccaatttttggtaagttttgacatgactaattttggtaaggcaaagttgtatttggattgaagccaaaatagcctaagttcactattgaaatggcatattttcttaggcatgccaaaatttggcttcaaaccaaataaacactaaacactattgaaattgtcaaatattggtaagcctaatttagacctcaaaccaaaccagcccaataccacaatcgagcatatgtggatctatttgaacgaaactcttatgtcttgccacactcacatgtccacacgaagtaaataaactgtacccatgtcattcttaccaggacaaaggcgaatcatggaattgtacaaggcagcaggcataaacagcagagaaaacagtacttgtataaaagtagaacaccctgattcatagggaaaagagagcattcaaaattgaaatctttttacacggagcgttggatggtttggcttattactcatatatgtccacaagcatgaaacaaagttattctttgcaaggaaacccagctaatgaaagctacatttcgctctcagacatcaaacatgaggctgaatttggtggcaagaggaatggatataatgacagctcccagggcagcaccaaaaatacggtgtgagattgagaacgtagcactcagctgcggcttcttcaaagggagatggggtgacagtgggcggtttgcaacaggagccgacaggggacgacttgtgtgcaggagtcggtttccagatgggaacatctttggtctcagagctcctaggggtgaagatgtgtagctcctagcttgtccagaacttgaggattgtctcagatgatctatgttgttgaaggatgagtttgagctaccaagggcacctgaaaacgatgaaaaaaggtgagggcatttatttagttgtttgaagcagttgcaaaacatgtacatcaaattatacaatatacactagcgtccagttcaataaaaaattagagactaacctaaaaacagtgaaaaccatgtctcgtgtaaaccaatgacgacttccattttcttaaaaaaaaacaataacttactctagtgtggttgcaagaaatttgtgtccta

SEQ ID NO: 20076 - DNA, 11654 bp, Oryza sativa
agactaacctaaaaacagcgaaaaccatgtctcgtgtaaaccaatgacgacttccattttcttaaaaaaaaacaataacttactctagtgtggttgcaagaaatttttgtcctacgtcagctacaagtcaattactgcattgcataatgtacttggctaccgcattatgaacaatagggtggctgcccatattattgattgatatatcaaaggcaaaccagaaggcaaggcatatagacatattcatgcaagagtcatttaccgcggagagcaaatggagcatcactgaggggtgcaaaccgggccttgctctggtacttctccattcctgaacaaacaagcagtaatgaatcgtcttaatcaacacaaaatcacggtttagtaaaaggaatctatttatcctttctgttttgcaaaactgagtttgaggaagagcattaatgctggagacctgccaatcagttgaacctactgaacttcatacctagatcaaatgatgcattttcgcaacatttgtactacagtaaaactcggtgcttaacagaaggctttgaattgtgttacaaaaaaagaaaatagtataacaaattaaattgtgggagcagataaccagatcgatctcactgcaaccatgtgcaattggcacacccaacattaaaacctcccattcttccagggcatctgctaatccatgaagctcccacccgtccgagtaaggattcgggggtagggttggagggagggtttggtttctgacgagccagttggcgaggctagggtttgggaaaggtggtcgcctagtagtagtagcaaattagggtggagcacgaggaggaggaggagacggcggcgggacataagggcgctgccggccggccggctggccggccgtggtggaagcgggggtggccgtagcaccggtgatggcgcgggcgggaggcgggcttggggtggcgcatggaggcgtgcggatctgggggcgctgatgaagattcggggggcggggaagggatcggatagaacgatcggcgaggaggaagaagaagggggcggtagagcttaccgggcaggacggtggcggcggagatcgctggaggtgggggtggggggagtcgaggcgatgtgtttggtggccgcgcgaaccagctgggagagagagagagaggtgtcgtgagtttcggattgttcactttgttactgaaattttgatttttttttttactgcctctattccataatagttgtatttctaagggtgtgtttgatttaccgtcaaaactggatgggatatgacggtacatattttgttgaatgtagtgatccaattttttgtttagttgggtgaatatggtgatacattcttttttttttagagatgaaggtggatttggtgatccaattttttatttagttggaaagagtagggtggatgagcaggtgtggtcacctctcacttagagaaggtgagtatacccccatcaaattcatatatacaacaaatcacaaatttaaatatatatactactacaaatcacaaattcccaacaaatcacaaattcatatatatatatatatatatacactactacaaatccacatagagaaaaaaaagaaaaataacaaagaaaaaaaaggcgggaagaagggccctgagctcgccgccgccgccctcgcatcctgccgccgccaccgccgtctccgggctcaccgtcgcctctcttcccgctcgccgtcgccccctcttccacgtcggccgccaagctcgccttccgccgccgccgagctcacatcccgcgtctacgccgagctcgccgccactgccctcgcatcctgccaccgtcgcccctcttcccgctcgtcgttgccccatcttccacgtcgcccgccaagttcgccttccgccgccgccgagctcacatccctcgtctacgccgccctcgcatcctgccgccgtcacctctcttcccgctcgccgtcgccccctcttctgcgtcagccgccgagctcgcctcccgcgctggtcgccgccctcgccgctcgcaccagccgctgcctcgctcgcgtcaccatcattctcgctagcgaagaggggtgacgcgacccgcctcgcccagctcgcctagcgcttgggaggctgcatccgggcaaatcaccctgatcccttcatccggcatttgaggggaatattcccctctgggccgcccaatcccacattcgccctccaaccaaacagccataaaaaatgggcccccatgttctatccacccaaaaccctccatccaaccacccaaaaccctccatccaaacacaccctaagatttaaaattcgtcccaatatacttgtcactacaaagtactagttgttacatccatttctttatattcaaatttctttcatttctacccctaaactactagtccactcctaaccatataccatttaatgtggggggtattatagtctttttttttctcaaaccttagtccatgctaaactatctaggatgacaagtattttgggacggagggaatattatcaaattttaacatattttgatattatcaacttttgatagtgttagttttgtttgttttcatatctttatcaaattttggtagagttttaagagagagagcttctaaaactaccaaaatttgatgaggtggcaatggtaaaagtgtgtttagtttgttgccttaccaaaatttgataaggttgaaaccggtacttgtgttcgtgttcgactttttcatgggttcggtcacgactcatgagttgaaatttgggttgaatgtagaaatttgtattactgtacatatcttaaaatttactcaaatttaaatacacatataaagacatttttacatgttgtgagcatgacagaaccaaaacttttaagcactgattattttctttgaagtagaaaagtattggaagtttagaggtggacgttagtggtaagattaacactgaaatttgatttttattccatttccttgttgtttcttgacaagtaatctgtataagagatccatccctccttaaaaactccctccaaccgaatgcactctaaaagaaatatgccgagatctaatttatgccatgtttgacacagatgcagattctagattcacattggatttgaagtgaagcttgtatgtcaaattatagtggttcaaaattttatacttaaaatagaaataaaatgattcattctaatgttaccaacgaaatcagaaaatcaaatccataaatttgtggagctaggaataccaatcttcaagaaatcttatatctgtagcagtgccaaataagaccttagtatgcgttgctcttgctatattgatttcataaatctttatgacagctaaaatatcaaatcctttagtagtatttaaaagtttaataataaatatttgccatttaactaaatcttctaaaacgtcattgtttggcaataaaacaatatctacgatgtaaactttaccaatttagaacacaagctttacccattttcgatcaatgttattgaaaaaaatcacatcaaacactgtgacaaatatcagcggaaaaaaacattgtgtcaaataaaaaaaggaaataaaatactcgaataatcaaacttgggtacatatacatattaagcttattctaatgaccaagacatacattctaatgatgttttaaaatcaagaaataaagggattggataatcaaaatattaagcttactcgaactacgtagaattaatatttttatataaaccctttcaataccctttcgaccaaggaagaatatgaagatctcatatgaggtagtctctactttacatttgacaaatatgatttcatcctactaaagttaactagtgttggacttaatttttttttattagagtctaggtgaaactcactatgttgattttgtataaactaggtggttcatcatgggatcataactgcaaacgttcactagactctaaagtgacaaacaccttattcctttacctttttttcaccaggaaccacacattagatccacttatcgtttcacctcacgtcgcagactacaggcgagcgcgttctctagcatcgttgggtagcggaaagatcccctgcccctccagcaaaacgacgtgccgacgggcatctcttctgctctactccatgttcttcctctttggcaagaagatagtaaggctccgcgcacccccttcgttcgctccccattcttcatctccagcaataagacagtgatggcaccactctccttacttatctcttatctttacaagggcggtgacgaggtgccatcccaccttcctcagatctgacgcatagcaccctttcttcttcgcgcatgttgtatgaattgccaaagttcttaaattttttttatttcgaagatgacctttcgaaaatgagttgaatgtgtaaagtattaggtatgaaatatcgagttgaaacttctaaaatcgggtttctaagtttaagggtttgaataggaagctttcaagttttcacatgaatatttcaaaatctgaccagatgatttgtaatccgagttgaaagtttgaattatagagttggaagttctatatatccgagtttaaagctttaatcatccggttgagaattttagtgaaagttttaatcattgggtttgaaatgatatcaatctgaacaagctctaagaaaaagaatattgaccaatcagtagacgtatcttatttatgtctctatatatcatagctatcgtgaataagttttataggaacccaattattaaactttaatctcaaagtgttaagtacgatactaccactccaggaaaataagcccgagaaaactccaggaaaatagtacaacctcgtgcgctgacacagtgcaccccttctagaaaaccctcgccaaattttcgtgcagcagacgccgtagaccccacaccctcccggactgttggtagtggatctcggaaggcaaaaccccgaccaaaacacccaaaaaagaaaaaacaaaaaaaaaacacaaaatgaaattccaccgagaccagaccaaaccaaaccaaaccgaactccacaacacaacgcctttccccctccgccctcctcctccgcttccttcccttccttccttccttccttccgcctcgcgtctcctcgtcctcacctcacctcgcctcgtcttcctcctcgcatcgccctagccctaggccacctcgccatttgatgcgggggcgcccgccatggcgtcgtgggggctgggctggaagcggagctccgagatcttccacctcaccctcgactacggggacctcgcggatggacctcctcaccatcaccagcagcagccgccgccgccgcagcagccgggctcccctcccacgccatccagcgcgggctccacgccgacgtcgtcgtcgtcttcgccgacggcgaggaggagcggcggcagcggcgagttcgggttccggatcgagctcgactggtcggcgggcgacgacgaggaccaggtcgcgctgcggctccagtcccagctcatggtcgcgctccccccgccgcacgacgccgtttgcgtcgatctgtccccgaaaggggagggcgccggcggcaagtagggtgcggtgtcggtgtatatacgggtggtcaggaggcgggaggctctgcggtcggtgcgcgtggcgcgggccccggggtccgcggccgggagcggcgacggcgccggggtgctctcgcggctcatcagatccaacctcgcgcccgcgccggccgtcgacggtgccgctgccacgggcgtccccgtgctcgccgaccactggcgctccgtcgccgtgctcagcctctgcaactgcggcttgctggtgagtccatttctctatctcttccccctccccctgatccgtgcgaaaacattccatcccgtacggcctattgttttaacacatgcctgatcaatgtagaattatgttaccgccgtgattgctcgatgctgtagtgatctaggaggtggcattgtagtgttgtcgtcttttgtgggagaatttgattggatgtgtataaaggaggcttgggcatatgttttggttgcttcacatacctttacttttagctatagagattctgattatcaggtttgaccacacattgtgcatgctacgaccactgaagatttcttagaaatgcttgttctgtggctctgtccaaatgttgttctcttgtcagacagacctcctgggtggcctattttcatgaaattgtgtttggttttgtggagttcgtttgatttcttgatttgtactgatctgtataatacgtcctggtttagtcgtgcaaagatggatatgcttgaattatgcagcaatcacctaataattgtgttttttttttgtttgtttgtcccctaaatctgttgccatgaaaacttagggatggacatgtagatgctataatgatctaaccatgaaatgctatgcaaaacttggcagatgcttcctgttgaattaactcgccttgcacttcttgagaagctacatcttgacaacaacaaattgtcagttttgccacctgaagttggtgatttgaagaaattgatagtgctgacagtcgacaacaacatgctagtttctgtacctggttagtgatcatgcctgcatctaaattaaaaacttaaaaaaattatgtttcacagcgtatttaagacttgaagacttgtggtctttcaagtttatgttatatcaactgcccatcagcccatgcaccaatctaatatcttatttccctttgaccaagcagcagaactgcgacagtgtgttttgctggaggaattatcgttggagaataataagcttgtccgcccattactggatttcaggttattcaattgtcttacagaggcatttttttattgacggtttcttcctgttggtgctattaagctaattattcattctttgttccgaacaggtcaatgcctaagttgcgtgtattgcgcttgtttggaaatcctctagagtttctcccagaaattttgccactgcataaccttaggcatctcacacttgcaaatattagaattgaagcactggaaagtcttagatctgtcactgtacaaattgaggttggtaaactatcctgcattgttattctgttagctaggttgtttcactactagcaatccttttgataagtgtgtattttggttttaattccagactgaaaataattcctacttcgttgcggccaggcacaaacttagtgccttcttttcacttgtttttcggttctcttcctgtcaccaccctttgctagcctctgctttggccaaaataatggaagatcgtagcaaccaagttgcaattagcaaagaagaaaatgctgtcaggcagcttataagcatgataagcagtgataatcgtcatgtggtacatattcaatctccctaattcattgtgctcaaagttctgtggaaacaaaatgctcatttcaagcacaacacagttccttcttttaatttagaagttacttttgcaggttgagcaagcatgccttgctctttcatcactgggatcagatatttcatcagctatgctacttattaagtgtgatatcatgaagcctattgaagctgtactgaaatcatttaatgaagaagaattagaatcagtattgcaagttgtagtcaccttaacttttgtttctgatcatgttgctcaaaaaatgttgacgaaagacgttctgaagtcactgaaaacactttgtgcacacaagaactctgaggcaagatgatctggatttagactctggttgatgtgttgtttcgatacccaccggtgagctcacttgtatctgttcccattttctaggtgcaacgtctatctctatttgcagttggcaatttggctttctgcttggagactcgtcgcaccctcatgcactctgaaagtttgcgcgaccttttaattcgcttaactctttcacaagagaagcgtgtcagcaaggcagctgcacgtgctttggcaattctaggtatgcttgttttggtactgaatcttaatttatgtgatccattttcctgaatattcaataactatatgtgttgattagtttgtgaatatctcttcaatccttttaggtgagaacgagaacttgcgtcgagcaataagaggaagaccagttgcaaagaagggtctgcgcattctatcaatggatggtggtggcatgaaaggccttgcgactgtccaaattcttaaacagatagagcaagggactgggaaacgcatacatgaaatgtttgacctcatatgtggtacatcgacaggtggcatgcttgcgatggctcttggagtcaagcagatgactctggatcaatgtgaagaaatatacacaaaacttggtgagtgtcttttggctcttactttccacatttttcttattgtgttgccaagtgaactgttggtttctccaggcaaacttgtctttgctgaacctgcccccaaggatgaagctgcaacgtggaaggagaagattgatcagctttttaaaagttcatcacagagttttagggtggttgtacatggatcaaaggtaaataacataataacttgttattgatgtggtctttcatgtgacacaatgtagttagtgaccaaagtcttaattacagcacagtgcagatcaatttgagaggttactaaaggaaatgtgtgctgatgaagatggtgacctccttatagagtctgctgtaaaaggcattccgaaggtttttgctgtatctactttagtcagtgtcatgcctgcccaaccatatatattccgaaattaccaggtttgttttcttaccatatatacagtctgtgcatgaccatgtcaatgcttgtgcttattagtcaggaaactgaagaagagtgcagattcacaagtttttttttctcttcttgaatattgggccatctgttaacctcataacatgttccagtacccacctggcactgtggaagtatcatcagtcatgacagaaagcccatcaattggctcagctggaacgcccgtttctggtgccccggtcggtattaaaccaattaacacggttggaactgctgtttctggtgcaccggttggtattaaacgtggtgctttcatgggtagctgcaagcatcgcatatgggaagccataagagcatcttctgcagctccatattatctggatgatttctctgatggtagatattcctaaacttagttgtggatattgttttgtgcaagaacagtaggcctctatttgtttgagtcctcaagatttgttatccaccgcagttcttatagccctttttttttcttcctttctcttcagacgtaaatcgttggcaggatggagctattgtagccaacaatcccacaatctttgcgataagagaggcacaacttttgtggcctgatacgagaatagattgtctagtttcaatagggtgtggttcagttccaactaaggtaatatacatcatagttgtcgactcttttgttaacactattattcattacaactattaagtatcagtggcagagacagaaatgcaaaaaaaaaaatggttgaatcgggccaatagtgttagttttttttctcaaaatttgctaaatctacaataaatttagtgtaaaatttggagccatggggggagtccaggcctctgcttgcctcctcctgtctccgcccctgttaagtgttgggcagccttccaagcaatgggcaatccatgtgctggaaaaccaattatttactgaattcctcacattttaaagaaatattgttttcccaattttgtaatacgttgaacacatgtacaatatgtcggtatattggaactgaaactttcataggttcaatatcgttccaggatagtaaattttagaggctaaaattttagtcaatttcatatattaaagtttttttttgttttgcaagtgacataatatgggaatgggatctattaattcgatacactacatataatctgtagcttatattagcctcatctgttggaaaccacaagtcaaggcatacattactagaagaaacacctgactgatccaagatgaataatttttgtttttagtttgaaaagttaacttctatggtacattaagtaatacacttccagtgatctcgttgtgagctatacatctatcacattgcttatatatataaatttattccatgtgttatgcatctagagtcggagaggtgggtggcgctacttggacacagggcaagttttaatagaaagttcatgctctgtagagagagttgaagaaactttggatacactgataccaatgctcccagaaatgcagtatttccgctttaatccaggtaatttgagttccaaggaaatccacagaacagcaactcgatcatagtgtactgtttaatgagttctagtacatatttaccaatgcactttgatattgaaagaatgggaatcttgttactgtggcagttgatgagcggtgtggtatggaactagatgagactgatcctgctgtctggcttaagttggaagctgcaactgatgagtacattcagaaaaactttcaagatttcaagaatgtttgtgagcttttagttccaagataccaagaggaagaaaagtcatctgaaactaccaaatcaatgttgttttcaagattcaagccatcaaattcaggtttgtcttctccaggtttgcactttgtgtaatgattcgaaggaacatttggttgattcatttttcaatcctctaattcaggttttagtgaaagtaatcctaccttaggatggaggcgtgtggttttacttgtagaggcttcatatagtcctgattttgggaagaaagtaaatcatgcccgctcgcttgaaacattctgctcccagaatggtatcaggcttactctaatgaacagtgcttctgggtttggaaaggcagctaccacacttccgactccaattacttctcccttatttactggcagttttccatctagttcacttctatatagtccagagggcacccaaagaattggccgaattgacctgtttccgccgcttagcctggatggcaacccaactgcaaagtcctcgccgccaacgtcacctcttaagtcatggcagccatctgtacatgttcaatcactatatgataagttgcaaaatatgcctcaagttggtgtgatacatatggcacttcaaaacgattcaactggctcaatattgaggtattttttatcacgatttcttttactgaaataagcgtcagtgtgtttacttttttctctagttttgattatgtgatgcaaaaattactaccgcagctggcagaatgatgtgtttgtagttgcggaaccaggggaacttgcagacaggtttctccagtgtgtgaaaactagcttgtcagccatgttgcatggatgtaagagaaagggtgcatattccttgtcaaagatttcatgtttgtctgagttggttgcagagtggccgtcgtttgaaattggtgggattcaccaccgctatatagggcgccaaacacaagtaggaactgttttccttctttatgtttccaagacaaatcattatgcatataataatctatcttgtcgcaggtaatggaagataatcaagaaatt

SEQ ID NO: 20077 - DNA, 3531 bp, Oryza sativa
  unsure (1)..(3531): unsure at all n locations
atatcatagaaaagagcatatttggtcaatgatcaatctggccagctattgaccaaaccaaaatctggccaatgatcaatgcctcacattactgaaaaaatttagtcaggaaccaaatgtcagacatactctaattgctgccaatgctgtagtaaagatgtgttatttacatctagtgatgctgaaatcgttagcatgcctttttctatttgcaatgtatctagagtttaggcactatctaatgttgattcattacatacatgtttcccaggttggagcatggagggagaggatcattgtatgcagtggtaagtatggccttgctcacggcctggtcaaagcattcatggattctggtgccaaagcagtcatctcgtcggccatggagcctccagattcccagtctatagtataccatgggatggaagtaaatggcagccttgagaacgggaagtttgtcattgccgatgatgaggcttccgagtctgaggcggaacctgttagccctacgagtgactgggaagacagcgacatggagaaaaatggcgatcgcagcaaagatttcgatgatgaggagtacatggctcagttcatctgcctcctgtatgacaagctgttccgcgagggcgtgacggtggacacggcgctccagcaagcgctccggtcacatccaaagttgaagtacaactgccatttacccaatgttttgtaggtaggagtacattcacagtccttatagaaatatataccaagatgaatatagaagaagaaaagaataatatgatctggcggattcatgagggggtttatagagtttatactcgtaatttcgttgttgaggctgtggtcgcagactgtttgtttcccccaagtgaatctttcggcgaaatgctgtttgtaattctaggctagtacatagaacatgtactgacggcaacatggacatagcagttaatctgagacaataaaggatgaagttttgcttgctgttgcagtaatgctttgcttgaagttcatgctattgcttgctgttaggatttggcatcttaacatgttattatgtgaacatcaaagcttccaattccaatagtatcatgcatccaaagcttcttcttactttcatattgaaacagtggaagatactacttgtaacaacaatttctacaaagcatagcctcacacagcgaagaaagtgaaagatacagatgaagctacttcctcttgaactgtaaacaacttgtgaatttcccggctaaactctaccaaacacaagaaaaacttggagaaacttgaaaaagaaaaaaataagaaaagataaatacgtagtatactagtatagccgaaacatatccaggcatcaaggtcgtcgtcgtcggcgaagcgatcgatcaggcggccaaggtggcggcgaagccgaggatgaactccctggtgtcgtcggcggcgcggtcgagcgccgtccggccgtcgacgtccttgacgtcgtacttggcgccggcgcggaggagctcctcgagcttgggcttgtcgccctcggaggcggcgagcatgaggaggatgtccaccgggtggatgtcctggttcagcagcgcctccatcttgtcgtaggtgccctccaccgccagcatccccatgtagttgaagtactacaagcgcagacagaaagattcagatacattcagaatctcatctcaggaatcaaagttactattctgaatctttcttgtcactagagctttccatgttcaggtgctgttcttcaatctgaatgtgctagtctacagctatcttgaattcttgattagcatattcagaatttcagataccctgcagctgcaatttgcattttgtccatgaaactacaaagactaaattgcgaggtgattggtgnttttttcttttcttctcttcctctttgctactgctggctatgatacgagccatccgtttgcttattcgcggaataagcgaagcacgcgaaacggaatatttgcaaataaaaagcaatctcgtcaatcaaaacttcgtatatgcatcattcttatgagatctaaaaagcaaatgctgaaacatatacttcaatgaaaaaacctctaaatcaactccaaatttaaaattcaaatgttggttgataagtataagcataaggaaaaagacatgccttaattcaactcaaatcaaatgctgcatcatttgtcctcaaaccaaactagcaagtatagcaatcaactacttcgtatgtctcacattaggatcagaattaccaatccaccaagttatatagcagtggtaaggtagcatctcagtcattcgtcagcacattccccatggactggagcaatcaaggaacacctaaggcaacatggggaggaggaagaacgagaagctggctcacctgctcgacgtcgtcgcggtcgaagtcgtccctgccctggctgccgtagatgccggcgccctcggcgtccttgttcccgaacttgaagaagcacgtcggccccaccctcccgctctcgctcgccggcaccaccgcgctcagccgcgacggccgcagccaccccagcctcgccgccgcccgcggcgacctcctcgccgccgccgccggccgacgccgacgacgccctcgcgctcagctggaaggtgcacgggatggatgccatggcttctcgcacgttggatggtggagtagcgagaggtggagaagaggggagagagatatatggagggaacggataagttgtaagtaatcttgaaactgtttggcacttggccacttgaaactgattgctgtcaagttaggtgattagatgcttcctaattctgaatcttttcactatttcactttttttcctgtggaagacaggacatgagatattcataaagtgcagtgtagaagatattaaaaaaaagtgtatgatttgtgataaatctgtgtgagataggagtacgtgctagagctgtgtgagatatactccatccctccgtaaaaaaaaaatccgtcaccaaaaaaacaacctaaaaggatgtgacatctcctaatataacaaatttggattaagtgctgtttagatttactgtattaggagggggtcacatccgttggttttttttgaacggaggaagtaaattgtatgagtgttgttaatttttttagaattttttttataaccatttgaatggtttttaagcttacgagaagacatcctcttgagaaatcaaaatagattcctaggataaaaagcagtagcattaagccaggttttaagcttggaattagctgtctaattaccatgtgaaatagacacccataaaaaatgtgaaaaaaagaaacggaaatgctacgcaccgggatccagttgggacgggatcctttgtcctccttgcctatccaaagagaagcgagagctgaacgcctgagccatgaggaggaggtggttgccgcttattggcgaggaccttcggcgcgggctggggaagaggacctgctctgcgagaagaggacgaggccccccgcgacgagccccttgtggtgag

SEQ ID NO: 20078 - DNA, 7874 bp, Oryza sativa
aatttcagtaaaagtaaggtgaaaaaaaagatggataaatttgatccgtgccatactgggacaacagcacactgcctcctgcatattcctggaaaaaggaatctgtgtgctccgctctcagctttgagcttttggcagctaccacctgcaaaacatatggcggcagctttgccatgtgaatcatattattgtttcattcggaagtgttttttctttccctttaggctgagtctgaatcagccttttgtgagttggccgctagtaggacttgttttccctaagatcctagggtgtgttcggacccaagggttcccagcacctctccatcgttttccgcgtgcacgctttttaaactgttaaacaatgtgttttttgcaaaaagtttctatacaaaaattgcttaaaaaatcatattgattcattttaaaaaaaaattagctaatttctaattaatcacgtgttaatggaccgctccgttttccgtgcgaagaagatttgttcccaacctcccccagcaaacacagccataaccatgttttctaagttgctcacagtatttttttctataaacttttttataaaaaaaatattttaaaaattttaaaaattattttttaaaaaatataatagttaatacttaattaattgtacgctaatagttttttctcgttaaacgtgccatggaaaagccagtctattaagctgctttgaactcactattagcttgcggcgttttgaccttcatttgggctaaagttgttatctcgttctctgtaagctcgttttcccgattaaatgatgtatttcgtccaaaaactttttatataaaaaattctttaaaaaatttaaataaatctattttattatatctcaggaatgaacggacagtatcttgccgggtatttgcttcttggcacttttccagaattgtgaaccagttggtagaataaccagtaggcttgtagaataataagccagctagaaacagttagaagttctaaaaaagctaggaacacagttaggtcctgtttgggaagcccaataaatccctgccaatatctcagtcccaagcccaaatcatttggcatgggtcttgaatatcctcaccattatttgattaatgattggtttttttacatatattatgattaatgattgcttaaccttcaaacagagaaagttcctgtttgctccaacaaaacacttcacacggttatcctgtcaagtagggctattaaactagctcatcatccagcatccaatcaaagatcttccctcttgtctccttcagatgatatgcaactgtgagggagttagtacagtgagtagtagtgatctcagatcttctgacattgcattcaatcatgaacagctcaaatctagcctcattttggatgcattgagcttggttatttcaaacatcaatcaacagtctagaaatccctacttccattccagacttcggatgcccctttcccatctcatctcccttattttccacacgtacgcttttcaaactgctaaacggtgcgttttttaaaaaaaaaaatttctatatgaaagttgtttaaaaaatcaaattaatccatttttttaacaaaatagctaatacttattaattacacgctaataaaccgctccgttttccgtgcggagggatccggttgggatccaggaatagcgaacacacccaacaagatttcctactttcccatcaagtttgtatttccaagatgacatacaccctccatgatgtaaaaccaaacagtgggtgtgtttctatctttcgctgaatcttataagccaatgagtcctttttttttccttcctaatacggtgaagtggtaaatcaccatgttagctaatcaattactaaaaattgcatccaattttgtagttcacttctgtctttctacagtacctcgacgtgacacgggaaaaaagtttcaagaatcgtttgtgcaagatctaccgttgattcgagatccagcaacgctcaacgcgccagtctataggctaaaaaacatggaaaaacgatcttgaactcatccaaatggttataatttttttaaaaaaaactaataagataaattaatatatgatatattacttcgtaaacatataattttgaattggcaaaacaaatttaattgtgagtagtagtagtatacgttaactagctagtgtttatgtttgcaatttgtggagatataattttaacatgcatgtttttagtgtaatatatcatatattaatctatcatattaccttgtttaaaaaaaataactatttggacggcataaaaaaacgaggagacattcactccaaaagttaaaatacgcaattacgggtacatcatacacatcaccacgaagaacttgcattgcgacgatggcaaaacgcttctcataaattaacttaatttggtcatacccatacacgagagaaaccagcaaaagaaaattttaataacaacaatataattactatagcaaacataatgcaattccgaattgcaattcgcgacacagctcgccgtcaggactgaagacgatctgattctgctcacgcgaacgtctccgacagcttggagaatcccagcctcctcagccggttgctcatcgggttcccgcacctgacgtccaccacctccacgccgccgacgccggggcgccccctcgccgccgccttcttcgccttgccgccgccgccgctccggtcgacgtccgccgcgagcatcggggagctggccggcgtggtactagagctcctcctgcacgccgccgtcttgcacgccgacgactcctcggcgctcacgcggtcagtgcgccgcccgctgccgccgccgctgctggtggtggagaggctggacgagctcttcctcagcgcggcgatcttcctcgggctggctccgcatggcaccgacaccggggtgctctgccgcctcagccgccgcggcgtcgtccccgcggctgtggcgtgcggcggcgcggccttgatggcctccagctccctcgtcatcagcgagccgatggtgccggtcgtgccgaccttcaccgcgcatgctgctgctgccgccgcctcgccattggcgagctcggccgcagcacaaggcatgatctggaaaaaaaagataatttatcacaactaaacaaacatatgctactgacaagaggaaaactaaagctacgagtgagaagtgcgttgcaagggtgaaaagaagttagggggaaaaacaaaaaaaaagttggtgacaagaagaacaaaaaatcatgatgttcttgagcatgcagagatggtggtatatgagaggtgcatcatggcatgcacttggccaccatgattgcagcttgggaaaactagagagtgtaaaaagataagactgcaatgagtcagacaccaccatggtaacatgggcatcaatctgtctgttcctaattcatgaagggaaaaatgatttttttaaaaaaaaaataattctaaccaatttgttcaaagaaacaactagtttggtcttctaattcaagaagtatgatatccacacaacaaatctaaccaatttgttctccaaattcaataattgtgatgtccacgcagtaaatccaaccaatatgttctcctcattcaaaaactatgatatccaaacaacaaacctgactactaaaaatctcctcattcaagaattgtgctgtttgttcaacaaattgtacatttttcttaggtgaacaaattcaacctttggtcctgttaagtctacttggttaaaaactttttatccataaatctaactaagaattggcagaaatccagtaacagaaggcaatggatgtcactctctggaggggttacagtatctaatcttctcataataatactacaatcaatgcaatgttgacatacaacactgggattaagaaatctcaacaagctgttctaaagttgtggtcgaattaacacaggagttaaggaaggcaatgtcgaaaacgatatgccgtctgcgtgatataaacgattttaaggacaatttgaccagcaattttaaggtgtggagatgcactatgctcaagcaaacctttcagccccttttcctgtcccttcctttctgccttaatttcctcaaattgcatctacacactactgatgccaactttctagaccacatattatgtaggccacattggcttgttcctctttttcttcttccgaaaaataaaaaaggtagtactaataataatgatttaccaccaacagcagcaagagataatcaaaatggaaggaagcatcaagcatcacttcaggggatgccaactgggcaaagtaaagaacctactctcttctgtccctgtttctttgcattttattaatgtaccctaatgttcttggattccttaggttactaatctaatgaataaaatcaattgcggcacaaaatcatgtgacagtgcctaccaaactccttatctaatacagggatggaagaaaacaagaactagaccacgcaattgtaacaaattttcattttcttgaaaagaggcaacaaatgagcagcattaaacaagagctcacatttccacttctgcatgtcggacaatatatggtttttggggtgcagatttaatgttctaaaccacaatctttcaggtcaaagcccagaagaagcatggacagagaacagaagctgacagtttgattaaaaaaaggcatacaagagcatccagaaaacataatgaactgctctctgttccatacagcagacaatttgggggaggagaaaaaacaaaaagaagaatagcagctgaaagcctgaaaccactatggattagccatcaagaactccacgcatggaatgaatttgtgggaaaatacatcaaccaaaaccaccctaagaaatggtaagaggaaataccaaaacaagaaccactgaatccccaattaatggagcttcaacaaacaactggtagtaatgaaccaatgattatgcagcaaatctccaatctctccagcaccagatggccagagcccagagagattacacagagcaagcaaaaaacatgaacagggttcataccagcaggcctgttcgatcttgaacttcttgaatctctgcactgcactccaccagagagacagagagagagagagagagagagagagagagagaggaggaggaggagaaaacaaaatggagatgaggacaggagactcaggactgaggaggagcagcctctgagccgaattgatgaaggggtgaggggagagtaggtcacattcaaatgacctgtttgtgtgccttgaagggtgcaacttatacacctctccccatttattgcctgccggctgcttcttcttctcttcgctctcttctctgtcattctgactcgaattccctgtctataggtgtttagtacacgttaaaattagaagtttggttgaaattagaatgacgtgacggagaagttgaaaatttatgtgtgtagaaaagttttgatgtgataaaaaaattggaagtttgaaactaaacttggccataaaaaaacaacttttaagtgtaaatttagactggacatgtataaaagttatttagtatatgtgctttatatatataagttatttgatatatgtatgaaagttacttttttctgggacgaagagaatagtgttaaatgtcatttgtgtgttgtgaacaaattattcttttttccatttggtattttctagtaaggcatttcaagaaaagaatagtatatttgtgaaggggttacatgcaaattgggctttcttggaattaaagaattcagtacttggaggtatttggggttttggacagatttcacctcggtgacataaaagattttttaaagctttccacatgcctgagttgaaatttcaggctaattatatgtccgtgtgtgttttgactatcacaacaacaaacatggcatatgcttactgtttcagctaagcagaaccaattctaaatactagtagcatcttgggatgttacttcattttataacttagtagtatcaatttttatttaggatgcggcgtatcaaaatacttgtcctttttttaaaaaaaatatttgccctttgagtaattcaagaatgaagatattgcagcaatttttttatttactaccccttaagtgtatgtagtgtaatagttgtttgtatggtatatcaattaataggtttatgtgtttgtgacatggaaaggacaatttattataattttcctatttcacaaaaaaaatgtttttcagctgtaatttaggagaaatcttcacataagaaccggattttttttaagaaaaaacacttaaaactctgacacatccagttaatgtggagatgggcacgtcatgaacgagctccaaacaggaaaattaaacagcctgtcggctgatatcaggtcatttgcaaatggatgtttttctctacgtatttgcgcaattgtgctgagcttgtcttcccaaaattcgatttccgagcaagactgcttattcaaatggatatgaaaaacttaaaaaggtctaaaagaaagagaactcgcttaaaagacaagaaagtttgattaaaaaaatatattagaaaggagctattgtggagagcgcagaaaggcgacagtcaaacacatgtatggagttgtggaccgcaacctgcgttttgcctctcaaatgggagatgttcatgattgctttgatactcatttattcaaaaaataaagattgatttcatgttctaattttaatcatcttgacttttcgtgataaaaatatttgacatttatagataagatttgatgaaaattttgattatcaatattttgttaaatggtcaacatttatagataagtttaagggcatgttcagtttgatgcataaccagaatttagcaaagtctgggaaatgccaaaaaaatggtaaggtagagatatgtggttgttgtttgatttggtacttagcaattatttcgtgtgaagctatatgaaaaagatttggtatagtattattttagatatgtgtttggattactagctacctaatggaatttttttaaactgcctaatggaaattcaacagtaccaaaacttgttaagattagaaatagtagtaaagtgaacaagtccttttttttcccagagggagctgcagtgaaatgttgcacgctacttcattatcaagccggcatgagcaaattaaagatataaatcaagcgccattaattacgatcaaatcatcggcaaatcaattttgaaaaattctggttagtactagtttaatcagtgcaccgtacgcgtgttctgaattttgatcggcttgaaatgatagttgcttggacatgcaaggacttaaactaattaagcaagattatatcagacagcgtacgttctgtttacaattcgtagtttaccgtaactacggcaccatcactttcccatccgttaattggtgtttgccctgcacgttgattaattgttttgatacgctctctaatgcaagtcaacgatggcctcatgttacctgctttaatttgttaataataattagattggtgttaatgagattggtccttgtagtagttgtgactgattagtgctgcctgctggaattggacgtacgtacgtggtacgtgccacctgcagggcaatttatatgtttggaaatggtgagtacctgatctcgttgtctgtttctgaagtagtagcccacgatggttagttaatttggctgagtcgttcaaaatgagtttggttttttaactcccttatttaccataagcacaagcacgtacgcttcctaaattattaaacgatattttttaaaaaaaatttaaaaaaaattaaataaattagtttttaagtttgtatta

SEQ ID NO: 20079 - DNA, 10710 bp, Oryza sativa
caaatcatggtgcaattaggcttaaaagattcgtctcgcaatttacacgcaatctgtgtaattatttttttctacatttaatactccatacatgtattcaaacattcgatgtaatagcgtgaaaaattttgtttggaaactaaacatgcccttaaaatacatactctctccgtcccataatataagggattttgagtttttttttattgtttgaccactcgtcttattaaaaaaattgtgcaaatataaaaaacgaaaagttgtgcttaaagtactttggataataaagtaagtcacacaaaaaataaataataattctaaatttttttgaataagatgagtggtcaaacagtgcaagcaaaaactcaaaatcccttatatcatgggacggagggagtattttaccttgatttttcttagcacgttttttatactgtttcgtgtcagaacttctatataaaagttgctttaaaatataaaataaatacatattcacgtttataataattaaaacttaattaattacatgctaatggttttctcgttctacaatatttaattgactttaattgaacgaagaagtcattcaattgacttaattgtttagtgggtaagaggtatatatacaacataattaattgttagtggataaaggccaaggggcatagaactatagatacaacataactaattcctgctttaattgacttaattaatttaatttaattgctaatgactttaattgaacggatctagtagttgaagcccgatgctttaatgtgggatgcatagagttaagtataaaaataacacatgcatataagttaaaaatactgtgaaaatgaagtggggatggtgatgatttgaaatattttctaatgaataatgacgtgacatatctatatgctgtaatactttctaaaaaaaatatttagcgttagttaactcaaaattaaactaatcaacacctaatatttcggaaaaggagatagcaaattaattgttagtgggcaaggggtatacaactatacatacaacacttacactaccataacatcgcgcattagcaggacaaagctgtatcgcatccatatatatgatccaaataaagcagggaaatccaaccgagccgtgctcgaagttaattaaaccgtcgcatcgagcaggtgatggaccgccgcggcagaggccgggacggggcccgggcacgtatactacatgggtacgtataggccattatcgtcccaaccaccgctacagggcaagcagagaccgacgcacgcatcatgcgtcgtcctacttactctacgtacttcctatagtaaagaaagtcatttagcacagcgatacggtctctaaaatacaattttgactttttgtttctataaaaatatttattgaaaagtgatatatgtatatctttatgaaattatttttcaagacaaatctattgacataagttttacatttttcaaattcaacaacttgagagttatttatgatttatattcttaaggtttgacttaaacattgtcctaaacgacttcttttacgagtacgaagatagtacacccttcctttaaatactttgtcctacttactctctaataattattttcacctattttttaatatcaatatttctttatatcaaaatataaatcacaaccattttttcaatatttaatacaagatactcatgcatgactgcaaataaatagcaccttcgtcttctccttagcttaccttttaaatacttccaccctcgaagtctcccgtcgtactgggtgcatacatatgaatacctagtcacgatttggaatttcgagcctaaaaataattgagattgagggagtgtttgattgggactaaaattttttagtctctgtcccatcggatgtttgacactaattagaagtattaaacgtaaactaatgataaaacccattccataaccctggattaattcgtgagacgagtctatttagcctagttaatccataattagcctatgtgatgctacagtaaacatgtgctaattatggactaattaggcttaaaaaattgtctcgtgaattagctcttatttatgtaattagttttgtaagtagtctatgtttaatactccaaattagtgttcaaacatccgatgtgatagggactaaagtttagtccctggatccaaacacaccttgagggcccctttgatttaaaggaaaaatataggaattttagaggatttcaatcctataggaaaatttcctatgaagccctttgaaacaaaggagtgaatcatatccaatcctttgaaattcctatggaatggacaatcctatagagattttggaggaaatttagcaagagcttcaacctcttgctaactttcctttgagtctatctctctcatctaattcctgtttttttttctgtggttcaatcaaacggtcattcctatgtttttcctgcgttttgcaatcctctgttttatacttacattcctatcaaaatcctacgttttttctattcctacgttttctcaatcttgcgattcaaaggggccctgaatggttttacgagagaagagataagagataatttgatccatatgtgtatcattcaaaggctagaaataattagggtgatgtggctcaatgagagaagagataaataacattaactacacttagtactaatgaactatataagtatataggattggattggtccaaacgagaagatgataataattctttattgatacctgtgttagtaatagttatggcttgtatattgggatggagagagtacctctttccatatgaaaggggtaaaaatttgtatttggatatgctacatgacactttcattattgaacatcggatggattgatttattgtatccaatgcaaataaaatacaaatttatccatgagacatgtttcttttttaacttgatcaggtctagttccaactagatttagaccaggggagtaagaatggttcaaatcagacctaatctccttacaagccgatggagcacacaagcaaaatggtactttccacgttatttctctcttcgtttataccaaatatcataagataacgtgtaaagtgtccagcagctaattacaatattttctgtatcattcatcgaatacgcgtttttaaatatcatgtagtaaatatcataaactttgagtatcttatagtaaattttgtaaaaaaaaaaacttatatagttgttggctagcggttgctcgtgtcgtctccttcctatcgtcgttgatgatgggctttgggcgccgcgttcctttcgcccgcccgtcgtccggccggtgcggtccggtccccgcgcgtggcgtcgtcgcgcgcgtaaatgctcgcagctcgcaagagctaaggcgaacacgcgtgctttgctcgagctcgtcgatactcgataggcgaggcgaccactgtgcgtgtgcgtgcccacctgcgttgcgccatagtacttgtattttccgcatgcgtccgtccacggtccatccacgtatggcctggccggcgcggctagctaccagctgcagctctcatgctcacacacgcatttccgattgggcctagcctctccattcatcaggtcaggatatgagcatttaagcacagctgttctaattagcctacggtcattgtaaatcatcttattatgtagtcccctatttcacaatgtaagtcattctagcattttccacatttatattaatgttaatgaatctaaacatatatatctatctagattcaataacatcaatatgtatgtgagaaatattagaatgacattctgaaacagaagaagtaacacgatggtaaaagtacgagacaaagggatatggtctatacatcaacaagccgatcgcctggtttctttcagtctacctacacctcaatctacatttttacggctaagattattttgagattcgtccaacaatcgtgtcctgataccctcttctctcttcccccgatctccaatcacactatcgccactcgcccatgagtcggcaacgcacggatgcgatttgtctatcctcctcaccaccttctacacgctagtgccatcaccacgagccccatcaactgttacctccctactcctctccatgcctccatagtcacatatcttcatcaactccaacgactttctcccaccctggttctcatctcttgtgtctgacggctcgcgtcactaaatccattggcatccctttcccttgccaccaacccctttatcttgtactccctccgtttcacaacgtaaattatttaagcatttcccacattcgtattgatgttaatgaatctagacatatatatctatctagatttattaacaacaatatgaatatagaaaatgttagaatgacttacattgtgtaacagaggaagtaactccgatggtgccatcacgttgcctcattgcccgccctgcatcttcatgtccactatccgccgccgtgctctagttctttgccacccaaaccattaccctaaagcggccattgttgcccccttgctcactcccatcaccaccaaccctaacaccaagatttcgcaagctagagtttagaaatcattgatattgagggcttgccaagaagaaagttagcgtgcaattaattgctaagccctcaccatcctcctccctctctcacgtctagctagaggctaaagacgttgcccaataataaaatctcagtcgactgatagtaaagacggtactacaagtaattaatgattggtcttaaatacctacggactatattattcattgtacctccttctttgcctctaagggtgtgtttagttcacgctaaaattggaagtttaattgaaattggaatgatgtgacggaaaagttggaaatttatgtgtgtagaaaagttttgatgtgatggaaaagttgaaagtttgaagaaaaaatttagaactaaactcggcctaaatcttgtgaattatatctattcagctagggcggagacatgggtaggacaactaggggcacataaccgtactccaaagtctggatgaccatgtcaatacattttaaaaatattacactactggaaaaaaaaacatttttactggaggccaaaacatatttttcaagcgtccataaccttcgcctgcaaccaaacacctgcaaaaattgattttcgcaggtggccaaatccaccctcatgcaaaaatatttttaacgtaaaaaaaaaaattggctgccatccagccctacccgccgccgccttcccttcggcgaccgccaccacgagctgtgccaccacaagggttttgggagagagggaggggaggggagctgcgccccacaagctcaccgcgccagcccgccgccaccgccgaggggatgagaggggaggggaggaaaggggagggaagtcaccgtccggatctgggagtgggagcgctgccgccgaccttcggcctccgcctcctcgccgcttcagccaccgccctccccatgatgccgccagatccgcgaggggaggggagcgccgccgacgaccgccggcctccgctgctgcatgcagccgccgtcgccgtcctcccccacgatgcttctggatccgggatgggagggccgccagccggatctggaaggtgggagcgccgccgctgacctccgtcctcctccgccaccgacctccctcctccgtcgtccgccccgcgccgccggccaccaccggcctcccccctcccccctttggcaggatctgggagggaggggaggcgagccacaccgggggtgcaccgtccccgcctcgccatcgcggatcccaccgcccacatgcgttgccgtcgccggttcccgccgcccccgccgctaaacgcccgtgaggagaggagaggaaaggaggagaggtgaggccggctaagggagaggagagtgaggacttagaaaaaatctaagtgatgagtggtccatttatactccacacctattttcgcaggcagaccacataaaaggtccgcctgcaaaaataaatggtatttttgcaggcggaccgcttaagggtccgcttgcaaaaatagatttcgtaggcagacaacgagcttcaccccagtttatatttttgaggcggtcattttactccgagggtcatgttcgcctgtgaaaataaaaccctcacgtctgtgaaaatgctttttctagttgtgttaaaaagaagagcacagcacgaaaatatgtaaaccacactaaactcatccctaggctcgaaaataaaatcggttgtgcccctgcgtcggagaggttcgtttggtcccaaatcaagtggccatggacagacgaccaattgttacttaactcgctagctactagtccgtcaatgggtctcgtgatgatgattgaccatagatgcacatccatgtagccatgtgtgacattctggttcaattagcatatgacatttgttgcttatagatgttatgtgtgtatgtttaataacacaatgctaattcagtaaggatggaatcaacttatataagtggttgtctctctagcactatatctctggggttaaccctttaatctaaagtgaaaatataagtgtaaatggggtattatatgtgtaagtgggggtgcctgtcaaatagagtggagtgcgcaattttggaggcttgggtgttacaccacgcgagtgacttaatttcgctcgcctttgctcttgtttctgtatgcacatttggaccggaatcgccggatgcatacttgcaatgcacacacggacacacctacgcgtacagacacaacaaactctcgcacatcatgtatatacgcgttctcgattatctgtttcttatacactgtagagcaaacaaacttcccccaagctgtatatgggacaattcatgcgaaactagtgtatatagacgcgcattcgcgcaacattaaccccctctatattgagctcctttacatgtttttaggattcatttgttctttttcttcaaataatcaaattgtaattaaatcattagagtatatttataaattaaatagtttttattaaatgacttgagtgttcatttacaatattacttattgttcgtgaagtgagcatagcttaatcgttaggttctagaacctacactcatattcaagttctagtactaagatttagtactgatactcgtatttatggccaattattctttcagcgatagtggatgtacccatttgcattgtgtttcttaaataaaatcttatttattgattaatactattattaataaatacatggactccaacataacatgtgcagtggctaataaattgtacataattaaaaaaatattgggaacatattgaatttatcatcttatatataatttttttgaatgttttagagaataaaatcattaggaggtctacttagaatgtaaaaatatttattttattctgatatgtaatgaatgaactatattagcacgacaacaaacttttattgcaattttatccaaaccttatattaatatgtaaaacgaagtttacataattttattaatatttgttatcatctttgtcgtagcataagtcgttgccttctcgccatctatgctacagcattacccttatccttcacttatttttcattagtgcacaagtattatagcatgtatacatttattttttgcgggtttattatgtatatttatatttgaatcgtacaaacctaatgattcattatgaaagatctggcatttagctgcctgtttgtaatagtaataatttttcgtttgatataaccaagtctctgccgtgtatttttccctccttttatttgctctttattatgtcccatgtgtgaggaagccagggaggttctggtgttgtattggtatgctggaaagctcgagagaacgccctatcactatcaggttcctttactgatatgatcctacggctctctttaattttttcatcatcggatggcctgggatttttggcttacgtggacgtatcaggtgatccttttggatttagtaacattttaaccttcacttatagagatttccaccttagatctaactactttctacattcggttttctttttaactctttttttaggtggacaaccatagccaacagctatcttgtcaagcagccattaatcctctcctacttgtgcagttgtgcgtgctgtgcctgcctgaaacatgtcgattacggcccaattaagatattgttagctatctgggctttcgagctggaataacgaactacgtgggcttcagtttgccctcttgctcgacagcacgtataaagcccaaattaaaaaaaaaaagagagtacctatacatctttcgaaagatttttatgatcgtatcacacagatttttaatctttggattaaaatctgatagatataataaaaagcaaaaagcaattaagaaacatcataatggacactaaattaccatatcctcaagaaaaagaccaaatccaatacaaaatttaaaatttacatgcgaagattcaaaaattacagtgtaacttacaaaagttacagtgtaagtttcataaattacactgtaacttacaagaaaatgcactgtaaatttgagtgagaaaatcgagtgagagataaaaaaaatctttcgattgagatatagcaaaatcgaaaaaaaaatactacggcccataatgtgtcgtttgatattcttgattaaatctactcttttgatatgctcaattagtactactacagtattactataaaacctgcatgctaataactttctagcatccctgcaaaatattaattctagcagacaacactcaatgcatgtctgacagtgtagcacgcagggagattacaagattagtccctgcatgatgccaaaggtgatcatcatacgtcttcattggcaacaacaaatagggacgtgctaaccacctatttctatggcgtttctttgtttttttgtttcagttgcagcgcaagctgtttttgatgtgtcctctgaacctacctcaccaaccatggtgatcatcttctccaaagctgcagcagcagagcagagaacattcatgccatgttgaactgtaaatttactcttgggaattagttgcagactgcaaacaaatttgcatcacaaaagagtcgggtcgggtgttgattcgccattgctattagtcattctactcgtgcctactgcttactttctcgatcgatggaatcggtgattcatttggttgggcgttgttagtacaaaattgaattaacgaatatcaaatcaaataatgaaaatggagggagtaactagtggtagtaatttattcgaatgtatggaagatgcacacataattgcgagtggcccttttactcgtatcttagtgggttaattactcacaaaacaacaagtctattacattatccatccctgatttcttcgtaaaaatagaaaaaaaaatctgtccttggttggattgttgctgctacatgcatgcatggtcctttgacaacttgtcatatgacagatgcagagtcttactccaagcagatgaaaatggaatgaactcctcaacataaaattgacaactttcaaatcagcccagagagatcagatatcgtcaaacggatagaatcatagaagtgcattttacctaaaaaagttgatgttttccacctttttttcttttcaatattagtatgattgtactggtactggctgtttgcttggagtttggacttgcatttgtacaattaaattccaccggcaacttacaaaggacagaagaaacctcgaccgacacccagagaaatgaacaaattcatgggcccaacataattattctaaagttcgtggatacttagcttctcatcgtctgattattaatttatcagtatcaaccaaaaaaaataaatttagaggttattttgaggtttcatcgtaatttatttttcagcactataacttttaaaacactaagctttgttataaattattttttattttgcttcgctcctagagcaaccagcttattggcagataagtcacgaatttggaaattattcaaaaattttagacgataaaaaaccgcaaacatggtgtttctgggagtaaacagcatggtgttttgctccgtacttctccacttgtcagtgagtacttccttcagttccaaattcttgatgtcttgaaaaaaaaatcaacaagtacactacactgtctcactgacaggtgtgcccaggaggacactctaattaaacagcaccaaatcatttgaacggccatttatttttccagctcgctatagtacactcctataaacccaggtaacccagctactaatccctgacaaggtggccccactctctaccacctcagtgggccctcactcctctaccctcctcctcatcgtctcgactccaacgaatcttgagccctttcgccctctctctctctctcgcctccgccctcctcgcctttctcccccacctccacctcctccgctcccgaggcgagatctcgccgccgccgccattccccaatccggcccaaaacccccaccccccaaacccttcgatcgatccgagggaggagccaatcccgcgctcgaattctttcgccccaatcagccgctggatgcgtcgagctcgaggcggcggaattcaaatctgagctcgccgttggcgcggatcccacgg

SEQ ID NO: 20080 - DNA, 4038 bp, Oryza sativa
  unsure (1)..(4038): unsure at all n locations
cctcctcgcacgctctgcgcggcgcaccccgacgccgccgcgccctacctgcagaaggtgatggcgcacctcgcgcggaggctcaaggacaccaactcggactcctccgtgcgcgacgcgtgccgcgatgccgccggccagctctcggaggtgtacctccgacccctggcggcctcggctgccgctgaagcgggcaatgcgactgtcacactgttcgtgaagccactgtttgaggcgatgggggagcagagcaaggcagtgcagggtggggcggcggcctgcctggcaaagacggtggagggcgcggggcctggacctggcgtggtagggatgtttgggaagattggtccgagggtttgcaaattgcttggtggacagggagtacaggctaaaggggcacttctcaccatcatcgggagcttgtctcaggttgggattgcgcgatatttttctttatgcatgcaatatgttcgatgaattgacttgacagatgccaggtggtagaaatttgtggtagacattactaaattgattatttttcatggacatttagttttctgtctgaatatgggaaatgttatcataaattgtggccaaggggtaggaattgtttttgtgataagtgatgtttggtgctgccgctgcggtcgaatgtagttcatcatgtaatcagttttggatgttgcctatatgtcttgctgacaactatatggttggaaattgttcgtgttgtgaagaatggtgagttatcattgagacaagggtttgatattttcaatcattattacaatgtgccattttgttttgcacctctgaatttatggatggttaggacttaggagtttagtatttgatatcctaccattgggtacataagactgttgttacttttgtgtggtgtttggccccatgaacaatggatagtaccacagcattgtgatttaatgtttagataagcgaataattaaccttttgctttgcctctggtagccttttattctttttagtacttcagttgaaacattgaactgaaacatacattgatgctctaagcgaatgtgtctcctaacacatgctttgaatggtactattgggaatactgtgccaagcattactgtgcgatacatatcttataaatctctgcaatgacataacatcagattcactagctctccttgtttgaataattgttgatatatttcttgtcaggttggagcaatcagtcctcagaatatgcctcaaacattgcaaagcattcgtgactgtctcgagaacagtgattgggctactagaaaagctgcagctgatacattgtgtgtcctggccacatattcaggccgattgataggtgatggaacagctccaacaatagctgctcttgaagcttgtcgcttcgataaggtaactaaaactttaactcactcaacccaaactgaaggatctgttgctcttccatggatccttttcagatgatgacaagtcattgttacatgcattatgttgcattaagttgttcttgtcaatccttttcaggtaaaacctgtcagagatagcatggctgatgcagtgcagctatggaaaaaaatggcaggagatgattcgaacggtatcaatttgttttttagtttaaaagtgcatgatgttatttaggattttattactctatgcttattgcaacataatttcattcaacagatggtaaaaataaggaatcagctgataatgaagggaaaatggattcacctaataacaatgacaaagtgaagggcagtagcatggctgaaaaagcagcagttctcttaaagaaaagacctacattaaccgatagggaattgaaccctgaattttttcaaaagctcgagacaagaatcacagatgaattagctgttgaggtggttgtaccccgcaaaactttacaatctcatttacaaagtgaagaggaaccagaagatgcagatggcgatcctgttggtccagctaacagcaatggatcagcagatgatgaagcaaatttgactcaactgcgttctagctctaattttcaaaatattcgagatagatgggctggccagagaggaagtagaaacaaagatgcaaaggttagggcatctgatgttgaagataggaatgaatctagtgcaaaagattctgcttcagcagcaatgaatgttcctggagaagggccttccttaaataataaaacaaactggttggcgatacagaggcagttgtcccacttggatagacagcagactagtctaatgaacatgctgcaggttagtgccatgtttatttattcccgtgaagaaattgttggaatttcttttttttgtttttctgttaagaaataattcttgaggagaaatgtccaggatatcacactttttttatgtcctaattggtaacatcagttttttttcttcttctgaatatgtaactatctgctaatgagatttgtcactgcttgctatgctttctgagattatattgtcatgtgttatgtttgtcttagtgatgtgctgctaggcatcttttggtgtcagcaatttcatgttgtcttctaaaagaaagtagtgctacgatattacacagtagcccaaataaagtgagcttacattatttagaacaaaacattatgttggctttagaagggatgttagtaggtagtagctttgatgtctatgtaatgttgtacattgctaaagtctacaaaaaagtactttattgatggtttatcaccgtttcttagtttgggtttgaaacagaaaatttcctgctttgttttgttgtacatgaaccttttttccagtaattcacaaatgtgatccgttgtgatgtactgatgtatgccatctctgaggacatggtttttagttaattgggtgtctgtgggctaactacctaatatcacttctttttttaatacaattttcaggatttcatgggaggatctcatgacagtatggttactttagagaaccgagtgcgtggtcttgagagagttgttgaggaaatggccagggatatatcactatcatcaggcaggagaggtggtggccccatgctgggctttgattcatctcctggtagatcatctatgaaatacaatggttttcatgaatattctaattcaaaatttgggagggatcgtgatggacgggtgggatttgcagaaaggtacttttctggagatggtatgtcttctggtgtaagaagctctgaaccatgggactcgtatgcttattctggatcaagaagtggtatgaatgccaggagagggttggactctgtttcatctgataacagggtgcctagaaatgaacgaagcaatgatcaagcaggacctaggcgaggatgggacaaaggacagggtccatttaggtttggggagggtccttctgctcgaagtgcatggcgagcctccaaagatgaagcgacactggaagctattagggttgctggtgaagataatggaacttctagggcagctgcgagagttgctatccgtgaattggatggggaaactttgaatgatgataatcaaggggatgaaagaggaccaatttgggagtcttggactcgtgcaatggatgcgatacatgttggtgatatggattcggcttatgctgaggttctttcaactggggatgctgaattacttgtaaaattaatggagcaaactggaccagtagttgatcaactttcaaatgaagttgcaaacgaagtcctacatgctgttggacaatttcttgtggaagannnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20081 - DNA, 651 bp, Oryza sativa
tagcttatctgggcaatgatcaatctggccagctattgaccaaaccaaacactggccaatggtcaattagttagcttaccaatgccattaatttgagcaattgtgcctgagctagcatgcaagtgacgtaggttgattaagaaattcatgtctccaggtaatttaccaaatgtacagcctctcaagccaagaacctgaaggtggcacaagctgcatactgaattaggcagtttcgcgatcccagtaaacgagaggtctaaatatctgaggtgtttcgttgagctaataacatttgaaagagcggacgtccgtcccagccatttgtaactccttgaagagaaggccagtaagcgtaggcttttggaattacacaaaaaattactaagagggagatgagtttcattattgctgggttgatgactgccgtcaagcaacataaaagtgcgcaattgttcagttttaaatttatctggtagtgtatctagggcatccatgtcaactgataaatagcggacatcctgtgaaacacctctcaccttattatcgttaccatggtattcatcagaagaaaaagcacttgcaaaatcccagaccaaatcatgcataatgtattcagttttccttgctgatggctgaagaaaggccctattg

SEQ ID NO: 20082 - DNA, 1064 bp, Oryza sativa
  unsure (1)..(1064): unsure at all n locations
caaagcacttccctagttagatgtaggttagacttcccgttcgagaaactctaccttctacctgccctcaatttatgcacgattaatgaatgccacctgggtggaagcgagaggtggaaatggaaggtcttattcggaggtgggatctctacctgatagttgcattgccattcatgatgatcccctggcattcgtccattcagccattcaccattcacccattcaactggaattttggttgaatgccggaattgtgtccacaaattgtggatggatagttggttggctggctggatggctggctggatggctggctggatggatggtgaatggctggcggcggttcggttgctttgaagcatttgttgctatctaaattccatttaaggtcgtacctttatcgccagcatcatcttattctctatttgtattccccccatctttcagatacagatgtaaccttggatgtgcccgtgcccaatgaagaggaagagcgcaacatgaaacgtaagacaaaaagtccggacacccacccagatcccaatagaatcccgcaaatcctgcggganattgtaatcccattcaccagctcctacatttaattaacaagagaactattgtatttatctaacacctggattatctccacctttcattgggggaaatttcccccccctattttataagattacgctgcgttgctacagggccgcacctcctatttcctcaagggtgaggaaatgaagtccatgtacaccacctacaatccgcagaatgtggtggccaccgcccgtttcctgttccacaagaagaatctatactactccttctacacctcatcgcgaatcggtcgtccgcgtgccattcaattcgttgatgatgcgggtgtaatcctggaggagcatcaactggagaccaccttggcgggcactctcagtgtctatcagaatgccacgggcaagatatgcggtgtctggcgacgagttccacgtgattacaagcgcatcctgcgcgacgatcgtctccatgttgtcctcctatggggcaacaaacagcaggccgag

SEQ ID NO: 20083 - DNA, 694 bp, Oryza sativa
tcaatctactatctcatctccctttctctgcttttcccatcttctctgctcgtcgccaccacggggcgacggccgacttggcagccgcgtcctcgccctcccacgttccactcgtatcccattagatcacttcccggagctcgtgacaacttggtatcagagactatggttcaaggcgactcttccgccgtcgccaaactccaggacaccatgtctgatgttctatccgggctctcgctcttggcttccaaaagcgatctcgtggacctacgtcgctcggtggccgtcgtcacttcacgcctaacatccctggaacaacaccatggattgtcagctccaccgaacaattcatcggcgccacgcctcggtggcaccggcatcctgccgaacccatctcagttgccgtccggcgctgacaccgcgacagaacacagctccgacagtggcaacaatggtggtggcgttccacgctactacaagctggagttcccaaagttcgacagcaaggaagatcctctgaattggctcaatcactgtgagcaattctttcatggccaacgcacggatgctggcgatcgcgtgtggctcgcgacataccacctcaccggcaatgcgcaagaatggtacttccaccatgaacaacacaaggggccaccagattgggacaccttcaatgatctctgctacgcccagt

SEQ ID NO: 20084 - DNA, 1583 bp, Oryza sativa
ggaggaggtcgccgggtgagcgttggtcgaggaagcggcgaggagcgccatggcggtgccggctggccggtggccttttgtgagctcgtcgaggaggagctgtgcatgggccttggcgaaaggtggggaacgggacttgcagcggcaggagggagggaaggttgtcgaacttgtcgttgaggctgccaatgagcatgaggacgagggagcggtccttgatggactcgccgacgtcggcaaggttgtcagtgaggaccttgagccggcggcagtagtcacctatggagagatcaccttgctggagatgatggacctcagcggtgaggttgacagcgcgccgctcgccattgtcgaggaagtgcagctcgagatcacgccaaactgagcgggtggtcgtggtgggagagatgacttcctgcatgagagtggcagagattgaaccgtaaagccatccgagaacgacgcaatccatctgcgtccagtcggcttggttgaggcgaggaacatcggagaagacatgctcggtgagagcaaacttgccgagcgccacaacgaagagaccacgcctatgggagcagttgtcggtgtcgaggttgagggtgacggggacgagcgccttcacgttgaggacggcgatggcttgattgtgaagcgtggcgatggcgtcggtgtcgatagtcagcggtggcacgacggcgtcctatgacggggcggccagcgtgatgttgaaggcaaggcgagcaagggccgccagaacttcagggggaaggagcgccacgggcgtcgtcgggggcgcgaacgtcagcggaggcgcggtcctcgtcggcggaggtgcggttgtcactggagccagcggaggaaccgtggaggagacggcgtcgttggtggctggggtgtcgtaggctcttcggaccttccattataattgagagatgaaatgaataattcaagtcattaaacaagcataatgaaatatcctacgcctcgagagaggaatattggagacattactggtcctttagcctgccagtcaacttcagcctgagatgtgcccgtcaaaccactcgaaggcggtgaccagatgtgttacacattcaggagacttgacaaaaatggctaaagatctacaacatctcaaatattcttaactcatactcatgtgaatctagttcccaggatgtgcactagattcacactttcatctcaagcatgattatacatagcaaacacaataagatgaaagcgattataaactacatctactttagttacattggccgaccggccaaataaataatagaacagcggaagcttgtctacccaatccacaagcacaccgactaggggtttacaccattaagttcaagtcctacaagaagcagtcgattacctgcatcactcaaagactaagtctaaatcctgcaagcaaaagttaattcaacagcaagagtcagtatattattagaaataatgtactggcaagcaccaagacaagcctaacaccctacttgcaaggcatataatcaaggaaggcatagtatggttctttttagcataagcaagttttatttgcataaacacat

SEQ ID NO: 20085 - DNA, 383 bp, Oryza sativa
agacgacttgaaatggcgtcatcttaagcgaggattggaacaccgtattgaagcaaaattccgcccacggcaaccaccgaagccactggtgtggccgatctcctgtgagacaccggagatacatcccgacgacacggttggctgattccgactggccgttactctgcggatggaacgccgagctgaggttgagcttcaacccggataggccaaagagctccttccagaacatgctcgtgaacaccgggtcgcggtcactgacgatggagctgggaatgccgtggagacgtaccacttcgccgaagaatgccctgagccaccgaggtcgccgtgtacgggtggtccaatgggatgaagtgcgcatacttggagaatcgatcaat

SEQ ID NO: 20086 - DNA, 2135 bp, Oryza sativa
  unsure (1)..(2135): unsure at all n locations
tagcttccgcatttccccctctaggcgacatcaaggtcctttgaataagaatcaaaacctaaaccacgattgtgtgtgctaacgttagattgatcaagaatcatgtgaggctctttttaccatcagaaaatctttgcaaagaacttttaaataacaaacctgctgagtaagaatagcacaatttttacaagcatccaaaagacctttttgttttctacaagttgagcatgaaaacacctcatcttgtttaataatttcttccatgtgtttaacacgctctaaagcatctttcaacttcaactcattcaaaacacactttgagcaatcttgagaaatcaaaacaccattgttttgttttgccttatttgcacatgtagcattgaccaaagaatntgacaaaaagcatctttgtattttttcaaaacgttctttgtcaaaatctactcatcaacaacacgagcatgtaaagcaaatccaagagcaaaagaagactccaactttttagatttttcaatctcaaattctaatttcttggaattaacagaattgacatctcgcaaagcattaatttcagaaaataaaacttcacaagattgacaattatcatcattaggaatcaaagattttaatctagcaatttcagcattaagaatctcaatagtatgatccttctcatcaagcacaatagaacatgtttgaagtttcttagcaaatttataagcagcatattctaattgatcataactaagcttttcttcattatcatcattagattcatcaacatcagaacttgcattacgagcaataaaagctagatcaacttgcttacctttgctctcatcttcatcttccgattcatcaaaagcttttataatttcttggattaaccactgaatacaatgcttcttcttctccttctccttcatgttcttcttcttattcacgtcatcatctttgactctaccatcatcttccttctttcctctcccaagcttaggacaatgcgagcgaagatgatcaagtgctccacactcaaaacaacgattcggttctcctcttttcctgttcctaacatttttcatagctcgagaaaatttgttagataacaaaaccaagtcctcctcctcgaactgtttgagttgatcatcggacatggcattaaataaagcaagaacagaagacttcgatgaagaagcaccaacatccaaagaagttgaagaaaaaaccaaagcactagacttagaatcaactttacgagtaagaatattcatctcatgagttttcaattttgtgtaaagcgaatccaaggtcaaagtagacatgttaacagactcctgaatagatgtaactttcatctcccaaatagacatgtcaagaccattcaaaaagtgacgagaaatctcagattgtggataattagcatcataagaagaatcaacagatctaagatcactcaaaattttattaaaccgagaaagatagtcatccaaagcttctctaggtttcatctcaaatttaatatactcctttttgaaaagatcacgacgaagttcgttaatattatttgttccttgatgaaaattactcaaagcaatccaaatctcatgagcagtttgaagatgagcaacacgatcataattcgaacgagaaatcccactcaaaagaatattgcgagctttgctattttgttcaaaagcagttttttcaacagcagtattaatagcttcaggactcacataaggatgagaaacttttttccaaatatcataatcttcagccataatataagattgcatcctactacaccaatgagaaaaatcggttccattgaaaacatgaggcttagttgaaaacctagcgggagtagccatggcaaaaactctagatcgataaaaatccaaaaaagaaaacaaggctctgataccacttgtaggatcgaatcacaagaactaagccaaccagaggggggtgaatggttgatatacccaaaaaccaaaacttatagcggaaataaaagttaccctcaaattcgatggattgcggtctaaccgaaggtgttgcgctggtcgaaccgcctgatgaacgtcggtctgaccgagatcgaactccggtcgaaccgacgagatgcctgctgc

SEQ ID NO: 20087 - DNA, 2451 bp, Oryza sativa
aaacctccctaatcgtcaagctaacattgccacttgtaaggataaaaattaagtctgagaatcagagttccaaagccaataaacatgcccaaaaacctaccaaatggccagcttggtagtataacctgaaacatgtcaaaactctccatctcatattcagattgccatagttaagatataacaccagaatagaacaaactgaagtaaatgaagtcctgctagatagatgccatatcacactgcgatgagcaaaagcatgctaagacctaaacatatggggtcctagcaattaaaaaatatagaaagcttcagccatggtagtattcacatgctgggataaattggtatagaatatgttcacacatactgcaatttcatgctagctataatgtacacagcaacctaatatacgtagtagttaacacataggtttcgatccatttcctacagcatggatgtaatttcataagcaaatttacatgacacaaatatggctatatgattgtataatgtacagagatgatcatagagactcaccagtcaaaagtagtgatacattgagtgaactacttcgatttctgcttagagtccttgtctccttgacttatgagcagagccaacaacatcacttctaatttacagaaagatcaactaaatcaaatattgtcacaaataataatgtgtgcaatcgatcatacgcactaatgcgacgggggaactttagtaaaaaaatcctttgtttagcttgaccatcttatactttttttctcatcaacgtggttcacatggaatagataatcaaagttgcatctaacagccaatgaaaatttcattagcatattttacagacataagaaaaaccattatattgtctgagatcacataaagtttaactcatgagctttcaaacctaggaaattaactattttattttcatatatcacaccttatattgccacggaaagccagtgctggaaacaatgtacgcatgttgaaagccactgagacacatcatgctgattttgtttgatatcacagaatgattaagaggaaaaacttcagcatgtcagttcagaactacaatagagtcaattatttgaaggtaatataccctaaagatatgaccatctagcccagttagaactgtaaaatagctagcaattgtgtgtcatttttttgacacaattttgttacaaacaaatacaattataacaagaaaataatattctaaattgtgctgcgcaaaagctggctgaagacttgatttccaagccaatgtgtcgctggtaaacagagtagaatgacagcaaccctttcaattggaccaactcaactaaaccacactaactttgtcaagcaatagaaccaagtgaaaatttcaagtgcccatattattctgccaatattctaattgcaaatagaaaactctgatactggcagttgtttcaaagataaaatgcattgtagatcctggaaagcaaatatcatgataattcaaatatggttgaaatttaattgaaaccatggatgtctgcataacaaaaactataatatatcatattgggcgtgtgagggcactgataagcaaaacatgacaaatatagatgaaaatattaatttaaaccaaattgtatataaagaaatattgcaatggaaggaatgttgtgaatataagcaactaatagagttgggatcaacttatcgtttggggtaaaaagaattgttttacttaagtgtatagatcgatttctagaaagacaaaaggcccagcttcccatgaatacattcaacatctcctggggctggggatacctcatcattaaaataaaagaaaacattagaaaataagagggaaaatttcatgagcagcacataagacaaaatatacgttatgcgttagtaacacaatgaaattacaaatatgtaaatttttcaataagacaaatggtcaaccgtgtgtctacaagttaacggcatcatgtattaaaaaacagaggtagtatgaattgtttctgtgccaaaaaacatagaaatactatggtagttagcaacttcgtattaatgtttagggccaagatcattttagttacaatagaaacaaaacaatcttaatctttaacaaagatggcttctcattgtcatatcttgagtcgaatcaggggccgaggtcaattatcagtggcatgtggcgattgagaattagtaaatgtgagttgacgttgaggcataccttgtaggtcggcgttagaaggatcagcagtgatgacttcatcagctccagtcagggatgcctgctgcccttgtagatgctattcccagttgcagctcaaaagtcgccaccttgccctccccttcttccaacaccacaagtggcatgggatggatcagacgagagtcctccccctcctgatcactctattcaacagatgtggtgggtggagggaggaggtt

SEQ ID NO: 20088 - DNA, 1550 bp, Oryza sativa
aatggaaccagcaaattcagtatattttttatttttaaatgaacgataattgtcaggatattctcttttccaatcagtagtacactataatcaaaattcatttgaaagtgaaactgacctctatggtactgatgtatgctatagtaggaaggaggaaaactaaacagcaagtatatattcattttattttcaattttctctctagttcagtcactttcgaacagatgcataatagctgttgacaatctagtactgggatatgcacacacacatatacacatataagagacatggaacttgttagaatgtgattgtgtttatctgtttcccttctttccttatcccctccgatattgttctataaatcggttgcggtagatatggaaggtttgggcctatatgtaatctgtcatatcgataatgcaatccattgtgtcgtgccaatcacactttcatggtatcaaactaggtttctttcctcgcttccgcctcttctccaccctagccgccggccggcgaatcctaccgctgccatggccgctccttcctctctcactggggactccatccacgacgacaccatcaaggtcatcaccgacgctgttcgctcctccttccaacaccctcccgggtttgatgacgcccaggccaccgctgtcgctggcgacgctgccgaacgcgcgcgaccgcggctcgcaccgccctcgcccctgtgttcctcggcatcttccagccggccccatgtaacatacctgaattctaggattaaggaatttccatcaaaactagttgaaagggaagttcttcaattttgtaaaccaaaaatttccattttaaacctaggtgaagttgatccaactcttgcatgaataaaatttgagagcaaattaaaactttttcatctttaacctaggacttggatgcaacccaagtgaaagcatgcatactcgcataaatcatattttgacttgagtccttcatatgcatttggattttcgatttgcatttcataataggtctcatgaatataattgcaatccagacaaacaactaaaccattagggcctagtgctaactaatggaaaataatacataggaaccataatacaccttaaaatatatcaacaagaacaatgtcaagccctacaaaactaatttggtcatccatctgaagactagtcatgaacatggaagtgaacaaataaattaactcatatagggtatattccaccttaattacctttataagcattctcttaatttaatactagagtaaacttatgcataaatagttaaggagcttatgaaatgaggtaaactaaaattctaacatatcaacatcacctcaggttaagaagagtctaaatataaaagttttaaaaacatttacatacatttaggaaaggaaaataagtcttgctaattatctaaaataatctgtgcaagataaaatcattggaaaattcatgtaggctctaattaacatatacaacacacagtaatttcggtacaatttaataactaaatttgatacctcaaataaatcagtt

SEQ ID NO: 20089 - DNA, 1455 bp, Oryza sativa
ggggagagctccggcttttcttttccatctcgaccatgccgccggccgtggagatgacggccgtcgccatcgccattgtaccgtggtcgtcttctctcttctaccgttccatactctcctcatcatgccgatcatcttctattttgacaccacgtcatttcatccactgcagccacgggaacgcagagctcgccgacgatgctctggagcgcgcactggacgccgtcgtcgggttctcgtcgtcgttccgaccgaaccgagccaccccaagccgaactcttgcgccaccaggatagcctcgacgtcctcttcgaaagccctcaagaaccccagccagtgccgcaacgatgagggagatcggcgtcttcttcctcaggtccggccgccgaccaccgtcgtcgattccttgatcccgggtgagcttcggcgcaattcctcactcgtgtagcatctttagatggtctttgagccgttccactatatttcttggcagcccggagtccggattgtggttgtcaccgttgccatgccgatttccgccgccgcggggatatcctctgcatcatcgtcactatccaggcctacccgtacctcgtccgagattcggtgagcaccctgcagcctatagaacatacatgcatgcatccctttgggtacatccagtctatagcacaacatgtctacccatgccaaaacatcctccgctcggactcgccgcggcgttactccgatgtcctctaaccgagaaaagtaaaggaatggaatcgcaataacatgatcttcattttgtatttttttcgcacccccaaacgagtcatcgtttgtcaccggcgagctcgagaacgagctcggccatggcttagctctgtgtcagctcaaaccaaggacctctgttgagaagaatcaaagctctaggtactagtttgtaaaacctacctcacacacagaacagtcatagaactgcgggttgatttcctgaaactctaggagcctttttgcatattggcctgaaactgacctgtggaccgaatctatttaaattctggaaaaatctaaatgaaatgcctaaagctttatattttcatcagaaaaacatgtaaatttgtaaaatccttaaaaaattggaaacaactcattttagagtaatacaaattactgttaactcatcgaatcatgaactttagtgttattgcataaaaacttgcactcacagtacaaatgtagcctctaaaatttatctaagataaatcatacataaagcatatacaaacttataaaatgcataaaaaattcatttcaactcattttatagcaaacttagtttctacagatccaccaacatgttctctaaaaataaagtaaaataaaacatataaacactttacatcaaatgcctctaaaactattgtctttaaaataactagttttgcatgaactgaactttagaagtttata

SEQ ID NO: 20090 - DNA, 19723 bp, Oryza sativa
  unsure (1)..(19723): unsure at all n locations
aagtctttgcagcagacttttgcccaaacatattctctaaaaaaattacatgaaatatcctaattaatagatataaatgccgtctcaggactcaatccgtgcatgacaatcctcatgaagctcattaactcaacccgacaatgtgtaccgcgtcacattgtcggactcggctcaatcggctaaccttgtccaactcggactctgccgatcccggtcatagcagatgcggactttagcagatccttgctctgtttccagaacgacttccatcttggattccgcctcaattttatctccatctctgatactgaaattaccaaatttggttgttaacaacgatccaaaaactgcataaataggtgatgacgatccaaaaactgcagctgttcaaccatcatgttataagcacctttacgaaaaatatatatatgtatatttgatagaatatggtatgttcggttatcagcacatgtgctctatcatcaaggttgtgttattaccgagagttagctaaaattaattatattggttccaggtgaagtgttaaaaaacttttcaagaaataaaaatagggaaagagagtaagagacaaagtgagcagtggatacactgtaggtaccttccatatgataagatcaacatagtcttgaaagtgaaaatagaacttcttcttcagatgctggactctcagtaaacaaatccatgggttcaacaaacaattaaaacaaaaaattttgctccacaacaaattaagttacaaagacggcacacagcagtaccaatgaaagacggcacacagcatagcaagttccaaaattcggcagtatttatcccctcaaaaaaaatcagcagtattttatttcactcttattgggtactccctccgtttcataatgtaagattttctagcattgcccacatacatatagatattaatgaatctaaacacatacatatatctagattcattaacatctaaatgaatatgagcaatgctagaaagtcttacattgtgaaatggaggaagtagcagttagcactattgttagcaagatggcagcaccatatcataactaaacttgaaccattaatctagccatagtaaaaatggattaataagatacattttcttgctaagaatcaggtgtgcgagagcttacagtgcaggtgagtatttgatggcactggtgcaaatcagcttcctctagatggtagcaaaaagaatatctgcagaaatgatgaggtctgatttagaaatgcaaatcctttggtcattacgaagcaccgttttatttcaaaaaatcctagaactagtggaatgcaatcatgtaatccttaaaaaatgaagtataaaacttcaggggaacatttaacccagtggcatttggcacagcaagggcataaacaatgatgatccacctcattacctctccaattttgagcatgtacttatgtatatatgtaatactaaaatacagatatacagaaaacaagaagaaatggtattttacaaagaaatggtttaggaagatgcatgtgctacctctaccaaaccataatttggggtgtacctcaactccagtagcaattgaatagaacaggtaaaataagagttctgctaccttcaaatccaagcttgaacatttctttgatatatccgtagaactcagttctatcactgtcttttccctgtcctattgtcactaagccactatttattgtaactgcctttgtcatcaccttctcatgtttatctgtccagaaacctcatttatgtcatatgtactatgtattaactcaagtgtggaatcctttagctgaaattagcactcatataaaatcatgtctgtgagactctacatgtcaaggtatagcgtatgcattaagcatgctgtgatcaacaaacataatgtagaagggcaataaaaaaatgagaaattacctgctggtagaaccacgccaagcaccattccgtacaagtttttctttatgtgttatatttggttcaccacgtctcttccactcctgacctataattctctatagaaataaaatgcatgcatgtcagcaaacggaaataaaatattgtgatgatctagaaaaaatatcccttctaaagctattttattgtgcatctctgaatgttatgcagcaacattgtgagctttttagtgaaaagaaaatttgagtatccaacaaactaagaccaatgttattagttatacaaactatagaatcccaaagcaccatgcaccatggaccatctcgtcatctataactaatgaaaaatgccatagtatttctgatgaataacatatatgcagcgattaagaatgcatgactagaaagtactgtggcgatatatagaaagctacagactgggtagctccttccggcataaaagcagatcgctaacaacaagcacctcgtgagaagcgatcttcgctaaaagtaactcagctgcaaaaagacagaaaatgtagctatgcagattgacatggcgcacagtgatgctcgctagcttactcttgtagtcttgtggccaccaaggagctggacagcgttcacaacgcgggcctggagcgcggtggtcacacggacgctcctctttgagcccggaagggacggccgccatatgctgccgccaccaagacgaccggagaagaaaaagaggggcattattggatctggagatggcggcctccccccttgccgcgctaggggatggatctggtggttttgagctcaaaaacgccggatctggtcgtccccagcttgcatcggccagatgaagggaagatgtaaggagatatggcggcggcggcgtcgctggggatagtaaggtggagaaggaggaggcggtggcacttggccggggaggaaaaggggagggacggcggtggaactgggccggggaggattggaggagagggaggtggaggcagtactccgatgcggaggggaagcatgcggcggtccagaagacgaggaggtttcgaccaactcgccgccggcagcaccgccaactgctaaagtcggagggcctggcagccgacaaagatacgaggagcacccctcggtcgacatcctcgccgaggagccggcgtccacaagctgcaggctgcagcgcggacgagcgaaggagccaaggcggcagcggcggcggcggcggcggcgcgtgggaagaggagggagaggcggagataagcctgagcgcgagtggggactggatttggcgaggtgatgggggcacggactgctttgatcgtctgagaccgacggatcggacggctcacgcgaaggaaggttactgctgccctagaaagatgggaatttgtattcccgcgcaccaccagaaattgggaatttggagggaaaattttttgtttcattaaaactttaaccaattcatttttttacttgttgtaacgtgtagcttatttattattatatcactaaaaacatatacttctgttgggcaaagaacaatttcactctaataacatttagaatggaaaattttaaacttctaataggataatatttccatcaaactattgcaaactacataattgaagaaggtgtatcatgaatgcattacaaaatttttccatacgagcgtattaagaaataaaattttaaaatttgaaactagtttatctcactcattgacggagcgtggggctcctcaccgggagaccgtgcaagccccccttcgccggttcggccgggggcgctaagtgaggttcttcgccctcgatctgaggaacgtccgcgagagaggaagagcacaagacacgggcgacgtagacaggttcgggccgctgagaagcgtaacaccctactcctatgttctggtggatctgtgcgtgaaggaatacagagagctggagagcgagcccgagttcagggtctagcacccattccccttttttctcctccctccagagtccccctcccttctttttttttctcctaggcctgggcctcctttttatctagtcaggggtcaccacaagggcctctagctgcctaagaaaggaaacatgctttttacaatgagggctagtctacagccggaagtgacctctgacaagcagagcacacgcctcctgccccgctcgcccgcttttccggtggacgcccatttcaaccttcatttaatggccagcgacttccttgccatacttgcgctgaaacctggaatggctctgaccgggactgacataccaactctaggagttagcacgccggctccggctagggacgagagccaggaagctctcatcattccgacgggacggggcgaggcgtgtgacaggccgcctgttgccacctaacccgtgatctgaccggtctgtgaccggtcacacaccgcgactggtcacggaccggataagcgtgcgctgcgccgcattaaatgcggcgtggcgcgctcgtccaacctgctataaatgtgattaggtgagccccgctgtgctcacctaacccacacacatggcgccaaaaccacagggggtcggggcgccccagccctcggggccaaaacgagggcgccccagccctcggggccgaaacgggagcggtccgacccctcggggagacagagggaggggtggccacgtcatcctcgggcccgacccccccgagggggtcgggccacgtgggtgaccgcggctacccaagcctctagtcacgatacccccggccccatgtcaccgacactcatataaactttaaattggatgattttttttctaaatgtttctaaaatcatgctctgtcatgttattgtattcttactactattattttggccatttttcttatgactttgttttataaatttaaattttgaattttaaaacttcaaataatattttgaagtagtaaataatttcagctgaaaaagtcatgaacataaaacttgtagaactcattaagacatacaacttttattttggtcatttcttcattcaataaagtgatactaacattgttcacaaaatttacatatctctcatatagttttataaactttgtgaacaatattattatcactttgtcagatgaagaaatgactaaaataaaagttgtatgtcttaatgagttatacaactttgttgttgataactttttcagttgaaatcatttagtatttgaaaatgttgtttgaagttatcatattttgaaattcaaatttaaattgttcaaacaaagtcacataaaaaaagaccaaaacaaaaggtgtagatcttgataagttatacaactttgttatcgacaatttttccatttgaaatcatttactacccaaaaaattatttgaatttcttatattttaaaatttaaattttatatagttcaatcaaacttggatgaagaaatgaccaaaagaaaattggtagatctcaatgagttctacaagtttgtttttgacaattttttcatatgaattcatttagcattataaaattcaattcgaaattcttatatttttaaattaattttttaataactattttcacatgtggtcctcttaaagagccgcatgcaaaaatctattttcacatgcggactctttaagtggtccgcatgtaaaaatatttcacatctaaacaattttttccctcctatccacttcaaaatttttcatctcttcttctctcctctctctcccatctctggtattttcccctctcactctttctcttcctcactctcaccctctctcctgtctttctcttcctctctctctcatcccgcatatgcgggcggtgcgcccgaggaagaggcgctgggagcaggtgccgccgcggtggcggcggccaggagcggcgccgccccgcgacgcggactccggcgatgatggtaggggcaggcatgggagacggcggcggccttccctcacccggatctgccggcggctatcctcccccgccccgatctgccggcggcggccctcccccgcctggatccgccggtggccaccctaccctgccccgattcgccggcggcgctctcccggcggccggcgcctcctcgttggatccgggaaaggagtacgatgtcaacggtggcggcagcggcttgagaatgacggcgacagttggaggataaggacgacggtggcagcgactggaggacgaccacaggctggcaacggttacatttttcgatttttgaaatttttatttttatcgtgatttttcattttcgcatgcgactggcttatggttgcgctgaccgcatgcgaagatcgtgatctttgcagactctctcgtgcatgcggtccggccaaccgcatgcgaaaatgcatttcgcccatttgcaaaaatggttcttttagtagtgccgaaatttaatatttttgatatgtagctaataatatggaattgttcgcatgtaaatggtatattggtggcataataaaaaaaacatctcccatatctgtgacatattgatatgcgaacaaaatctgtaatatgtactatatataagttgtgtttctcacgagtcacgacgtggctttttatggctagagttcttttccataattgttttcgtaataacttttcgcacctggaggaaacggcagcacacacagacgggaagttccaaccccttcattgacatgcgggcccctccactagtttctccgttagttagttaggattaccgggtgtcatgtttaacaaacacggtaactaaaagctggagcgttgcttttccgtttcctctgtgccatttgcgtaccaaccacaagaaaaaacgttctcacagcaacagatgagtgcgcgccaacggaaaatgatctggagatgggactttgggacccatgttccctagtgtaccaacaaaacacttagtaatatttcagtgttacctagtatcaagagaacactctgtaaagagaatagttacgtggtgtatcttgaaaacactacggaactcaccgagtgccagaaaaaacacacggtacatctctagttacacccgggagagactcacatttggatcatgatcttgttgcttgtgagtgttcaggttaagcatcaaacaaagcttgttaagcggggaagtcaagtgcgtggcgtgaagaagccctcaggactatacggaggtgaaatgtctggtattaatccaaatgtgagccgtagtgttaggttcaagggctgatggatcgaattgattacgcccaacatggaaatttttgtttgatggtaggaagtttcatggttgtaatttgccagtaacagttttgcctagagagagagagagcatgcatgcattgtctttcaattttgtaccaactagagtgtagagccctcccagtcccagggtgagttgccggaagcatgtagaggcgcctggagcacgtcgtgcagggaatcggatcggaggattcggtggcagagatggaccaattggatactatcatggtcatggcgctgtctgcagtgtccagtaggattatgggagtgcgaggcgaaattttgtcaattaatatcaatattggcacacgtcgtgggtgcgatgtttctcaccggaatgaaaaaagttcaaggagcaccaaaatatgatttttggacatagtggagtgtattgggtgcgttcgtggaaaaaaaattacttcctgattcgcgcggcgaaattttctcaattaatgccaatattggcatatattgtcacacgtatgtgcaatgtttttgaccggaatgaaaatgttcaaaaagcactaaaacataatttttttgatatattggagtgtattgggtgcgttcgtggcaaaaaaaaatcacttcgtgattcgcgcggcaaacttttatcaattaatgccaatattggcacacgtgggtgcgatgtttctcaccggaatgaaaaagttcaaaaaaacaccaaaacatgatttttggatatattggagtgtattgggtgcgttcgtggaaaaaaatcacttcgtgatttgcgcggtgaaattttgtcaattaatgccaatattggcatatattggtacacgtaggtgcaatgtttgtgaccaaaatgaaaaagtttaaaaagtacaaaaacatgatttttggacatattagagtgtattgggtgcgttcgtggtaaaatatcacttcgtgatttgcgcggcgaacttttgtcaattaatgccaatattggcacacgtgtgtgcgatgcttctcaccggaatgaaaaagttcaaaagaacacaaaaacatgatttttggacatattggagtgtattgggtgcgttcgtggcaaaaaaaaaattaacccgtgattcgcgcggtgaatatttgtcaattaatgccaacattggcacacgtgggtgcgatgttttcaccggaatgaaaaagttcagaaagcacaaaataatgatttttggacatattggagtgtattgtatgagtccgtagcaaaaaatcactctgtgattcacgctgcgaacttttgataattaatgccaatattgacatatattggcatggtgggtgcgatattttcaccagaatgaaaaagttcaaaaagcaccaaaacatgatttttgaacatattggagtgtattgtgtgcgtccggggcaaaaaaatcactccgtgatttgcgcggcgaactattgtcaattagtaccaatattggtatatattggcacagtgggtgcgatgtttttcaccggaatgaaaatgttcaaaaagcacaaaaacatgatttttggacatattggagtgtattgagtgcgttcgtggcaaaaaatcactccgtgattcacgctgcgaacttttgtcaattaatgccaatattggcacacatgggtgcgatgtttttcactggaatgaaaaagttcaaaaagcataaaaaatgatttttggacatattggagtgtattgggtgcgtcttcggcaaaaaaattactatgtgattcgcgtgacgaacttttgtaaattaattcctatattggcatatatttgccaatttcaattggtcagtctagatctctgatccttcataactattcataaattcagattggcaaatgcaccatcatgcagaacaagattcagacgaatggttgtgacggtgtgttgaataaaattgcatctcttgatagcaccaagcaaatgcatgtggatagtgtagtactcacgtccaccaagcagtgttggtgctaatgcaatctggctgaaagtgtcctctttctgttgcattccatcgaacaggtggtctgcaatagacaagggtgacaaccacatcaaccaggaaagaataaaagcttctggaagctacatggccatcatccccagcgcatagagaaaaatcagaaattgtatcttgtgagaaatcagtattgacaaataggaactaaaccatccacacctaactcagtgttgctgatggtcagttcgtgcattcccagccctggtcgaagaagacaacaggacaatagtccggcagcgacaccaccactggcagccattaggatcagttcaattgcttaattgtacacataatcttctctgattcatgttccagttggaactcagtttgtgttaagaaatccttgaaccagaaatttagcccaaatttccagaccattttgtgtattaaatccctatccagaaatctgcaagggtacacaaaataacaagtaatatacagttcccaacgtaaataaagcataaatacttagagaagaggcacttagtcctcgcatcgaaacgaaaacagcagcagcggaaaaaggcgatcctagcggggcttcagctccactccataggcaacactcaactggggtctgagcctttgtcctttaacatcgtcttcagatcagaagcactacacttttcacttttgaaaagaggaataataccaaggctgagtacaaccaccatactcaccaagccacaccaatgatgcagacatgcaagggggtaaaaggatggcttgtggctctttgcataaaggcggttgcaaagcattttattgagcaaacggtaaaaaagttgattaattaaagtaatattaaatctccccagatcaacgctacaccacgttgaacaggccatccatcccacctgagctaaccagtgcattgagtcgatttattaggggtgacactgatcacagtgaatctggtcaatcgcccataaccacgggcacggctattcgaatagttttactttggccagaggtgcacaactgtaaccacaagatacaatccaccggcatgtcaccgtgctgtcacgtaaaatgaggaaaaactctaataaaaactaagtaaacagtatataaaaagtaaacaaacacgtagagctcaattttagatgaattttgcaaagttgaacggctcaatttggtgttcgtatgaattagatatgaattttagaagttttgagccatttaaatgaatttctataattattaaccgaatttattgcgcaattatcatgatttatgacgtcaccgaggggattggtggcgccgacaagcgggccccacctgtcggtggctcaagggaggcgggtgcacagtggaccgggtccacgcggcaccggcaagcgggcgcaccacgtggtggccatggcggacggagagggcgacgtggcgccgacatggcgccacgggggcaccgatgccgggtggcacggggagggccacgtgcacagcctagatcacccagagggggatcgggcggtcatgggctagcagggcggcagcagccggctgaccgatcaggaggcggcgccgccgggcccgatggtcgtcagcggcgagcggcggcgtcgcacatgggaggtggcgggggaaggagagggggctcaccgagaggacgtgatggcgaggcgaagatgggaaggcggccgacgacaaggattagcggcggcgcttctcgggttggggtcggggacggcgctccggcgactcctgagagtggtggaggtgcggccgagggccagcgggacctggggagcaaagaggaggggttagaggagggagaggcgtcgcggcatggcgaggaacgccggccgagcatggcgtttgcagcgggactcaccggggagcgaggggagatggttacaacggctcccggcagcagtgaggtggtggccgaggatctccttgcccttgcggagccgaaggaggtgacggcgcaccgtgaggaggtcggaaacagcggccggaggtgtcagtcacgcggcggtgacctcgggttcacggttgggtggtagttgcggtggctatttggggaaaccaagcgaaggccgggtgcgcggtgaggtgtggcgatgctagtggtgcgagcggcgcggcacggggactgcgggtaggggtggaaaaaaagcttgggctcgtgagctcagctcgggcttggctcgagctcgcttagcttggctcagctcgggcagtctgcgggagcagcggtggcaggcggctgaatagcgccggtgagcggcggaagaggtcggcacggcgggagcggatttttgggctggatggggaaaatggagcagcggccggggtgctacgcggtgcggcgaatgtagtggaggcggaggcgcggcttggcagtggctagggcagtggtggcgcgtggccggagctcaccggcgagcggcggtgcacgggctcggtgtggggagagcgagagagagtgcggcgggctctggaaagatggggaaaagagagagggagtcctgaggagcattttttataagctcggggaggggagaacgtgcccggacggggcggcaacgggcggcggcgtgggactccggcaatgtgggcgactggggcggctcggcgccgattttctcggggagagtgggggatttgagtggaggtgtcgacccccgattttggaaatcggaaatcttctgtgtttatcagtaccaatccctggatcagtagttggtacacacatacatagccgaatcacaacacatcacgtatgaattcaggctaagagagttaaatacttgcattagggccaggcaggccaacaactatcagagaaacaacagcggaaaacaaaataatacaagggcccggttgacatgccacaagcagtcgactggggaacgagacctagatcgaaaccgcactccgatcatcttgttaagtacgcaagcgtactaaaacaagggcttctcttcaacactctgctaaaagatatatatagagcaacaatgagtacaaaagtactcagcaagccaccacacaaaatgcagtaatgtacaggataatacaaggagtggctatggttactttgcgtaaagctgagttttcaaatatcatttcacaaacctaagacctagcataaactgatcaggttttaactccattgttcattaaacaacgacagttctatccaccatccattgtattcccaaggatagcttcccgccactggtcgtcatggttttctggggtctaccccttctcacctctcgagaagttgatccaccagtacaaaatcatcatgcatcatctcacccatcattttaagaatttagagtctagccaagtgtaatacatgtcccggtgctcaataaccgcgagcacgggtattcgaatagatttggtttactcacactgcagtggatgtacactttacccgtactccgcgactgcccaacacatgagcctcgtcccaacacatgagacgcgtcacggcaaagcctttcaataacctcacattggcagtacccactccatgaacttacatcctcatgcactctaggcgtcataagtttctagcagtgagaggagttctggctctcccgggaagggaagactcacacatgcattaagttatagttaagtttaggtttacacatggcagtcctaccgatggcgacaccactgtaggcacccgccccacgcggtcctaccaatggctgccccaccgtaggccctgcctcacacacatcaagaaaaccactatgcagggatactgcctccgctcggctatttacaacgctaggtctatacccactcgagaagtacggttgtacggaggtcgtttcatgcttagcttcatggctcgatccttaactgaacagggacggcactagcctttaccggacaccacccaagtcctccagccgccccaatcgaaaatagttgtttagtttcatttttcctttcacaaatcatgtcaccaatgtcatggcaatgtggcgctcatgtctccacatgccgtatctcaactactttccctaaggtagttgcccaagcatatagcatatcatgcaaaaaagttttagtatagttatttaaagaatagatagaaataagattgcgtccaatagcatttgaacctataccaaaggtnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctgagctcccaaccagtgggaggggaaagtgatctctgaccgcgtgcctgttgaagaatgagccggcgactcataggcagtggcttggttaagggaacggaacccaccggagccgtatatgagaatgcatgattctaaagtaccattactaagcttttgtcataattgactaaggactcatacgtaatcatgggtacaaggaaataatgaggtaaacaataatcaaaggcgtggcataataacaagtaggatattcatcattgcatgcaattttatttataaacaaaacaatttcgcaattgggaccaacatgctcaagggatggggtgatgacttgcctactcaggatagttcttattcttaatataatcttgatcaaccttcacctcctggaagctacatacgttgcctcacgactaaccgatatacaaattctataatacgcgagaaaaaccaatattcaaataacaatcaaatgtgcacaagaaaaatataatgatggtgtcgaacctagggttgctcatactattccggcttgctaatggattctaatcatgctaagggccaagattcttagtctttctattgtcatggcggcttattaggggctaatcatcatagtataaatgagatacacagtgctaatatgtggttaggatttataacaagtacctgtttactgtatgtgatggttctgttgactattcactggaggttaaccgaactatacatatactactccacatgatgacattgtaccgactaacttctaagtggtccaaatacaaccaactctgttattatttctcataaacaagttaaagattcatctataagtattaatattttagttataaaatatgaggctaaactttatgtaaataatttataagtcatgggtttaattacacaaccattaaatagtactagtagtctagtatcatcctatacattaatttgagacatcatttaaaattagtttgtgtggttggtacagtgacaagacatgttagagacaaatattcttacatctactttactgtaaaatataaattttatttgttagcacatttttaaattgactattatgcatcatcttgatattaattattttataattataaatatattttattaaataatgaattatataccattgaaaagaatatgaactttatatgaatttaggttcaagtttcactcaaatccgagtaagttacactagtttaaagattcaaataggaataattgcgaaatagcactgttcataattgattattttagttccgaatcattatccataacctaccgtgactgacaggtggggtcagggttttattattctttcagccgatttgttttaccccggataaaaattggagcgggcccggcttgtcagcgacttggccaggagtcgtcttctaccttcgtcttcttcttcctcccgaccgagcggaagcagcagggaaataaggcgcgcacggcaaggccggtcgagggcgacccgacggcggtgaggggagggtgcggcaaggctccggcgaccttcggccggcggccacagcgtaggatggtgcgggggcgagcagcgtcgcatggccgccatggccgaactcgggtagctaggggctagggtggtagggtttgtttccgaccaaactgatgagggattgagcatctatggtgtacgagttccgtttttacataaaaatagaaggaagagcccccgggatggcatgtccacgttgaactccatgggcggagctttggagctcgggcttggcactgctatggacctaatcgacgaaattgatgggggatttagttcccaggggactagtatgagtcacaggagcgaggaattaccgaggaaaggaggaacgacgaagttccatgtcgcggaacagaggcagacggcgttgatggcgcccgaaggtgttcgtcggcgttccttggcgtccaacctccccaatggcgacggcggcagcgcagctccgcctccacttcctccaacctccagctccggccagagagcctcgcaatggtgatctctagcagtggtgagagagtgatcgcaaggtgttcgatgaaatgcactcgagggaaaaaggcagagagggatggggtttttatgggggcttagcttagggtgtaaggaaaccatggggataagatcgccagcacatggcctggacgagctagagttcaatggcgatcggataagagcaatgaggtcgatgacacagataaagattgatctccttcaatactaaggttttgtgggccatcatcaccctataacctatagtctgcgagttttagccctagctggggaaggggactccgttttatccactggacacaaagaggggcgcatcgttttgtctagcgggtgcatggaggggcgacgggacgtcatggcgtttggataatggggtggatgtggcgatggcgacgcgcttatccaatcggcttcgttcctcatctcttggagcgacggctgaaggagatggcggcttgaccggggtcgagtcgcggacctgcctggcgtggcgcgggctcatgggagctggtccggttcagggttggacacggtgcggacatgatgttggtgcgagacgcgacgaagtggcgcacgagagggagtggcgcagtcagcctgggactgggagcggatggatgcggcgcgagggaagggatgcgcggcatttagcgcacgggcacgacgcggggcgcagtgcagagcgacgtacggaagaggcgcgacgcggacacaacgcggtctaggtgggaggcggctgtgttgggactcgggaggagttcggttcgggatagggctccggtcgagcacctggcggcccatgaacagtagccggctggaaaagagagagaaggaagaaaaggaaaaaggaaggaaagggaggggttaatctgcaaaatagttgggattggaattgagatgtagctccatacattttggattcaagaattcaaatattttatttgaatatttatttgcttattcattagttcccaaatgaatttgctttagattatccaaaaattttccaatataacttggagggtttgataattctaaaattaattaaaatatttaatgtgacgattacaatggtagtgatgtatttactctgtttatatatttatatgatgaattctataccatatggtacttgataaagtgttttaaatgttaatttaaatattccagcgaaacaatcatctatagatgagatcattgtaaagaagtggccattatttcatgtgagattggattcagatgaattcgatttaatcttaccgttttcatttgttacgtatgaaaccaagctatcaacatggtttgaatatttaatatttgatttataatttatagaaattaataattaacttttccttcatttagttttctgccttgtgcataatatttatgggatcgatagataacttattcttgcgatttgtacatctttaattttaatgtttcattgtgacaatttataatatccagcatgatgcaaaagttttaaaaagtttgaaattttagtgatttttattgtcgggaattttcagggtgttacaggaggaatggaggggagccgattccactcggtttgggcgcgagggcgcgagcgggagggcgccggattcggtgggacgtgggcggcaacggccggccatggtttcttcggcctgggaggccagaggtaggaggagggcctgacaggtggggttatcgggcccacctgtcggcgatggagggagagaggaggctggattagggaggtaaaatagactttggggagagagggccgagcaggccgagggaggggaagggaggccagcctggccgggaaggagggggagggaatgggccgagcccaaggaaggaaggggtaagattttctggtgtcgggacaacctgcccaatcagcgtcggaatatgcgatcaggtcgaccgtagtggaacgccgaaggtggacgacgaagtcaatggtgccgcgaacatagcacaggatgcgcttaagagcggcaagatgcggctcgtgcgggtcgtgcatgtgaagacatatctgctgcacggcataagagatgcctggcctggtgaaactcaagtactgcagggcgccaacaagactccggtagtcggtaggatcagcaacaggagcaccaacaatagctgacaacttggcatttgtatccactggggtcgagcacggcttgtagtcagtcatgcctgcatgctctagaatctcaagacagtactgccgctgactgaggtagaggccagaagactgtcgtgtgacagaaatgcctaagaagtggtgaaggctgccaagatccttcatggagaactccgactgtaacgaccgtatggtccagcgaagcagagcatcagaggaggctgtcaacataatgtcatccacatagagcagtaggtagaccgtattatcagcactgtgatggtagatgaatagagacgtatctgatttagcctcaacaaagccaagtgacaggagaaagctggcaaatcggctgtaccatgcccggggggcctgcttgacgccgtagagagacttgttgaggcgccacaccaagtcgggtttggttgggtcaacaaatcaagagacggcccagctggcgaggccggcccagtcggtgcgccgaccgaccgagcaagagaggacggcccaacaggcgaggctggctcagtcggcgcgccggccggccgagtagaggaggctgccccccaccccggagtggtaggtttgtcggactcgcaggccgccggaccagaacggggaaggcgggagcgatgtccaataggcgccggaataggagctgtaaaatcctccaaaaactccaaatcaatagcaatctcattattagtcatttcggctaacggaaaggacgtctcatcaaacaccacatgttgtgagatgataaccctgtcagtggcaaggtctaaacactgataccctttatggtggaggcgatagccgaggaacacacgcggaatggatcgtggggctagcttgtggggggcggtgacggacaggttggggtaacacttacagccaaacacgcgaaggtgggaataggatgggtgggcaccgcagagggcaaaaaagggtgtgcggtgttgtagattcttagttgggtggcggttgatgaggtgggtggcggtgtgaagggcctcaacccagtattgtgcgggaaggttggcttgaaaaagaaaggagcgcgtgatgttgttcagggaatgaagcatacgctcggccttaccgttctgtggggaggtgtgggggcaagacatccgcaaggagaccccgttggtgaggaagaaggagcgggcggaggagttgtcaaactccctaccgttgtcacactagatgctgtgaatggtcgtggcgaattgggtcttcacaaaggcaaaaaaatgagatagtgtagaaaatgtatcggatttaaagcgaagtgggaaggtccacacataatgcgagcaatcatcgagaatgacaagataatatttaaatcccgacacactaggaataggtgatgtccacaaatcacaatgcactaaatcaaagtttgccttggcccaactagtactagtggggaagggaagacacacatgacgacctaattggcaagtataacataaagaggtggtgactctgggtggtgggatgacagacgcctgtgcgaagcgaatgagagcctcatgaccaaattggccaagacgacaatgccaaaggtcaatgttggtggaggtagtgacaaaggcacgtgcagaggccgccgaagagtacgcatctgccgggagaggatagaggtcaccggaactattgcacctgacgatctcggccttggttgggtaatccttcacagagaggccaaaagggtcaagttcaacggatcaccaattatcacgagaaaaacggcatgcggaaataaggctcttaataatctcaggggaaatgagaacattgttaaggacaaaggaatgattagggtaatgtaaaaaggcacgaccaatagaggtaatagggagaagggagccattgccaacaataatatgagagggagtattgcgggtggagctttgggaggtggtgagggtaccggtgttagacatcatatcagaggaaccacctgagtccatgtaccatttggtggagggcggagtggtcaacgtcaccgtgttgtacgcgctggcgaggacccagtccactggaaaggggactgtgcttgtgctgca

SEQ ID NO: 20091 - DNA, 588 bp, Oryza sativa
ggtcaaaaacatcgcaccctcgtgtgccaatattggcattaattgacaaaagttcgccgcgcgaatcacgaagtgactttttgccacaaacgcacccaatacactccaatatgtccaaaaatcttgttgtggtgctttttgaactttttcattccggtcaaaaacatcgcacctgtgtgggccaatattggcattaattgacaaaagttcaccgtgcgaatcacgaagggttgtggtgctttttgaactttttcgttctggtcaaaaacatcgcacctatgtgggccaatatacaccaatattggcattaattgacaaaagttcgtcgcgcgaaccacgaagtgagtttttgacacgaacgcacccaatacactccaatatgtccaaacatcatgttttggcttttttgaacttttttattccggtcaaaaacatcgcaccctcgtgtgccaacattggcattaattgacaaaagttcaccgcgcgaatcacgaagtgagtttttgccacgaacgcacccaatacactctaatatgtccaaaaatcttgttgtggtgctttttgaactttttcattccggtcaaaaac

SEQ ID NO: 20092 - DNA, 254 bp, Oryza sativa
aaataggaggggcggcccgttagcaacgcagcgtaatctataaatagggatcaaatgaaagggggagataatccaggtgttaaataaatacaatagttctcttgttaattaaatgtaggagctggtgaatgggattacaatttcccgcaggatttggcggattctattgggatctgggtgggtgtccggtactttggtccttacgtttcatgttgcgctcttcctcttcattgggcacgggcacatccaaggct

SEQ ID NO: 20093 - DNA, 910 bp, Oryza sativa
atcacttgtgggtgatgagaccgtcacacactgcccacgctagtccctgggtgccgtcacggatcttgtcgcggagagcggacaggtcggtgtccatcgcgacttcctggcgcagatcggttaacacttggaaggacggcacagatatcgcactgagcgaagccgtggcgtcttcctgatcacgatgtgagagcgcgtctgccaccacgttcacccgccctggcctgaactccactgtaaaatcaaaccccattagcttgcttacccaatgatgttgcgggatggtgaagaggtgttggtcgagcaggaacttgaggctgtaggagttcgtccatacagtgaacgtgcgtccccacaaatatgcccgccaatggtgcaccgcctgcacgagaccgatgagctcgcgctcgtacacggcgagccctgcatgtcacggcgccagcggccggctgaagaacgcgagcggcccgacgccctggtgcaggatggcgccgatgccggagcccgaggtgtcgcactcgacaatgaatgccttggcgaagtccggcagctggagcacgggtgcagacgacaacgctgtcttgagtgcgacgaaagccgcgtcggccgctggtcaccagcggaatgcctcacgcttaagccgcgccatagtcacgtttgaacttgcagtagtagccggcgagaccgaggaagccacggaccgcacgcaccgagcgcggcggaggccagttttccaccgcctggatcttctgttcatccatcgccactccctcagcagacacgacatggcccaggtagtgcacggtgcgttcgccaaatcgacacttggagcgcttgagcaccagcttgttgtcgcggacgacgtgaaggacggcgcggatatgttgcagatgctccgaccacgttgagc

SEQ ID NO: 20094 - DNA, 633 bp, Oryza sativa
gtacacacatttatctatcacgcatgcatgtatacctatatatatcttgtatgtatatacctgtaactataccttgctatacggtgcacggctgcacgctcacacacatacatattgctggtacacacatattattagtacatacagtatatgataatatagctagccaatctataataactaataatctctcaacaaatctcactcacatcgatcacacaagaagccaaaggcaatgcaaaagccatgatgcatatgcataaaaatggagtatagctaaattaacccaccaccctctgtcatcacactcgcgcatcggcgcatgcatgtatgtatctatgtatgtatgtatgtatgtatgtatgtatcagtacttccagatggtagcgtccatgttgcatgccaccgacgagatgtcggcggcgttgttctggtcggcagcatcctgcggcgacaccaccagcgacgacggctcgctcaccacgaagcctccggcggccatgtccatctgctgctgctgctgctgctgctgctgctggtagtacatcgacgggttcccaacaaactgctgggcgccgccgttgatctgaagcgggaagccaggtagagtggagtaggaaggcggaggcggag

SEQ ID NO: 20095 - DNA, 1922 bp, Oryza sativa
gtccctttgatccactcctatgaataaatggcagtttttttttttcttattgttatttagttcttgacatttccttgtccctcgttttcagctgatttcagcgattgataggcactgacactgtacagagcatccaataaaattcatatcagtgaagcagccaaatgttgtcaaattcaagataaaaccaggtatttcttactagatcatcatcgttagcaattatcatctagattctgaagttcttgcttgtatcttcatataattatcaaggacattgtgtaatattacattacgaaggccacatcatatgaataaaccaaaataatggttaacatgttgtgtaacatataggcgtactatatggctgagtgtagaataagtaactttcgagtttgatctattttttgttggtcatgtaaatcaaaatatccttggtttaaacttttcaggttcagattctggtgcttctgacagcagggcaaaaagaatttcttccttcttgtttcacccatttttccctctcgcactttctattcagcagacatatatgcagccaactgttgtcaatttacatttcaggagatagaaagatattgccgttccctcaattgtatttgtaacagttatgagcggtgcacagctcagtaaaaattttgcccgcctgtagtaggatgttttatcggcaaagatcttattataggcaaaggaaaaatgtggttttaggttctccctttgattatgctggaatgtacattttgtaggaatatggctgtctgaaggcaaatgtggttcatctaaaaaaaaggaaggtaaaatagagtgaacaaaatgagcttttattttgaattcattacgctgtctttccctcctgatccccaagtctttcccaggggcctagctcaatttgtcactgtacatagatcgtccatcttgcaacatggcttgtaggggtggcaatttccctgttggggtcagggacgggcgggggagaattctcacccacgtgtgagtggggacaaggccctgcaaaatttcggggatggggcagggatcggaattaacttgctggtgacctggaggggctcttgatgtgagttacttttctaaaaagctacccattgcaataatatagacccaacaatctcattcaaaattgacatataaaaactcaacgccttagttcccctcaactgtaatctttttcgttccatcaaccaatccacactgtcgggggctattgaaattttatcatactattattcaatgtattgcaatatttttatggagcgttaactccatccaggtaatgcggggccccggtcacccgccgggtcccctgtggaggcggggatgggtgatgtttttcacccgacttccattccggggccaggggcaggggcattccaagtttccaacccaacccagccccctgttgctacccctaatggcttgaaagtgttactattaaattagttagttggtttgatgcgatcatgatcattgactcagagataaacatcagtagttgtttatctaaggggtgtggactctggattatgggcttctgcagttaaccatttatttagtccaggaaaccccagcccttgacgatagatccgtctgtgttgagtgagtacttttgttaggtgggctcaaaggagagtaattatataagacttccagggatgtgataaaggacatcgaatgagcattatgaactatcaaactatccccaaactcgtctctctactgcttcttcctctcgagtttttttcctgttcttccacccctaaactcttgatttcttctctcaagctcccaatctagcttggcgtgacaccggcatatcgtgggttcttgacacttggatagcttgatggagttggaccatctatcaattatgatgatagtagtgaacc

SEQ ID NO: 20096 - DNA, 1855 bp, Oryza sativa
cctccccttcctcttctcctcccctctccttcctcctcctcccctctactccgtcttccatcagccggccggcggccggcggcggcagcgcgtggggaggcgggcggttggcgtggggaggcgggcggctcggccgcgtgcgtggaggcgggcggcggcgcgcggggaggcgggcggcggcgtggcgcggccgcgcgtgggcaggcggccgacgtgcgccagcggcggccgcggccgggcgccggctcattttttttaataatttgtggatgtataattttttagattttttgattcattgcatcgcatggatctaagatgtataatttgtataatctgtgatgtatttaatttgtgtgtagttttttaggatttgtgatatagttgatctgtgtgtaggatttgtgatgtatttgatttgtgtgtataagtaactttaatatttgggatgttgatttggggatgtgcatcccattagattcgggagaaaatatatagattaacactagccattagcaaaatcaacaacaaaataaaataaaaaaaatctcgaggaactgtcgtgaactgtcgcttcccaacaccaaccgggactaaagatcgatctttagtccgggttatttgaaccaggactaaagataacgatctttagtcccggattcgtagttccggtaggaaaaccgggactacaaagggttctaaaccgggagtaaagaatatttctccaccggtgcccccttggatgtgaatagcaaaaatgagttactagacaatgaagacgcaccgtagcccggaggcctttgctgtggatgcttggtgcacgtctagcaacatgcacacatgcttcagagttgtcgtccttaagctagccaatgctccaatagcggcgctattaagccagccaatggcccatcaaggctttcacccgcgttttctcattcagtcccacacaactaatccacacaaggagcatgactgttaccgaccaccacactgtacatccaacgtccagcatgggttcatagggttgctcttgttcatcgccatcccttcatgtgcaagccactgcctccaccctcacactggagcttcccataatcaaatctagaagcagactggctataaaaaggtgaggagctccatgcactacaccatgtcctaaaattcccgtctgactttggttgggaaagatgcatgtataccgattaacggtcggtcggtataacttttcgacgaacggacagttgggaattctaattttattagcgaactgtcggtcggtaattatgtaactttttactgataaactgtcggttggtaataataaactttataaaaagagacagtcggtcgataaaaatataacgatatctcgtcggtcggtaataggctaatagccggtggaggaatttagggagccaaaattttcgcctctgcttggccggcacgcgcgcgcggttgcggtggaaaattttgcggcattaatttttttcggcattatttgcaccaaaccctatctatccctttgatccatcgcctgtgtcccctccgccactccatcgcgcgcggaggccaagcgcctccggcgccgccgccgcttcctcccggcggtgctgcctccaggcgccaccgacgcttcctccccacggcgctgccccaggtgccgcctcttcctccccacgctgcgccgcccttcttcgtgccaccgccgccgcctctccgcttcgcagcgccggcgccgactccacctcaatacgccatcaccagtcgccctagcccccacgtccaccttcacagccgccctagccccttcctccgccacccgcaccagccaccctagcccccagtcccccac

SEQ ID NO: 20097 - DNA, 2814 bp, Oryza sativa
cccccacctccacctccaccaccccacacctccggtgcttcctcgaggtcagcctccccttaccccttcacccccaatcccttcctaaaaaatcagggaagtgttcaagagcctctaagcaaggtaaaattgtttggtgcttttctctattatagtatagttatgtataatgtggtagcaggagggaaaaaaacaaactatttactaatttcttttgcatggaacaatgtacagttatatgggtattgaatgattgaagaccacgggtgttcgcatgcagcaagacaacatcatttgaaaggaagacatcaagaattgtaagttagtgttcaatttctcaattttgctgtgatggctgtttgtccaaatagagtcctgtgtggaatggcgatctgtgtatgctgtgatgttcttttgtgaaatagagccatgtgtgaaatgactatatgtgcatgctggcagaacaatattaaataaaatcttgcagcgacgttgtgaatttggttatattatgcaatatgtaacatataacaacttctttgatatgcagttgtagttgtatttttttggtactttttaataattgtctctctccttgcaaggtttatctagacagggaaggtatttaccctattggtagtttgaattggctgaagaggatgagcaccttaacttatttcaacaggctatctagcatctgcatttgatagctatcattggctccctttctaattgctctcacgcaggactttggctgtttgtagagcccaccatgtgaagaacaagaacttgctattgggagtcatgatagtgatattgaggctgactgtgctcatttgcaagaagtgcttttcaattacaatgaaaacattgtgcacagaagagttgtacaaaggggaacttcacgatgtgtttctgtcactccaagaggccgcacaacctcttgcaatgaagatgaaagccttgtaatgtctacatccttctctatgcttatcttaggtatataattacttgtgttatattcccttttctgaactatactgtgttttaggttggcaaggatgttatactctatgctgtcacaagaaatgatgtcccagtagccaaggcaacaattgtctcaacgaacccaataacaacagtgggaggtcaagctcttggagtccaatactatgaggtggttgtgaatgtggtgttaaagagggacaccgtgcttccttgtccatttcgtattaaaactatggctgatgcgtaaatgctgtctattgcatggccaaataacaaagtaagaactgcagtatatttttgttgttttggttctcatgtatcaccttaagatactaactaatgctaatattgacagatcagggcaaacaagaggccaggtatctcccaatgcggaggtattttacatataaactttactttttttcttgcactaaaatatgatttatagaaccgctgaattctaaatattgaatattctagtgttgagttctctctgcgacgtatttagatgtgaactttactaccatgcactaaattatgatatgttcaagttcactccaacaatatcctgctgcaacatattgatgtagccctcaaagttagaagttacttaacctgtcaattcaatataacaatctgatcagaaagttcatttgaattagaaaaagccttgtatatggactccatgcttttgtttcaatctgaactggccttgtttatgctggtaacaattagtatacatactgcctatggttcagctgaaagaaacctgaaggatttatcatgtaaatttatatggtgagataaggggagttataaaagtagtattcctagttctttaatatccttgaacttagtgattgttgagtattactacttcatgattcaggttgacatgttaggtggtctaaaatatatcatttggaaaatgtagaaagtacaggttactggaggcatgtattttgcccaagtgatgggaggcaacaacagtactagcatgttttgtaattttttagttaactacattttcttaaaagtaatttgtttaactggaacataatacctttttctgtaggtggaggttctggaaggacatagaggtggaccttgtcttatgttgacaacaagctatggaggatgaccttgttttgggggcaagacaaggtcatccttttgtaatggagtttgctacagaggcgaacttgttgggaaatgccaacatactgcatgtaatggagtttgcttcaggatagatatggtggaacttggatgaaatgtaaatcttttggacacctgttgtatctatgccacatgcgtactgcatgcatgtatgcttgaattaatctgtgaatgaattaaagttagtcactattttgatttgaagtgttgtcttcagtccaatataatgaatctatggagactaatttggtgagaatattggtttgtcatttctaattgtgatgaacaagtatataatttgatatggatacattaatatgaaactggaattgtgatgttcgactgacagtgggtcagcaattctcatatctgcggcaaatagtcggtcgggaattgttgtgggtggggataaatatgttggtcggtataaataaggtcggtcggcaaatctaaccaaccaccgtctgatagtcggtcggtaaaaatatgttggtcgggaaatctctttgccaaccagacttattccgactgtgcaagttggtcgggaaaacatttaccgactgatggttggtctctaaatgtggccttcacctaccgatcctctgttggggattttgtgtcatggtg

SEQ ID NO: 20098 - DNA, 263 bp, Oryza sativa
tagaggaggggctgcaagatgttaccatgaaactgatcttgctaatctggcaatccccgagtagacctgctttgtggctgaccatgtcgttaatttacttccactgcctcacaaagcgtgggtgccactatggctgcaatagtcatcgtcgtcccttgggagcagggacagctgggctctgctaacggcgctggcaccccttgcagcgccgaagcctgcaatactagccgatattcgtcagcacaagaggaccatgcgagcag

SEQ ID NO: 20099 - DNA, 108 bp, Oryza sativa
ttggaggagaggtgcatggatcaacttatctttcaacatgtggaaggcgttctcttgtgatgtgccccaagtgaaaggcactcccttctttgtaagcgcattcaatgg

SEQ ID NO: 20100 - DNA, 553 bp, Oryza sativa
ccaagtgaaagggggcatatgagtttcttcgcttgatatgtgctggatggtagtgagttaggcctcgggagcattttatgcagaagttctaaaagactgtcgaaactggtatcagaccatccatgtctcgcctttaacctcataagttcaagaactgaccgtaatgttgtgaactcactgtcacagcccttcgactcatcgtacagaacttccttagctgccttctataaagcttcaaagtttatttaaacctctagccgatcccatcagcacctcgggttctgcatgacgtaacatttcctctagatcgattttgtcctcaacagaaccatctagggatggcaattttacccatgggtccggatatccgcggatacccgacccgatggacatggacatgggtgtgactttttacccatgtgcactgcccgcccgagacctgaagatgttatgggtaataggcgagtttcattttttacaagtgggtaacccatgcccgacccgatacatatgtattatctaattctgactcattccttaattcttataccat

SEQ ID NO: 20101 - DNA, 6155 bp, Oryza sativa
ctgaacaaatgcatgcaacagttgtaccactttgtatggcaagcgagaacactgaatattttctcattggaccatggtagtgccaggtacgaaaagtagacacttatgaactcaatatccccttgaatgtcatctagcttcctacctgtggtgctgtatgcatcgatcttaggttccctgttgatcgtttccaatatcttgtatactgcagcctggcctcctgcaaactctctcatgcttggagatgcctgacctgaagctctggtgaatgcaacagtaaagtttcagcttctggaactaataagtagttactgttagtttaattgaaaagaaatatcatatacaatcatggaaaacatacaatagcacataccgactgtagtagctaattcattgactattgaaaactcatatactgaaattgtctgataaggttctttttgaaggaaaaagagatgagaagaagcaattttttaataaaagaagacgctatgaaaatacaattgacgtaaatccaaaaggcctgtgttgcattattgcctttgtcgaatgagataattcaacttttgtgacagtgaattggtattgtgttgacaccaaaatataaagtggatatgctcttagtttgttgctgctaactgaacaatcccttattagcaggatgttcacgaaaacaaaatatacgtgcacacagttggtttagcaggatgttaacgaaaacaatcccttattactgtcaagtgtcaaacagcagctaacttaccttttttttgtcctggccgaacatgtctaaatcagcacaaaatcaaaatactccaatgggtaaagaccattttatcagtcaccaaataactaactgaaaattctatgatgatattatttttttcaatcctaaaaacttttatactcataatatttcttacaaggaaaccatttgtcaatcacgagaacaatgcaactgaattgattaggaggatggccgagaaacttacagcaagccgatgagcacgacgaatatgacattcatcacttgtgctccggtgcatgtatatcccttctccaggatcagcttggcatcataagaaatccccagggagtagccacagaagaggagcactatgaccgtgcccatggccatgccggctgcgacgttctccggaacgttggagctgtacgtgctcttcatgacgcaacctgcatttgtcggaccgaatgttcagagacatggcgacatgtacacaaagttaactgaagggaagactgaatgtttactgttctgctgcgcgaaggccactgcgaagctgctcaggaatgtgacaagaagatggacaaaattaccgatcttgtcacacattctcaagacgaccgacgacctcaccggtgtcatcgtcgtcacctcccaaccggatcggaatcacaagcccatatcgtccccgtcactgccccaccgcttgccgccgtctccgcaccatctagacacaggcagagaaatccacctaggagaaagacgagagggaaagaagaggcgaggggacaaagaggagacgacaacctgtcaagcgagaaggagagatctttcttttagacaacggcagcgatttcgtggcggcgttgtggtggccggtggagtggaagaggaagaagcggcgccagcaagagaaaccgacgagaaatccgcgcggggaagacgagacggggcgcgggctcgagccgaggtcgtcgtgacttgtgtcgcatcaggtgctgctgcgtgcacgccacctcttctctcgtttccttcttcactaagccacagacccggccactccgatggcggcgtgcggcttgatccctagtcaaacagtacaagcaaaaacttaaactcccttatattctgtagcagtagctatctacaaataattaaacctctctattgcaacggggttagtatcaagtatcacaagtatgtttgtcacccatgagtcatgactagtgtcatgttgtgttaccattaagcccattttgaactatggattttaccgaaagctgtaaaattccaagggaaatgtatgtatgcaataatgcaagtgcgagtatgcaacacacctgcggagtgtacttcatatgcttcagttttggaagggtcccaaaaaagcattccttgttgggtcatggacgcagccttattccctccagagaactttgacattgatcctagtatcctacggcccaaaaagccacatgaccaaactgcccctccccccagcacgatgaccgtcaccgacccccttaactaactccccagtgtacctccacgccgtgggagctgagctgatctgatgatcccttctcacttccaagtactacacgaatgtaacaacttgatgtgacctcagttcttctcccatctcctcttctccccacctcgcgcgcgccgccctgcccagatgtttctccactccctcttgatgcaaaacatggccaagaacacaacaacgcagcagcagcagacgacgaggtacgcagttaggcgcaccttgcatgtggcatgatgatgattgcttcggttctacgtgtttggctgacgtgatggttccatgcgcaggtcgtcgaaagaggcgggcggcggcgccgcggcgaggtcgagaggggtgtcgtcgaagaagtcgccgtggtaccagcgggcggttgaggtgttgctgctgatatggaagcagccgacgggggcggggacggggacggggacgacgacgaaggccgcggcggcggcgggggtgacgggcgggaaggcggcggcgtcggggatgggggctcggctgaggaagtcgtcgtcgctgaacgtggcggcgttgttcacgcgggtctgcctgtgcgcgcccatctcgatgtacaacgagcaggcgctctacttccaggcgggcgacgtgacgccacaccggagctacagctacccgcgggcgtcctcggcgtcggcgtccgggtgcggcggaggcggaaacagcaacccgctggtggcaccgccgcccgcggccgagcagagggcgctgatgaggacgcctggccccggcggggagagcgcgaggcggccggtgttccgcggcaagtcgctgacggacgacatcctgatgcggcggttcgtcgtcgacgaggaggccacgcggcggcgcaacgagatggaggtgatccggagccgccacgcggccgccgccaagcggcggcgcctcggccccagcccgctccgccggatggccctagcggaatcggagtcggaggccgacgacgatgaggaggagacgacgacgacggaagcagcggagccgacgtcacggtctcacggaggaaaccccaagccgtaccagtcgcagcgtaacacttctgggggtccctgtctcccctctcaattttttttccttcccttacacttcttctcccgttccttgtgctcttgtcgttgtctcgcaatgatgcaagaagaaaactccgagcaacacgcgcgttctcttcgactcttccatatcgaccgatgcggacgtcccgcccagcccagcgcccgccccgcacgcaaaagtacgcgcgcgtcgtggagaaacccggcgaaaccgacgtgtttcccccgcgcggcgtatgattagggatcgagcaatatatcactagctctatccattcatctgctctactagctatatgctatacaccaggaaaccggccggatatccatggctagctagctgcatatgcatgcatgtatcatgtgcgcgcgcgtagtatacgtatatgtgcatatgcgttttcttttgtagaaaagtaattataaaatataagcacgatgcatgtactggtgtccgcatatctggaaaaggtagctatacatgaaacaaaataactaacgatgatatagatatatagatagagatagagatagatagatagtcatgacgtgtacaagcatatgtataagtatatatacatgtatgccgcatgcaatggcaacttggtgggttcgatcaaattaaaatgaagacaaattagctaattagaaatgctacttaattaattaattgccatgcatggctgtagaaatcaagtgatacgcactattagaaaaagcattatcgcaagcggccaaaaagggtcttcgcaagcggggcggccgtccgcctgtaaacaaacgactatgaagatcgccggtcttctcatgcggagcggccgtccgcctgcgaagataattttcgcaggcggattttcgcaggcggacattggctagtccggttcgcctgcgaaaatagaaagcggccgcctgcaaaaaaaaatagccgcctgcgaaaataggtaggaaattttgaaatttaataataatttgtccgttaatagaaattcttgtaggtagattattatgtacatatattggaagattatcaagcatttggtattgagaaatctacatatattgtataactcaaaagtgttaccaaaatatatatattacaatattttttacattgtgacttcaaatacgccatctagtcatattatggcatagcagtgttccactccagaagatccttgaattcgtcacttgtcgctagggcaccatctgggtcgaagaaatctcctttcacatgacagcactcagagtggatgaagtggcacagatcatgctggacatttgtgatgcctgtatcgtcaaagcttgttcgacgttctaatcttggcaactgcatgcattgaagataaacaatatattaatatcataaacatgtgaagcggtctagtacatagtatagagacttacatcctctgcgttaaccctatacctcccattaaccctaaggaattcccacgcgtaatactcgcagaggacagttcctctaggttgcttgtgacacttcaggacatatcatagaaaaaaaaagataaattttgcaattagtgaaacaattggaatacattaagtgagtgtagtattaccggccaataggtacgtactagcagctcctctcttattcgggtctgttctccacccttgaacttgtagtattggtacacactgtatggatgtcgtaccatttcacattaagaaggatacttatttataatacattcatataaaaatgcaagaatcataatcacttactactgtaagattgttagaaattctttgtatgactggtgtttgtaatcgagagggtccaagactaccacggttccgtctttagggtggatgagtaaacagatataatgatcgctacatattaacaacagcatagttagttagtaccagctaaaataagacatatgtgtagaagataaatgtaccggacttactcaaaattatgagcggccatgacgactctcttattttgaaagtgcaagaaggctcgttcaatgtactgtgcgacagtaatcaacttctccttgtgcaggcccttctgatattcagctatctcttttggagtcttgcccttcagctggtctgaccctggtgctagcctcacggtatgctgtgtttgacagatctgagttggatccaagaagccaataggttcttttttcttcttagcatccatgttttgcatcctacagaagaagtttgttagtaacaatcacatgaatttgtattgtacatatttttcatgtaattaattaaaactcatactcacatgcaccaaacaccgacatagttgacgtccatcttatcccgacgatatatggcgtggagatctgacaaatctagccatatgtaaccttcggcactgaaacaatctgccgatgatcgagctgttatattgcccaagcctttcttgttggcttccatgtagaaggtttgtaatcttctcatctcctatggtccttcgtttagtgcccaatccggcaagagtgctttcccgtgttcgtacttttccgggcaatcatcagttagccagtatgttggcccggctagttcagcggccttctgggggtcatcatctttgtgtttggcacgttccttaccccctctgaagacggttaccatgaacttctccttgttctcatatttggacttgtagtcgtggctcctaagcactctaggcacctcagaactggtagtggccttctcagggaccggggtctcttgcacctcggggtctttcgcaggagaagggtcttcaaatatttctggctctgtaccgtcccat

SEQ ID NO: 20102 - DNA, 1070 bp, Oryza sativa
tgttgtggtgctttttggaacttttcattccggtcaaaaacatcgcacctgtgtgggccatataccaatattggcattaattgacaaaagttcaccgcgcgaatcacgatgtgagttttttccacgaacgcaccaaatacactccaatatgtccaaaaatcatgttgtggtgctttttgaactttttcattccggtcaaaaacatcgcaccctcgtgtgccaacattggcattaattgacaaaagttcgccgcgcgaatcacgaagtgagtttttgacacgaacgcacccaatacactccaatatgtccaaaaatcatgttttggcttttttgaacttttttattccggtcaaaaacatcgcaccctcgtgtgccaatattggcattaattgacaaaagttcgccgcgcgaatcacgaagtgagtttttgacacgaacgcaccaaatacactccaatatgtccaaaaatcatgttgtggcgctttttgaactttttcatttcggtcaaaaacatcgcaccctcgtgtgccaacattggcattaattgacaaaagttcgccgcgcgaatcacgaagtgagttttttccacgaacgcacccaatacactccaatatgtccaaaaatcatgttgtggtgctttttgaactttttcattccggtcaaaaacatcgcacctgtgtgggccaatatataccaatattggcattaattgacaaaagttcgccgcgcgaaccacgaagtgagtttttgacacgaacgcacccaatacactccaatatgtccaaaaatcatgttttggcttttttgaacttttttattccggtcaaaaacatcgcacccttgtgtgccaacattggcattaattgacaaaagttcgccgcgcgaatcacgaagtgagtttttgccacgaacgcacccaatacactccaatatgtccaaaaatcatattttggccttttttgaacttttcatatctagcaaaaacatcgtacctgtgtgggccaatatagactaatattgggattaattgacaaaagctcgccggacgaaccactaagcgagttgttgac

SEQ ID NO: 20103 - DNA, 3121 bp, Oryza sativa
ttttatttatcaaaatcacaagtattaaagttctgtccagattatttcaaaatcaatttttcatatttgtaatgacccccataatgacaaggaagaccattctaagcatggctaagcattatagtaacctagtgactccaaaattcatatataaagtggtatagtcatattgttcctaaggttaggaatgagggatatggatatatgtggggtcaaggtgaatgcaaacaataggagtttgtctaacaagtttaacaaaattttaatttattagtgtacaatcgacatgcaagatttgcaaacattttcaataacctccaaaacataggttcaaagtgatcaaagagatggaggtgggacttgccttgaatcaggaaaatgtcagcacctaaatcacttcttcaccgtttaagcaatcatctatacaaagtacacgttatgcaattaaacaccgaaatatgcgaaaaatccaaaatgctctaaaatggatgatttgtgcacagtgaataggtactggtctaaaattaatttaggtgaaagaatttctattttatctcattttatttgggagttatgaattttagaagtttcgtcggtatagtgtaggatttacttagttactgttgtgaaatgctattgtaaggtaattcttattaagtttatgtttgctggggtgaagatatgtgttttctaacactaacacatttggtttcataatttttagagttaatatgaattctttatgtattttacaagttttaacgtgtcatggctttagaggtttagctctagaacttgcctcatctagctagtgatgtataaaatgagtattttagttaactaatctaaccttagttcataggcttatggtctttattatcatggttcatattttataaactaagggagctctagtccatgttagcaatttattatatcaacctagaaattattatatgagctaagtgccttaagttttggtggatgggaatggaactatgcattcactggtctaacaagttttatttgagtttcattatagctagagtgtatttctatatacatttatatatatacatattgctcaatcgatactatgtgattagcacctatcctataaatttaaagtttagagctataacctgtacagaaggttccatattttattttactatgttgaagcccactgtttgctggttctatagatatttggttcacttcatttagactaaagatgaattttctacaaattttacaatttaaggttgctctatgatggttattacttacataagtatttagaggcttttatcatacagtaagtatataattttattttataatttggaagtatatgttttggtgattctacagaacttgggtttactaaaaaagatctaagatgaattttatatgaacttctaaaattcagcttatctaaaactagtcatttaaaggtaatagttttagaggcatttgatgtatagtatgtatactatttcattttgctttataggagaacataagttggtggatctgtagaaactgagtttgctccaaaatgagttgaaatgaattttgtatgcattttataaattttgtgcgtgctttctgtgtgatttaacttggataaattttagaggctaaatttgtactgtgagtgcaagtttttattccataacatcaaagttcccaatttggtgagttcacagaaatttgaatcatcttaaaatgagctatatttaattttatatggatttttacaagttttagttactgttcttttataatttcagattttgtttccaaggggtgcactgtcagtctcaggccaatatgcaaaaaggctcctatagtttcaggaaatcaacccgcagtcctatgactgttctgtgtgtcttgagcttttgcataaagagccctatattaacctaaattcttgtgacgaggtccctggttcgagctgaagcagatcaagccatggctgagctcgatctcaagcttgccagcggcaaacggtggctcgtttgagggtgcgaccaaaagacaaaatgaagatcatgctattgcgattccattcctcttcttttcttggtcagtggacatcggagtaacgccggcggcgagtccgagcggcggctgtgcttaggctgctactgcatgttgagttggtgctcaattctaagtgaatgaaatgcatgaatgcaatcctatgggctcaagggtgctcaccgaaccttgaacgaggcgccggaaagtctggacagcggcagcggagaagaagatggtccggcgacggtgtagagctccgggaagacggcaacggctcgatccactcatcgaattgacatgcatgtgttttcatggggttagtgaggtcccagggatggtgtatacgcgaagaatcggacaatggctcaccggaggaggcggaatcgacaatggcgacggcgaccggaggtggagaagacggtggacgatctccacactcgtagcaccattcttgaagattcttgaggggaaatggagaggaggttgaggtgaagctggtggcgtggtggctcgctccggcttgatctagattgatggcaacggcgacgatgttgctgcggcggtgcgcagagcgcgctccagagctccggtgtgcatggcagcgttcccgccgattggctgcaccagagaggatgaaatcaaaaggagaaatattcggcatggtgaggagagtatggaacgcaagagaagaggaaacgaccgcggctcatcaacgattgcggccatcgtcttcttcgcagccggtgatggagaaccagtggagaagagcagcgaggatgctctccctcgtatggatcggcactggaatggtgggtgaagagtggcgacgcgtctgggagaggcagaaatggagctcggcgtttttagggcgtcgacacgtcgtggccacgcgtcgtgcggcgtccagagccggtcggcgctcgatctctccctctcagtgtttctcggtcggctagggaagttgcacagagaaagggcaagccggagggactgacaaggggggcccaggtcgaagtaaactaggtggaagaagatgtgtaggcagaaacatgggtgagcttggtttttg

SEQ ID NO: 20104 - DNA, 5390 bp, Oryza sativa
agagaagataaattctgaaaaaattatttttattaatgataaatgacctagtatttgaataaattattttacttatacacttctatgcagttaaatgcacttttagataaagtatggttttagccgattaagaactacagttaatctagtttttattagtttgactgatttatttgaggtgcaaatttagttattaaatcataccaaaattacagtgagttgtatgtgttgagtagagcctacatgaattttcccatgattttatcttgcacgaattattttagataattctcaagatttatgtcttatatgtgtttccctttcctaaatgcatgtaaatgtttataaaagttatatttggactctcattaacctgaggtgataatgatatgttagaatttcagtttaccttacacaggtcataagctccttacctattatgcacaagtttactttagtattaaattaagagaatgcttatagagatgattaagatagaatatatcctatatgatataatttatttggtcacttccatgttcatgactagtcttcagatggatgaccaaaatagttttgtggggcttggcattggccttgttgatatattttaaggtgtatggttcctattttaacttcctctagctagcactaggccctaatggttcagttgtttatctagatcttagttaatattcatgagacctattatgatatgcaaatcgaaaatccgaatgcaatccaaatccaaatgcatatgaaggactcaagtcaaacatgtctatgagagtatgcatgcttacacataaatttatatttttgtcctaggttagagatgcaaaggtttttaatttgttctaaaattttatcatgcaagagttagatcaacttcacctaggtttaaaatggaaatttttggtttacaaaatagaagaacttccctttcaactagttttgatggaaattccttaatcctagaattcaggtatgttacagtattccgggaatcatcaaattcctatccatccggaggaccaaagtaagactacgttcacaagtccgtacggtacctatgcttattgtaggatgtccttcggactatgcaacactcttgcatcttttcaaaggtgtatgatgtctattttctcggacatgatcgaggacattatggaggtcttcatggatgacttctctgtctatggaaagaccttcggtcattgtctgcagaatttagacaaagtcttacaacgatgccaagagaaggacctggtactcaattgggaaaagtaacatttcatggttctgtgaagggattgttcttggtcatcgagtgtcccaatgaggaatcgaagttgatcatgctaaaattaacttaatagttcagcttcctcctcctgtgaacatcaaggggatccgcagtttcttgggacatgccggcttttatagaaagttagtggaaatggaaggttcgggttgtgtctcgattgttgaaggtttctctatcttggacacggatgcctctggatagggctaatcagattgtgtcatgaaggaagtattttctagaatgcgatctagaattacttttccttccgacggtgttttgtgcatgaatgatcctccgacggttatgtccagatagaatgccgattccttatccagactcgtatgaaaatgttgcaaaagcacatactcaggaaaggaaaaggttggtccggactgcactaaatcagtgaatatggaccaggctgcaccgatcgattcgtttttgatctgctggaaactgaggatctctactcgaagggcaatgatacgagtaactgggaagaaggcaaggcagaatcggtcacgcaaatatacaccaacacttgtggattatgtgagattaaacacctattactatgttcgatgttttattatctagactttatgcagatgttggcgatatagaatcagcatttaataaccgccaacatggacgtccaggattgctccataatgacagttggagggcgtttaggacatttcccatacaataaccgtcatctgaagcctataaatagagctcctctccctcattccaacacacaccaagatgtagagctgaattacaagaggctctaagtatactttagcttctttatatgttctatagtatacttagaatagggagagagtaaagtaaaagaagtcggaggactcccggagttgtcggtaatccactccttattcttgtacttttttaattactttggttcaatagaaatatcattctgagtaattaagattttcttagtgagaattattctttgttagttcctaataagcatatgtgatcattgttcactatagtccattaattatatatttattgctttagtgtttagctagcacaagagtagttattaattgcgtagacgtgttgtctgggcaattgatttccagtggttgctgcgtatcccacggtacgttagaggttggtgtagaggtggtgacagcgcataagagcacttaagtcctccctgtccaggtacgtagtcgagcgacatctgggaatagcgggttgctagtgcctgaagtatcgtgttaggattaaaattaagctttacttagacactgtttctcactaggaaatcttctctacctttatccatatttatcttgtgtcattgatgaaccggaggaagagataatcacacatgtttccttggattcgatacccttgaaatactccataggggaagtgctacatcggtatatccgtgcgcttgcggattctatctgtgatcgtaagaaacaccaacaagcatttctggcgcctgtccatatttttctattcttctacgttcaccctgctctatccgaagaagtttcctggaatacacttcttcctcttctatggagcaacctatctttgaattatctgctcatagggatgaattttatgagtgtcacgaccggaattaacccaacgggcgttccttacgtgtgtgtattattccttgtgctaggaggcaaggtacaccaaaagttgatacatttcagagtttatccagcggaagcataaatagttaatttattacatgggcggcgaaggcccagcacacacaaagacaaacgggaaacagcggaagactagggcgacgaccacaggcgcttgacggcaggcacgagctagacaccaaagccttcatcttccaggggctcctcttctgggtttgggaaaaattgagcaagactgagtacaaccaccgtactcaacaagacacacctacaagtgcaggttaaatgcaagggagtacaagggggttataatataaagggttagggtttgcagtaaacagcattaaaagacacttagttgctcaaagctattttgtaaacacgattccagagctatacaatattattaaccaaggccgtgaacccacacgaacctgccttaacccaaggcctacaatgattcagaccgaactggcaacccgaccctgggtcccagcttgtcccaagccaacccaggacaaccattccacattttagttgttaagcaggttttaagaattaaaacactaacttcggtacattgctcggcttgcccataaccgagggcgcggctattcgaatagattatactctaatcagaggtgtacatctttacccacaagacacatcttcctcacgtgtaaccacgtgccacataccaccacggtatacggacggaagacgtgacatagtttccaacccatcctagccatagacaagagtaccgacccaaccccacctacggccggaacccacgggacaggtaggcaggactgagcccctagcagcaggacaccggccctgtgccatgacatctcgactaccgggccgcagctcgtgtagccttcatttgtcctagagatgtccatcgacccccgacttcgtccatctcaatccgtgtactattgtttataaccagactgagccacaaactaagccttacccactagacatgtggaagtacggtagtgctttgcaacagaggcccgaagaccggtccttatatggccgaggtgctactatcaaaaccatgcaccccgagcccaggctaaaaccattttgaggattttgaatagagggggaggtgtgaatccaattccacaataatccaaccattccatagtgtccaggtgatatgaatatcctaaagtctagagttgtaaaaccacctaatgttgcctaattaaccagcgaagcatctacctaaaatcatactagtggtaccatgagtagagtgtgcactagttggggttttgtttattctagggtgaacaaggaaataataacaataacaataataagatcataacaaaggtaaataggcatggctatataaaacagtgataacgcgggaatttaaataaagcgataatgcaataatttaaatcaacataattttataaactgggtgtcacgtcccaaaacgactctaaaatacatcctctaaattatgcctagaatcattaaaatccgtgggaaagcctccaacaaataaaaggtgcaaagttaaaagtcaaataaggcttggaggatttttgtatatttcctaaaagcgtaaaatgcgtaaataaattttggtggaattttcagagcacaaataataattattaagaaataaacaaagttaaaatggttttataaaaagaaaagctctaaaaagtccttttttccctcctctaccccttgggccggctcggcccatctccttccccctccctctcctctcctcgcggcccattcggcctcctctccttgctgacgggtagggcccacccgtcatccccttcctcccgccgctcccgccgccccgcccacgccctagcgccgccgccgccgcgaatcccgccgcccccgtgtcacgcccagaaatttagcccaaatttccagactattttgtgtattaaatccctgtccaggaccagccagggtacacaaaacgacaagtaataaacagttccaaacgtaaataaacggaaaatacttacagaagaggcacttagtcctcacaccgaaacaaaagcagcagcagcggaaaaaggcgaacctagcggggcttcagctccactccacaggcaaaactcaactggggtctgagccttggtcctctaactccatcttcagctcagaagcactacacttctgaaaaagggggaataatagcaaggctgagtacaaccaccgtactcagcaagccacaccaacgatgcagacgtgcaaggggatacaaggaggggtttgaggctatttgcataaaggcagttgtaaaacattttattgagcaaaacagtaaaactgttgagtaattaaagtaataatgaatctccactgatcaacgctacaccacgttg

SEQ ID NO: 20105 - DNA, 2432 bp, Oryza sativa
ccgttgcccacgctggcttgtggtaagtacgataagttcttccagggcatcccgcgaaccggtcgttaattgccatgggtgcgactagcaaaaccatgcacccacagcccaccattcagttgcattttagttggataattacgaccatgaagcatggccagatgtctcgagcacgcagctcactctgatactaaaaaggtctaataaagtaattatcccatcaactgagctagtggtaattaagcatggctaagcatatagttctagctaagtcacataagtaacacgagctagtcgatttattacccaatgttgacaaaggatagatatcaagtaaacatggcacaagcgagcagataggtaaaccctgatcccgtgtaattagcaaaatatgcatatttatttgtaaacagtaaaacatttgtaaattaggatcaaaatgctcaaggggaatgtgtgacttgccttgcttcttcactttgatcttccgaactcttttccttgcgaccgcggacttccgaaacgacggaaactacacgctggcacgcaaaacgaggaaaatctctaataaaaaccaaggaaacagtacataaaaactaaacaaacatgtagagctcaattttagatgaattttgcaagttgaatggctcaatttggagttcgaatgaattagatatgaattttagaagttttgagccatttaaatgaatttctagaattattaacgaattatgacgcaattattatttatttttccaaaggaaaagagggttgctgacgtcatcaaaggggaggggcggcgccggcaagcgggccccaccggtcagcgggacaagggcgccggtccaccgtggaccgggaccaccaaggcggtccaccgccggtccacgggaaccgatggcccggatcggcccaaaccgatcgagcggccaggggcggcgcggctggggcacagcacggcacaaagccagctggccaaacgacggcgcgcggcggcgcggccacccgcggcgacggccggcgacagcgcggggaggagaggagggatgctcaccaagggcggcgacggcgagactacaacgaggaagccggcggcgggctcctcggggaggcaacggtggtccggtggcgtaccacgggcgcgaggcggcggacggtgaccgggacgaccggggcgcggagagggcgatttcagtggttcccggaggcgaggaagcggtggccggggtgcggctcggagttgccgatccgagggaggaaacggcgcagtccggcgtcgaccggggaggcgaggcgacacagatggagatgacaaacacggcggcgatctcgggttggtggtgaagttggtgctcgggcggcgagaggcgacaaccgagcggcggccgagcttgactttgaggcggcgaaggtactggcagtggtggcgcattggggcgacggctagggcggcggtggtgcacggctagaggcggtgaaaggggcggcggcctcgggtgtgcggtgggagtggtgctcgagcggtggagagggggaaataagaggcggccggacttccccttgcggtggcgaagctggcggtggcggcggctcggcgcagcgacggctgtggcggcgggaaacggcgaccggagttcgccggagtgtggcagcgcgtgggtgcggcgtggggagagcgagggagagtatgccgggctcgggaaaaatggggaaacggacgaggggagcacggggatgctttttatgggctcgggaaggcgggatcgaggccggacgtggcggaatcggccggcgaagtggggcgccgatgtggggtggtggaggggttaaccggcgccgattttcgcggggagagtgggggaaatggtggaggacgtggagaggatcgttcccacgtcgttggatgcgagcttcggtgcggaagggcgccggattttgcggcgatgtggacggcaatggcggttggggtcggccggcgagaggtagaagaaggagctgacgggtggggtccacgggtcccacctgtcggggagagagggagggagggaccggctgggaaggtaaagcagacttgagggagagagagacccgagcgggccgagggagaaggccagcccgagagggagagaaaagggcgcgcgggccgagggagggaaggaatacttgggccgaaaatggcccaaagagaggaagggggattttaattgttttctttttattttaattgatgcaatgatctttgtgctattaaaactatttctcgagctccgaaaattcacggaaaattccggagagtacattagggcacaaagaatattacaaaatattcccggccaatgatttttaaaggaaatttttaattccctcaataattcacttgattgagttgatttaactttaatttaatttctagaaaatgtattattaattga

SEQ ID NO: 20106 - DNA, 405 bp, Oryza sativa
ggcccgttacgctccggaggatgtgcgggaagatgaggagaagcaagagaagttcctggcaggaatggaccctgagctgtccgtctgtctagtctccggggattatccggatttccaacgtctggtggacaagagcatccgcttggaagccaagcacaaggaactggagtcgcacaagcgccgcttggcgaatttccacaaccaacagggtgctaaccaaagggtccgctacaccaatccctatccagggggatcctcctcgcagcagcaacagcagcagcagcaacctcgctccgcgcctcgacctcaattcgtggtgcgcgtcccacagccgcagcaggagcagaatcaacaagggactcgtgcgccccgtcctcctccaccgactgtgcagcctggtcaagg

SEQ ID NO: 20107 - DNA, 3197 bp, Oryza sativa
  unsure (1)..(3197): unsure at all n locations
ggcccacctgtcgggcccgtctccctcctcccgccgatctcgcgctcgcgccgccgcgccgaaaccatttttttgcccacgtncccgccttccccgggccacgtcgaccacgcccgcgcgtgcgccgcgtctccagcgcccactcccctctatctcccactcgcgcccgcgcccgagatggccgggattcgaaaatcgaatcccgcctctctctcttccccattcccccacgtcggccggcgatttccgcctctcccggccacgtccggttctctcttcccctttttaagcaccgccgtcgccccctctcactttttccccatttcgccgcactctctcgagcctcccatcgcccccgcgtcgtgcaacctccgcagccgccattttccgcttctccggccgccgctagccgccgttagggtcgccgccaggccgcgccgtcaccgccgtcggattcgcgtggccgagatccaccccgtccacctctcctccgtcaaggttcgtcgccggagccctcatcccctcgcgcacgggtgagcaccacctctaccgctgccttcggccatggtttccggtcgccgtggttcatctccctctctctaatccctctctcctccttccttagggcaccccgaagctcgtccgctcgccgacgtcgtcctcccgtggcttgccgtcgccgttcgccatcgtcttcctccgcgccggccaccctcggtgaggcacccctcccttcttttccccttcctctcctcttagtgtcgcgcgccgtcgccttcgactgccgccgccgcctcccgtgctgccggtcgccgccgtcgttggccgcatgccgtcgccgctagacctagccggccggtcggttttgatgccgagccgagccggcggccgcctttatcgccgcccgttccctccccttcctagccgccgttagcgcagccgcctccgcatcgcctttgcgccgtcgccttcgccgccggttgtcgtcgccggcaacgcgttcgcgcgcgcgccgtcgccgtcgccgcggtcggtcggccggccgtgagccaagccgagccggtgccgctgccccttctctcccgcgccgctgaccagtgggtcccgcgtgtcggcgcccttcctccctctcccgagtcgctgaccggtgggccccgcatgtcggcgccgcgcccccgtgctgacgtcagtcctggttaatattgcgcaataaattatttaaggatttttgttatagtaataaacacagtgaatcttctaaaattcataactaattcatccgagctccgtttaatcccattcaagtctcagtaaatcaagaaaaatgtgtagaatccattaaaaatggttttgttccctgtttcagtagtcttatagcctgtttgcaatgtttgccttgtatgtcgctagattccggctcttccgacgctccggtgtacttcgagatagtcgccgaggtccctccagcagcagagcaaggcaagtcatgcttgtcacttgatcatattgatcctatattgcaaatgtcctaatgttttctttcaaatatcgcatttgttttgcaatattactatgggatggttacctattgttacagccatgctaatttgataccatgctcctttgttagcttgggttataacatgattagagttaggactagggtttgcttagccatgcttagttcaactagcacacaatggggagatctcatttaaaacctagactataggtttatatgataatgttggactagtgacaccgcttgggtgttggttaattaaaatgaatcacatggtgggctgtgggtgcatggttttgctggtcgcacccatggcagttaaggaccggtttgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccgggatgtcgtggtggcatgtcggcgcacggaaacgtgtcgtggggctgtgtcttgtgggtacatttgtacacctctgatcagagtaaaactattcgaatagccgtgcccgcggttatgggcagtcaaccagattcaccgtaattagtctcaccctagtgtaatcttttgaatttggatagtttaggtggatggttgggcctgtcgcaacgtggtgtagcgttggacagtggatgattaatactgcttaattattacaactgttttcgcattcaattcctgtttataaatgccagtatttatgcaaatgaacctgcttagctatcccttgtggaatccctgcatcatacccccgttccggtatgacttgctgagtacagtgggtagtactcagccttgctctattttccccaatcccagagctcgagtatgtgtccgatggcgggttctccgaggagtaggctttgtccgtgccgtcgaggatgcctgtggagtggtgttcccgctgcagttcgagtcaaggattagctccagttatcttttgttttccgctgcatttttgtaagacttttatgatgtttgtaagacgtggatctgaatgtcaacattgttgtttgtgtaccccggctggtcctggacggggattttaatgcacattctgcttggaattctattcgggaatttctgggcgtgacaagttggtatcagagccgaccttgaccgtaggacaagccaaatggaaaaacctaagagccctctgaatccttttcattgcatatgttctttgcaattggattttattccgggaaaattgggatctgtttttgtggttcaagggaaaaaatcttggtcgctcgttaagtgagttttttcaaaacgggtcagtctagggttttagtaaaactattgggatttattcgtcagtcagttggggtttgatgggtgaaatgcattaggtcctagctcaggaacatgggttgcaaggtatttatgctttatttggtattattagtatatatctaatttctcattattttatcgttatgtgggtctgtcttgtttattcgctctc

SEQ ID NO: 20108 - DNA, 5639 bp, Oryza sativa
tggcgagaacgacaccacctttggtcacatgtgtgctgtgatgaggggattggacaggatgcactcggacctgcacaaggcgaccaaggccttgaacgatgggaagctcatgaggatcgttgctctgaaggacgagatagcgcgcctgaagaaggagaacgctcagctaaagggtcttccagcgccaggaggagtccggatccgcactacgccccgcaagactacgacggcacccgtgcgcatccagcttgcgcccaggaacccacctccagcagcaactcccgcagcacctccagttccgcccgcagttcctgcagctccagctccagctcccgagtccgctctctccttcgctccagcatcagccgccagaggtccagccagtggcaccggaggttggttgtctgctactcccagtggcagcggcgagacgtatctgccaggctccaggagtcgctcagagggacttggtgacgagcaggaggacgccttcgactccaccgaccgcaggagccgttccgagcattaggctcgtttttcccattagtttatcgactgtctagcttctgcttgttagttggtgtgtttaggttgcttgtttggggtcagtcgacggtcgatatcatgtgcctatgatatggctgtcttaataaggatttttgcttgctctttaagtgttttaattcagatcagaacaattgcagttttaattcctttgtaataaagcttagtttctgagcatctgtttttcttctttcccccccgtctgcttttccctccagatggtctacaccaggactggtagccgcgcaacaggcgagggcagcaacggcgaagaacgcgctaatggtgtgcaccccagcagtgattccggcaatggtccgccaccacttcctgagaatccgacgctagcccaagttatggcacatcagactcagatgatggcagccatgatgcagcagatgcagcagcagcaccagcagatgcaccagaggatgatgcagcacgccgaacagcagcaccagcagtttggtccccctccccctcagtccaagttgcctgagttcctacgtgtcaggccacccaccttctccagcaccaccaaccctatggaggcaaatgactggctccatgcgatagagaagaagctgaacctcctgcagtgcaatgatcaggagaaggtcgctttcgccacacaccagcttcagggtcctgcgtcagcctggtgggacaatcacatggccacccgcccaccgggtactgaagtcacttgggtagagttctgccgtagcttcaggaaggcacaggtgccagatggggtcatggcacaaaagaagagggaatttcgtgcactccatcagggcaacaggactgtgacagagtacctccacgagttcaatcgcctcgcgcgatatgcaacagagaatgtccgcaccgacgccgagaagcaggaaaagttcatggcgggtttggatgatgagctgaccaaccaactgatatccggggactacgctgactttgagtggctggttgacaaggcaatccgccaggaggatcaacgcaacaagatggacaggaagaggaaggccgctcagttcagggcacctcagggaagtcaccagaggccgcgcttcactcccggacagcagggtggacctaccaccatgatcgtccgtcagcaccgcccgttcaactccagcaacttccaccagggctctagtggcagtcagaaccaccatggaggtcagcccaaccgcggtgcagctccacgcccacccatggcaccggcacagtcaggcccgcccgcgcaagccaagaaggagacgggagcaaaaccagggtcctgcttcaactgtggtgagcttggccacttcgctgacaaatgcccgaagcccaggcgtgccgggccaaggtttatccaggctcgtgtcaaccacgcgtctgcagaggaggcacaaacagcaccggaggtcgtactaggtacgttccctgttaactcaatccctgcaacagtactttttgattctggtgcaacgcattctttcatttcaaagaaatttgtggggatgtatgggttaaggaaagaagagcttagcacaccaatgagggttcataccccggggaatagttcaacctcagtcagttttagcccttcagtgctaatagaaattcaaagattaccatttctagccaacctcattcttcttgaatccaaatacctagatgtcattcttgggatggattggctgactaagttcaagggagtcatcgattgtgcgaatcgcacagtcaccttgaccaacgagaagggagaaacggtagtgtacaaatcactagccccgccaaagcaaggggtctccttgaaccagatcgagatggaagtcccagtggtcaccgaggagaagaatttgaagaaattggaagacatacccatagtctccgagtatccagaagtgttccctgaagacctcactaccataccacccaagagggagattgaattccggattgacttggcaccgggaaccgctcccatttacaagagaccgtacagaatggcggccaacgaattagccgaggtcaagaagcaggttgatgagcagctgcagaaagggtacatccgaccaagtacttcaccttggggtgctccggtcatttttgtggagaaaaaggataagacgaagagaatgtgcgttgattatcgcgcactcaacgaggtcaccatcaagaacaaataccctttgccgcgaatcgatgatttgtttgatcaactgaaaggagctaaagtgttttctaagatagacctgtgatcaggctaccaccagttgagaatccgggaagaggatattccgaagacggccttcaccactcggtacgggctatatgagtgcacggttatgtctttcggacttaccaacgcacccgcattcttcatgaatctgatgaacaaagtgttcatggaatttctggacaagtttgttgtggtgttcatcgacgacattcttatctattcaaagtccgaggaggaacatgaacaacatctccgtctagtactcgagaagttgaaggagcaccagctatacgccaagttcaacaagtgtgacttctggttgacggaagtaaaatttctgggtcatgtcattacagctcagggtgtggcagtcgacccatcgaacgtggagtcagttaccaaatggaccccacctaagaccgtgtcgcagattcggagttttcttggacttgcgggttattaccgccgattcatcgaaaatttctccagaatcgcccgacccatgactcagttgcttaagaaagatgagaagtttaaatggacagctgagtgcgataagagtttcgaggagctcaagaagaaattagtatccgcaccagttttgattctgcccgacccgacgaaagacttccaagtctattgtgatgcatcccgtcacggacttggatgtgtcctaatgcaagagggcagagtggttgcgtatgcctcgcggcagttgcgtccacacgaaggaaattatccaacgcatgacttggaattggcagcagtggttcatgctttgaagatctggaggcactatctgattggcaaccgctgcgaaatatatacggaccataagagtctgaaatacatcttcacccaaccggacctaaatctccggcaacgaagatggttggaactaatcaaagactatgacatgagtattcactaccacccgggtaaagccaatgtggtggcagacgctttaagccggaaaagttactgcactgccctatgcatcgagggcatgtgtgaggaattgcggcaggagtttgggcatctcaacgtgggaattgttgaacacaggttcgtagccgctctggaggcacggcctacgctcgtggatcaagttagagccgctcaagtaaatgatccggaaatagcagagctgaaaaagaacatgagagtcggaaaggctcgggatttccttgaggatgagcatggcacgatctggatggtagaaagattgtgtgtacctgacgacaaggaattgaaggatctgatactcaccgaggctcatcagacccagtactccattcacccaggcagcactaaaatgtatcaagacctcaaagaaaagttttggtgggtcagcatgaggagagaaatagctgaattcgtcgcactctgcgatgtttgccaacgagtgaaggcagagcaccaaagaccagcaggtttactccaacctcttcaaatcccggaatggaaatgagaggagattggaatggactttataacaggactgccccggacatcatcgggtcatgattcaatctgggtagtcgtggatcgactcaccaaggtggctcactttataccagtgcataccacctatacggaaagagattggcagaattgtacctcgcaaggatcatgtgtttgcatggggtacccaagaagatagtatccgaccgaggtagtcagttcacctcaaaattttggcagaagctacaggaagaattggggacccgtttaaatttcagcacggcctatcacccgcaaactgatggtcagaccgagcgagtcaatttaatcttggaagatatgttgagagcttgcgctcttgattttggtggagcttgggacaaaagcttgccatatgcggaattctcgtacaacaacagctaccaggccagtctacagatggcaccgtttgaagctttatacggtcggaagctttatacagccatatgcgctttattctgggatcagacaggcgaacgtcaactgttcggaacagaggtattagcggaagtagaagagaaagtcagaatcatcagggaaaggttgagaattgctcagtctcgacagaagagctacgcggataaccgtcgaagggagctcacttttgaggaaggagattacgtgtatcttcgtgtcactccgctccggggagtacaccatttccagacaaaaggcaagttggcaccacgcttcgtgggaccatacaaaattttggaacgaaggggagaagttgcttatcagctagaacttccatcaaacatgatcggcatccatgacgtgttccatgtgtcccaattaaagaagtgcttaagggtacctgaagaacaggttgattcggagcacattgatatccaagaggacctaacctatgtggagaagccggttcgtatacttgataccagcgaaagaagaaccagaaataaggtcaccaggttttgccgagttcagtggaatcatcattcagaagaggaagcaacctgggaaagggaagatgagttgaaagccgcccatccgcacctcttcaccagctcctccgaatctcggggccgagattccgtttaaggggggtaggtttgtcacaccccgaagtttccctcccaagccaaaattgtaatttataaatgaccctaagaaaataccggtgcaaatcaggagaaaaccctaagaaagtaatgcaaataataatcggatttgacatgtgggactttttcttgagttctacaggtcgaaattcattaacaggatttttagtggaattttcagagctctagaaataattttaaccaattaaaattgagcaagcaatattttaattccagggaaaatcctttttcctttttctttt

SEQ ID NO: 20109 - DNA, 5419 bp, Oryza sativa
aaaagaagaaagattttttcctgggatttaaaattgcactttggtgatttttaattggttaaaattatttccaaggctctgaaaattccactaaaaatcttgttaatgcattggagcatggggaactcaagaaaaattccaccacgctatttccgattattaattgcatttattaactggggattcagctctaggttaattaagataatttcttcaggcaatttatttaaccaattttttttaaagcaagaaaatggggggaaacttcagggtgtgacaaacctacccccttaaacggaatctcgaccccgagattcggaagagctggcgaagaggtgcgggtgggtggccttcaactcatcttctctttcccaagtggcctcttcttctgagtgatgactccactgaaccttgcagaatctgattactttgtttctggtccttctctcactggttttgaggatacgagtcggcttctccacatacgtcagatcttcctgaatttcgatgtgatccgtacttgcctgttcctcaggaactctcaaacatttcttcaactgagagacgtggaacacgttgtcgatgccaagcatgttggagggaagctcaagctggtaagcaacttcacctctacgttccaagatcctgtatggtcccacagagcgtggtgccaactttcctttggtttggaagcgatgtaatcccctgagcggagtgacacggagatacacataatcccctgtttcgaaagcgagctcccttcggcggttgtctgcatagcttttctgccgagattgcgcgattctcaatctttccctgacagctctgactttctcttctgcctcatttaaaacttctgtaccaaacaactggcgttcccctgtctgatcccagaagagcggagtacgacaccttcgtccatacagtgcttcaaacggtgccatctgcagactagcttggtaactgttgttgtacgagaactcagcatacggcaagcttttgtcccatgctccaccaaagtcaagcgcacaggctctcaacatatcctctagtatttgattgactcgctcggtctggccatctgtttgtggatggtaagcagtgctgaaattcaaccgggttcccaattcttcttgtaatttctgccagaactttgaagtgaattggcttccttgatcagacacgatcttcttaggtacaccatgtaaacacataattcttgccagatagagttctgctaatttcttccctgagtaggtagtgtgcaccggaatgaagtgagccactttggtgagtcggtcaacgactacccaaatagaatcatgccccgatgacgtcctgggcaaaccggtgatgaaatccattccgatttcttcccacttccattctggaatctgaagtagctgtagcaaacctgctggcctttggtgttctgcctttactcgttgacagacgtcacagagtgctacgaattcagctatttcccttctcatcctgacccaccagaacttctctttgaggtcttggtacatcttagtactaccgggatgaatggaatactgagtttgatgagcctcggttagtatcaggtcttttaattccttgttttcgggtacacacaatctttctcccatccagattgttccttgttcatcctcaacaaaacctcgggcttttccaactctcatgttctttttgagctctgctatttcaggatcacttgcttgagctatgcgaacctgctccaccagtgtgggttgtgcctctagggcaaccacgaatccgtgctcaactataccaaggttcagatgttccaaatcgcgttgaacctcacaacatagttgctctacccatgcaacattgcagtagctcttcctgctcaaggcatctgcaaccacattagccttgccgggatgataatgtattcccatatcataatccttgatcagctccaaccatcttcgctgtctgagattcaaatcaggttgagtgaagatgtactttagacttttgtgatctgtatatacctcacaacggttaccgatgagatagtgccgccaaatctttaaagcatgaacaactgcggccaattccagatcatgcgtcgggtagttgccttcatgaggacgcaactgccatgaagcataagaaaccactttgccatcctgcatcaacacacatcctagcccctggtgagatgcatcacaatagacctggaaatcttttgtctgatcaggcaggattaagactggtgcagacaccaactgtcgtttgagttcttcaaaactcctattgcattcagcagaccagataaacttttcttccttcttcaatagctgtgtcattggcttagcaattttagagaagttctcaacgaaccggcggtaatagcccgcaagtcctaagaaactccgaacctgagtgactgtccttggtggggtccatttggtaactgactccacatttgctggatccacagctactccttgagcattcacgatgtggccgagaaactgaacttccttaagccagaagtcgcacttgctgaacttggcatatagttggtgcgcttttaacttttcaagtaccagccggagatgctgctcatgttcttcctcggacttggagtagataagtatgtcatcgatgaaaaccacgacaaacttgtctagaaattccataaacaccttgttcatcaaattcatgaagaaggcaggtgcattagtgagtccgaaagacataactgtgcattcgaacaacccgtaccgagtgatgaatgctgtctttggaatatcctcttcgcggatcctcaactagtgatagcctgatcgcaggtctatcttagagaacacagtagctcctttcaactgatcaaacagatcatcaatccttggcaaaggatacttgttcttgatggtgacctcattgagtgcgcggtagtcaacacacatcctcttagttttgtctttcttctccacaaagataaccggagcaccccaaggcgacgtgctcgggtggatgtatcccttctgtaactgttcatcgacttgcttcttgacttccgccaactcgttggctcccattctgtaaggcctcttgtggatcggtgcagttccaggtaccaagtcaatccggaactcgatatccctttttggtggcattgttgtcagatcgtccagaaaaacctctggatactctctgactatgggaatatcctccagcttcttagtggttttctccactgctacctcttgttcttcaccaacagcctggtttaaactgatccctggcttctgcggcactggagactggaaggttaccacctctccttttgcattggtcaactcgatggtgcggctggcgcaatcaatcactcctctgtgccttgtcaaccaatccattccaagtatgacatctaggtccttggattcgagaagaatgaggttggctggaaaaatcaacccttgaatttcaactgtcacagatgggcagtagtgagttgtggtcatgccacctccaggagtatgaactcgcattggtatcttaagcttcactaaagataacccatgtgcaccagcaaaacgcttggaaatgaaggaatgggttgcaccagaatcaaacaatattactgccggtgtcgagttgacggggaatgtgcccaatataacctctggtgctgactgcgcctcctttgcagatgcatgattgacacgggcctgaacgaacttgggtccagcacgtcttggcttctggcactttccaaccgtgtgtccgggtttgttacaattgaagcagagttcgggtttttctcccaacctcttgggctgttctggcagagctagctgaactgattgggctggaatctttagtgaactcggagtagggttgaggctgtgctgctcactgttgttgtgactgccactatggtggttcttgttgaagctacccgggtggtaggggcggtgtcccatcgtgaaacgaggcttctgacttttcccctggggagtcctgaactgagctgccttcctcttacggtttattttgttactgtgctcctcctgacggatagccttatccaccagcttctcaaagtcctcataatctctagagatcaactggttagtcaattcatcatcaagaccagacagaaacttctcctgcctcccgtcatcggtacgcacgtcctcaggggcgtagcgcgcgaggtggttgaactcatgcaaatactctataactgttctggttccttgttgcagggaacggaactctctcttcttttgtgccacaattccctcgggaacctgtgctttattgaaactatgacaaaactctgtccaagtaacttctgccccagctggacgggtcaccatgtagttgtcccactaaacagaagcgggaccttgcagctggtgtgtagcaaaagcaaccttctcttgctcgttgcattgcaaaagattcagcttcttctcaatggcatgaagccagtcgtgggcctcgattgggttggtggtgcttgagaaagtgggcggcttgacctgaagaaattctaacagtttggactgaggaggtggaggaccaaactgcaggttctgctgctgctgctgtgcttgctgctgcacctgctgcaacacctgatggtactgttgctgcatctgttgcatcatcattgtcatcatctgagtctgattgtccaacacctgagcaattgttgggttcttgggcagtggggacggactgttgtcagatgcactgttggcacgtgctccattgaccggctcttcgctgccactaacgttgttggagtcgcgtgaaccattccttgtctccatctgaaggggataggtagaaatatgagaaaaggaagaaaaacagggggctcagaaactaatcttgcttatgaatttaagtgcaattatcttaatcttgattaaaacactgaaaaagaggcacgcaactcctaattgaggcagtcataccactgacacatgatatcgaccgccgactaacccacaagcaacaaacctaaacacgaaaactagcaagcaaacagactaagaaggcgataaagctaagggcagcgactctgaagctcggggcggcgcttgcaaacgagggataggactgacatctaaagtagacaagggataggaaccaattcatgctcaaatccaaattaagcaaagcaaaagaagactcaaataaataaccgagcatgatgatttttatgcatagaacaacatttttcacgaaccgagacaaaagacactaatgcaactgactaaacaataacttaatgcacgaaatagatgcatagtcatactgatacgcataaacttaccctaccgaacatagacacgacctaatgcatatcacccgacaattcccgaccgactgccgactaaattctgaataaactttt

SEQ ID NO: 20110 - DNA, 13099 bp, Oryza sativa
tcatcttcatccggatccaatacaatagttgatcccatcggtgtagaaattgacttgcaatccgccatcttgaagcgccttaaaagatccttggtgtacttcatttgatgcacaaacgtaccttgctttatttgcttgatttgaagtcccaaaaagtaagtcaactctcccatcatactcatttaaaattccctgcgcatagtctcagcaaactccacaaccaaagggtgagatgaacaaccaaagatgatatcatccacataaatctgaacaaaaagttgatcatcaccatgcttaagaacaaagagagttttatctacttttcccattgtaaaacctttatcaagcaaaaaatttttcaatctatcataccatgcccttggagcttgtttcaaaccatacaaagcttttgacaaacgaaaaacattgttgggaaaatcagaattttcaaaaccgggtgattgttttacataaacttcctcctgcatataaccattaagaaaatcacttttcacatccatttgaaacaatttaaaaccttttggagcagaaaaagccaacaaaagtctaattgcttcaattctagaaacatgagcaaaggtttcatcataatccaacccctccatttgagtaaaaccctgagcaacaagcctagccttatttctcacaatcaaaccatcctcattttgtttgtttttgaaaacccatttagttccaatgatattatgaccaataggaggttcaactaaagaccaaactttgtttctttcaaaattctctagttcttcatgcatggcatttgtcacgcccataaattctcgaaccaaaatttctaagctgaatgtgcattaaatccctgtccaggaccagccagggtacataaacgacaattgttgacatacagacccacgtcttacaaaaatataaaagattacaaatgcagcgggaaagataaaagcgagctaaaccgagaagcttgacttcaacagtgggcgactccactccacaggcaatccttgacggcagcgacaaaaccaacctctctgagacggctccaactgagaagaacttcaactctggtgtgggggaaaagagagcaagactgagtactgcccactgtactcagcaagtcataccgaaagaggaggtatgatgcaggatataaccaaagaaagctaggggtttttttgcataaagcaggcatttcaaagcagtagttgaaagcagtaaaacagctgtagtaattaatcaatattaaccaatcactgtccaacgctacaccacgttgcaacaggcccaaccaaccacctgaactacaccagttcattaagctaaactaggggtgagactaatcacggtgaatctggttgatcgcccataaccgcgggcacggctattcgaatagttttactctggccagaggtgtacaactgtacccacaagacacgattccacacatgtcgccatgccccgaagtatcaccatgatactgcaaagggggaaatcgtgacaagaccctccacataaccctcccctaaccatccacaccacgctaaggtttcacccccacccctcaaaaggcagtgggcggtcccctcttgcgccgcggtgaatccggcagctggacaaccggacaccccggccgacccaactccatcacgcccaccctcgccaccggtgcctaggaaagggtcgagctatacttcagaccaagcagttacccactcccgcttgtggtaagcacggtaagtctcccagggtttctcgtgaaccggtccttaactgctatgggtgcgatcagcaaaaccatgcacccacagcccaccattcagtgtattttaattaactaacaccattgcggtggcaccaatctaaagctatgccaatagacaaagtctatgtaataatgtgatccccatttgtgtactagttgaactaagcatggctaagcatttcctaagccaacatctagtcattttgatacccaagttatcaatggcataaggtaaccaatatgtggctgaggaataggacccatcccacattacattgtaaaagaatgcaacatttaatagaaatgcgggatattggtaaattgggtacaatatgatcaaacgtattgcatgacttgccttgctctcgaactgatgagacctcagcaacgtcttcgagaaaccgcggatcgacgaaacggccgaaacctacgcgacaaacaaagcacacaagcaaaacatgctataagactactgaaacaggaaacaaaaccatttttaatggattctttgcatttttcttgatttactgagacttgaatggacttaaacggagctcggatgaattacttatgtattttagaagataaactgtgtttttactaataaagaaaaagtccttaattaattattgcgtgataatacccagggctgacgtcatctaaggggggcggcgccgacaggcggggcccacgggtcagcagctcaaggtggccggtctaccgtggaccgggaccacgcgggtggtccaccgccggtccacgggaccgacggtccggatcggccgggaggccgatcggacggcacggcggcggctaggcacggctcgactcggcttcaaaaccggccggtcggccatggcaactggcggcgacgcgcacggtcaccggcgacggcaatcggcggcgcgggaagcgatggcggacggggtaaaggacggcggcgtcgaccgaaggcgacggcgagcgcgtggagagaggcggcgcaaacgagagagaggggaagagggaggagggggggatcctcaccggcgagtatggcggccggagcggaggatgaaggtggcggcgacgacctggcgatgaggaggggcggacgggcggcggcagcacctacggagggagttgagaaggattaggagtagagggagtgaccacggcggccaccattgttggccggagacgaagtagaatggatagctcaccggtgtgtgaggagaaccgggctccggtggggtttagcggaaaccgagcggcggccgaggtggctcacgcggcggcaatgctattggcggcggcggcttggcgcggcggcggctctagcggctgcggcgcgcgaccggaggtggcggcaagcggcggcgctagtggcgagcggcgcgcgacccgtaggaggcacgggagagcgcggcgaaaaggggaaaagggagacggagatgcggggaagctttatagcggctcgagaggggcggacatggccgggaaaccccccgatttggccagcgacatggggggagagagagagagatagtgggggggggattcaaatcgaatcccgcccatttgcgggcgcgcttgcgggcgggaatggcggggagggcggcgacgtggggacgcggagtgggggcgcggcgtggagcggagaagacggcggcgcggacggtttcggcggcggttgccatcgtggggcgggtggctggaggaaggggacgacctgacaggtgggccccacctgtcagcgtcccggagagaggggaaaggggaacgggccggcccaaaggaaggaggccgagcgcgggagggagtgggccgacggcccaatagagaaaaaagaaggaaaagaaaaagaaaaagaagaaaggatttttcctgggatttaaaattgcactttggtgatttttaattggttaaaattatttccaaggctttgaaaattccactaaaaatcttgttaatgcattggagcatggggaactcaagaaaaattccaccacgctatttccgattattaattgcatttattaactggggattcagctctaggttaattaagataatttcttcgggcaatttatttaaccaattttttttaaagcaagaaaagggggggggaaacttcagggtgtgacagcattgatccacgattcatttgctaaggcatcagtaacatctttgggttcaaaagtagcaacaaatgcagaatttacatgagtatcacgagttgttaccttagaccttgtggtacattctccaatattacctattatctgttctggaggatgtcgtcgttgaatatgaagtggagcaataacatctgatgaaatttcgtgttctgcatcatgatttgacgaactagaaacttctggaggtcctctattatcagcacccaacgaactcggagatgagcgccctggccggtctgaccgctcctctgcctgcggtctgaccggcggtgggtcgacggtctgaccggccatggccccggtctgaccggtcgtcggttcatcgtcttcctcgtcgtcactttcctctacgaaaatatcctccccctgaacctgtgataatgtacctgaaatttcgggtctagctccaggactagcctcatccaaagtgactttgcaagtctcaacaattttgttagtgtctaaaacaagtacacggtaacctcgagaatgtgcagagtaaccaagcataagcccatcggtggaatggggctcaaattgtccaaattttctgatttaacacaaagcacttgcccccaaaaatacgcacatgtgaaatcttaagtgtatgaccaaagcgaagctcataaaaagttttttcaagttttgatgtcaagaaaacacgattggaaatataacaagcagtgttaacagcttcagcctaaaatctcctaggagtatgatactcatcaagcatagtcctagccatttcaaccaaagaacgattctttctttcaacaacaccattttattgaggaacacatggagacgaaaattgatgttcaagtcctttttctttgcaaaaactctcaaaagaagcatttttgaactcaccaccattatcactttaaatagttcttaaagatccagaaaattcaagagccaaatgaagatacaaacttttaaagtgttcaaaaacctcatccttagtagccataaagtaaacccaagaatatcgagagaaatcgtcaacaataaccaacacataccactttcctccaacagattgcactctagctggaccaacagtgtccatatgtaatagctgtctcggtgcatccgtcatcacagaaataataggagtatgtgaagaagcaaccatcttagcatgacgacatggcgaacaaaccaaatcaagatctttcttaagtttaggcaaaccatgaacaagatcagaaccactaagtctagtgagatgatcaaaacctacatgtccaagtctacaatgccaaaacatcacatctttagaaaattttgcaacaagacatgcaatctctgaagaaacacttctttcaaaatcagccttaaaaactgtaccatatcgagaaactgttgatgcgaaaagcacacaccgacctggaagatctgcttaactcctgtgcaggtccaaaatcttgcttttaggttcgtgagcgtgctagttgatttgatcctgcaatcaacaagaaagaaagacaagaaaaccgcgtttaaatccataaacgatagccgatcggctagttgccaatgacatatcatttatcttcgagccgatgtcatattgggatcgattggcagtcatgaatcaataagataagctaaatctactcgatcagctgtagatattaacgacatataatccttccttcgacgtatatttaaactaagtgattaggatagatcggtcgtcatgccgagatagtataaatcacttcagtcgaaagatacactaaagcaatgattatatagacatttatagcatagccgatcagataggtctagcatgtatcggctaatactccgataccactttatactaagatattaaaacaagcaaaatatattaaacaagaagcctgatataccttaatgcgataagatcttaatataaagggcagatctagcatatcaatcaagcatataagacataaagtagctaaatcaggtaagatcggctgaaactccgatactatctctctcaacaatcataaaacaagctagatattataattatggatattactcaatagatcgaacccaaccgatgcagcattaaacataaagataagtataagatctagacaagatgatgaaaatctctaagagatggtagacacacgatataatctagattaataatgaaacataactctatcgactactttctaatagtaagaaccagccgatgacaagttatatagcgcaactaacagagattacaaagcgtatgtgataactcgacgaattacataaacaagattagagtattataaagatggaagcactaatcccaagaacgcaagccgtcatgacaagtttacctctagttgaatatcggaatcgatgcagctcaacccgaaagcaagaactcgtcgaaatagaacgaaagtgaaaagggtggcgatacgccgaaagtgttattgaactgttgttgtaaattacatgggttcgggtgatatttatatgcgagatacatgatatgtccttgccggacacgactcttatctctaacaaactctaagatacacataagtctttgctgcagactcttgcccaaacatatctccaaggaaactattcaaaatatcctaattaatcgatacaattgcctatatgagagcttatctccatcatggcaatccttgtgtagcacgtcgaagcagtttcataactgaccccggcaaaatcgtccttatcgggtgtatcggccatatcgactatcctctatccgatcgatctcagccgatgaaatacccagccgatgccttcgcagccgatgcacactctgttctttgaatctaactctttgccaaatccactatgattccaatgccgaacctggttcatatcttaccaaatttggtcgtcaacacatgccccccaagtccactatattggtaatgttgcggattttctcaatcacctgctctgactataactagggtttcccactccgattctgttttggccgttaccgcgctttcttttaaatagtaaccaccggcgtcagcttccgttttaaccgccctagcaaaaaaactttccccaatctcttcctcgagctcttcagcgacctaaaggcgattccctgcagcgccccctccgttgccaacaatgtcgagctccgccgatccctcgagcgcgccaaccgctgagtatgttgaggtaagtaccatcggctatatcccccttttttccgtactgaatcggttcttccttcgctcaatcttcgattttcctcttctatagcatctctctcatcaagttgcagttcccaacataaccgatgagcattagtttttccttggcccaatcggcaatctagaccccactgagttcataaatggtgaaaccaatcggacaccctttagatttgccaaccccgacttaaccctttggaagaacacctttaaatcttggccatcagctgaaaaaagttgggcagcctggtatataagagtatcggctagcaagctaacccacggggacaaaatcagcatatcccaagctttggccttgactatggcagatatggctaaggatgaacttatgataacagccacaacctacttctggtcttctactatgaacaccttccttttctcccaaggaccaatgacccccactctcttagatgttacaatgataaccagtttggatattacctcatcggctaacccaattagtttgaacacaacatacactaatgagttcaaaatccggagcataggtggttggtcaggttttttcgccaaaaacatgggcactggatcagtaggtccaagggaacatgcaaccctcctcatgatgtggcttgagaaattcttattctgcggctcaagttgtggtcctactgctaactgacaacacatagctgagaatttggtggagaaaaagcaattccctcttggaaaatacctcctgggctatttatatcagactctgaacactgcaataactaaaatagcctcaggacttccaatcggcacaggaggtccctggtggctcctttagatttggctcaacttacataccatgaaggttgctaattggctgcctttacaagatgctaaattcccaaggttcgagccaactattgatgatgatggagaagagatcaccacacgccggtgtatgtcctttagagaagcaacatatatcagcaccgcatccaagctgtcggctgaacctttcagagaatggttccataacttctatgatagatttccaaggaatgccagaatctggtttgcatatgaaggatttggcacctttgaatggccaaatgattttcgctttgatgagatcaactctgaagaatatgagaaatctagagaggtattctcaacagccatcagcacttgcataattcctgtcagcattcatcgaggcaaaaatatccagatatcatatgaattctaccatccgacaagtgccgcaaggcaactaggcatgggccaactgcagattagtttgttctttgccgataagatctagagtaggggagaaataacatcggcactcatgacggatcggctgctgaacattccatgaccacctttaggcaggatgttgaccgatggtggatagagtggaagaaatatttattacatcaatcaccttcaatgtacctgacagatctgtttcctgaagctgtccctcaagtaagaatttttcccctttgtcaattctgtcaattaagccaatgcatcaatcttaacttttaaatctctttctttacagacaacagaatcttctccccccatcgcagtgaaagtggcatagatatccaatatgctccaggactccttcctaataggggtggtctaactcctccagtcatcagctatcatgccccaagacctcaacgttgctacacggtctgccttgtgtgccgatagcccctattgctggcaagaagaaaaggacaaaatcggctgcaagaaagaaacctaataaacaaaaagttgctgcggatgaccagcggcccatagatccagatgtagaggaattcctggaagatgaagtagcagaagtcgtggactatgctgccgacatcgttagcgaaataagggaacaaacacctccaaccgatcctccagctcctcaaagaacaccatcacctccagtacgccctacttacaaaccaagggtatgcatttgttgtcacgcccgaaaattcacttgtatttccgaacttatttgtgcataaaattctcgtccaggaatcagccgaggtacacaaactgacaatttaatatacaaatccatcgtaataataacgttacatacttacaatagaaaagaaaaacagcagcggaattaacggtctagcgatggcttcagctccactcccaaaggcagctcaactagggtataagccaaacgtcttctccttctggatcctttttcttcaactgaggttgattgattattgcaagaatgagcatatgaaatactcaagccacacagcaaatatgcaagtgcacaaggataccaaaggatggcataatataggctcatttgcaaaatcagcatttagcaaatatttaagaatagtaaaacaatagagtaatcatcaattttaatcaacactgaactgcacacccatgctgctcaggcccaaccatcctgaacaaccatccccggctgtacagatctaactccaaaccaggagctaagcaaattattgtgagaggtatgagactaatcacgaaaagcattgctcaactcgcccatgaccgcgggcacggctatttgaatagttttactctggctagaggtataccactatacccacaagacacagcctcaacatcatgtctaccatgcgttgcgatactagaaagtacccgaatagaggctgtgacaataccctctgcacaacacgactcaccacagtgcaccgttcttagatcataatcaccccctcaataaccagaggcatggactccccagcgactcccacggacttctcgccgcttctcagtctgtcaccccgtaatgaaccatgctatacaaaaggtatagccgttgcccacgctggcttgtggttggtacggttaatgtctcacaacagtagctcgcgaaccggtccttaattgtcatgagcacgacctttaaaaccatgtgctcacaacccaccattgtcaagttttagttatcaattaattatcataacacgattaaccatcgtgagctaccattaaatataaccataagtaataatgtagtatgattcatcccattaatgagctaatgtctctaagcatggctaaggaattatatatatatatctatatagcttttagctgaaccaaaccaatatataaggttcaagctaatcaatttattacctaaggtatcaaggaatagggtattcaatgcaaattggccataacaaaggaataggttcacaccacccaatgacatttgaaaataaatgcacagttgaaataaatagagaatttaaacataggatcaacatgctcaaaggaattgtgtttgggatctgtgtgacttgccttgcaataatcggtcttcaattagtcttctgaatctcttccgacgcactcacgagccttcgcatcgacggaaacgacaagctaacacgcaaaacggagaaaaaaaactaataaaaaccaaataaacagtatatataatcatgattttagatgaatttagcaacttgaacggcctcattctgacttcatataaattagttatgaattttacaagattaaactgattttaagatttatttttagaagggaaaagggctttatgacatcatcgatgacgtcatcacctgtgagaggctcgggacatcacggtcaccggcgatctaggtcacggcggtgagaatggagggcaccaacgcgacgagcatgacgcggggaactcactgaggggcggcacgacgacgaacaacgacaggagacggccgacaacgagattgaagcggcgacgggctcggcttgacggcgtcggtggcgcttcggcgacgagcggcaacaacggaggggtggacgggcttctcctcggtgctgcgatgccgagggaggtggcggcacaggtcggggacgaccgaggcgacggcacggcgcggatggaaactcggcggcgacgacgacgctagggtggaggcggctagggcgctacgggcgacggcgagctcaggcgagggtggcaaacgaaagaggagagggaggggactctatttatagccacgggagagagagatcgggcttggaacgcaagtaatcacgccgggaaaacctagggtttagtttggagggataaacacgaatcgagctcgattccgcgttgatttcttcgggataaagtctgattcttgggggaaaggatacgggaggataagaggaatatttcccctcaactaattttgcaaacggatcacgggatgcgaaggattcaacggaggaagcggcagcacagagcacggcacgggcggctggagcttgaagaagaacagtagcacgggggacgcaaactagacttttctgtgtggtttcctttactaggcccaattgaaggagggacaacaaatggacttcggaagagggataaggccagccgaaaggaagggagaatgggccgaggactgaagctgaacttttcctatttcggcccgaaaaggaaagggggattttaattacttttccaattaaattaatcacggaaatgatttttgaattgttaaaaatacttccaatgctcaaataatttcaaggaaaatcctgaaactgattggacactcaaagtacttaaaaagattataatcagaccatttaatgactaatttaatatgggaataattactgaaatgttctttgtattattaaaattaggaattgagctccgaaaaatccgagaaaattttagagagtataattaactacggagaatttaataaaaattaaatccagccatgctttatatttaggaaattttatttcccacatttaacttcacttgtaaattaatgaacatttaatataaattctaataataatttattaaataatttataaatcctaaaatgaagttggcttctaaaaaaccacaagtgacgactccaccagttaaatctctaagtcccatcaaactttcttttcaacttttcaataaccgatgctaacttaaacttgtctcttttcaggctcgtcattctccaactcctatttccgaagcaagtgagcacacccaattggccgcaggaagtcatcacatggaggaagaagaagaagtaatggcaccagctcctgctatccccgtgagtttatgttctcaacttttaaatcatatcggctgccatgtgattctaactaatcaaatatacccgtactctctttcaggtcttagccgatatgttttcctttgacatccggcaattcatggacaaagaagaagcaaccacgagcacagccttggtacctctagctgacgatgtgaaagcaaccctgctagacatttcaaaacgactagaaggctctttggaaactctggtaaccagctgtgggtctattagagatagattccacgaattccatgataaaatcccagacaagttagacgatgccattaccccagcgacataccttgagcaacatcggcttaaactcgaaaaagccaaatagaggattgctgatcgtcatgagagaagggaccttgaagcaaccatccaagttagcagggcttctatgtcacgtccggaatttctatccaaaattccaaacgcttacatgtatgtgaaccctcgtccaggaatcagccgaggcacacaataacaaattgataatagagtacagttattactctaattaataagcgaataaaatatcattacagaggtagatagttcctctcaatcaataaagatctaagcagcggaacataaaataaacggcgcagacggctccactccacaggcagcttgaccaaggctacacctaatccttcacaccatcagcatcactgtagaactcttcctctgatgaatgattgcaaggtgagtatataacatactcagcaagccacgcagcaaatatgcaagtgcacaagataacaaaggatggcaaaataggggtccattttgcaaaagcag

SEQ ID NO: 20111 - DNA, 10300 bp, Oryza sativa
tgtaccccaaaacacaaccccacatcatgtcaccatgtgcctcaataccaccacggtacctcggaaaggagttgtgacaataccccttgcataacacaatccaccgcagcgcaccttcctggatcataatcacccccttataaaaaaggcatggactccccagcgacccccgtgggcttatctccgccacttctcagtctggtgccccgcaatgaaccatgctatacaaaagataaagccgttgcccacgctggcttgtggttggcacggttaatgcttcacaaccgaaactcgtgaaccggtccttaattgtcatgagcacgaccatcaaaaccatgtgctcacaacccaccattatcaggttttagttggcacattaattaattaaccaatcacgattgaccatcgtgaactatcattaagccatcattaagtaatagtgagtcataagttatcccaatagtgagctaatgtttctaagcagggctaagcaattatatctaatatctagttgaaccaatataaataaagctcaactagtcaaattataataacccaaggtatcaaggaataaggtaatcaagaacaaaagggctataacaagcaattggttaattccacccaatgacattcgaaaataaatgcaatatttgaatagaaacaatagctttaaataggatcaacatgctcaaagggttgtttgggatctgtgtgacttgctttgctggccttggaactcttcaaactattctccggtgaaaacggactctccggaaacgacggaatctaagcagaaaagagcaaaatcaccaaaacagcacataaacaagcatgaacagtacatgtggatatttttaacatgtagatctcaattttagaaaaatttagagacttgaaccaactaaatcggagctaagatgaattagttatgaatttttgaagattaaattggattaaaacacttaaattgattttaattgaattatgacgcaataatgaattatttttgaaaaggaaaagaggatttattgtgtcagcgggctagggtttcggtggaccgggcgcacggtggcggttcacgcgaacggacggccgagatcgacttgatccaaaacggacggccgagatcgatcggtccacgaccggctcacggcggacggtcccgatgacgtcagcggtgacgtcatcaccggcggcggcggctcggcggctcggacgcgcatgctcgccagcgaacggcggcgcttcggcacgaacggagggcaccaagacatagagcacgacgcggcgaactcaccgacgaccaaagcgacggcggaagaccaacggacggcaccggcggtgaggaagaagcggcggcgctcttcgggtcgacggcggcgagggtgttccgacggtcttcggcggcggcgaaggagcggacgaggacggcgacgacttggcgatcacgacggtgaccttcccgagcgacgacgacgaccgagacggcggcggagcacggctggagcgacggcggcgacggcggcgctaggttgcacggcgctagggcgctacgggcgacgagaggcgaaggcgagggtggcggcgggtagaggagacaccggggagccttttaaaggggctaggaggcggcggcgaaggcccacggcggcggcaacggcgaaggaaacttcggagttcggaggaaagagaccgatccgattcgacctcgaatccacgaacttccaaagcgattcaaccgatgattccaaaagagaaaaggtagaggagatcgagaagatcatttcccctctatcaattcggccggaaacagaaaggaacggccggatttggaaaggaacggcggcggcgcggcgctagggtttcgggcggcggcggcgtctcggggaagacgaacctgacaggtgggacccacctgtcagcgacagcgagggcgcgcgcggctgcggcggactgggccggactgggccgaggagagagagaagggttttgggccgactttcggcccaaagccaaaagagactttttaaaacctttttcaatttaaattatttcttaaatgcaattccatttattaaaaatacttccttagctcaaataaatcccagaaaaatctaggaattatagaattaagcaaagcatttaataaaattttatctggccccattttatattggaatttattaattaaaattagatcttctcttctaggattttaaaataaattctgaaaattccatttaaacaacaatttatatattttgaattttcagggtgtgacattctatcaatgaagagaaggctaaacttgatgaattagaagctagcccaagttcaactcaagctagcattaatcggctgaacgcccggaggatagcaattttggctgaggtggaacaatgcagtgcacagatcgcccttgaggaacaaaagcttgctgacttgccaaaagccattgaggatcaaaagtcaaaattgaaggcatccgtcaagcatctaaccgatctgaccaaatctttgaagatgatcccaagaactgatgcagccgatgcccaaataatagatgaagtagatcagattaggcaaagggcaatatcggccatcccaaaatatgtgtctagatgagctaaattttgtaacttcaactttaaatttgcaaacttttgggctgtaatgaactccaagttaaacttttgcctttaaatcttgttttttgaaatccatgtttcatatatatttgcccccctaattttgcaatgttgaagacattgataaaattataactgagcctaaaggcgatataatccatatcagccattatacatcggcaaaccataactaattatgataataaaaaaccactaagggcgatataatccatattgtccatcatacatcggcaaaccataaccaattatgagaagaaaaaaaccactaagggcgatataatctatatcggccgtctgaaggcgatgtcaccacatcggctagcatgtatcggcaaacatcagccgatcatgaattaatccatacacttgggtagtatttcttcaagtacttgccattaagcgctcgtccataaacttcaccatcaagtccttgcaacttataagctcctttggatacaactttataaatctgaaacggtccttcccaattcggtgaccacttgccgaatttattgtcacgagttcctatcggcaagatcaatttccaaatcaactccccttctgaaaaggacttagacaccacttttttgttataatggcgagtaattcgttacctttgcaagggctctcaatctagactgaactagatcttctatttcatctgccataagattataatactcataggctgtcaactcatcctacaaatctatcctttttgagccgattgtagattcccatggcataactgcttcatgtccataaacaagcttataagtagaaacttgaatcgatccataatgcctcagctaatcttgtatgccactgccaaagaaaatctgaaatctttctcttaatcagggggatcaaacttttattagatgcctcggcttgcccattagcttgtgcataatacggcgaaaaattcaacaacttaatgcccatgatattggcaaactaaacaaagtcgtcagatacaaagatcgatccttgatcggttgttatggtttgagggataccaaatcggtagatgatatgttccttgacaaaccgtatagcatcccctgaatcaaccttcttcaaaggaatcccttctacccacttggtgaaataatcggttgccaccaatatgaacttatgtcccttgcttaaaggtggattgatttgaccgatcatatccataccccatcctctaaatgaccatggcttgatgatatgattcatagctgatgctggcgctctctgaattgctccaaacttctgacaatcttgacaccctttgtaatatcggaagcaatcttctaacattgtcggccaaaaataccctgcgcgccgaagcaaccacttcatcttatgagccgattgatgagtaccacatataccttcatgtacttctcccatcacaactttagcttgatcagcacttaaacatttaagcaatatcccatcaatcgtccgacaatataactcatcatgcaacaaggtatactttaaagccttatagcgtaatttccgtgaagccgattgagatggattctgcaaatattgatacacatcatacctccaatcatcgactgcaattgtagcaacttccacctcaatccccttcgccatcggcttatatcctgatgccccctaagccaaatcattagcttcaacattatgctcccgagaaacatgcttcaaagttacctgccaaaaactatccattaattctcggcacttctcattgtagaccatcaacacatcgttcttgcattcatattctcctgccaattgactgaccaccaacaagaaatcccccatgatttcaatagcatcggcttctacttcccttagtaactacaaccccttgagaactgcctcaaactcagcttggttgttagttgcataaggtttgatggtataggcaaactcaaaacttgccccacgaggggaaattataaccaagctgatagcacagccatgagtgcaaaccgatccatcgaagaataaagtccaaggcacaatatcaacagagccgattgaatcatcacgatgctccacaacaaaatcggctatagcttgtcccttcaccgccttaggtgattcgtactgaagatcaaactccgtcaaagcatatatccactttccaattcttccttttaaaatcggagtcgataacatatatttgatcacatcggctttgcatattatagttcattcattggatagcaagtaatgccttaactgtgcaggagaaatataaacacaaacataacttctccaccagagaataccttgtctctgcatccaagagcctgcgacttaaatagaaaatagctctttccttgccttcgatctcctgaataaaaactgagccgattgacttctctctggctgataaatacaatctgaaaggtactcccttctgtggaggaactaaaactaggggggaactaagatactccttaatattatccaaagctttctattgctctgcccctaagtgaattcttgatcggctttcaatctcagcaaaggtgtaaaaagttccaatctccctgataaattagaaataaacctcctaacaaaattcaccttgtcgatcaacttctgtagctgcttcttgtcttctaggggtttaatcttctgaattgcattaacgctcctctgagttacttcaattcccctctcatgaacaagaaagcccaaaaactgcctagccgatacaccaaaagcacacttcgtgggattcttcttcacgccatattttcttgttatctcaaaaaccttcctcaaatcggctatgtggtcatctacctcttttgatttaacaagtatgtcatcaatgtaaacttcaaccaacaagccgatcagatcatggaatatataattcatggccctctgatacgtagctccagcacttttcaagccgaaagtcatcaccacccactcatataagccgattgcacaggacatctgaaagcagtcttgtgaatatcttcttctgccataaaaatctgattgtaacctgcgttgccatccataaaacttataatcttatgtcctgaggcagcatcaaccaattgatcagcaatcggcattgggtactcatccttaggggtagccttatttaaattccgaaaataaatgcacaccctaagcttgccgttttacttgatgaccgggactatgttggaaacccactcagcatatcggcacggcctaataaaaccagcataatataaatgagtaatttcagccttgatagcatcatacatatcggctttacatctccttgggggttgctgatatggtttgtatcctggtttaataggaagccaatgttcaacaatcgatcaggtgagtcctggcatctcataatactcccaagcaaagcaatctctatattctttcaaattctctatcaacttggttctgaattctgcagataaattcttaccgataaatgtcggccttggcctatcgcccctggacctatatcaacttcttccagattgtcagccaacatgaaaccctgtcctagcttgccatcgagatcatccaccgtgtccttggtgtagaaatttgaaccctccacgacgtcctcaaagtaataatttgggctctccatcttcaattggctgtatatcacaatcggacacttttagataatctccttcccaaacttttccagacaggcaatcaatcccatccatcgcccaaagagctaaattggcactagcaacattaactgacctgtcggctggcatgatctcaatcttgtcaccttgccattgaatcaagcactggtgcatggtcgaaggaatacaacaatttgcatgaatccaatcccttccaagcaacaggctataggaacccttcccatcgatgacaaaaatgttgtaggaacagttttgctgcctactgtcaactccacatttagaactcccttggtttccgaaggattgccaccaaaatctttgagaatcatgtttgtcttgatgagatcatttgtatttctacccagcttcctgaatgtagcatatggcatcaaatttatagccgctccaccatcaaccatcatcttggacatcggcttcccgttgacgaatctgttaacatacaacggcttgagatgccgattttctgtcccctctggcttctcacagattgcttgctctggtgacaaaatcaatctagtagaggtttcctccacatcaacatcggcttgtttagcctcatattccacaggcaacataaaaaccatattcaccgatgaagatgcaacagctttgcccttgagcaaccactctgctttgttggcttcaacctcatcggttgctataactttgctcttaatgcgccattcttgttttgtctttttcagccgatggttgatttcttgttgcacttcttgaaaacgctccatgttcctcatcctctggacacttctcttctgattcttagtaaaaataccagaagggcaccatgtgatttcccgtcttcatcctcatcttgaaaacgatcctggtgtactggacccaacctctgatgaacaggcactattttttgattcagccgatttcctctattgtaagatcggcttggacccctgcattgtcactgcacctggggcaatcttctatcgatggcagtctcatcccttcgttccagcaaaacctaaaaatctcacaatcccaatgtgggtcaaagccaccatcatcttgctcaaaatacctttcctgctacttatcatgccttctttaatatttattgataatcctagctgaatttagctgagaactccgatttttcccccatcgactactctcccagacatatgcatcatgttgacaggaaaaggatggccatctaccttcatcggcttctttgaatcatcgaatttaatctttcctccctcaatagccaactggatttgttgccggaaaactttgcaatcattggtagcatgagacccagaattatgccatttgcaatatttccttttccctagctcccctagctcctcagctaatggaattatataaccagcaggaagttgaatttgtttctcccgaagtagcaaatcaaaaatcttgtcagccttggtgatatcaaaatcatatttttcctcttttccaagactcttaacccactgacatgtcacaaccttttagctcctcgcccactcggctgctgctacctcagagtcatattcttcttcatattcatacatataaggataaaaatggttgacctttttaaagtttttcttagcctctgcaaacctttgctcatgtagggctaccttctgtgcaagatgagacaagctttcaaaatcttgagacgaaaacttctccttgatcggagttatcaaaccctggaatgcaagatcggccaactaggaatcggtcaaaaccaaactatagcatctattcctcatatctctgaacctctggatgtaatcttgcatagtttcatcatgcctctgtctaactgctgtcaaatcggaaagctcatctcatggttcccactgtagaagtaactatgaaactgtttctccaaattggcccagccatgaacagaattataaggcaacgaagaaaaccacgtgaatgtcgacccagacaaagacaaaggaaacaatatgaccctcaaagcatcaacagccgatgcctcaccacattgggccaagaatcggctgacatgctcataagttgacacattgtcttgccttgaaaatttcaaaaagtctgggaccttgtatcgtcttggcaatggaactctctcaaaccactcagggtaagggtgccgatataggtttccagtatcctttggcttaagcccgaactgttccttcatcacatctgcaatcatatcagcccaaggcttctgctgaggcactccttgcatctgctattggattcgatcaaattgattgaactgaggctgaagctgaggttgaggtgatcctcccagttgatactgaacttgaggtgaatgaggctgatattgaaaattcaaattaccaccaagatagttctgaggaggctgttgcacattatgtatctgctgtttaggaacaaactgagctccaacaggctgattttgctgaataataggtgttctctgtcctgccggtatttgtggaaccatctgctgcctaatcggctgaaccacttgctgcctaattggtgtcgattgaatcggctcgacaaccggttgagatggcccaaatatagctgcaatctgttcctgagtcagccgattgacgtttttcccagcatgccgaggttgttccctagtcagtacatgaggattgaccactggtctctacgtagaagatgatgctcctggtctcaaagctgaagctgacgccatcggctgccctggaggtacattggagacaggctgttgattacatgtcaccaagcttctatatgtatggaacccaccttctggcagaaagactggcccgttatcctaatgctcagcaattgtgatatcaaccacagtcttgatgatatttgtcaaagtattgaccagcacccgatagattaatcaaagcttgatgaacagcataatcaacttgatcctggaaattattgaacttcaaggcctcttgctcctcaatctcctcttcttcaatctcctcaatctcaccatccttaggctccccacttttgtcacctgaatcaactgtgctacctttagttcccttagctttaccatgcttagatgatgtcacatcctgattttcgtcttaggatttataaattatttaataaattattattagaatttatattaaatgttcattaatttacaagtgaagttaaatgtgagaaataaaatttcctaaatataaagcatggctggatttaagttttattaaattctccatggttaattatactctctgaaattttctcggatttttcggagctcaactcttaatttcaataatacaaagagcagttcagcaattatttaaatattaaattaatcattaaatgatctgattttaattttgttaaatacgttgagtgtccaagtattttcaggatttttcttgaaatcatttgagcattggaagtatttttaacaattcaaagatcatttcagtgattattttaattggaaaaagtttttaaatcctctctgtaacatcctgaaaattcaagacaatgaaaatcacgaaaatttcaaactttttaaaacttttgcatcatgctggttgttatgattgctattgcttgccaaaccgtaaatgatcaccaagaaagtaaagaaaagaactacatttaagcaataaatatgatttgcgggaacatatttaatcctacaaataattatgcacaagatattaaaatcaaataaaagaaaagttattattaacctattttatcaaatattaaaatatttgaataatgtaggtgggtgccataatatgtgtacacatgaaatgatgatcattcaaataaactgagctctctgtatatataatagaattacgggagtatttaattcgatatgtagatcgatattgcaccaagttcctaattgcatttagtagttgcaagatgtgaaacacgatcaaaatcagaacgagaaatcccactaagaagaatatttcgtgctttaca

SEQ ID NO: 20112 - DNA, 15147 bp, Oryza sativa
aaaatcaactccattgtaaatatgaggtttgcttgaaaacttttcagccatggcaacaaatctaaagaccagtaaagatcaaatagaagaacgtggctctgataccacttgtaagatcacacaagaccaaacaaacctaccagaggggaggtgaatggcagggaaaaccaaaaacccgaaaatctttgcgcaattaaagattaccctcgaacgaagacgatgatgaagtcctattgccgccgatcgaaccgccctcctgccgccggtcagaccgccaacgcctcgctggtcaaaccgcccggacacctgcggtcagaccgcagctatcccaccagtcagactgcgcgtacacctatggttagaccatcgggacccagaaacaccggtagatgacaaactcgaagatgtagattgaaactttttgactttattgcatcaactagtgtttacaaagtgcaccaacaacactcctcaccaaaatctcgaactaaactcaaaaccctaacttgctctcaattctagtctctctacaatcgataccgggaggcctcaccctccctctctatttatacatgaggtaggctgtgcaaagcccacgaatctaacataacttaggactcctaacccacgtaggaaaccttcttttgcaagtaaacaacttatctctttccttatctcaatcaaacttcccgaattcggactcccttccaaattcgactcctctttccatacgtacacaattcctcttgtataccatatggatttcttcatcaccacgtgcattgtcctctagcctttagtatccggcatgtttttttgatccctgaacatcaacttctcccaagtggacgacgatctatcaccggcaacactctcccaaggccttaagcaacacctgcacatgcaacaaccaagaaaccatattccgagcccaagttcgtcccaacttgactcacattagtataacaacagtatccatacgtatagaaactgtctagaagccaaatacccgaggaaatatccaaatccaacaaaacaacccgaaaccgaacatgattaggatcctgccggttagaccattgggccggccggtctgactgccagggtcaaccgaaactgcacacttcacaaaatcaaccatctcataaaatctccaaattaacattagcaaaccaccaatattttcatcacaaaatctaaatcaactccttgattctacatgcaagtttgttaggcaagatgtgatgtcttttatatattatctattttacatttcaggtcgagattcttaagctagtagcttctggtgatcatgcagctgctctcaaggtaacagccgctcatcaggggcctcctgctgccagtaacctggcttcactgtacctttgaaggaaactttggtaacactgattcaacccagtgaagatgtatgtactcttggaggcggtatcactgcctattcttgcaaattctcgccagctatgactaatgcttgtattttgttaggtaccaagtctaatttgtttgtttcatttattgttgatactgatggtattagactacaacttgcatattatttgtggaagtgcatgaaacaagcataatacattcccgtggatagtaaaggcaaagcagaggaaataacgcctgaatcatgtgatattttatctgtgctaatattagtgtaactttcttagttaggatttacctctcttacgttgttcctcccatccatatggaagtgttccatccattatctggattacttcacattctgttactctttattttgggcctggttactggcttagaacttctaggtcttttacttgttttaagtagttctatttcgtccatgtttttctaactaatcaaggttgttgatgtgaaatattacttggttactacatatgtgcttctgatagtatttggttcagtggctctctgggtgctgactaattcccccttttacgtcatgtaaaattgatgggttcatttccttgatagtgctgacccagttaccaaccattcattattcctttagttttcttaaagtaaaaggttccaaccttgtctatcatccagaactccagatgatcttttgattgcatatattatgctaatttgatactgtaggacaatgtttacgttgcaatttgcaatacaagtgccagttactgtgcacaaaatggatagccaattaggtaggaattcagccaccaactagtagggtgaaattgaatgatattgtagacttatgtatgttctcttttgcagattgcaggttagcaggaggcggtattgaagaaccccagtgaatgaagatagtaagaacatcacttcgtacacaaagtgaatagtttaggcttcagatagcggacgctacaacgttcatgggtattcagctgaatacccattttttttacaaagtagctataccccatatcatcaagtatatcctgcccaaatggttggtgggtcaacaggtgctaggttcgattcctagcttccttctcgttttttctcgattattcaatcctgtttttggatttttcttccataagctcacaatattttttaagcatacatcgattatatttcaaaatcatgttaacccaacaagataaatgttttcattcaatatttttctatagtttataacttttctaattaagaaatagtatttgcattgatgatattaaccatattttttaaaaaacaaattcgccatgtaaatttttgaatacccaccttcgaaatcctgcgtccgccactggatgtacaaggacctttttgaagaatgattctctaaaaaagattgatccatgcatctgtaggtagtcacaatatatccaaggttcttacaggtcaatgtgctaatggatcatctcaaatcacaacatagctttgcatttgatggcatttcagtacatttattttgtgatcgacggcacaagaagataacactcgcatacactttgcatgtgtattcgtgggaggtgtaatagcagtgataacagcaatatgatgtttgcagtgggatagaacatgtgtatacactccgatgttctgtttctctttgtacgtttagaattttcttccctcagtatttatgtcataactagctaaccctaccagataaaatgttaaatttcatatgaggctgtggaccttatcttgtgagaacctgagagatgataccgatcttaaatcaaatagttgaactgatgccaacatgtgtaattggttggttgctaccctgtcaacagttaacaatgtggaaaattgtaaatatgttaggtaaaagtgaaaacaaatagttcgaacataaggagagaatattttgatttgcttaacactgggcctaggctaatggcaaaatacattttagttttttcttagaaaaattaaagatatacttaagcgaggtgagatgagagggcgattaaataaaatgaaaagaaaaaaaaagaaaggaagtaagagcaagaaagcaaatgttgataataaagggcacagtaattcttattttccccatacctacacacagtaaggcaagtatcaacttgggaagaatgcatgatcagttgatcactgtaaaaaggaggccgttatcacacacaccagtgacaaacgtgtggtaaatgtaccgtaacagtaacctttttatcaccggacaccgggggcgggggaacaagtactgagcagagcagagtagagcataacacacatccatcttcttgacaacgaagaaagaaatcgaatattgtgacaggcagtaggaggccaggtggacgctccagattgtttctccaacgatcggaaggcccatcggggtttcgtcacggccacggcgataattcaaagtttaaactgcacaagaggttataaagtgcttttccttttggcaaggaaatgagaatcgaatcgtatggcaggcagtacgtggcaagagatggacgttctagatcgtctcctccagtgatcggaaggcccatggaggtttcgtcgcggtcacgtcgataagctgcagactgcacagctaaagtgcttttccagagtctgcattacagtaaatgagaaggagagggcgggagaaatatccagcttcccgccctcgacccagcctataaactggctactcatccctacctctcttcttgctccaattcgtaaaagccaccatagtgtagtgctcatcctccatccacccaagtccatcgttccgcccacagctccacaccatcaaccatggtccaaccccccgccgccgttgtccaagcccagccggtttcggaggtcgaggcgggagatcccgtcctggtccgggatttcttcaggcttctttctctggggtcggaggcatccgttccgcgagacggtgtcgtctgctgttacatggacgtatccgctctgttcctgtactacaggaacatgagcggcgttctggtgctggtgccgcatgtccgtccgatgtgcgacgccccgctgatggtgcagcagctccagaagatggagatgcggtcggattgggaaatcccaaatctggccgccctcaaggacgtcgcgaccgcctcagatgctcttgggcgcatgggcaagatgatgctgcaggcgcgccgcgtcctcaagactctgaagaattacccggatggcgaggagggattggagatactcttctacaacactcttctgggggaggcgctcaccagggcgcgcgaggccataccagccgtgataacctccgctgacctgctcgtgttcgacaacggggaggtgcggctgatggcgctctccctcgctcaccaagcgatgagcaccgtcgaggcttgcctcggtgctgtccacgagggaaagggcttgactgggcgtgagatgcaccgcctcgttaagaaggtccttcgcccgctgagctacctcaggaaggtgaaggtcatcgacctcccaaggttcaacccctttgacgtctgagttctgtcttggatttatctttatcctgcaatccagctagttttttttcttttgaggggaactaagaagtggaaacaagaaatgtttgagctagtatgtttgcctttcatgtctcgttctattttagttgtgatcctgagttattgttatcaagagtgcaagatcttctgatatttatcgacctatctcaatggaaactttattattatgtgcctgcattgtgatcctctttgttatactttgtttgaagtatgaatgctgaatgcattttaattatgccaatgtgctgaccctcttttctatgaaagagaaattgcatcaatgatcaatttatattagttccttgttaataactgttctgttatcccctattctaaaaaaaaaatcaactgttctgttatatcttgtggattggccaatgatgagatgttatttgcaagcactccgataatttgaagtgcaatagcgcaaaatgttgtgagtcctggaactagctattaatgctagtttcaaacttaaatgctacatttctctatgtttttcttggatagtgcaaagtttctggttacttatgattgttttctttggttcaaacagtgtaaaattccatcaatttcctaaaatttcgttcccttatatttgttttgatgtaagtgtaactggcacaccgacaaacaattgactaatgtgttgttctgttggtcacccaatttcatcaattctcttcactttacaaattttgagccattaacaagctaattatactagcagtaactattactgtttttattttgttcatatgtctatgttgtgagaaataccagtgtactaaaactagctactttatgttccctatcactataatcagaaaccacccacttttagagcctttttacttcatggggatgataaatattaagttctaattttatcatttcgacatactgaaatgcaaagatctgggcttattgaaatctgagctcttgccttttcatgaatttgatcatatattgttcaggaaaatgtctctggactaatggggatcacgaggtgactaggacagtatcaaagaagtctggggtctcataatttttatcaagttaaccatagcatttcagtttggggttcctccttttcttcagcataactgttatgtttgtgacttctccctgttgtttacacatgcttcttcttcaatttatcttcctagatgcagtggtatataataatattacttctccctgtttgcaactgtaatttcattggtgcatgaaaacttaatttaattttttttcctgagactttttatataccacagatttggagattaatgattgcactcttagatctgtttctatatagtggttaatagctaatttgggaaagatgacgtgccatttcgtgtgctcaattggttttgcactttaatttgtgcttcacaataaaattgttcaagttattctgaaattcaactttttttttcagtgtgaaatttacatgcttaatactattcgataccaaccagtgatcaactaaactccaccgatatagcataccatttttgtttcttgcatattttcctaagaataactttagacactcctttagataccaagtgatgtaaaaaggtttgaaactgaaccgtggatcatgcattcccatttgttacatttagtttcattttcagtgagccaatgatgatcctgaagtgttgctgctgttatatcccttaatatcatgcagatttgtactggcactttctgtttcatttcctttcatgtatttatagtattggagtacccatggaaagaaccatttttccagatggcaagtttggattcctcactgtacaggatgctaatcaatgcattatcaagaaaaatgacaagaaaacatgatactaagtttgcaaaagatttctcgatgttattcaaggcaaaaattttcctgtgcaggttatccttgtggagttctcatctgactcctgatttggtagctagaattttggtaatcgttctatgattttgatttacagtttctgaggaatttaaataaatttattaatgtgcttagtgatttgtgttgacgtcagcctattttctactgttctctgtgacaaaggatatgtcatgcaattttctttgtcaagattaccagggttctactttagcccacttcgttccatggctacggtactggcatcattttggaggcgacggtaactagggatgtaagtggacttgtccgtgaacccacttgttggcaaaatttctatgtaactcgcgggttacctattaatttgacctgtaaatgggtttatggatcgacccacttgcatatctagatgtagcaaaccggaccacaaaccgaaaacctatgaattatcatttatttgatctataagtgaactcgcaggtcggcccgcttgcatcctaacggtaactcgattttccgttctataatcgcctcaatcttctaaatgtcccaacattatgaatttggattttagagtatattgacttgcttctggtgtccaggatgacaacaaaatatgagtcaggatttgaaccaagcatgcatgtaaattcccctagtttccatggtgcttaaatatgccaaaattttcaaagttcaaggatttttcaacgctcacaggttctttgcaacagtacaagatctgaaacacaacctagtttgtgtttttttttatagatttagcttagaatggagccttgcaagaaattggtctgccttctgatatttgttggtgaacttgttttgcttgtaagatcaacccaaggatgacaattgtctgcacatgttgaaccataaataatgtaacccaatgaatgaatcatattgtttattcgtttatctacaacatttgcgaggcacaagaaaatcttttgcatttcactttagtcaggtttggaagtgtttcataaaggatcaacaattgctagttttgctttggtgggccccaagatctgcatactcatctcctacacctgaagttctatttgttgggagcctttcctatggttactgatgagaggagaatccgcacacctaaatgtattttcctgaaagacaagttgatacgaattccaaagcttgtactgaattcttttacttaagctccatatgaagtagtaatgaaatagtttgaaactgcgtatatatgcccacatgcagcactggtaggacagtgattcatttgttttattaggtttgatgaattccttgatagatgctacactacttatttcattttgctgctaaaagtcaggttcattcgaatatcctgttcaacctcattttctattcgctcagttgtttgtacgtactaactctgaaagaatatgcatggtgggatggtttaggtttgaacacttcctttcattcaggacttcatatatcgatcgcttatattttactaacctatgttgaaatggacatatggtgagtctctccgacgaccaagctgaaaggtcactactcatctactatcttatctcccttaatataagggattttgacattttatttgcactgtttgaccactcatcttattcatttttttttaaatataaaaaaagaaaaattgtgcttaaagtacattggataataagtcacaaataaaataaataataattcaaaatttattgaataagacgaatggtcaaacaacgtaaccaaaatatcaaaatccattatattaggggacagatgaagtattgcctattgactgcaatttcatagttgatcacactggaccttcttgtggttgatatttatggctaggtgtaatagtctagtttagattttattgctggttgtgttatgccactcttaattactgatttgatagctgtgccagtaaaattttataaaattaaaaacatgtcacagccgtcacgttttccatccatctcttttttttccgttttattccttctttctcccatcttcttcctgcaccgacgagcgtcaagtggtggagggactagtgaggaagtgttggttttctccccttttgagtcccctgaatccctcctcgaagatgatgccaatgcactcgtcaaggaagatgacaatcttgcagagttggtagagttacccaaaaccaatccaactttacggcctccagttgaactcaaaccacttccttcagttcttcgctatgcttttctacatggtgatacggagtcgcccatcatcataagttacaaattgattgatatgagacctctcgactcacggccgtgctagaaaagcatcgctttgttctaggctactctcttcaagatcttaaagggattagtccggctctttgcacacaccatatccctttagatccttcttatgcgtcccctcgggagccgtaatgaaggctaaacaatacaatgagagaggtcgtaaaaataaaaagaggtcttgaaactcctacacgccaggataatctatcctgtgtcatatagtgagtgggttagtacagttcaggtagtgcctaagaagggaggaacaacagttgttgaaaactcgaagaacaagttgatcccataacatatatcttgggatggaggatgtgtattgactatagaaatctcaataaggctacgaagaagaacaacttcacgctacccttcgctgataaaatgttagagcgactggcaaatcattccttcttatatttcctttatgggtattctgggtatattgatggtctttaagtaccaaatctgaccgtcaaatcctgcataaaagaaaatgaaagaatacaaaatagaatatcaaacttacgggtagtggttattactaactatttccacaagtcttggtaaatattcgtatgcaggtgaattatggatgaaaaccacccgccatgtgaagaaacacacctccgcccaatcagatgcgagtactcggattggagggcccacaaaccatagcaaaaccgacatatttgaggccaacccccatacaccgttatgagggcccacaggacagtgactcaagcgagaatgggggagaaaggcagtaaaattggttcgactgatcgcccccccatcttccacatgtcgcttcctcatgcctccccaatgacggttatggcggtttcctcagcagttacaaactttaaccgtagtcatttggagctataaaagggggagctcacttaactctcaacacacaataaagtggagtacaactcactttcatacttaggcattgctctagtagagtaggtagagagtgaggggaagctctaaaaggagtacctgttaacgaccaaatttggtaaatcataggttgaatttggagtcaaaaccgaagcgggtttggagggagttcgttattcccgaaaacagagtgtgcatcggctgcactctgcatcggctagtaccaaatcggataaggagaagccgatgcagctgatttcgacaaaggggcttagagtcattgtcggactcaatataaatgttgcaaaagtattgccaggcatggatcacgttagaagaaggcaaatgtctatattaattaggatattttaatagtttccttatatatatttttggtaagagttcgcctaagggacttgttcgtcttttagagttgtaatacaaatcgagtcgtgtccgatatggacatatcatgtattttgggtataaatatatgcccgagtctttgtaaacaattaacatcagttgtcgcgaccgggaaaattgccttttcccgaacgctagtgtattaatccccgtcccaggaaaagccggggtacaccacacaaacatgatataaaagacacatctttattatatcgataatatttacattattacaaaggcgcttcaggcctgacattcaaaaataaacagcagcggactagcgggcctacggctccatcttcacaggcgctcaactggggtataagccaggactccacctaagacttcttctccaaagcttctcttactgaagggggaaaagattgagcaagaatgagtacaaccacagtactcagcaagccacaccggcagatgcatgattaatgcaagggagtacaaggggataataatataggggttaagttttgcagtaaacagcatttaaaagtcacttagttgcccaaagccattttacaaagacgatcctagagctacacagtattattaatcaaggccgtgagcccacacgaacctgccttaacccaaggcctacgatgattcagaccgaactggcaacccgaccctgggtcccagctcgtcccaagccaacctaggccaaccattccaccttttagttgttgagcaaattttaagaattaaaacactgacttgggtacattgctcggcttgcccataaccgatggcgcggctattcgaatagattatactctgatcagaggtgtacatctttacccacaagacacatcttcctcacgtgcaaccacgtgccacataccaccacggtatacagacagaagacgtgacatagtttccaacccatcctagccatagacaagagtaccgacccaatcccatctacggccggaacccccgggacaggcaggcaggactgaacccctagcagcaggacaccggccctgtgccatgacatctcgactaccgggccgcaactcgtgtagccttcatttgccctggagaatgtccatcgacccccgacttcatccacctccatccgtgtacttttgtttataactagactgagccacaaactaagccttacccactagacatgtggaagtacggtagtgctttgcaacagaggcccgaagaccggtccttatatggccgaggtgctactatcaaaaccatgcgccccgagcccagcctaaaaccatttttggggattttgaatagtgggggcggtgtgaatccaattccacaatactccaacaattccacagtgtccaggtgatatgaatattcccaaagtctagagttgtaaaaccgcctaatgttacctaattaaaagcgaagcatctacctataatcatactagtggtaccatgagtagagtgtccactagttggggttttgtttaatctagggtgaacaaggaaataataataataacaataataaggtcataacaaaggtaaataggcatggctaaataaaacagtgataacgcgggaatttaaataaagcgataatgcaataatttaaatcaacataattttacaaactgggattcaatatgttcaaagatgatgtgacttgccttgctcgctttcccaaacgccggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggccaagttatggccatttgaagtttatatgctctttaaatgaatatttgcgaatttcttcatttaaattttaattaaaaaaaggatttattgcgtcagccgaggggaggggcgcgcggaccgggtccacgggagtggggcccacgcggcagccccacggtccggcgaggttaggggaggggtttccaaacgaatccgagggagagagggagggaaaaatggggggaaagggggaggggatcccggggaataattccccctattgattgcacgcggggcagatgtcacgcccggaaattcactaataatttccgaactaatttgtgcataaaatcctcgtccaggcatcagccgaggtacacaaactgacaatttaatatacaaatccatcttaataataacgttacatacttacaaagaaaagaaaacagcagcggaattaacggtctagcgatggcttcagctccactcccacaggcagctcaactggggtataagccaaacgtcttctccttctggatcctttatcttcaactgaggtttgatgattattgcaagaatgagcatatgacatactcaacaagccacacagcaaatatgcaagtgcacaaggattccaaaggatggcataatataggctcttttgcaaaagcagcatttagcaaagatttaagagaagtaaaacagtggagtaatttatcagaaattttaatcaacactgaacatcacacccatgctgcataggcccaaccatcctgaacaaccatacccggctgtacagatctaatctccaaaccagggagctagcaaattattaccaggtataacatctataattattgtgagaggtgtgagactaaccacgaaaaacattgcttaactcgcccataaccgcgggcacggctattcgaatagttttactctggccagaggtgtaccattgtacccacaagacacgattccacacatgttgccatgccccgaaataccaccacggcattgcaaagggggaaatcgtgacaataccctttgcacaacacaactcaaaacagtgcaccgttcctggatcataatcacccccttataaacaaggcatggactccccagcgacccccgtggacttctcgccacttctcagtctggcgcactataatgaatcacgctatacaaaagataaagccgttgcccacgctggcttgtggttggcacgataaatgtttcacaacagtagctcgcgaaccggtccttaattgtcatgagcacaaccatcaaaaccatatgctcacaacccaccttaaccaggttttaattatcaattaattaacatcgcacgattaaccatcgtgagctaccatttaatgtaaccataattaataataatataacatagcttataattaacccctttagttagctaatgtttctaagcatagctaagcaaacttacatatagcatttagctgaaccaatccaatatataaggttcaagctaatcaatttattacccaaggtatcaaggaatagggcatccaatacaaattggccataacaaaggaataggttcacaccacccggtgacattcgaaaataaatgcacagttgaaataaatagagaatttaaatataggatcaacatgctcaaaggattgtgtttaggatctgtgtgacttgccttgcaataatcggtcttcaattaatcttcttgaatacttccagcgcactcacgaaccttcgcaacgacggaaacgacaagctaacacgcaaaacaaagtaaaagactaataaaaaccaaataaacaatacatataaaataaacaaacatgtagaacatgattttagatgaattatgagacttgaacggccctattctgacttcaaatgaatttaatatgaattagacaagattaaatctaattaaagcccattaaaaagaattaaataaatttaattcaatttatggacaattttaatatgtagatctttattttagaaaaatttatcaacttgaaccacctgaaacgaagctacggttatttagttatgatttttcgaagatttaatctattagaaaaaaactggaaaagaggaatcatgacgtcatgctgacgtcatcatcggcggcatgacatgggcgactacctccccggccatagatagatcggcggggctatccaagggcatttacacttagaggacgacgtcacgaacgcaacggtactcaccaaagcgtccaacgacgaacgatgacggccggcgacgacgcaagaggcggcggcggctcggttgaacggcgggaacggcgctacgacggccggcgacggcggagaaggggtggccgagcttccccgctcccgtgcgcacctaacggcggcaacgagaggtggcaacgacggcggacgcggcggcgcagcgtggccggaggatggccggcgacggcggcggctaaagcgacgcggcggcgactctacggcgcactagagagctcgggaaaaggggcaaacgaaagaggaggactagtgtcacaccacgaagtttccctcccaagccaaaattgtaatttataaatgaccctaagaaaataccggtgcaaatcaggagaaaaccctaagaaagtaatgcaaataataatcggatttgacatgtgggactttttcttgagttctacaggtcgaaattcattaacatgatttttagtggaattttcagagctctagaaataattttaa

SEQ ID NO: 20113 - DNA, 1483 bp, Oryza sativa
atgtcaatcgacccccgacttcatccatctccatccgtgtacttttgtttatgaccagactgagccacaaattaagccttacccactagacatgtggaagtacggtagtgctttgcaacagaggcccgagcttaatccttatagtggccggggtgctacttcccacaactggcatgcacccaaaccccaccgaaaacaggttttaggggttttgaaagaggaagagaggtgtatgtccaattccaccataaaccaacaattccatagtgtccaaatgatatgagaattcccaaagtctaaagttataaaaccacctaatattgcctaattaatcagcgaagcatctacctaaattcatactagtggaaccatgaatagagtgtccactagttggggttttgtttattctagggtgaacaaggtaataataacagtagcaataataatgtcttaacaaaggtaaataggcatggctaaataaaacagtgataacgcgggaatttaaataaagcgatcatgcattaatttaaatcaaaataattttataaactgggattcaatatgctcaaggatgatgtgacttgccttgctcagagagaacggccttccgaaccttcggcaacgaccgcaaaccacgcttcgcgaacctccggaacgacgaaagctacgcggagcacacaagcaaagctacaagcctataaagaagcaataacaacacataaaaaagaaagcacacagttctttaggttataacaaacattaagagacttgaacgggtcgattcggagctcgtatgaccaagatatgatcatccgaagtttaatgctgttatatggagatttgcggattattataattaagctttgcaactataaaacatgtgtaagcgctagcctggaaaagacaggaaggctgcgccgttgacatgcggaccccacatgtcaacctaaaggaccgcggtagaccgggtacacaaagacggttctcgggtcgacggaagcagaccccgtgtgtcaaccgaggcgagtggccgacaaacggactccactaaacaccacacggcctgcacacgtggaaaccacgcggctaccgagcgggcacactaacacggacactacacggtcaccacccgcacgcgtgaacgactaccgacaccggtacacgggtaccggggccgagaaccgcacaacgagcacgggcgacaccgaaaggacgaggacggggcagcgagggagagggatccttaccaccacgcgacgaggcgcgggaacgacaacgacgaacgggcgcggcggagacagacgggcacaacggagacgaacggcgaggggacggcttcggcggcgatccttggacgaaggcgagacgcggccggcacgaggcttgacgacgcggagccgagaacgaagacgaggacggggctgcagcggctcgcttgacgaatgcggacgacggacgagaacggctcgacggagggacaaac

SEQ ID NO: 20114 - DNA, 2785 bp, Oryza sativa
cgaggccgagggagaagacggcgcggtcggactgtgctccggcgaggagggagaggcggctggaggcggccggcgcggaggaaagagaagggcgacggcgggaacgcgcctccggcggtcaccgcgcgaaacggagggcaagccggggtggaggaggtggcggcgacgctggaggaggcgacggcgctgtcggccggtgcacggtcgaggcggcacacgcggctggaggcggcccgcggcgtgggaaaaaaaagaaggctgccgggagatggctagggaccacggggaggctcgggagggggctaaaacgagagaacgggggatgaggatcccattttatatgagagaagagggagccggccacgggggaggtcggaacggcggcgggaatggcggccgacggccatggaaagcgaccggacttggcgcgtccgttcccggggattgaaggcacgaatcaagggggaatttgggggcaattgaagaggattcaatggggattaaaaccccccaattaattttggaattggccaattgaatcaagcggatttggaggagggagcgagctaggtttccgggagagagagagagaggtggccgggcggctggaggagggagacgacgcgcctgacgcgtgggccccacgcggtcgggcgcgcggtcagcgcgcggcaacggcgcgcacgcgcgcgcacgtgcgctggacgggcgggagggcgccgctcgggttgggccgggcggccggcccatgaagaaaagaaggggaggcggcttgggccgggcaggccgggggggggggagagacagccccggaaaaaaagggaagaaggagctgggcccaggggaaaggggcccaagagaagggagagaaggagaggaagagaaagaaagggaggaaagggagacttccgcccgtggcccgaggggagagaggaaggactttgggccagacttggcccaaaggaggaaggaggggtatttttaggtttttatttttaataaactttgttaattgtttttgttgcttaataattatttccggtgctctgaaaattcaagtaaaatttgagggctccttttagaccaaggcgaatttaacaaaaattctccgggccacatttgaatttttcttgtacgtattttagtgtttgccaatttctttccgaattttaattaattctattattccttttagcgaatgatttttaatttcgggacgaatttatcaggacgtgacatcagttcaatacactttcggcgcatcgcgacctttttctactttcattgtttcgacgagttcttgttctctagttgggctgcatcgttttcgatctccggcgagaggtaaaacttgttattgcggcttgcgttctcgggattagtgctcacatctttatgacactctaatcttgtttatgtgaatcgtcgagttatcataaatgcaatataatctagattgattttactatctggtcttgtcggctcgtctctatcatcgaaatcagccgatagaatcaggtaatatcattggtttagatcatatagtatatccaccatctcgaaaaagttttcattggcttgtttactagatcttatgtttctctctatgcttaatgctacatcaattaagtttgatctaataagtaatatttagaaccataatctctagcttgcttcatgattgctaatagagatagtatcggagtttcagccgatcttacctggtttagttatcttgttctttatttatttacttgacatgctaaatctgccatttatattaagatctcgctaagactaaacatattaagcttgatctcaatctacttgggtcttcctaatagtagaccgacacttgtttaatatatttaatctataatgatatcttagtataaagatgtattggagcaatagccgatacacactagatttacctatcagctatgcaatgaacataaataatctttcctttgaagtacttttaaacttaagtgatttatactgtctcggcagccatccgatctatcccaatcgcttggtttaaacacatttcgaagtatagattatatattgttattatctaaagccgataaagtaaatttagccctttgtttactatatatatcactgctgatccgaaatataccgcatcggcttgctctcagacgatatgtcatcagcaatccagatgatcggttatcgttgatggatttaagtttggtttctttgtttcttgttgattgcaggatcaaaccaactggcacgctctgaacccaaaagcaaatttaggacctgcactagagtaaagcaaatctctcaggccagtgcgtgttttttgcatcaacacgcttttggcacgcctagtgggacaacctttggtagttcttcatcatggttgataaaaaacatgatatcgatgatgaaaacatcatcccggtgatgctagataaactgacagaggagcagaaggcgactctggaacagatgatgaatcagttgcaaaatcagtatctacattcgttcacattgactcggcacggtacggtaatccaaagacacaaggtcacgttaccgttcgatgatgaaggggcaagctctcctaaggatataatgggtaaagatgagaaagctaaatgaagtactgaggagttccatactttgcaagatcgcattgattcagctatttatcacggattgatcaaccagtcgggagtgcttgtcaacaccttaaccaatatgataaagactgtggttgatggtacgatagctgagcaccaagttaagg

SEQ ID NO: 20115 - DNA, 1382 bp, Oryza sativa
tcagcatggggggcacaatatacctcatctttctctagaacaagttgctgcattgttcaagacaaagcagccagtggttgagccgattcagcaaattcctatagggcaaccatcatttattccacagcagcagtagatggggatgtcttaggctcctggtacttagttcatccctgaacaatccatccatttggcacatcaatctccccaacatcatatgggaggtaatgtaaacatccttattcaccttaggtacaatatcggccaagaggatcacctcaaccccaatacctgcctcaatacaatcagttacatcagatgcagcagcaattgggagggacacctcgacagcaaccttgggttgatatgatagccaatgtgatgagggaacaatttggtcttaagcccaaggacggtggtaatttgtattggcatccgtacccagagtactttgaaagggttccattgccaaaccgatacaaggttccagatttttcaaaattctcaggacaagacaatgtgtccacttatgagcatgttagccgattctccgttcagtgtggagaagcatcggctaatgatgcgttaaaagttaggttgtttcctttgattttgtctggatcaacatttacatggttttcatctttgccaaataattctatacaaagttggcaagatctagagaagcaatttcacaagtatttctcaagtggagtgcatgagatgaagttgtctgatttgacagcaatcaggcagaagccaaaggagtctgtcctagattatattcaatgatttagggatatgaggaatggatgctgtatcttggctttgacagattctcagttagccaatcttactttccaaggcttattgacaccaattaaagagatatttttagttcaagccttcgagagtatagctcatctagcccaaaaagtatcagcacataagcaaagattccatgaggctaggaaggcataagaaaagatcaataatgttgatcaatatgcttctgagtctgatgaagatgatcccgaagtagctgcaactgagtgggctaggaacaagaagattgttacttgtcaatgggttaggaattctggaagggaagtgaagtttgattttgacattactaaagctgataggatttttgatttgttgctttgagaaaaacatattcaacttcccgctggtcatgtaatcccatcggctaatgaattggggaagaggaaatattgcaagtggcataacacaggatctcatttcactaatgattgcatttcagacaacagatttaatcggctattgaacaaggaaggataaagtttgatgatccaaagaagccgatgaagattgatggtaatccgtttactgtcaacatg

SEQ ID NO: 20116 - DNA, 707 bp, Oryza sativa
gattaggataaaatacccaaccatttgctccgattcttgaggggaaagatagaggaggatgagaggataaaaacccttcaaaaatcgaaagaatcggggtcggattgggtgcggatttgagggcacaaggtggcgcggtagggcggctcgggctcggcttggccggcggctggagaagaaagatgggtccgacatgtgggtcccacatgtcggtgacccgaggagaagggggcgggcggcgtcggctgggccggcttgggccggttcgaccgcgcggggaagagaagagttgggccgaaatcggcccaacgacttaggggaggattttaaaaacttttccaattaaaataattcgtgaaatgatgtttcatttattaaaatacttcccttgctcaaacaattcctagaaaattctagaaaatagaggaacaagcaaagtatttaataaaattttatctagctcatttttatattgagatttaacaaattaaaattaggtcttatcttttaagcttttaaaattatttctaataattccttttaaacaacaatttataatttaaggattttaaacaagaaaagaacttaacaattataattagatcattattgatcaaataattactgaactgttctttgtatcatttaggaattgagctccgaaaaatccgagaaaattccagagagtataattaaccatggagaat

SEQ ID NO: 20117 - DNA, 9263 bp, Oryza sativa
tcaagacttttaaaattatttctaaaaattccaattaaacaacaatttataaattttgaattttcagggtgtgacattaagaccataaacaaagcactgccgggagatacccggattatctttgtaagttttctttccaataaaagcaagaaactgtgtttaagatagtgtacacattcgggtattcttggtcgctaaccatttcacgttgagattaagagcgagggtcatacgatgcctaagaacacgggagccacatcaaccgtacaccatggtgatccttggtaatgcgatacgctttataagaggccccagtatcacatacttggtttttgacgtctcatgacacaaaagaccaagtgtgggggagggaggtctacgagcttgcatgaagaattccatcaaccaagaccatcttggtttacagttggtgttagtcttaccttgctgaaaaaaggaaaaaaaagagaaaaaaaaaggagagacaacaaaaaaatgaaaaaaaaagatgggagaagaggaagagagcaagagagctgacgggctacatttagatcaaagaatgcattatgtgtgagtctttaaaaaatggctatacaccttgctggtagcgatcatgatgcctggctacacccagcctctctcttgagctcatgtgttgccttggcttagccttcatccactcctagctgtgcacaactcctcactcttgcatcacctactcgcacacaagcaagaggagatgcactcttcttttctaggtgttttctgctccactccagttggtacttgcatatttgctcaaaaagagatgcatcctacgtctctacaacattgtaccaacggagagaatttaacttccaatctcttcacccagcgaaataaataaaataagatgtgtgggcgtgccagtgtactaagtacacaaaataaaatagaagaaggaaaatgcattttattataattcttgaagaattacaaaaatacaaaaatccttggtcaaatgcgctccacagctcattgacgaggtggatctgacttggcgactgtgttctcatggttcccggggtctcggaaaacacccggttaattactctcgcgggttagaccgcgagacacctcaaattaagctacgctggtcgtcgtcgtcggtcttcgcttcacattctcccatgcatgattgtgatggtggtgatggtgtcgatgtgtgtgggcgctagtagcggttcacggcctcgtcggtccgtgcgccggtgtaggtgacatcgacttcatatagactccacttgtccgtgccatttagcctcatcagtcttaaaaagcgtatgtagttggcataggttttttggttgtaagcactaggaggctggtacaactcttcttgaccgtcttggtgccatgtcaatagtgggagaataattgggagagaacattgaccaatcgttttgctcgattatcgtcgcggtaggtctctggctcggtgtagaggtacatgttggtatggccttcagtcgaccaatcaccgtgacactcgggatagcgctgcttttctggtttctagcacaatggctgaagatcattgtggtacaggagtatgccttccgatcattgcactgcacactcaagattaagtgattttaggggatgttaggggcgtagcctagcccgggaacgatgagatacgttctaggaactgggtggccctcttgtatatgtgcctgacaatcggagccgaacccaaattttgttgggtcgcctccgatcgtagtggcttaactcgggagtgcaccgacgacggccacgacgaaatcatacgtcatgtgtatgggcgttgtggagtgagagacatcggtggggatgccgaactcgtgatcactagatggtgaggtgaggattcatgtgaggatgacgccagtggcagcgacaagttgaagaacttcgccggcagcagtcgagcagcagacggtggtgcatatgcatagatatatgtatatatatccaagaatttcgtcattggacagccggggtcgtcgagcgtgacgacagcgtgagacggacgcgaggtcattaccagcccgcggtgatgccaagaatgttcgtgaaaacagctagtggctccaaacttgcacgttggcgacgaatgcacgattggtaccggcaacgacgacaagaacgggcttgtcattggcggagaaacaatcagtgcgggcgatgatgaccagaaacaggttcgccatcggtgatagccgcaaggataaatgtatgccaatgatcgttgaagatgacgaggatacgtcctgtttgtggacgagatcgcatcaccggcatcgatgacaatcatgaagacgcctcggcggtgcgggtctgagagtatgatcggcgacggcaacgattcggcaatcatcgtcgatggcggtgtacatataaagattttgtcatcgagcggtcaagaccggcgagcatgacaccgtatttgtgggtatgaggatgatcccgacgtgccgaagcgaaagcgtcgtggaaggatggcacgacgacctcagccagctaaagcgaagggatcatggctggacttggcgacgatcgtgcaagcaccaagcaatggcgctccggcattcttctcaggtggctcgacaattataacatgaggaagatcatagcattggcgaggatgatttagtagacatcggcggcaacccgcagaggctacgatgagcgtgggggacagagggcgtcaccgattagtagtctttgtggggcatctctgcccagcaaggctgcatcatgacaggtgccggcacatatagtctgacaataccatcgcggcttgtggatgatatgttaacgacctccgggtatcggcaaccaaccccttggcaacctgagaatggccttctccggtgggcatcggatggtgatggggacaagcgttagttggcaacgcctcatcgtctatggatttgggcggcttagcggcgtccacgggacaacggcaactccaacgagatggctcaagacgcaaccagagctaatgacgcctttgtcagaaaaaaactcacgcgaactggctctcagtctctctaaaacacacactctgacgcttgtaggtgcagctacagctaactgaagaagttccgaaaatacagagtcgtacagaacaactgacgaacagagttggcgctgcgtaatacagtgcagctttttcggttttctcttctatttattcatctccacacagattttgttacatgtataatagaatcaaatcatgacaatctcggatcaactactgaccgcgccatcccacgatccgagccgagtcattgcagctaaagaaggaagcaaatatgctaaaacagaaaaatgctattctactggctagaattcagactccaacagaactctacatgcaacgaaacaaaagagaatataaatgctcaagattacaatccaacaattcaccccctaatcttgaagcatcagactggaactaatcccagcttgcctctcaactccaaaaatcgaatcttaccaagaggctttgttaaaatatctgcatgttgctcctctaaccttatgtattccacctccacccgtttctgatcaacacaatcccagatgaaataaaactttgtatcaatatgtttactgcgatcatgaagcacaggattcttcaagagacttatagcagacttgttatcaaccttgatcagtgcacaaccaggttcttggccttccaactcacctattggtcgagccagccacactccttgtacagcagcagttgcagcagctatatattcagcctcacacgaagatattgctaccaccttttgtttttgtgactgccaactgatcaaactgtctcccaatttaaatagaactccggttgtactctttctatcatcaatatccccagccatatcactgtcactatagccattcagctgaggaacctgttgttgcttctttctgaattccaccccgagattcagagtacctgccacatacctcaaaactacctgggtggcctgcgcaattgcgcggctagcacccaaacaaaatcatatattttttagtattattctacttaaaatttattaaatagctatctcattgtcttaagactttgaaagaccaaaccttatcatcctcgtgtttctaattatatagtttttaaaagttacaccagtatcatcctcgtgtttctaattatatagtttttaaaagtcacaccagttgctacctcctatgtcatctctttctttatttgcttactcgatctatcactatttctattcattctttctggaacctttaaaatttggattttatagttttagagtttattgtcatatagggtttcgtttttataatttccagatgtcccgtcaaacgttgcgattatactcctctacgacccgtccactgtctcttctctttattgtcattgagatttgtcacgtcccaaaacgaccctaaaatatatcctttaaattatgcctagaataattaaaatccgtgtgaaagcctccaaaaattaaaatgtgcaaagtaaaagtcaaacaaggcttagaggatttttgtatatttcctaaaagcctgaaatgtgtaaataaattttagtggaattttcggagcacaaaaaaataattaagaaataaataaagttaaaaaggttttataaaaaaagaaaaaccctaaaagtcccccttccctcctttgggccggctcggcccatctccctctcccccctctctctctctctcctctcccccgcagcccattcggcctccctccccgcgcgcgcaccgctgacaggcgggcccgcccgccaccctcactgacgggtggggcccacccatcatccccgtcctcccgccgttcctgccgccccgcccgcgccaagcgccaccgccgccgccaaatccgccacataccgtcgtccccgcgtgcaataaagtggggggaaatactccccatgattccctctccctttccccccatttttccctctctcgcgttcaaacgggcggatttgcccccgcaaatctcgccgccgccattgatggcggccgaacctcccgcgccggtttccttcctccccagccgctctctccccttccaaccctatttaaacccttcccgcacctcctccgttcgtttccgcctctcgccgcccttcctcctcgccggattcgagctcgcgacgtcgctctctctctccgccatcgccgccgagctccggtccgccgccgtcgtcgccccggaccgcctcccacctcggcgccgcctccttcggcttcgccgcatccttgccgacctcgtccacctctccgtttcggtcgccgaccgccggagcgctgccgtccccgtcgacccgagccttgccaccgcctccctccgctctggccgcctcctccgtcgccgccgtcgcctcggggtgagttgtggaccgtcgcctcctttcccccttccctcccctctctcggccgccgctccgccgagctgatggtctccgggcgagggaagccgcctcccgtcgaccgcgccggcatggccgccctcgggcgcgccgagtggctgccgcgtggggcccggctgtcagccgcccgcgcgctcgggtgcggctgacgtgtggggcccacggcgccggccggcgtgagccagggtgcacccggtccaccgtggaccgtgaggctgccgcgtgggccccactcccatggacccggtccgcgcaccccctccccctcggctgacgcaataaaccctttttaaattaaaatttaaataaagaaattcgcaaatattcatttaaatagcatataaacttcaaatggccataacttggccatttgaactcggaattggaccattcaagtctctaatttttccttaagaagtcaagaacccatttttgtgctttgtttctgcttgttatatggagtttattagagtaaaagccttttcttttctgttggtcgtgtagacgctgcagcttcggaagatccgctcttcgtggaggttgaagccgacgtttgggaaagggagcaaggaaagtcacatcatccttgaacatattgaatcccaatttataaaattattttgatttaaattattgcattatcgctttatttaaattcccgcgttatcattgttttatttagccatgcctatttacctttgttatgaccttattattattgctattgttattattaccttgttcaccctagaataaaccaaaccccaactagtggacactctactcatggtaccactagtatgaatttaggtagatgcttcgccgcttaattaggcaacattaggtggttttacaactctagactttgggaatattcatatcacctggacattatggaatggttcaattattgtggaattggattcacacctccccctctattcaaaatcctcaaaatggttttaggctgggctcggggtgcatggttttgatagtagcacctcggccatataaggaccggtcttcgggcctctgttgcaaagcactaccgtacttccacatgtctagtgggtaaggcttagtttgtggctcagtttgattataaacaaaagtacccggatggagatggacgaagtcgggggtcgatggacatctctagggcaaatgaaggctacacgagctgcggcccggtagtcgagatgtcatggcacagggccggtgtcctgctgctaggggctcagtcctgcctacctgtcccggaggttccggccgtaggtagggttgggtcggtactcttgtctatggctaggatgggttggaaactatgtcatgtcttccgtctgtataccatggtggtatgtggcacgtggttacatgtgaggaagatgtgtcttgtgggtaaagatctacacctctgatcagagtataacctattcgaatagccgcgccctcggttatgggcaagccgagcaatgtaccaaagttagtgttttaattcttaaaaccttcttaacaactaaaatgtggaatggttggcctgggttggcttgggacgagctgggacccagggtcgggttgccagttcggtctgaatcatcgtaggccttgggttaaggcaggttcgtgtgggttcacggccttgattaataatattgtatagctctagggacatatttacaaaatagctttgagcaactaagtgtcttttaatgctgtttactgcaaaccctaacccctatattatggctcccttgtactcccttccatttattctgcacttatgggtgtgtcttgttgagtacggtggttgtactcagtcttgctcaatttttcccaaacccagaagaggagttcctggaagatgaaggctttggtgtctagctcgtgcctgccgtcaagcgcctgtggtcgtcgccctagtctttcgctgttttttgtttgtcttcttgtgtgctgggccttcgctgcccatgtaataaattaactatttacgcttccgcttgataaactctgaaatgtatcaacttttggtgtaccttgcctcctcggacaaggaataatacacgcacgtaaggaacgcccgttgggttatttccggtcgtgacaagattttaaaaatcaaacataattatcgtttgggttcatttttactttaagtcccgtcaaaccgtcagcggctttgctattgtactcttctacggctcgcccgctgcctcctttctttattgtcgttgagattttaaaatcgaacatgattatcattaggtttttttactttttggaagttccgatcctttaaaatttgaacgatgccactatgcccctctacagcccgtctgtcgcctactctttattgtcattgtgattctaaagatcgaacataactattgttgaaattcattttttattttctataactcttatacgcccgcccgctgcttctccttttatgtcattgaaattttaaaaatcgaatatgattatcaatggggtttatttttttactttctagaagtcccggcaaccgccttacttgtttgcttcacagcctgcctgacgtccctccttttaatcgtcattaggattctatttgttgttttattaacatttctaatttcagaacttatttttttaaaaaaattagttaataccgtattgtgttctttaaatgtttttattttttttatttttaatttcagttgtttcaaaattgtattcctacttaaactctcttttagtttttcaaattttagatattattttattttttatttgaaattttaattaatctcgtattgggttcttatacggactcttctttcaacattgcttatttttaattccgaatttcagctaattttaaattgaatttctacttgagctctccttttattttcttttgctaatttcggattttttttatttttattccgaattttaattaatctcgtattgggttcttatatggactcttcttttaatatttcttatttttaatttcgaatttcagctatttttaaattggacttctacttggactctcctttccttttctaattttagattttattttttttattttaaattttggttaatctcatattgggttcttatatggaaacttctttcaatatttcttatttttaattccgaatttcaggtatttttaaattagacttctacttggactctcctttttctttttttctttttcttcgattaatgtgggaatttctagcccccacagcgaacgtggtgcctcctttcaaggctgttttaataatataatagatagatatgtttcatggcagcccaatgttcagaggtcggtttctccataaacctgctaacataaccaaccgaataacttagatgaggtcttgtgttcaccaagtacctcaagctcccaattatgcttctgaattgagtttcctccatacattctcctccctcctttctcaacttcaaccgagcatccatgggagtctgacatggattacaatccctcatcccagctttgtcaagtatctttgctgcatatgcaccttgagacactgtgatcccttcctttgcatgtttcacctccatcccgagataataagagagcagaccgagatcactcattttaaaaagagcctgcatctgctccttaaacttgtttatttccatcagacttgctcctgtagtaatgagatcatccacatatacaccaaccacaagtcatgagttcttctctcctcgagtatacacagcacttttgacaccactcttgacaaaa

SEQ ID NO: 20118 - DNA, 10781 bp, Oryza sativa
accttcaattgattccatctcttcaagcatggccttcctccagcagctctcctgctcagcctccaagaaacttgctggttcctctgctgccataaggcattgatcactgtaattaaaatctaggattggggtcaaggtggcaagcgtgttcaccactgttctgtagctcctgggcccttcatcagtcccttcactagcatcagttggaggggaacagaattcaacaccagatggcagagttgttgcagttccggtgcttgatgttggtgatgttgctagcatggttggagtggctgctgcatcctgggcatgtgtctcactcccttggactgggattgtgaaattctccaccgtaaactccacatacgcgtcctgatctccttcttcatcagtgttgctgccccagtcccagaacgtcgtctcataaaaaaacgacgtcgcgtgacacacacacgcgtcgcaccacaaaatcatacatcttgtaggcttttgatccttgctcgtagccgatgaagaccatcctcgtgctacgatcatcaagctttctcaagtttggcttggctgtcttaacatagcccacacactcaaacacacgcaggtgttcgacagtgggtcggcgaccataccacgcttcatacggcgtcaccccatcaagactcttcattggtgatttgctcaagacatagacggctgcaaccaccgcctctccccagaaatatgccagcatgtttgccgccttcagcatggacctagctgctgccaccacagtctgattgcgccgctccacgacactgttctgctgccgtgagtagggtgcagtgatttaacgtttcacccctgtgtccgcgtagtactccatgaactctatagaggtgaattcacccccgcgatcagtgcgcagcgccatgagcttccgattgctatccttctccacgccggcttaatcgctgccgatgcttcgtgtttggcagagaggagtcgtatccacatgtgatgactcatgtcatcgactaggagcaagaaatacttcttgccccctgtcgtcgccggcgtgattggtccgcagaggtcaccgtgcaccagctcgagcgccgtctgcgccctgtactgcgcctcctctgggaacggtgtgcgatgttgtttgcccgcgaggtacccgtcacacaactgatcaatgtgatcaatttgcgggatcctgcggaccacgcctccttttgccaacctccgaagtgccaggaaattcagatggccaaatcgtgcatgccatcgccatgctagctcggagccgctcgctgccatacagattagtgtcgcaaggttcaacttgagaacatacaggtaacttgaatcacgatttaccttagctagctgcatcccttccgggtcacgcaacgtgaaaacaccatgccaaatgtgtgcgtcgtagccgcgcgcatcgaggcgaccaacactaacaatgttttttctcagcttggggatgtagtacactgcctctagtgagcggtgatcaccattcttgctctgaaacaccacagttccgcgcccctagatgtcaaccactgagccatcgctgaatttaaccgtgcccacaacaccagtgtcaagctccgcgaacgctgagcgtgcgcccgtcaagtgattcgtggccccggtgtccaggaaccactctccagtcttctcctccttacgcccatcctcatggtccagcacaaccttcttctctgtgagatgcacttcctgcacacaaggtgttcgaccaacggccgcttcgccggcgagcgacacccccatcacgtgtgccatgagcagagtcggctcttcctcagcctggaccagatttgcatttgcctctccccgacattggcgacgcggcatacggcactgcttcgagtaatgaccgtattcatcacaattgaaacacttcaccttagagatgtcacgacagccatggccgctggtggccatctcctttcccttcggtgaatcgccggccttgcctcgacggttctggttgccagagcccgcccggcccttgttgctgctgccagatccctcctactcccgctgcttgacaccggcctgccactgctccttagtgaggtacaatttgccaccgtcacttgcctcctcatcatcactgtaggagtcgaccgtcgacagccactcgatgagctcctccagggccatggtcttcacgtcgaggagctgctcgagggaaattgccaccggcttgtacttcttggggacaacacgcagcagcttcttgttgatgtgttcgtcttccatgactccgcccatgttgcgcatgtccgcaacgatggcagtgagccgcatcgcaaattcctccggtgtctcaccgtccttgaagcgcatcgcctcgaactgacggcggaatccctgctccctcgcctcgctcacgcggtcgacaccgacccgcatggttttaatggcatcccacgccgccttcgccgtgtcgtgctttgccaagccgcgcaacatctcgcggggcacagcttggagaatcgccgagagcgctgcacgatcctcgcggtactccgcatagcagggatcgatggccgtccagagcccctgcgcctgcaggttgacgcgcatcaacagcgctcagtctatataatttgtcctcgacaggatcaagagacgggcagtgtgccctgcatcgactagcgggagtgatgccgcagccgttgtcgcttcccccgccgccaccgccaccacgacggccaggcggtgtgtatgacattaccggatcgtctcagcaaagctctgataccaaatgtcagaaaaaactcatgcgaactggctctcagtctctctgaaacacacactctgacgcttgtaggtgcagctacagctaactgaagaagttccgaaaaaacagagtcgaacagaacaactgacgaacagagttggcactgcgtaatacagtgcagctttttcgggtttctcttctatttattcatctccagacggagtttgttacatgcataaaagaatcaaatcacgacaatctcggatcaactactgaccgcgccattccacgattcgagccgagttaacgcagcttaagaagggagccaatttgctaaaacagaaaaatgctattctaccggctagaattcagactccaaccgaactctacatgcaacgaaacaaaaaagaatataaatgctctaagattacaatccaatagccttgcaggcaccaagtagtggtgctccggccggcgttctcttcaggcagcaaggcaatgaatgtgaagaagatagcagcgttgatgagggggagcggacgtcgacggcgttgcagagaagaggccgaccagcaaggtgacgacgtccgagcatctcggcgacatctcctcgccatatagaaacatcgtcttcaacatcgccgcgccatatagaaacatcgtcttcaccttgacggagacttgcagacgacgtcaactctggcgactctgacgatggcggtgcatccggcatcttctctgctgaggagcttcataccggcgtgcatgcgctgaaatggagcaaagggatgataagaaaataggctagttacccatggcagtgaactggagcggcatcgtctccctggtgatcgtctcctccttagcgcgcttcctcagcggctcagcgcacgcgcctccttgccggacgccgaggtacggcagccgatgtcgccggccgcagagcacgctcgttcccgcaggacgccgagatactccggccaagacgacgtgcgtgatggttgccgatgagcagcctgtgtccgctctccttgtccttgtgtttctgtgtttctctcctgtgtctctgtgtatgtctctctagggactactgccaaggctgggcatggcggcagcggcggcgtgaactgcaggccctcggctcgtgcctctgtactctctctgctgcctccccccgccgtgaaggaaatggcctgttttatagtggcgatccggccgtatcagagatccattgatgtgcgatcactttccaatcgactgtggcgcaaagagagcatttccttgtatttgtatgcacacgcgcgtcccagccgcgcggacatatatagcaaggatctttggccaaaacaatattatccaccgtatttattttaattccatgcaaatgcatattcgaaatctactgttgattccaaatgagttagagcccgataactatccaactaaagaggattttttttagataatggaatagatcatcccggcctttgctcaaaagagctacaaccaattattacaaactaacactctaaaacaagtaaagttcaaaaaaaaaaataggacaccaatttaagaagtaaaataaccaaaataggataaggagtacacatttattgaagcctatttgtgaatctccatccatagttggtaaaaagttgtataaccgtcgtctcaagtttacgacatgcaacctttagaagatctccgtcttcatcacacctttataattgtgcccaaaatcagagccaatatgttgctctgaaaattatctgcatatatgtaaaagatgatgatttgttaaaaaccatatcattcctgctcaaccacagcgcccaacatattgtagaagctccaaccaatagaagtttactctttttcttgtccacccctaagagccacccatcaaaaatatgagaaatgctagtaggaaggtataaaccaaaagagaattgaactgctctctatataaactttgcatgatgacaattcataaatagatgttaaatagactcatttttcatacagaaacagcatcttaaactgtcattccaattttgtttagtcaaattatctttagttagcactaccactttaagcaagtaccacataaagatcttgatcttaagcagcatcttaagctttcaaattatcttgtttctctcaatgttgccattattaatcaaggctagatgcatcgacctaaccgagaatcgtccactctgattaaatttccaaataaaacaatcaaaagattgattcaactgaacatgtacaatagaagcacacaaatcatgccaagatacaagattatgaccaaccaatgctctcctgaacgaaacattaagcggaacagagcccataacactagcaattgaagaatttttccttctgataatagcatataaggatggatgcttatcttgaaaagcaagttccctaaccatttatctggccaaaatcttacttgttccccattattcacattccaggaacccatattcaagaaagtactcttaactttcatgtggtctaaccaaaaatgagaatcaccttgtttcctatcaacttgggttatagactgattataaagatattttctcttcaataagtcctatcaaaccccttgctcatttattaacttaaacaaccattttctcaaaagacatttattttgtatttcccaattatgacccctcatgccgccctgatctttgggctggcatataatatcccatctagcaagcctttactttttcttatgatcatccccttgccaaaagaagcgtgatctataataatcatttttttaagaaccccttttggtatctcaaaaaaggatatcataaacatagctaaacttgaaagtacataattaatcaaaaccaatctacctccgacagacatatgtttacctttccaactactaagtttcttttcaattctttgtgcaataactttccaatccttgttactaagctttttaaaatgcattggaataccgagatatttgacagggaagttacctaacttacaaccgaagatattataatactgatcataataatcctttgcgtgaccaaaacaaaataattcacttttgtgaaaattaattttcaggctagatagctcaatttcagcttttcaaagaggatattgtgatggaatgcttccattccaaaattttctagcatggaatgggatcgtgtgtgtttccattttgctttatatacacattgtattgaccagcagagagcatgcatagctgccgatcgattgtcccatatatattgccattcatcatcaggctgacctgtgaacccaggtgatcaagtatagatgcatatggcactgataaagatgtcagacaagcaacccctattactttctggtgcatttgtgcgtccttgtcagtaatcacttcagttaagactaattaccgtgtttaactaatcatggaatttacgcatatagtgaaaacttgtgggaaatgcacacagcttgtttgtttgttccttcgattggcacattcatgatttttagttttacttaaaaaaaatgcacaaaatctcgtccaacacaaggtaaagggttcttgcacctgagatgtgtgcataaccgaagcactcgcttgagttggcgtgatcaaagtgccttccttcaccacaacccgcatcaagacggaggagagatcgacaatcacatgtgatcatgctaccgctccagagatttcaacatatgcatcatgccggcggtaaggtatacaaaagacagcaaatgattcaccatttcttttacacatacttgtctttagatgagtttggcttgatcatacctggttatgcgtcctcagtccattttcgtatgctatggtttgggtggtcgtcgacattcataggctttttaaaattaagcatgatgcttaggataaatagccttctttaattaaagttgacgtggtgtcaagtttgcttaaatgaaccgtaggtccagtactttcatggacttcggatgtatatccttcgtgaactaacccctgcagggaatttttcaaattgacgagcgagtcctcaagcacgagtcacactggaggtaagacagagctaggagaaaaatcagttgctaacataaaaaggagaaacatatcacctatcaaggtgtacggtgcgcatatttctaattgctcctttagcatgttcatgcaaatttaccttagccctgtatgagttttgcttaaatgaaaatttggtgaacaataaaaaaaattgaaagaaagaaagagaaaaaaaagaaaattttgttttcaaagaataaaagaagcgtctctcgattaaaaaaatttgtctctggagtaaaaagaaaaaaagatgatgacaaaataaaattatggcaaatttgtgggatccatgcttattaagaatccaattccttgttagcatggatgtgaacaattaatcttcaggctatgataaaatcttttcaattttttgttgtccctcgggtatttgttatccactaaccttttgcaggaaataaaaaagacaatagaggagtagtgtaaaataactccaacattcataccacgctccttagtctatgagaagacagatgcttaggaaaccaagcagaacaaatgcaaagttgtgctgtattcttgcatccaaatcaaagcttggtaagacctatctggtaataattcgaaacacctcgtgcatcctcgcctcacatatgtccaccctgctaagttacccatcacctcaattgatgccataataaaaataaaaataaaactataaaaattataaaatgaaaataaaaataaaaacaaaataaaagtgaaataaaataaaagtaaatttaggcacttcatgcgcctagagttacttaaataaaatttggctcaccgatattttaccccggtagaagcctattttgctttccatcctttttgttgaataaagacaagccacaacacaagtgtgggggagtcttttcgaactctcgacgcgcaacagcatcgactcaacatgacactgtgatgaacaccagcctatggccgcgcacaaaattcagcagtcatatatgattctcattgcaaggcaatactcctcagcgactatattattaactaccaaggccatatatgattctcattgcaaaacattacatgtataggctgactgacattacattgagctttctcaaattattgtgacccatgtgagatgctttttgatactttcattatcaagatcacgtacactaaacttacaagcacgtaagctaaatttctacactggaagctagcatccattgtccatcatttattttatccattatccacaaaataaatactccatgtcatttatgcctcatcctccaaaattctttcaaaaaaaaaagagagagagaggcatggctacccaaaataaagaaaaataaatttttgctcatagaaaaatggagcattgaaaagaaaaaaaggagagagaaaatcttgctcatataaagtttggggaatgaaaaaaaaaagaggaaaaaaacggatggccatgccctttcttaatatggacaatgagagaaaattggaggaggaggtatatcaaaggagttgtaatcatttatttttcctttttccacccccaaaacaaccatacacatatcacacacatgcacattcttgatcagagagtatgacttgcgatctccttaggtctggtcttttggcttggtgaaatatgtgatgcaggtatgccccgattgatccctaccaagctccacatatacaaccttgtagaattgggacaattcagcaaaatatgccttggtgagaatccacaaatcaaaccacacgagagacttgagagaaagtcattcgaggagtatatctactttgaaaaaatatatgaaaacccaagagattgacaggaggaacaagaaggacttgagccacgacagttccattcatcaattacccaagatggatagttagacactggaaagttcacaagtacttgtatggcttagaataaattgtatacctgtattatatcttggaaagttttattccacattcatccttaaccattactcggaacgagtaaagagctaagtgtgggaggttttgttgatggctgttaaatacaaaatatatgccgtcaatacctgcataaaaccataaatgtaaaacatcaaccatagtggtagggtttatttctaatgatttccactagtgctagtgtatatttgtatgcaggtgacaaattaccagagttgagaaaaaataaacatgtaggcagggggattatacttcccgttggagtccatggagtgatgagcccacaaaccatattaaatcattatttattgggccaacgctggaagaataataaagagggacccaaatgtcaggagatagaagaaggccggaggcagttgggccagcccatggttcggctgaaccgccatgaagcccaattcatcccagccttccatgtgggcgtccaggattgctccctaatgatggttggatggtgtttgggacatttcccataatgtaactatcatatgaagcctataaatagagctcctctccctcattccaacacacaccaagacgtagagctgaattacaagaggctctaagtatactttaggttcattatatgttctatagtacacttagaatagggatagagtaaagtagaagaagtcggaggaatcccagagttgtcgataatcctctctttattcttgtactttgttaattactctggttcaatagaaatatcattctgagtaattaagatttgcttagcgagaattattcttcgttagttcctaattagcatatgggattattgttcactatagtccattaattatatagtgattgctttagtctttagctagcactagagtagttattaattgcgtagacacggtgtctggataattaatttccagtacttgctgcgtatcccacaatacgttagacgtgggtgtagaggtggtgatagccctcaagagcacttaagtcctccctgtgcgggtacatagtagagcgacatctaggaacagcgagttgctagtgcctgaagtatcgcgttaggattaaaattaagctttccttggacactttttctcactaagaaatcctctctgccctgtgcccatatttatcttatgtccttgatgaaccggaggaagagataatcacacacgttcccttggattcgatacccttgaaatactccgtagggaaagtcctacatcggtatatccatgcgcttgcggattctatctgtgatcgtaagaaataccaacaactggcatcccgccatgcctcttgaacgatgctgacctcgatcttgtcggtgatcaggagatgcaagcctactacatgctaaaggatcagatatttgctcacacgcgggcatacgatccggagctactaaaaaagataggtatggatgttaattctcataccatttggaaagttgttggatggcagagatttgcggtggcagatgagcctggttctcgtttgcttactttacaatttcggtacactttgaaagaaatagaagatggaatttcctttcgctttttccgtaaagaatttacacttacatggaaatgattaagtacacttctttgttttcacgatgactataaaaccgttcttcggaatttctgggttcgagaaaaacagattttgggaaaatatttctggtggtccaatttgcaagaaacctagaacgaatgacatccataatcctacacttaggcttatgcacaaatggattgttatgactttgtttcctagaggtgatcttaggcctataagagaggataaattgattatcatgtttgtcacagttaggaagattaaagttgctcctgtgaaatgtgcaatggttagagagtataaagtttactgctcctgttgagtgcacttccctaattactagcatagcatacagacttggggttatttctaatgatcagattg

SEQ ID NO: 20119 - DNA, 2833 bp, Oryza sativa
agaaatgaacaagaaggttcaacatccgtgcaaatgtacgaagccggttagtaaccatctggggatgcacccggatggacccaagctctacaccatagcctcagaggctcggtctggaagagtgccagcgagagccgacagagagcatctcatgacatacactggggaacatgaacattcattccctcagatcaagcagtatgccttcatcccccaatgaatggtgaatggtgctcaagttcctctcgttaggacttgggagaaattacaaggaggatggataaaattgacatgcaaacgggagagatccaattcaacctggatgtcgatttctaggatcggcaatatattttaaaaggtgggctagatcaaggatagatggtgacgcagggattatcttggttcaagccctctgagagaggaaataccgtacgtccagtgtgttctttcttgtgtatagtggaaaaatggtcggagaagctagacagaagagtcgtggagatgattcgacctcctctagggaccccttccccctcttatataggatgagggggagggttacaaggaaagtatctagttgattgcaactagatcaacctattctatctataaaagatatgcaggatcctcgggatttatatcttatcccgggaatctctctttctttatttacaagtatgacgcatggggcctaggacacttggcccaccccatgcagtgtggcccaagggttgtcattgggtacccgggtaccgtgtaccccccactcgatgaacacttaacacagacgcaagaatgacaaccgaatgttgatgctcagttcaccaacaccaacaacgcaacctgatgcagcaacagcatgacgaccttcaagcgtactttcgcttccaggggttcaatccttatcaaggaccctgagcgaaaggcaagcttggtgggagacgtctctccccccgctgaggtaacttgtatcacattgcatgtttccctttccaaatgcatgttttattttcattgcatcttataaactaaaaacaacataaaaattgcaaaatagaaaataccaaaaaaataggttagactttattatgctaggtaagacaactttttttttgactagaaatactgccaggactttgcccagcagtgtagttttatagaactcaaaaaatgttttcaaaattacagaggaaagaaaccacacaaagactataaagtttttaaccaatcagaaacaatttgttttaagggacatatgtagaagaatttctttcacaaaaagtgatctccaagcttggaaagatggctgaatattctgtaaagtaagacaacttagttctctttgttgaaatgatgaatagttgctctgttttatatctctcatatatggggtcatggttaaatactctctcaaaagtcgaataagagtagccaacaaatatccgggagcctaagggaagtgagctgcacttgctgatttgagtctaagttgttgtgagatatgagatagtaaataagagttgttatgaccctagtctgaatttgacttgaattccaaatgttttctttttctaaaataataaactcatgaagttcctcatttgatataaatttctaccaaagccaaaagtattcttattggataaaccatatacattttggtgggctgtaattccattggactttatcaaatttttgtgacttgggtagaactttttcatgctttatgattaagatcacacacccacatatatgcacatgctaactttctacactggaagctagcatccatccatttcatcttgatattccttcataccaccatccaaataaattctccatgcttaaatgtgctttcttctcctagaaagaaaatcctttcttaaaaaaaagaagagaaaataaggagggaaaggcatggctatgaaaataataaacttatgctctctcaaaatataaatcatgatgatgaaaaaaaagtagccatgccctctccatatttatgaaaggaggattttggagaagaaagtaagcacaaaggagaagcattttctttattttccacattccattttccacaatataacacacacactttgcacgatcttgatcttgagaatgtctagtcatctattttagtccaagtttttgacttagtgataaatgtgagtacaagtatgccaatgccatcgagatcatctacagtatcttcggtgtagaaatttgaaccctcaacgacgccctcaaaacaacaattagggctctccatctctaactggttgtatatcacaatcggacacttttagataatctccatcccaaacttttccagataagcaatcaactccatccatctcccaaatagtcaaatcggcattaccaacattaactgacttgtcggctggcacgatttctatctggtctcctttccattggatcaagctctggtgcatggtcgaaggaatacaacaatttgcatgaatccaatcccttcccaacaacatactgtaagaacctttcccatcaatgacaaaaaaggtagtagaaattgtcttgctgccaatagtcaactccactttcaaaattcctttggttctgaaggattccctccaaagtctttgagcaccatcttagtcttgatgagatcatctgaattcttccctaacttcctgaaggtagaataaggcatcaagttcacagcagccccaccatcaactaacatcttggagatcggcttgccattgacaaatcccttgacatataacggcttcaaatgccgatgccctgttccttctggcttctcaaagatagcttgcttaggtgacagacccaa

SEQ ID NO: 20120 - DNA, 2649 bp, Oryza sativa
gtctctgtgtgtgctgggccttcgttgcccatgtaataagttatctatttacgcttccgcttgttaaactctgaattgtatcaacttttggtgtaccttgcctcctgggacaaggattaatgcacgcacgtaaggaatgcccgttgggttatttccggtcgtgacaacttctccgcgccgagcagtgatacggaaaggacccacataccgaggtgcgagcttcccctttgtccgaaacctgtgtacacctcgcaatggcgtgacccgaacatacacaaagtcatccactgcgaattccaggtcacggcgacggttatctgcataacttttctgccgggactgtgccacctttagattatcccgaatggttctgactttagcttcagcttctctcaggatatcagtcccgaacacttggctttctccaacttggtcccacaatagcggtgtccggcatttgcgcccatacaacgcttcataaggtgccatttgtatgctggcttgatagctgttattgtaggagaactcggcataggggagactcttatcccaggtcttcccgaaatctaggacacatgcgcgaagcatatcttctaggatctgatttagacgctcggtctgtccatctgtctgcgggtgatacgcggtgctgaaatttaatcgggtacccagctcttcttggagcttcttccaaaagtgagaggtgaattggcttcccctatcagatacaattttcttggggacgccatgcagacttacgatcctagcgaagtagagttcagctagtttgttccctccataggtggtctttacgggaatgaaccgtgctaccttggttagtcgatccacgactacccatatagaatcatatccgccttgggtttttggaagtccggtgataaaatccatcccaatttcatcccatttccattctggtacttggagaggttggagaagtccggccggtcgttggtgctctgccttgacacgctggcacacatcacaaagggccacgaactctgcaatttcccgcttcatactaacccaccagtatttctccttcaagtctaagtacatcttcgtactgccagggtggatggaataaggactttcgtgagcttcctgaagtatcagctgtttaagttctctgttatctggaacgcatacccgatttccgttccatagggttccgtgttcatcctctgtgaaaccagcggctttaccctgtttcatattcttgaggagcccatgcatatccgggtcattcttctgagcctcgcgaatttgatcgagcaaggtaggcttggcttccagcgtagccaagaatccacgactaactatgcttaggttcagggcttccatctgttgattaagttccggtggaatgccacggacgttaagagtgttgcaatggctctttcgacttagagcgtcggcgaccacgttggccttaccaggatgatagtgaattcccacatcataatccttgatgagttctaaccatctcctttgccgaagattcagatccgactgggtgaagatgtatttcaaactcctatgatcagtatatatttcacagcgattcccaatgagatagtgccgccagatttttagagcatgaaccaccgcggctaattccaagtcatgggtagggtagttgccttcatgaggtcgaagctggcgtgaggcataggccaccacatgaccgtcctgcatgagcacgcaccccaatccttggcgcgaagcgtcacaatacactatgaagtccttgcgagtatccggcaagattaacactggcgaggcaaccagcttttctttgagagttctgaacgccttctcacattgcgggctccacacaaatttctcttctttcttcaacaactgtgtcatgggtcgagcgattttggagaagttctccatgaacctctgtcacgaccggaaataacccaacgggcgttccttacgtgcgtgcattaatccttgtcccaggaggcaaggtacaccaaaagttgatacaattcagagtttaacaagcggaagcgtaaatagataatttattacatgggcaacgaaggcccagcacacacaaagacaaacgagaaacaacggaagactagggcgacgaccacaggcgcttgacggcaggcacgagctagacaccaaagccttcatcttgcaggaactcctcttctgggtttgggaaaaattgagcaagactgagtacaaccaccgtactcaacaagacacacccacaagtgcagaataaatgcaagggagtacaaaggagttatactataaaggggttagggttgcagtaaacagcatttaaagatatttagttgctcaaagctattttgtaaacacgattctagaactatacaagattatttatcaaggccgtgaacccacacgaacctgccttaacccaaggcctacgatgattcagaccgaactggcaacccgaccctgggtcccagctcgtcccaagccaacccaggccaaccattccacattttagttgttaagcagggtttaagaattaaaacactaacttgggtacattgctcggcttggccataaccgagggcgcggctattcgaatagattttactttgatcagaggtgtacatttttacccacaagaaacat

SEQ ID NO: 20121 - DNA, 8770 bp, Oryza sativa
catcttcgtactgccagggtggatggaataaggactttcgtgagcttcctgaagtatcagcatacccgaaatgtctaggtacatcttccttaagttctctgttatctggaacgcatacccgatttccgttccatagggttccatgttcatcctctgtgaaaccagcggctttaccctgtttcatattcttgaggagcccatgcatatccgggtcattcttctgagccttgcagatttgatcgagcaaggtgggcttggcttccagcgcagccaagaatccgcgactaactatgcttaggttcagggcttccatctgttgattaagttcgggtggaatgccacggacgttaagagtgttgcaatggctctttcgacttagagcgtcggcaaccacgttggccttaccaggatgatagtgaattcccacatcataatccttgatgagttctaaccatctcctttgccgaagattcagatccgactgagtgaagatgtatttcaaactcttatgatcagtatatatttcacagcgattcccaatgagatagtgccaccagatttttagggcatgaaccaccgcggctaactccaaatcatgagtagggtagttgccttcatgaggccgaagctggcgtgaggcataggccaccacataaccatcctgcatgagcacgcacccctatccttggcgcgaagcgtcacaatacaccatgaagtccttgtgagtatctggcaagattaacaccggcgaggaaaccagcttttctttgagagtttgaaacgccttctcgcattgcgggctccacacaaatttctcttctttcttcaacaactgtgtcatgggtcgagcgattttggagaagttctcgatgaacctccggtagtatcctgccaaacctaagaaactgcggacttgagtgactgtcttgggttgcttccaatcagtgacggcgatcactgtttcggggtccacagcaactcctttagcagatatcacgtgccctaagaatttgacttcggacaaccagaactcacacttgctaagtttggcatacaattgatgttcccgcaactttcccaataccaggcggagatggtgctgatggtcttcctcggattgtgagtatatcagaatgtcatcaatgaaaaccacaacaaacttatccaagtattccatgaacactttgttcattaagttcatgaagaaggcaggtgcattggttaaaccgaatgacatcaccgtgaattcatacagtccgtatcgcgtggtgaatgcggtcttcggaaaatcttcttcccgaatacgcaattggtgatatccggaacgaagatcaatcttggagaatacagtggcacctttaagctgatcgaacagatcatcgatccggggaagagggtacttgttttttatggtgacttcattgagagctctatagtcaacgcacatcctcttcgtcttgtctttcttctccacaaaaatcacaggagcaccccagggggaagtgctcggacgtatgtaccccttttctttcaactcttccagctgtttcttgacttcggccagttcatttgctgccatacggtagggtcgcttgcacagaggagtggttcctggagcaagatctatctggaactcaatctctcgcttgggcggcataccaggtagttcttccggaaacacgtctccgaactctctgactatggggatttctgacagacctatctgatgcagttctgaactactgacagaggttgggggtgcaaagaaaacaaccggttgtcccggccctcggtacagagtgacggtgcgtctcgcacaatccactactccttggaattgagccaaccaattcatcccaaggatcacatccaagttcttggtgtctagcagaatcagatccgagggaaaaggaatcccctgaatttctataggaaccgcagggctataatactttgctgtcataacccctccaggggtggtgatgagcagagggtttctaagcctttctacccccaactgatttctccccacgaatggcacagatataaacgagtgggaagctccagagtcgaacaaaatggtagcagggatggaatgaatgaggaacgtaccaacgatgacgtctggagttgtcagcacgtcctcggccgtcacatggttcacacgaccccgaatgacgtccttaccaccgttgttggagcggggaggcgcttggccttgctgacgcctcggctttgggcatttatccgcaaagtgcccgggctcgaagcagttgaagcacagacgctgcggacctgaagcgtccctgcggccttggccaggctgcacagttggcgtaggaggacgaggcgcacgggtcccttgctgactctgctgttgctgcggctgtgggacgcgcaccacgaattgagggcggggcgcggagcgaggttgctgctgctgttgttgctgctgcgaggaggatccccctggatagggattggtgtagcggaccctttggttagctccctgttgattgcggaaattcgccaagcggcgcttgtgcgactccagttccttgtgcttggcttccaagcggatgctcttgtccaccagacgttggaaatccggatagtccccggagactagacggacggacagctcagggtccattcctgccaagaacttctcttgcttctcctcatcttcccgcacatcctccggggcgtaacgggccaggttgttgaactcatgcaaatactccatcacggagcggttgccttgcttcaactctcggaattcccttttcttaagggccacgactccggcgggcacatgggttctccggaaagcggcggtgaaacgggcccaagtaataggctgtccctctggctgcgtagcctggaaatggtcccaccatagagatgcgggcccctgcagctgatgggcggcgaagatgactttctcctcatcgctgcactgcacagtgtctagctttttccccacggcatgcaaccaatccaacgcatccacggggttgttggagctagagaaggtaggtggacggatgcggaggaactcggcgagtttagagtgttggggaggtggtggtggagcattatgttgtggcggattttggaggtggtggagaaaagcagtcatcatgttggcctgctgggcgaggatttgggtgagaatggcgttggtatctggtggtggtggtggaggcggaggaggaggtggaggtgggctgccatggttgttgtggttgctgccttcgggttggttgccatcactggtggcagcatttctcctggtcatcaccatctgaaaaccccacacagaaccagcaaacagagagagctgacaattaaagctaaccacccacgactaccataattcttgaatttattactgctattaaattggttcattaaagttcaagttgcttaaacaaataaaataaagacaggctccgacaaagttacaccacacaccggcataaccgtgccccacacaacccaacaagaagacaaacgagaaagaacacacgcgcaagcctactaactgctcgtctactgctgtgacgggccaggacggaaggtgagcaacagcgcatcctccgtgctaccaacgccggaggcttccccctcctggggaaccacgggcgcgggctcggcacgaggggtctccacgaagcaagtccacgccagggactgacgaacaagctcgggcctggaggtgctcttgcgggcggtgatcttctggctgcggtagacgcggcgatgcttggggcggcagatctctccctgggcgatcttgagctgatgcagctgcgcctccaccgcatctaggtccttcttgagctgcaggttctcctgacgcagctccaggatcttcatgttgttctcgaccatcccacgacgcaccatctgatggaagtcgatacgagccgcgtcgtacgcctccaccatgcgcgccaggtgcacgatggtagcgtcatcctccgagctagcgtcccggaaggtggcgtagtcgcgggctcctccgcgacgagggtggtagcggtagggcgagtgctgcaactcgtccgggtagcgctggtgaagagtgccgatggcgaggagagcggcgctctggcaagcggcggggaaggaatccccacccgcggtgactgtcagcgaagtccgctcgggagagccagcgaggatcactgcagtgacctcccaagcagcgtggggctccgcatcgtcaccctcctgctccggaagcggcctggcctggtagtccactccatgtggataccccaggaccacgcacatgccccgcagctccaagacgaagccagtcatgtccaaaccacgacggctgacgctgccggccatctacaaacaaaaacaaaaagaaaagcaacattttaaaggtcagattttggcgataaatgaagcagcaggacagagagagaatagaggattttcacaaataagaagggatttttattttgaaaatattgctaaggcttgggatctaaggctcgtcctagggtcaagggggctctgataccaacttgtcacgaccggaactgacccaacgggcgttccttgcgtgcgtgcattaacccttgtcccaggaggcaaggtacaccaaaagttgatacaattcagagtttaacaagcggaagcgtaaatagataatttattacaggggcagcgaaggcccagcacacacaaagacaaacgagaaatagcggaagactagggcgacgaccacaggcgcttgacggcaggcacgagctagacaccaaagccttcatcctccaggaactcctcttctgggtttgggaaaaattgagcaagactgagtacaaccaccgtactcaacaagacacacccacaagtgcagaataaatgcaagggagtacaaaggagttatactataaaggggttagggttgcagtaaacagcatttaaagatatttagttgctcagggctattttgtaaacacgattctagaactaaacaatattatttatcaaggccgtgaacccacacgaacctgccttaacccaaggcctacgatgattcagaccgaactggcaacccgaccctgggtcccagctcgtcccaagccaacccaggccaaccattccacattttagttgttaagcaggttttaagaattaaaacactaacttgggtacattgctcggcttgcccataaccgagggcgcggctattcgaatagattttactctgatcagaggtgtacatctttacccacaagacacatcttcctcacgtgtaaccacgtgccacataccaccacggtatacagacggaagacgtgacatagtttccaacccatcctagccatagacaagagtaccgacccaatcccacctacggccggaacacccgggacaggcaggcaggactgagcccctagcagcaggacaccggccctgtgccatgacatctcgactaccgggccgcagctcgtgtagccttcatttgccctggagaatgtccatcgacccccgacttcatccacctccatccgtgtacttttgtttataaccagactgagccacaaactaagccttacccactagacatgtggaagtacggtagtgctttgcaacagaggcccgaagaccggtccttatatggccgaggtgctactatcaaaaccatgcaccccgagcccagcctaaaaccattttggggattttgaatagagggggaggtgtgaagccaattccacgataatccaacagttccaaagtgtccaggtgatatgaatattcccaaagtctagagttgtaaaaccacctaatgttacctaattaaacagcgaagcatctacctaaaatcatgctagtggtaccatgagtagagtgtccactagttggggttttgtttaatctagggtgaacaaggaaatactaacaataacaataataataaggtcataacaaaggtaaataggcatggctagataaaacagtgataacgcgggaatttaaataaagcgataatgcaataatttaaatcaacataattttacaaactgggattcaatatgttcaaagatgatgtgacttgccttgctcgctttcccaaacgtcggcttcaacttccacgaagagcggatcttccgaagctgcagcgtctacacgaccaacggaaaagaaaaggcttttactctaataaactccatataacaagcagaaacaaagcacaaaaatgggttcttgacttcttaaggaaaaattagagacttgaacggtccaattccgagttcaaatggtcaagttatggccatttgaagtttatatgctctttaaatgaatatttgcgaatttcttcatttaaattttaatttaaaatcggatttattgcgtcagctgaggggaggggcgcgcggaccgggtccacgggagtggggcccacgcggcagcctcacggtccacggtggaccgggtgcacacggcttgcgccggccggcgccgtgggtcccacgcgtcagccgcacccgagggcgcgggcggctgacagccgggccccacatggcagccgcggggcgcgcccgatggcggcctcgccggcacggccgacgggaggcggcgcgcccgcgccccgatggtcaccggcggcgacctccggcgcgacggagcggcgcccgagagaggggagggaagggggaagcgagatggcagtcctcggctcaccccgggtcgacggcgatgacgggaacggcgaccgaagcggagagaggcggcggcgcggctcgggtcgacgaggacggcggcgttccggcggtcggcgggcgaaacgaaggggtggacgaggtcgacgaggacgcggcgaagccgaaggaggcgatgccgaagcgggaggaggtccggggcgacgacggcggcgaaccgaagctcggcggcaacggcggagagagaggacgacggcgcgagctcgattccgacggggagagaaagcggcaagggtcggaaacggaggagggaggcacggggagtgcttaaatagtgttgggagtgagagagggcggccggaggggaaggaaaccggcgcggcgatctcggctccatcaatgacgccggcgaagtttgcgggaggatttccaaacgaatccgagagagagagagggaaaagtggggggaaagagggagggaatcacggggagtgatttcccccctctttattgcgcgcgggggcggcgggatgcggcggaatccgcggcggcggcggcgctagggcacgggcgaggcggcgggcgcggcacgaggtaggggatgacgggtgggccccacccgtcagcgagggtggcgggcgggcccgcccgtcagtgacgcgcgcgcgggggaaggccgatgggccgcgggggagaggagagagagggagggagctgggccgagccggcccaagagaggaagggggaaaaaggacttttagggatttttctttttataaaaccactttaactttgtttatttcttcttaattattatttgtgctctgaaaattccactaaaatttatttacgcattttaggcttttaggaaatatacaaaaatcctccaagccttatttgacttttaactttgcacattttaattgttggaggctttcacatggattttactaattctatgcacaatttcgaggatgtattttagagtcgatttgggacgcgacaaacctacccccttaaacggaatctcgaccccgagattcagaaggactggcgaagagatcgggatgggctgccttcagctcgtcttcacgctcccaagtagcttcttcctcggcgtggttgctccactggaccttgcaaaaacggattacccggctcctggtcctgcgctccatggcgtccaggattttaactggcctctccacgtaggtcaagtcttcgcgaacttcaatttgctctgagtcggcctgctcggatggcactcgaaggcatttcttgagttgcgacacatggaacacatcatgcacgttgcccaaggaggcgggcagttccagctggtaagcgacttctccgcgccgagcaatgatacggaaaggacccacgaaccgaggtgcgagcttcccttttgtccgaaagctgtgtacagctcgcaatggtgtgacccgaaggtacacaaagtcatccactgcgaattccaggtcacggcgatggttatctgcataacttttctgccgggactgtgccacctttagattatcccgaatggttctgaccttcgcttcagcttgtctcaggatatcagtcccgaacacttggctttccccaacttggtcccacaatagcggtgtccggcacttgcgtccatacaacgcttcataaggtgccatttgtatactggcttggtagctgttattgtaggagaactcggcataggggagactcttatcccaggtcttcccgaaatccaggacacatgcgcgaagcatatcttctaggatctgatttagacgctcggtctgcccatctgtctgcgggtgatacgcggtgctgaaatttaatcgggtacccagctcttcttggagcttcttccaaaagtgagaggtgaactggcttccccgatcagatacaattttcttggggacgccatgcagactgacgatcctagcgaagtagagttcagctagtttgttccctccataggtggtctttacgggaatgaaccgtgctaccttggttagtcgatccacgactacccatatagaatcatatccgccttgggtttttggaagtccggtgat

SEQ ID NO: 20122 - DNA, 3353 bp, Oryza sativa
  unsure (1)..(3353): unsure at all n locations
gtatgggcgcaaataccgcacaccgctaatgtggaaccaagttgaagaaagccaagtgttcggaactgatatcttaaaagaagctaaagctaaagtcagaaccattcggaataatctaaaggtggcacagtcccggcaaaaaagttatgcagataaccgtcgccgtgatctggaattcgcagtggatgattttgtgtatcttcgggtcacgccattgcgaggtgtacacaggtttcggacaaaagggaagctcgcacctcggtatgtgggtcctttccgtatcgttgctcggcgcggagaagtcgcttaccaattggagctgcccgcctccttgggcaacgtgcatgatgtgttccatgtgtcgcaactcaagaaatgtctccgagtgccatccgagcaggccgactcagagcaaattgaagttcgcgaagacttgacctacgtggagaggccagtaaaaatcctggacaccatggagcgcaggaccaggaaccgggtaatccgtttttgcaaggaccagtggagcaaccacgccgaagaagaagctacctgggagcgcgaagacgagctgaaggcagcccatccagatctcttcgccagttcttccgaatctcggggtcgagattccgtttaaggggggtaggtttgtcgcgtcccaaatcgactctaaaatacatcctcgaaattatgcaaagaataagtaaaatccatgtgaaagcctccaacaattaaaatgtgcaaagttaaaagtcaaataaggcttggaggatttttgtatatttcctaaaagcctaaaatgcgtaaatacattttagtggaattttcagagcacataaaataattaagaagaaataaacaaagttaaagtggctttataaaaagaaaaatccctaaaagtctttttcctcccccccttccccctcttgacatcannggcccacgtccatccctctatgtcatctcccccgcgacccatcggcctcctccccgcgcgcgcgccgctgacgggcgggcccgcccgccaccctcgctgacgggcggcgggaatttaaataaagcgataatgcaataatttaaatcaacataattttacaaactgggattcaatatgttcaaagatgatgtgacttgccttgctcgctttcccaaacgtgggcttcaacttccaagaagagcgggtcttccgaagctgcagcgtctacacgaccaacggaaaagaaaaggctttgactctaataaactccatataacaagcagaaccaaagcacaaaaatgggttcttgacttcttaaggaaaaattagagacttgacgggtccaattccgagttcaaatggtcaagttatggccatttgaagtttatatgctctttaaatgaatatttgcgattttcttcatttaaattttaatttaaaatcggatttattgcgtcagccgaggggaggggcgcgcggaccgggtccacgggagtggggcccacgcggcagcctcacggtccacggtggaccgggtgcacgcggcttacgccggccggcgccgtgggtcccacgcgtcagccgcacccgaggacacgggcggctgacggccgggccccacatggcagccgcggggcgcgcccgaaggcggcctcgccggcacagccgacgggaggcggcgcacccgcgccccgatggtcgccggcggcgacctccggcgcgacggagcggcgcccgagagaggggagggaagggggaaacgaaatgggcggtccatggctcaccccgggtcgacggcgacgacgggaacggcgaccgaagcggaggaaggcggcggcgcggctcgggtcgacgaggacggcggcgttccggcggtcggcgggcgaaacgaaggggtggacgagatcggcgaggacgcggcgaacccgaagaaggcgacgccgaaacgggaggaggcccggggcgacgacggcggcggaccggagctcggcggcgacggcggagagagaggacgacggtgcgagctcgattccgacggggagagagagcggcgagtggcggaaacgaaggagggaggcacggggagtgtttatgtagtgttgggaggaggagagagcggccggatgagggggaatcggtcgcggaagatccggccgccattgatgcgccggcgaagtttgcgggagagtttccaaacgaatccgagggagagagagagggaaaagtgggggggaaagggagagggaatcacggggaatgatttccccctctttattgcgcgcggggacggcgggatgcggcggaatccgcggcggcggcggcgctagggcacgggcgaggcggcgggtgcggcgcgaggtaggggatgacgggtgggccccacccgtcagcgagggtggcgggcgggcccgcccgtcagcggcgcgcgcgcggggaggaggccgatgggccgcgggggagaggagagagagggagggaggtgggccgagccggcccaagagggggaaggggggggggaaaaagacttttagggtttttctttttacaaaaccactttaactttgtttatttcttcttaattattatttgtgctctgaaaattccactaaaatttatttacgcattttaagcttttaggaaatatacaaaaatcctccaagccttattcgacttttaactttgcacattttaattgttggaggctttcacatggattttacttattctttgcataatttcgaggatgcattttagagtcgttttgggacgtgacacattagtacacattcgggacaacttatgactcactattatttaatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgagaagtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacataatgtggggttgtgtcttgtgggtacagtggtacacctctggccagagtaaaactattcgaatagccatgcccgcggttatgggcgggtctaacaatgtctttcgtgattagtttcacacttctcaccttaatgaatgatgctatattggtaataatt

SEQ ID NO: 20123 - DNA, 8244 bp, Oryza sativa
aggaagagttcttcaatgaggctgatggtgtggaggagtaggtgtagccttggtcaagctgcctgtggagtgaagccgtctacgccgtttaatttatttttccgctgcttagatctttattgattgagaggaactatctacctctgtaatgacattttatacgcttattaattagagtaataattgtactctattatcaatttgttattgtgtgcctcggctaattcctggacgagggttcacacacatgtaagcgtttggaattttggatagaaattccgggcgtgacaagttggtatcagagcctccttgaccctaggttatgccaaatggttacccatagaagccctctaaaaatattggaaaagtagaactgttctcctccctttctcttttaattaaaccaaactaatggcacatacacttcataatcccttttaatggttctcattcaaaatttattccagtgttattagtaccgtacatctattactgtactaatggcttatttatcagcaaaagttttacaatattgttttatttaatcttgctgcaataaaataaagttagcatgttgattttataactttcttttatttcttttgaaacctgttattcaaaagtacaaaatttgtgaccttgtttccaactgttttaacttatcttgcaagtttggtttactttatttacttacctttttactctgatttttctaaactttattcaaattaatccaaaaacttgtgctgttaattggatagatgtcttaactccctcctttcacttgtctttagatgccgcgctacaagcctgagtacctgtttggtgttgagggttttgtccaggagttgcgtacgatgtcctttgtcataggatttgggactgcccctttttatgctcagattcctcatgatcgtcatgaagagaagtgccgagtcaaagtcaccttgaatagtaatagtgaagatgtcccctcagtgatgttcgaagctggaggaagaaactacatccatgcatgtcaggaagtggcaaggatcgccataggagagctccgtgatcgctacagtgatcggttggctgacactgagtatcgctaccatcctcgtcaaccacagggaagtgaccgtggcagctaccttgagactgaaggaattgagaatgatgctaccacaaggcatttagttgagatgctgtgggctatggatgaaagccgtgcagagactgtgttagcggctcaagatcgtgaagattggaatcgtggtaagatttgcaagttagaagacaaggtggatcgtttggagaaggaactagccgcgttgaagggagaagcaccaccgcagaaggccaggattcgtcttaccgcaaggaagagagctctatttgtccctcgctatcaattggcgccaaaagttcgtgtggtggagaaagaagttgccccagcagatcctccggtcatcatcataagtgatgatgaagaagaagaatccaagcgcacccattccaagattgagtgggtagcaactcaagatgatgaagacgagccgaacgagcctacaatcgacctccgatgctcggaagaactagagtgacttgttaagtcgttgtcttagatcgttgtgttagtttgcttgctttaagtttgcttgtgtgtgtctcgcatgtgatttacatcagtggtgggatgtaagtgcatgcgtttgtttgcttttgagtgttaggaagttggtgagtttagtggtgtgagagtcttcagtttgtaataatgaaactcagttaagatcaataaaagttaaagtaattctctatcctaagtagtttcccccggtttctcttcttgtgccctgccagatggtgctcactcgcagcaacgggaatggccccaacagcaacaataacaacaacaatggagagaacccaacacttgctcaagttcttgctcaacagactcagttaatgaacatgatgatgcagcaacttcagaatcagcaaaaccaaggaaataaccatgcacctccccagaacaagttagcagaatttcttcgtgtgaggccgcctattttctctagtaccactaatcctgttgaagctggtgattggttgcatgccatagagaagaagatggatttgcttcagtgcactgatcaggagaaggtctcatttgcatcacatcagttgcttggccctgcctctgaatggtgggatcacttccgcctgaataggattactgctgaacctattacttggcttgaattcaccgctgctttccggaagacgcatataccatcgggagtggtgtctctcaagaagaaggagttcaggtcgctcacccagggatctcgctctgttacggagtatctgcacgagttcaatcgtcttgctcgttatgctccggaagatctgcgcaatgatgaagagcgccaggagaagtttttgggaggacttaatgatgagctttcttacccactcatggttggagattatcctgatttccagaaattagtggataaggctatacgtcaggaggacaagtacaatcgcatggagcagaagaaacgccggattgctcacttcaaggcacaacaggggagtaatcagaagccgcgtcttactttaggaccccagtctgtgccacagggaggttcttcgtccattgttcgtccgcagcgtcagttcttcaacaacaatgctggcaacaacatccgtaatcaagtcccacgtcctgttgctgcctcgacacagcaacaacctgccaagaggaagcaaggcagcaagcccgtggtgtgtttcaactatggagacccaggacattatgctgacaagtgtccgaagccccgacgcgtgaaggttgtccctgcccagaataactctgctgtaccagcatcaaaggcccgtgtcaatcatgttgctgctgcagaagctcaagatgctccagatgtgattttgggtacgttccctgttaactcagttcctgcaactgtgcttttcgattctagtgctacacattcattcttatctatgagttttgcgggaaatcatgggatggaagtagaagatcttagacgtcctttgatggttagtaccccaagtaatcaagcactctctctgcaacgtagcccctctgtcagaatagaaattcaaggggtaccatttctagccaatcttatcttgttagaatctaaagaccttgacgtcattctagggatggactggttagccaaacataaaggtgtgatagactgtgccaacagaaaagtaactctcatcagcaatgatggtcgagttgtaactgttcatgcattgtcatctgagtttttaaggtcaagactgaaccagataactttgggagagattcctatagttcgggagtatcccgatgtgttcccagatgatttacctggtatgccgcctaaaagggatatagagttcagaatagatttggtacctggaacaactccgatccataagagaccttatagaatggcagccaatgagttggcagaagtcaaaaggcaagtagatgatttgcttcagaagggatacatcagaccgagttcatcaccatggggagctccagttatttttgtggaaaaaaaagaccatacccagaggatgtgtgtggactatcgtgcactaaatgatgtgactatcaagaataagtatccgctacccagaattgatgatttgtttaatcagcttaaaggtgccactgttttctccaagatagatcttcgatcagggtatcaccagttgagaatcaaagagtaagatatacctaaaaccgcttttaccactaggtatgggttgttcgaatgtacggttatgtcttttggacttaccaatgctcctgctttcttcatgaacttgatgaataaagtatttatggaatacctagacaagttcgtggtggtctttattgatgacattcttatctactcccgaaccaaagaagagcatgaagaacatcttcgccttgcattggagaagctacgagagcatcaactgtatgctaagtttagcaagtgtgaattttggttgtctgaagtgaaattccttggtcacgtcatctcagccggaggagttgccgtcgatcctagtaacgtggaatccgtaaccaattggaagcaaccaaagacagtttcagagattcacagttttctaggcctcgcaggatattatcgaaggtttatagagaatttttccaagattgctaagcccatgacacgcctgcttcagaaatatgtgaagtacaagtggtcggaagaatgtgagcagagttttcaagagttgaaaagtcgtttaatatcagctcctattttgattttgcctgatccaaagaagggtttccaagtgtattgcgatgcatctaaacttgggttaggttgtgttctgatgcaagatgggaaggtggttgcctatgcatctcgtcagttacgtccgcatgaaaagaactaccctactcatgatcttgaattggccgcagtagttcatgcgttgaaaatttggcatcattatcttttcggtactcgtacagaggtgtataccgatcacaagagtttaaagtatatctttactcagccggatctgaacatgagacaaaggagatagttggaattaattaaggattatgacatgggaattcattatcacccgggaaaggctaatgttgtagcagacgctcttagcaggaaaggttattgcaatgctaccgaaggatgacagctgccattggaattatgcaaggaatttgaaagattaaatttgggaattgtcagtagaggttttgttgcagccttagaagcgaagcccacactaattgatcaagttagagaagctcaaattagtgatcctgatattcaagagatcaagaagaatatgagaagaggaaaagctatcggtttcttggaggatgagcaaggaactgtatggttgggcgagagaatttgtgtccctgacaacaaagatttaaaggatgcaattctgaaagaagctcatgatactttatactccattcaccctggtagtactaagatgtaccaggatctcaaggaaagattttggtgggcaagtatgaagcgtgaaatcgcagaatacgtagcggtatgtgatatttgccagcgagtcaaggcagaacatcagaaacctgccggtttgttgcagcctttgaagattcctgaatggaaatgggaagaaatcggtatggattttatcactggtttacccagaacgtcatcaggccatgactctatttgggtaatagtcgacagacttaccaaagtggcacatttcatcccggtaaagacaacttattccggaagtcggttggcagaattatatatggcaaggattgtgtgtttgcatggtgtccctaagaaaatagtgtctgatcgaggcagtcagtttacttcaaatttctggaagaaacttcaggaagaaatgggttctaagctgaactttagtactgcttatcatccacagacagacggacaaaccgaaagggtgaatcagattttggaagacatgttgagagcttgtgctttagatttcggtggaagttgggataagaatctaccttatgcagaattctcgtataacaacagttatcaagctagtcttcagatggctccttacgaagcactgtatggtcggaagtgtcgcactccgcttttgtgggatcaaacgggagaacgtcaggttttcgggacggatatcttaagagaagcagaagaaaaggtaaagatcattcaagaaagattgcgtgtggctcagtctcgtcataagagttatgccgacaatcgccgtagagatttgagttttgaagaaggagattatgtgtatcttcgtgtcacgcctcttcgaggagttcatcgttttcacaccaaaggaaaattggcaccgcgttttgtgggaccttataagattgtcagtagaagaggagaggttgcttatcagttagaattacctcaatctttggcaggagtctataatgtgttccatgtgtcacaattgaaaaagtgtttaagggtacctaccgaagaagctaatattgagcagatagaagtccaagaggatttgacctatgttgagaaaccaatccgtatcttggaaacaaatgagagaagaaccaggaatcgagttatccgtttttgcaaagtccagtggagtaatcactcggaagaagaatcaacttgggaacgagaagatgaattgaagtcagctcatccgcatctgttcgccagttcttccgaatctcgaggacgagattctgtttaaggggggtaggtttgtcacaccctgaaaattcaaaatttataaattgttgtttaattggaatttttagaaataattttaaaagtcttgaagaaaagatctaattttaattaataaattccaatataaaatggggccagataaaatttcattaaatactttgcttaattctataattcctagattttttctgggatttatttgagctaaggaagtatttttaataaatggaattgcatttaagaaataatttaaattgaaaaaggttttaaaaagtctcttttggctttgggccgaaagtcggcccaaaaccgctctctctctcctcggcccagtccggcccagtccgcagctgccgcgcgcgcgcgccctcgctgtcgctgacaggtgggtcccacctgtcaggcccgtcgtcttcctcgggccgaaaccctagtttcgcgccgccgccgccgctttccaatccggccgtccctttccttctccggccgaattgatagaggggaaatgatctccgggatctcctctaccttttctcctttggaatctttggctaaatcgttttggaaagcgttggattcgagtttgtctcggattcgttcttcccgatctttccttcctcgccgccggccgccgtgggcctttgccgtcgcctccgagcccctttaaaaggacccccggtgtctcctctacccgtcgccaccctcgccttcgcctcacgtcgtcggaatcgctctagcgccgtgtgccctagctttgccgtcgccgtcgccgctccagccgtgcgccgccgtcgtttcagccgtcgccgtcgctcgggaagaccaccgtcgtgctcgccaagtcgtcgccgtcctcgtccgcctcttcgctgtcgccggagatcaccggagcagcatcgccgtcgtcgacccgaaggttcccgccgcttcctcctcgtcgccgtcaccgtccgttggtcttccgccaccgtttaggtcaccggtgagttcgccgcgttgtcctctccgtcttggtgccctccgtttgcgtcctagcaccgccgttcgccgacgagcgtgcgccgttcgagccgtctcctccgccgagccgccgccgctgtcggtgatgtcaccgctgacgtcatcggggtcgtccgccgtgagccgccgtggacccgatcgatctcggccgtccgttttggatcaagttgatctcggccgtccgttcgtgtgaaccgccgcccgtgcgcccggtccaccgaaaccctagcccgctgacgcaataaaccttcttttccttttcaaaaataattcattattgcgtcataattcaatttaagccgatataagtgttttaatccgatttaatctttaaaaattcataactaattcatcttagctccgatttagttggttcaagtctctaaatttttctaaaattgagatctacacattaaaaatatccacatgtactgttcatgcttgtttatgtgctgttttggtgattttgttcttttctgcttagattccgtcgtttccggagagtccgttttcgcagaagaagagtttgaagagttccaaggccagcaaggcaagtcacacagatcccaaacaaccctttgagcatgttgatcctatttaaagctattgtttctattcaactattgcatttattttcgaatgtcattgggtggaattaacctattctttgttatggcccttttgtacttgattacttcattccttcataccttgggttattacaatttgactagttgagctttatttatattggttcaactagatattagatataattgcttagcctgcttagaaacattatgtcacgaccggaactgacccaacgggcgttccttgtgtgcgtgcattaatccttgtcccaggaggccaggtacaccaaaagttgatacaattcagagtttaaccagcccaagcgtaaatagataatttattacatgggcagcgaaggcccagc

SEQ ID NO: 20124 - DNA, 2088 bp, Oryza sativa
tcatgcttttttatgtgctgatttggtgattttgttcttttctgcttagattccgtcgtttccggagagtccgttttcgcacaagaagagtttgaagagttccaaggccagcaaggcaagtcacacagatcccaaacaaccctttgagcatgttgatcctatttaaagctattgtttctattcaactattgcatttattttcgaatgtcattgggtggaattaacatattctttgttatggcccttttgtacttgattactacattccttgataccttgggttattacaatttaactagttgagctttatttatattagttcaactagatattagatataattgcttagcttgcttagaaacattagtacacattcgggataacttatgactcactattatttaatgatggcttaatgatagttcacgatggtcaatcgtgattagttaattaattaatgtgccaactaaaacctggtaatggtgggttgtgagcacatggttttgatggtcgtgctcatgacaattaaggaccggttcacgagtttcggttgtgaaacattaaccgtgccaaccacaagccagcatgggcaacggctttatcttttgtatagcatggttcattgcggggcaccagactgaaatgtggcggagataagcccacgggggtcgctggggagtccatgccttgtttataagggggtgattatgatccaggaaggtgcgctgcagtggattgtgttatgcgaggggtattgtcacaactcctttccgagataccgtggtggtattgaggcacatggtgacatgatgtggggttgtgtcttgtgggtacagtggtacacctctggccagagtaaaactattcgaatagccgtgcccgcggttatgggcgggtctaacaatgtctttcgtgattagtttcacacttctcaccttagtgaatgatgctataattggtaataatttgattagctcctggtttggaatggtatattcctggtttggagatagaactgtgcagccgggatggttgtacagaatggttgggcctatacaacagggtatgttgtatagtgttggattaatattgtttaattattacttaactgttttattaaattctgaaatgtttgctaaatgctgcttttgcaaatggaaccctattatgccatcctttgttatcctgtgcacttgcatatttgctgcgtggcttgctgagtatgtcatatactcaccttgcaatcattcatcagaggaagagttcttcaatgaggctgatggtgtggaggattaggtgtagccttggtcaagctgcctgtggagtggagccgtctgcgccgtttaatttatttttccgctgcttagatctttattgattgagaggaactatctacctctgtaatgacattttacacgcttattaattagagtaataattgtactctattatcaatttgttattgtgtgcctcggctgattcctggacgagggttcacacacatgtaagcgtttggaattttggatagaaattccgggcgtgacacttaagcttgacctttgggacatcatcatgtaagattagtgtgaaaacatatacgagatttgcagtatttatgataaataaaaggatccaagaccacttttctaacatgttggaaaaaagaatcgtaaagtggttgtggtcctcgcacgagggggtagtactaatcgaacaggagtctggggtttccttatatgagcatgaatcatgagggattttgaaagagaaggtttcatgctcatttgtggagtgatttctcttgtccaccagagctgatgtctcaagcttgtccatggcctgaaggttctccttgccaaaggatgtgtcgtgcatgatcgaggttgtttcctgacaactatcaagaacaacatctcgagggccagagggacaaggtttaggctcgagatgaggttgcgatggtggttctatggataacacttcaagggtctcgccggaatcttctttttgaatgaaatgataaacatcctgttctaaaagggattcaggggactcatgaagcagaatcgccattacttcctctatggg

SEQ ID NO: 20125 - DNA, 1091 bp, Oryza sativa
atttacaattgtacaggtacgatatgtggagtgttggtgttgtcatgctggagttgatagtaggttctccacatgttttccagataagtgaccgtacacgtgctctaatggatcatcgccttgaagggtggagtgagcaaacaaaggaacttgcatacaagtgagacattattttgatattcctgtctgaaaattgtgaaggacgttttctatttctggatcagtgaaaactgttggtgctgcattttgattatttcatcaggcttaagaatatcaaagttgtttcactgtaaatgaaaagagtataagctcctgtcagattgtcaaccacatggttctcaggatatcccaaaatattcagaaaattaccagacccttctttttagccaatcaaagaattcatgaccttttctgaagtgcatgattaacagtacaatccattattgctggaaattcgatccaccctactgcaagctacataattttggttttctaactatctgtaagcaatttaccaaaatgacctttctattgatatgatgtagtaggtagtagcatgatttaatttgtctggtttgtttccctgccaaacctttgaagatgctctatttattggaagggataattgcttatttgaccctgtttggaaagctaactaccaatctgaccctagtttttctagtttgcttattggaattacgaatttaactatttccaaattaatttttcatatggaaagatatagtcctgaagagtatattgtttgactaactatttcttctgttcctgttgtaatgttaggttgaggtcctacatggaattgtgcattttagtcccaggaatttcctcgcagcatcagggcagtggtgactctgaacatgtcagtatctcaactccactttatgttcatttaacatgtaatgattttttacaatatatatgttcatattcttccaaaatgtgatttaaatggttatttcctttatttacacattgttcattatggaccaaaacaatctgtatttttttaaaaaaaaaggaaatgtaagaaatgtactccctccgtttcaggttataagacgttttgactt

SEQ ID NO: 20126 - DNA, 5820 bp, Oryza sativa
  unsure (1)..(5820): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntatacggccggaagtgccgcacacctctcttctgggatcagacaggcgagcgtcaactgtttggaacagaggtattagcggaagcagaagagaaagtcaggatcatcagggaaaggttgagaattgcccagtctcgacagaagagctacgcggataaccgtcgaagggagctcacttttgaggcaggagattacgtgtatcttcgtgtcactccgctccggggagtacaccggtttcagacgaaaggcaagttggtaccacgcttcgtgggaccatacaaaatcctggaacgcaggggggaagttgcttatcagttagaacttccatccaacatgatcggcatccatgacgtgttccacgtgtcccaactaaagaagtgcttaagggtacctgaagaacaggctgattcggaacacattgatatccaggaggacctaacatatgtggagaagccggttcgtatacttgataccagcgaaaggagaaccagaaacaaggtcacccggttttgccgagttcagtggagtcatcattcagaagaggaagcaacctgggaaagggaagatgagttgaaagccgcccatccgcacctcttcaccagcacctccgaatctcggggccgagattccgtttaaggggggtaggtttgtcacaccccgaagttttcctcccaagccaaaattgtaatttttataaatgaccctaagaaaatgctggtgaaatcagaagaaaaccctaagaaagtaatgcaaataataatcggatatgacatgtggaatttttcttgagttctacatgtcgcaattcattaacaggatttttagtggaattttcagagctctagaaataattttaaccaattaaaattgagcaagcaatattttaattccagggaaaatcctttttcctttttctttttctttttcctctctttttcctcctttttctttcgaatgggccgccggcccattccctccttcctccccctcctccttgctgggccggccgcaggccgaggcccagccaggccgccccgccgcctcctctctcggggtcgccgacaggtggggcccacctgtcgggtccttcccccacctcccgccgatctcgctcgcgccgtcgcgcccgcaaccgccgccgcgccctcgtctccgcctcctccgggccacgtcgaccacacccgcgcgtgcgccgcgtctcccgcgcccactcccctctctctcccgctcgcgcccgcgcccgagatggccgggattcgattttcgaatcccgcctctctctcctcccccactccccacgtcggccggcgattcccgcctctcccggccacgtccggttccctctccccctatttaagcatcgccgtcgtcccctctcactttttccccatttcgccgcactctctcgagcctcccatcgctcccgcgccgtgcaaccccttgccgccgccttttccgctactccggccgccgctagccgccgttagggtcgccgccaggccgcgccgtcgccgccgtcgggttcgcgtggccgagatccaccccgtccacccctcctccgtcgaggttcgtcgccggagccctcgttccctcgcactcgggtgagcaccacctccatcgccgccttcggccatggtttccgatcgccgtggtccatctccctctctctaatccctctcttctccgtccttagggcaccccgaagctcgtccgcccgccgacgtcgtcctcccgtggcttgccgtcgccgttcgccatcgtcctcctccgcgccggccaccctcggtgaggcatccctcccctcttttccccttcctctcctcctagtgccgcgccgccgcttcgagtcgcgcgccgtcgccttcggccgccgccgcctcccgtgccgccggtcgccgccgtcgtcggccgcatgccgtcgctgctagacctggccggccggtcggctttgatgccgagccgagccggcgaccgcctttatcgccgcccgttcccttcccttcctagccgccgcttagcgcagccgccttcgcgtcgccttttgcgctgtcgccttcgccgccggccgccgtcttgcgccgctgccgcaagcgcgccgcgccgtcgcgcgccatggccgccaggccggtttgcgccgtgcccgcgcgccccggccgcgagctcccgccgccgtccgatctacccttgggtagatcggggccatcggttcggccgccacgtggtgcgccgctcctccccggtccgtggacccgatccgccgtggaccgccctctcccgagtcactgccatgcgggtcccgcttgccggcgccccttcctccctctcccgagccgctgaccggtgggccccgcatgtcggcgccgcaccccctccgtgctgacgtcagccctggaatatattgcgcaataaatgatttagggtttttcttttatagtaataaacacagtgaatcttctaaaattcataactaattcatccgagctccgtttaagctcattcaagtctcagtaaatcaagaaaaatgtgtagaatccattaaaaatggttttgttccctgtttcagtagtcttatagcctgtttgcaatgtttgctttgtatgtcgctagattccgattcctccgacgctccggtgtactttgagatagtcgccgaggttcctccagcagcagagcaaggcaagttatgcttgtcacttgaacatgttgatcctatattgcaaatgctctattgttttctttcaaatattgcattgttttataatattactatgggatggttacctattgttacagccatgtttttggatatcatgctcctttgttagcttggggttataacatgattagagtttggactaggaattgcttagccatgcttagttcaactagttcacaatggggaaaaccatattaatgtttagactattggttctaatgataatgttggattagtaccaccgctctggtgttggttaattaaaatgaatcacatggtgggctgtgggtgcatggttttgctggtcgcacccatggcagttaaggaccggttcgcgggatgccctggaagaacttatcgtacttaccacaagccagcgtgggcaacggctgggcttgtagtgtagctttcctctagccgacgcatccaggcaagggtgggcgtgatggagtttggatgggccctgcgacggcctatgcggcttccggattcacctaggcacgagaggggactgcccgctgccttgcgaggagtgggggtgaaacctgaggtgtggtgtgcttggttagagggggttatgcgaatggtcctgtcacggcctctttccggtatgtcgtggtgacatgtcggcgcacggaaacgtgtcgtggggctgtgtcttgtgggtacagttgtacacctctgatcagagtaaaactattcgaatagccgtgcccgcggttatgggcggtcaaccagattcaccgtgattagtctcaccttagtgtaatcctttaatttggatagtttaggtggatggttgggcctgtcgcaacgtgggttagcgttggacagtggatagttaatattaattaattattacaactgtttaaatctttcaatctctgtttataaatgctcgctttatgcaaatgaaccacttcagctcttctttgttaattccctgcatcatacccctattccggtatgacttgctgagtacagtgggtagtactcagtcttgctctacttttcccaaccccagagttcgagttcgggtcagatgaaggtttctctgaggagtaggcttcgtccgtgccgtcgaggatgcctgtggagtggtgttcccgctgcagtttagtcaaggcttagctcctgttatctttcttttcttccgctgcatttatgtaagactttatgatgtttgtaagacgtggatctgtatgtcaacattgtcgtttgtgtaccccggctggtcctggacggggattttaatgcacattctgcttggaattctattcgggaatttctgggcgtgacaagcattccccttgttcctgaacaaacgccttagccgtggtattataaggaaataccacatcaccttagcaggaattctcttctttgttagctgcccgtcaacttctcctggatcgtcccgtctaatcttgtatcgtagtgctttgcaaacagggcatgcttctaggttctcatactcctcaccgcgatataggatacaatcgttcggacatgcgtgaatcttatgaacttccagtcctaacgggcagactatcttcttagcctcgtacattgtctcgggcaatttgtttccccccggaagaatgttcttgacgagtttcaataaatcgccaaattccttgtcactaaccctattttttgccttccattgcaacaactccagagtggtatccaactttttgtgcccctgctcgcaacctgggtacaacgaagttctgtggtcctccaacatcttgtccaatttataggcctccttttcactttcgcagtcctccctggcgtcctgcaacatctgaccaagatcatccgcaacgtcgttaccatcagcagctatttcctcctcgcccgtttgatttccttcaaatccaacatactgagcaaagtccggaatattgtcgtcttccacttcatcttcttccatttcaacaccttgctctccgtgggatgtccaacaattatagcttggcatgaaccccgactcaaacaagtggaaatgaatagtcctggatgcagaatactccttctgattcttacacttattgcatggacaacaaataaaacccctttgcctgttagcttcggccactctcaaaaaatagtgcacgccgtcaataaactctttggaccgccggtcagcgtacatccattgccgatccatctacatgagtcaaaaaaaccgtacacaaataattattcttacaataatgacagtcatacaataattataagatatctttattcatacaaaaatcataaaatattacaccaaataattcttaaaaactatttgtaaagttttaaactaattttaatgtgttttacttcttttaattttcattttagtttgttttctattatttaagattaactttcactagagttttccttctcaactattttataaaaccttgtttagcaaatgaactaaatttctatatattctttcttccccacacacattttctctctcatcaacttacaactaaattttggagacaaaaaaagtgtgcaaaacataggtgcaaatgtagtatgacaaaaaaaacattggaggatgaagttgcaaaccttttaggcacctccgatttgtatgtaatcaccaaaataaattcaatagaaattttggcatgacctcccctcttttttgaagaaattttgaagcttgctcgggcagctggaggaggaaaaagacatatatatataggggtgggactttagtcccggttggtagcaccaaccggggctaaagatcaccgggatctttagccccggttggtgctaccaaccgggactaaagtcccacccctatatatatatatctttttcctcctccagctgcccgagcaagcttcaaaatttcttcaaaaaagagaaaaaatcataccaaaatttctattaaatttattttaataattacatacaaatcaaaaatacctaaaaaatttacaacttcatcctccaatattttttttatcatactacatgt

SEQ ID NO: 20127 - DNA, 20591 bp, Oryza sativa
atcaataacttgtttaaaccgggcgaatttaccccctgagccaatttaaaaggggttttcatctaaggtggacacgtgccagttgggacgggtttttgttctatatggcactttttgggtaaaaaaaacgctattcatcactatttaattttattttattcatcactatttatttttacaaaaaacctattcatcactatttaatttaattttattcatcactaataatttttacccctgaactattgcgtcgatcgaattacccccataaacttgaataccagatatttcacatcataaacttttaaaaccggacgaattacccctgactcaatttagagtggttttcatcctacgtgtacacgtggcagttcggaacggttttgttctatatggcactttttgggtaaaaaaacgctattcatcactatttaattttattttattcatcactatttatttttacaaaaaacctattcatcactatttaatttaattttattcatcactaataatttttacccctgaactattgcgtcgatcgaattacccccataaactcgaataccagatatttcacatcataaacttttaaaaccggacgaattacccctgactcaatttagagtggttttcatcctacatgtacacgtggcagatcggaacggttttgttctatatggcatacatgtgatgctaacgtggcaatccaatcccaaaaaaaagttaacaaggccccacatgtcatatagagtagtactaaactctctctctctctctccttccctccgacgtcgtgggcgcggcgtggagcggagccaaacgcgatggaaacaacaggaatggcaggtggagccgaggagccgtgctcaccggtgaagaccaaggatctgtgcgccggcggatccagaggaggagccatgcgctagaggcggaatcgaggactcgtcgccacatcgccatcgcccctagccttggcagcgtccgccgcttccactatcctctgcgcggcccaccggccaccgcgccctcaccacgtttccgcctcccgccacctccactatcctcctcggcgccccaccgcccaccgcgccctcccagcgacgctgccgcccaccgcccgtgccgtcccctcctcctcctccccccccccccctctcccccgcgccccggcgtttgaccagtgcaaagaagaatgatcgtgcacacgtacacgcgccacccatacgaaagctatactccaaccaaacgtcaggccacaactgttggacggactcccccgcgcgtgtcagagatgtcgggtttcgggtctagggggtattttgtactcacacaatagtttaggaagttgatttggactttttcggaaaaaaatatgacagtgggtctagacactatttctctctttttcaaacacaaataaatattttgatttgtagagtgtctagtaataaataatcatactttgaggatttatttctccaaggatcgatttttctcatgtccatgaactatgaccactaattcgtgtcctaccttttttatgtcctctaccaaattacaaacttaagtatcatgaaccaaaatttaccttattaataacgtcaacaattaggaaaaatagagttttttttaatgttttatgacaagttaaacatgtataatgaaatttttcatgatgaattagtaaggacttcaaatgaaattcattctaaactaataatatcaacatttctaaaatacaacggggtttttaattgtcttagtaaattaacgtaaagaatttaattaatctataatttaattgccaaatatccgtagatgtaagtaactgcgtagcaaattaagcaagccttttgatttataaaaagggaacatttataaaaaggacagcaacggcggagcaccccctgtcgaatagagcgcaagtgccttgcgtgctgcagctgaggcgcgctaaggacgctgatggccgggtgggcgcgccaccgcagctgcctcgccacggggtgcacgtatgttgcatggttgtatcgtccatgctacgtgcccttgagttgaggcacacgcctagaggtgcatgtggccgtggccgacaaaggtgcatggctgattatcgacgagcgtgtgtggcattcgcacactccactcaactggggaagctcgtctctactgagttcatagaggtggttgtcttcgtttgtgccggttgggaaactcttcctctggcacaggagaagtaacccattaacacataattaatcaagtactccctccgtattttaatgtatgatgccgttgacttttcgaccaacgtttgactattcgttttattcgaaatttttgtgcaaatatgaaaatatttatgtcatgcttaaagaacatttgatgacgaatcaagtcataataaaataaataataattacataaattttttgaataagaagaatggtcaaacgttggacaaaaagtaaacggcgttgcacattaaaatatggaggtagtattagttaaaactaacatgaaaaataaattagtataatctattataacaagttttctataatattttttttgtaaaaattatatcgtttagcagtttaaaaagtttacatgcataaaacaagagtgagcagttgggaacgtagcctcccgaacacaacttaaagtccttttagcttgtcttcctgtatttttggggaaaaaaagtaatatgaagttatctatttattcatcactatatttcaagaagaaaattaaatttatttttaactattctttattaatatttttttaattctaggccttttatctacttttttttgtgattatatatactatatgatattatcgacatgatgtggtcttttgtgggcaaccagaatcgatactaggctagtaaacagatgtgtggaagaaatcaccttatggcttaagggattgagggggtgttgatcgaggggtgtaaaattttagtgtgttacattgggtattatattgagtgtcgcatggggtgtttggacactaataaaaaaactaattacagaatccgttagtaaaccgtgagacaaatttattaagcctaattaatccgtcattagcaaatatttattgtagcaccacattatcaaatcatggagcatttaggtttaaaatatttgtctcgcaaagtagtcgcaatctgtgcaattagttatttttttctctatatttaatacttcatacaggtgtccaaacgttcgatgtgacagggtgtaaaatttttatgtgggaactaacagggcctaaaatgcgctgacaagattgtggtatcttcctgaaggaaaccttatcatccatgttaccttgtcatttgacttctaaattccaatcaaaattttggtgggaaacccctcctcctcctcccccccccccctcccccgcgccccggcgtttgaccagtgcaaagaagaatgatcgtgcacacgtacacgcgccacccatacgaaagctatactccaaccaaacgtcaggccataactgttggacggactcccccgcgtgtgtcagagatgtcgggtttcgggtctagggggtatttcgtactcacacaatagtttaggaagttgattcggactttttcggaaaaaatatgacagtgggtctagacactatttctctcttttgcaaacacaaataaatattttgatttgtagagtgtccagtaataaataatcatactttgaggatttttttttccaaggatcgatttttctcatgtccatgaactatgaccacgaattcgtgtcctaccttttttatgtcctctaccaaattacaaacttaagtatcatgcaccaaaatttaccttattaataacgtcaacaattaggaaaaatagagttttttttaatgttttatgacaagttaaacatgtacaatgaaatttttcatgatgaattagtaaggacttcaaatgaaattcattctaagttaataatatcaacattttaaaaatacaacagggtttttaattgtcttagtaaattaacgtaaagaatttaattaatctataatttaattgccaaatatctgtagatgtaagtaactgcctagcaaattaagcaagccttttgatttataaaaagggaacattttaaattgccagaacaaagtaaagcatctataaaaatgataagctcctcaaaagcccttccacatgaattagtttcagaaagcttgcaatagttccacacgaatacagttcaaatggatatttattacaggatcaaatatatagtgccaagcaggtctgatgatagtttacgtgtcaagcaaacagaacaggagacgaagataaaggccacagttttacaaagtcaatccaacataagattccagtgaccaattcaaatcctaatcttgatttctaactcttctgctcacagcttcccggacatgtacgttccacctacatgcatgattcaaaagcattcacgtcaaacccaaagtaaaatctctctaccagtttctatcatataaggtgtaatatggtgctaatcgattcattccatttcgcattagggaacaaacatttatatgtacctctctcagcaatctattccatttgtacaaaaaaaatcctccgaccgtcagcctctacaaaatctctgtgactcccctatccgcctctacaaaatctcgacaactgctgtaactccgggtgttcctgagttatttacaaattcgattaacagttgatatacataattgcgcgcactaattacaaattggattaacagttaatatacgtaattgcgcgcactaaataaggtatattaaaaatctctcacctcgaggagttcttgacagttctgaacgtgtaataaacgatgctcctccgtacggaatcgcacagcacatccgttctcagggcaggcagcaccataaagtccatgattttcgtaaacatgtttgattacctgcatagagagaaagacaaatttgtaaatttactttgttcataaataagtttatttctatcctctcacttttcttttagtaggaaggggtaaattaattaaataaaacatacatctttgcgacggatgactccatcccaaggaaatctgggtgctccttcgaagaagcacaaatgacataactcgaacttttctgagaattttgccctggcatcattgaattccttgtatttcttctttttctggtaaggattatccaaaacctaaaataatatggcaaaaataaatggtcaatttcatctaggggtggataaagaaaaggtttagggagtaacacatatcttctttctataaagctaatgatcactaatggccattcccaacccaagacactagacatagttttgacaaaccacacatcatcaagaaactagtactaggcactacgttttcaatgcaaacaccactattacatacttaaatttaatgctgcttagtatctcacgtgatgttttggatggtgtagaaaccaatggttccggccttctccttcctcatttattcacttgccacatcatttttcatactaagtgacagcttatttaatgatatggacactatcctagtcatttggttgggaatagcctaaacatctagagctcaacatgcaagcatagtatttattagcactcctaaaatctctaaacatatgcatggagcattaaatataaataaaatgaaaaactaattgcacggtttgcatgaaaatcgcgagatgaatcttttgagtctatttagtccatgattagccataagtgttacagtaaccctacatgtgccaatgacagattaattaggcttaataaattcgtctcgcggtttccatgcgaattatgaaatcaattttttttattcgtgtccgaaaaccccttccgatatccggtcaaacgtccgatgtgacaaaaaaaatttattttcgtgaactaaacaaggcctaagataaaaacacagggacagcgatgtttgcaacacatgtcccaattatttgagtggaacatcaacagaaccatccaaggacgtccccacgaacagaatgtatgataatccaagaggaccttaattagtacctggtcatctttcagatcgccgtcctgcggctgatcgtctccctcttcctcatccggctcctctttctttcttgccgtggcgagttggtacttccatgcatggttacctgtcgcgatgaaagcggcggcgcgcttgggtggtgctggtcctggctcggcggcgacgcgcggtgcagtcgaagtggtgcgccgccgaaacgcccatctcttcaacgcctcccaaacgcaatgcaggcaccctccgacgcgtcctcgtccatctggtgatgtgtcggatgtggacgacgacgccggcggtggcggtggcggtggcggtggcggacccggcacttctcggaggcgtgcaagatttcttgcccttcttcttgccatcgacgcggggcgcgaacggcggacggcggagagcactgcaggacgtgcccgccgcgcgtggcgaagaagggacggcggcgagcgcgcggatgaggcacgcctcctgtcgaacaggtagcgggcgcgcgccggcgaggatggctcgcttcggccggagcgtcacggcgaaggcgttgcaggacggagtcaccgccggggcgacaagcgacggcggcggaggtcgtttcttgggcgcggtggtggggaagtgcgcggcggcgagaggaggcggcgtcacggtgggaagcggcgatcggcgcggtggagggcgatttcttggagctcaagacccagaacacgaggttgttattataaccgccttctgcacggccgcctcgccgccgggaatccgtcctcattcggacgccagcttcggcgtctgggttcatccgccgctgctcagccgctcggtcggtcggtcgcacctggtgcgcgtgcggctcaaacgaagcaagccacagcaatggcgccgccgcggctgcgctccaagcttcgagaaggggcctgaggccctgagctcggtggaggccaagccaagctcatcctgttaaaattggttgctctttcaactagtacaagtcgtacttcattgcttggctggtgtacccgaatagctttcaatccgtatgtcctgtgttcgactcccgctctgtttaattttttttgtttttgatttagattttttttctgtcccctctattgtttttataataaataaaaacttccaaaatgctactagcaaattattctttttccttcatattttctactgtctgatacattattacactataatagggttcttttttttttcttctccttcctataatagggttctttccttctttttttttccatgccccatctaattcagttcaagctccgcaactaaggttgtgtgactattcattggtgcctctagctatatttcttgctcgtcggggtatttcgccgaacacaacgaaactcagcatatggtaggcctacgcttccaccaagcttgtagttcagcgccatacatgctcccatccacggcgcgtccacacgtatgtatgtacatggcacgaagatatatccattttcactggcggtcccttaggtgggccgccagcgaagattgattattttcgtaagcctttttttaagaaatccgcttgcaaaaatatccatatttttgctggcagatctcttaaacaatcgcgagcgaaattgaatttttgctggcgtgctgggggcagctaaaaccaacacacgaaaccccgcgcatcattttaaaacaagccacccctcccaccaacccccgcaccctcttttcttctcctctacgcccttctctccggccattctccggcgccatcaccgtcgcctccctccacgacgaagccgcctttgccgaggtccacctctgcatcggtcaacttcgaggcccgggccactggccagatctagcgatcccgggctctccgcggcgggactcaagacctccagatctgacgtcggtgatgctcgggaccgcctgatctgggggagggggtggtggcgacagtccttggcttcggcgagagctctggcaacgataaagtggcggctgcgtccggcggcctacaggctcccgccagccgcacgcgcccagctgtggcgcccggcggcgcagctgtcttcgtgcgccgcgccggcgcccgcgcagccgcgtcctctccgtgactccgcgtctccggctctcctcccctggccgcgccctctccgtcccgcgtccggctgtcgcctactcgcccggcagcctcccgggctcctggcgtcccgcccgacgccgccagcacccagccgcctaggccagcaggccccatccaccgtccgcccgtccggccaatgctagtgcgccacagcgccagtgcatcactccctcttcggatctaaacacatgcatccctctaattatagatgtaagcacgcaaatccatcatttaaatttgtaggcatattctcacatgtgtactaattgttccatcaaattgttcgtccaacaaactaatataattccctggtgaattgtcctttcttgctcatctatctactaatgcagcaaaaaatttgcttgagttcagatggtgttttttattttggaaattggaactgtatcggacatttagtcaacctagttatttttgttgggcatcaggccatcagctcaaccggattgacatggtgacatgtgcatgttgcttagaaacagaattctaaaccttaggtgctcacatatagaattaggcagctgcatgtgcttagatgaaaaaattttggaaagttgcaccttgtgatctaccaattccacatatggatgaagggtcatctgttcctgttgtagatgatgctccaattgatgaagacaccgttgttgaagaagggtcatgtgaagaacaaggaccacctccacctccagatgttgttgctcatttaggtaagattcaaacttatttgtcattttgtacttgtactgaaccatttagagttatataccgtatcgtttaccacattttatatcgaatcatattgtattgcattcggtttttttgctaggcctaccctgagttcaagtcctgggtccgccactgctcagatgcccgacctgcacggctgcacgtatacgacatgtataccgacatgtatagttctagaaccatattatactaaataattgtgtacccaatacatataagcatcatctctctaattaatggcaatatgcaacaataaagtgcatggaaaaaaatgcgtaccataatgaaagataccaactgataataatatttataaagttgataatgtgtcaaccatagacaaaatacctccatcctcaaaacatatgagtatatatatgtatatcaagcaatacaacgacgacacgagacaggatggacgtgcatggccttaatgaattggcgtgtgggctgcgggcctttagctttgtggaacctaattagaggcccatacggtgcagctagctactgtgctagtgcgggtttaatttagtcccacctcactcaccgaatgaacattgcactgccttataaacggaggcatggatactgctagcaagaaaaacataaactgagagctgcagctgatctggagtgtatcgtactgcatatgttaatcaagcatatgtgcttgagaattcacggatattcttgtgatgtgctgccggcctgattgaactttgattcaatcacatttttttatttcattactatttaatttaaggtaaagtatgaactaatcactcttttttattcattactatttaatttaaggaaaaaaaaacgaattacccccttacccccataaactcgaataccagatatttcacaccctaaacttctaaaatcgaacgaattatccccctgacttaatctagagtggtttttatttcattactatttaatttaaggtaaagtatgaattaatcactcttttttattcattactatttaatttaagggaaaaaatatgaattacccccttacccccataaactcgaataccagatatttcacaccctaaacttctaaaatcgaacgaattatccccctgacttaatctagagtggtttttatttcattactatttaatttaaggtaaagtatgaattaatcactcttttttattcattactatttaatttaaggaaaaaatacgaattacccccttaccccataaactcgaataccagatatttcacaccctaaacttctaaaatcggacgaattatccccctgacttaatctagagtggttttctactatgtgtacacgtggcagtccaatcagcatttttttttaaaaaaaacattgggacccacctatcagcttctgccccctttgagcgtgaattttaaacacggagaattaagggttcaaatgaacttatcctgatacaatcaaattatattgctccttaagcacagcgagtactgatacaatcactttttttttcaccttcttataatagagttctttcctctcttttttttcccatgccccatccaattcagttcaagatccgtaactaaggttgtgtgactgttcattggtgtccctagctagatgtcttgctcatcggggtatttcaccaaacacaacgaaactcagcatatggtatgcctacgctaccaccagccttgtagttcagcgtcgtacgtgctaccatacgcggtgtgtccacacgtatgtacgtacatagcacacccctgccatcttataagaacatgcatgtgggggtgcaaaagatgaagcgaccatatcctacacgcttacacggtgtgtatcgctcacatacgcctcagtcaccatccgaaacacacagacgccggcagcgctcgcacttgcaatcactaagctcctagtgcacgacgcaataattcgatcgatagtatatatattactctagatatccacttttgcggtcttcagctaaatagcaccctcgtcataactcatgtatttatttaatttaaacattcagaaatatacatgagtggtttacagtactttgaaccggactaactgtcatacatccagtttacaaatgaaccccttaagactgggcaaataacacattcgagcagcattttgtggaaaagggctaaaaagaaaactaaaaagcaatcaagtccttgtcccatggcctgccttgaacgtcgacagcaaggtgatgaagctggatgccggcggaggaagaatccaggtgagctgcataaggtgaagccaccgcacaatccctaaaaagcctcatagttatggaggttcaggcgatggcgagcaatgcaacgaatcagcaccaccccaaaagatttccatcggagatttgagatgaagtcgatgtagaggcagcccaaccaaaggcaacaacttgatcttttcatccaccggcgagaaaaacctagaaagcatggcaagctgcaaatggaaccaagtacgtagcttacccaaatagggcctccacatcacggaggttgaaggcacctcggcatagctaaaatatatacttcagccgctacgagatgattcttcgccagagatcaagaagatgcatggctacccccttggaaagacctcactggagatcaaacaaaaggccgacacaatatgtttttgtcccagtttggaagtaccccagctgtcccagtttggaagtaccccagctgtcggttaggagtagaggtttgacggcgtggagatccacttctagaaagtctagcgataactactgctgcttcctagagatgaaagccacctccgaccacctcgtgcaaaagggaaatatcaatggaattgacctgactaaacaggagaagctgacaaagaagacaacgattactactacttctactagacaagcaaggacgcacgacccctctcacaccctccgttagtggtgagccaccaacgagaagggatgagaggattcggcatagctagaatactttagttgttgcgagatgattcttcgccggagacgaagatttccccacagggtaatcatcgacgtaccaactatcgatcgattgaaatggagtgtatatcctactgtgactgcgtggcagattgtcgatgagggtgagcagccgcatgtacggctcagcctcagccaacgatctcgtccttgccggcgcacaaaaatgggctgcggacctttcgctttgcggaattaattcgaggcccatactgtgcagctatgctagggggagaaagtacaccgaaggtccctcagcttgtcatcgagttcccccaaccgcaaaaccggatatcccgtgtcccttaactaatcaaaaccggtcataatagatcattgggtggttttgaccccggttttatcctacgtgacggctgagtcagcgtgggacctatataaaccccacatgtcagcatggccacgtcagcctactctctctctctcttcccctcttctctcccttcctcatctctctctgtctctcccttctctgcgaggctgccagtgcgagccgggagaggagggcgtcggcggccggcgatgggcgatgcggcggcggtgggggaggagctgcgggcggggagccgcacctagtgaagctgcagccgtcgacgaggagttccttgccgtcgcggtggagcgccgacgccgggcagcgtcctgggtgggcgtcgggctcgccaccgaccagtgctgccttctccctttacaacctcaagccggcacccaccagtgctgcctccccgctggccgtcgtgctcgttgacgagtcggcgagaccggcgtcgccgtctgcaaagtcgcggctgttcccggccaaggtcaaggggagggtgggacccgtttctgcggcggtggcgagcgcggctcgtccgcctcgccgccgtcttcgtcgctgcggccctcatcctgacaggtatccgcacaacccagttccccatccccatctcctctcatatatagctcagccaacttgtaaagatttgttgtttttctattcttcttgttcttgatatgtttggcttatgcatcgtttgctcgatttggcttttagcttcggccaagaagtccggagatgtcacggagcttcagatcggtgtgaaggtaaccgatttttctggttgctcttgcgattattgcttcggggtgtagtggatctgatactgctgagttcgtcgatttgatacatatctgctaatccgttcagacaagctcgatttgtaccaggtgtctccgccaccacatcgccgccgccgcatccccggccggccgtcggacctcctcaccccagcgacctcctgcccaccgtcggcctgcctgcccaatcagagaagggcgagagagagagagagagagagagagagggggaggaggaaaggagaggaagggagagccggagaggcgcttgctgacttggcatcctgatatgtgggtctcacgctgatttagccgccacgttatataaaaccaggcttaaaaccgccgagggacctagtttgcactggttttataagttggaggatgtgttgtatccggttttgtggttgggggatgattctgtaacttgatgataaattgagggaccttcagtgtactttttccatgctagggcgtattttggtggtgtttggatccataagtcctagggacttattttagttctaggactaatcactttagtctatggctgtttggttatagagactaaaagggactaaagttcattaaatgcgctacacaatgaccatgttacccttaaaactatgtaaagataaatgcaccatgcctatgcatgagggtagcaggtggaaaagagctactttagtcccaataagctcgtcccttagggacttatggactaaagcactttaatccctttttagtccctcctgtttaggactctacagacttaaagtgaagagacttattttttagaccctcaaataaacagggcctttgtcccacctcgctcaccgaacaaacattgcacaaccttattaactgaggcatggatgccgtatgcgagaagcacgtgaacttgagctgagcaatatttgtgttagtgattgcaggagagcctatactcttgtcatttgcctttctgggctttgtatttgctcggcctgatgttctgtttgtcttctcagtccggtcacttttttggaaaaaaaccactcgtcactcttaatttcgaagatatttattttattcatcatcaatattttaaacccattatgttatgacttttattttactcatcaccattttagcatagcgataagtcaaacatttttaacttttactattaatagcaaaaaaatataaaatattaatcctgtataattgatgttactaaatttatcattaaacatttaaacatttgtcttctcagtccggtcacttttttgggaaaaaaaactactcatcactcttaatttcgaagatatttattttattcatcatcaatattttaaacccattatgttatgacttttattttactcatcaccattttagcatagcgataagtcaaacatttttaacttttactattaatagcaaaaaaatataaaatattaatcatgtataattgatgttactaaatttatcattaaacatttaaacatttgtcttctcagtccggtcacttttttgggaaaaaaactactcgtcactcttaatttcgaagatatttattttattcatcatcaatattttaaacccattatgttatgacttttattttactcatcaccattttagcatagtgataattcaaacatttttaactttgactattaatagcaaaaaaatataaaatattaatcatgtataattgatgttactaaatttatcattaaacaaactatcataatatgctactctttttatttaaaatattttattatattttcttggttaaaataacatctcagagactatgtcagagttcaaaagttgttatattttgggacagagggagtaaaggataatttcatttgacacctggtgagaggtgtcgccgaggcagggaaggcccgcggggcagcaacggcagagcacgcctcctgccgaataggtgtgctcgggaaagcgcgcagcgacgaggatggctcgccgcgggcgaaacagatacaacgtacttgatctgagacgaggagcaatgacgagcacgtggttggcaagtgcatacttgccgaggaccatgagaaacaatctgcgccacctagaacagttgtcgatggcgagatcgtgggtgaccggcacgagggccttcacattgaggacggtaacggcctagccatggagagtggcgatggcgtcgtcgtcgagggtgggaggaggcggctcctggggcccgacatgtagagggtgcgctcccagcgcaccatgaaccacgagacaggcgagcagtgctgtgaactcaggcgggaagggcaccggaacagaggagcgctaatgcacaagcgctaaaatctcactcactcgcagttattggcaagccccttctaacttagttgtagcttttttagcaaagaccaagattactattccattatttgaaaaaaaaaacccttctaactagcggtgagctctacctagccccatggtgtcatcgcctcctccttgacgagctcgccatagtaccagatccagaccaccctccactgtaactgcatggcagattgtcgacgaggggtgaacggctgcatatgcactgctaagccggtgatctcgtccttactggcgcgcgacagtaaggacgagatctggaatccactgtcgcccactgccacgattagacctctcacagtgcagtgagctggatcggtgctccaccatgccaactgggattttcgcgtgcgtggcagaagggtgcgcgccctagcagaggagctcgccccctaggagggaagcgcgcttcctcacgtactcgagcccacgcgcggcgaggaaaaggaggatgtgctacgctgtggaggagtaaatccccaaatcgccctccaaaatccccaaatcgtgacatgcttgcagatcatccatctcaaaagaacaatcaagaacagaaacagattgaatcacaatcaagaaagcacaaaattctttctctttcccagcccttccatgccagcaccgaagaacccattctgcaaaatctggggattttttttcaggtggatttcaatgagaactactaccaagctcagatcttgggatgattgatgaggcaagctaaagaaaccagcaaaaagggggattttgggatcaatgaacacaagagcaaagctccaagaaacgaaggcggcgtcctcctcgcctctccccatggatgatggaggtggcgtcctcctcgcctcccaccgccaagaacagccagcgagccgacgccaagatcgagggagaggaggcaccggcgagcctctggaagaccaccgaagtcgccgccgccgaccgctcccgaaggcgcgcgtgaggccgtccgctcccgccggatgaggggagagccgaagatggggggggagagccagcgaagggaggaggggagagcctccgctgagtcttcgccgcgcgctgccaagaaccaccggccgccgacgcaccggcgagccgccgccaacaacgccgcagaccgcgccatcgaaggccgcgccgcagaagccgccgtcgcggaagccgccgccgccgaccgtcgcagactgccccacctcctgctgctgctgctgctgctgctgcttgggatgagaggagaaggaggcgcggcggcgtgggaggcggggaggcgcgggcggaggagaagacgaggggatggcggcgcgggaggagaggcaggcgatggcaatagagtggaggaggagaagacgagtcgctagctggaagggtagttggggaataaatttcgtctattggcttggggtaacgcgtttggggtaacaggcactgtgggctgagtttgcttcaacagtatcttcatcccattaaagccacacaaaataggatgcttgttttgtcgggtgggtgtctttcggccaactttttaggctaggggtatgagccccatagcttgcactgtgagtggccttaggccttagggcatctcctttctttgtacaccccacgacataacgtgccctcacgcccgaatcgcataacttccactaaggtcagccgccccatcacccccagtggactgaggaagaaacaagagaagggggctcgagagagggagaacaacaatgagctgaggcaaacagtagaagcaattagaaaattcaaacaataatttgaaaatgtaacgggtccgctggctcaagaaacattgttcggatggacatcaatgttggcccgtccacgtagaataaaggcattgcccatggctagctaggattgaggcccatcaaaagggccccggaaagcccaagttttaatgcaaaatcccaaattgccaatccacctggtatgtgtttgttttcgggactaggtggaataggatggaaccatccttgattttagggttgggatgattccactcatatttttggtttgtaggataggatgatcccaattttttgtttggttgaaggggtgagagagagatgggatggacgtcgtttgcaaccaccgtcaatgaccgggcggccgtgcgggcgagcaagccggcagagttcacaagatggactatggctgagttcacaagcggcgagcaagaggaaaagtggcgaggacgggctcacaagatggacgacggcggacggagatgcgtgacgagcggcctcgacgacagccggacgagtggaggagcgtgcacagtggatccggcgccaccgagtcccccgccttaggatctgccgccgcagccctccccatcgctggtttcgccgctaccgccctccccaccactagatccgtcgtcgccaagccccccaccgccgccgtcgccgagcccaccgttgtcgtcaccgcaggcgcttccgagggcgaccagggcggtgagcagggtgtcgtcacgacgttcgctcgtcctaggtgggacgagttcgtccgcgaggtttggccggatcgattggtcccagatctgaaaggaatattcgtctccagggaccaacccatcccactcacccctaaaactacgtttgtcccatcccataccattcttgcaaccaaacactaccctactgaatgggcctggattgtgtcctccctaaaaaggccaaagttcacttttggtcccttatttgaccccgagtctgaaattcaccgctaaacccaactaacatatataacatgtccttcaactctaaaaccagtacaaacttgttcatggtttgtacagtggttatggctaacgtgacgtctacatggctagtttgattaggtccacgtcccacatagtattgatgtggcacttgcaataattaaaaaagatgggacccacatgttagtgagtcttcgattaaaaataaaaaaaattacagtggaacccacttcatcacattcttcctccctcctctctctccctctcctcatcgtcgtcgtcaccagggcacgccacagctacgaccgaccctgccgatgagtgttgcctactcgcttcccaccatcggttgtctcatcctctcctgcgtaccgacgagagggaagaaggcagttcatggcgacgacactagagcgacgtcttcctcgagagtgatggccactggatgaagagcaccaggcagtagacctcctcagctcccgacagtgatgggcggctagccatcagatctgggtgccatgggggtggcatcttcccctagagcaaggacaaccagaaggacagcactaggcaacgggccccccttggttcccgatggcagcgggcgaccagctgccagatctctcgagcaaggacctcggcgctacgaacatcaacatgctcggcctcgttagtggtggcacggtctgcggcgacgccgatgaggagctcgatttcgaagtaggcccattcctatggctggcgagccgcatagtggtgtgggcatggaatttggccaggacaccaacaagaagtgggcgcgcgaatacagagactggcatggggagtagtttgccgactccttgttagtgtaaaaacacggcggcctgggagatctaaattccgttgttaacacacctctctgctgttcaagccggccacacgagcatgactccgatcttgctgccatcaccacggtgtaacctcccgccagtggctgccgcccccttccctcgtacctcttgtcacgcccctccacaccgcccgctgcgccaccctgaaggagatgggaagagagaggaagaaagaggaagagaggtggagaaagaaggaagtaaaaaaattggttactaacatgtgcagcacacgtgagtccatgttgactcggctcaccacgtcagctaaaactgagtataatacaatctggtaccttgagtaattcggtattatgagttaggggatatgctatatctattttttttagagatgaatttcagactcggcgataagttgcaataaattaaagaacttgaacccacctccttcctgtggaataagttcatatgaggtcccttaacttgtcaacgaatccgattttcgtccttcaaccggaaaaccagatacaagaggtccctcaactatcaaaaccggtgcactcaaggtccctcggtggtttagatggcggttttggctgacgtggcgcctacgtggctagtttgactcggtcttcatctgacgtggcattgacatggcgcttacatggcaattcgatctgaaaaaataataaaacccgtaggacccacatgtcagtttcacatacaaaataataataaaaaatggtgggacctacatgggccccatatgtcatcctctccttccgtcttcccactatcctctctctctctctcttcttccctacggggcgacgggcggagtagagcgacggcggccgaagcggcggagcgcgaagccagcagggcggcggcgggaatcggcatcaccttggacgtcttctcgtcggagaccaacgaatgggcgaagcgcgatgtggtgttcggcaacgttgaggccttgttgctgtcccccagtcccctaccatgcactatcgcggcggcgtcctccacgtgctcgtgtacccccgaccgcgtcgtgcttacggacctcggtgccagcctcctctctatctccttcttcctttcactcccaaagtcccaatgaggaggcatggtttcagagcttgcaccatcgacagtagagttgtccgcgcacggcgcatccttgtgcagctctatgacacaccctggtcgaaattgcataacgaattgatcaccaacaccgtcaatatactgctggcctatccttgtccatttcagcaacctcattcatcactcctttgaaccactcaaacgacaacggctcccgggtaacccaggaaaattgtgcgcggcttgttctgtatgccctcttcttgttgttacttcttgttgacacactgaagctgttggcgacgaccgacagcgcccggcaagaaagggaggagcggcgggaggtggccggcgatcgaggagg

SEQ ID NO: 20128 - DNA, 14121 bp, Oryza sativa
  unsure (1)..(14121): unsure at all n locations
agcgaggagccggaggaggaggaggaggcccccaccccgaggcggaggaagcgatgagcccttccattgagtcatcggaggaaccatccgccgccgccgccgccatctccctggccgcggccaccgtcagcgagggccccgtgggaactcccggccctggggccgccgaggaggaggaggagagtggcgctagcgccatgtagcatatggttgcctccccgccgctgtgtctccttgttgccgcggctccctcctcgccgggcgccgtcgccgctactccggcgaggcagcgaccccttcccgtgccgctgctccccaccgccactgggaacaacctatcaatgcgagggtcccactatttttttattattttgtgtgtgaaattgacatgtgggtcccatgggtattattattatttttggatcgaattgccacataagcgccacgtcaatgtcacgtcagatgaagaccgagtcaaactagccacgtaggtgccacatcagccaaaaccgccatctaaaccaccgagggaccttgagtgcaccggttttgatagttgagggacctcttgtatctggtgttgaaggacgcaaatcggattcgttgacaagttaagggacctcagatgaacttattccccttcctgtccacacaaacctgcctcttccgacccattccaagaggctcatccagcccacgaacgagctctctcctctctgggccgacccaaaactgccgcttccacccactccaaccggcccatccagcccacggcccccgcgtggcgccgccactaccacggccgcattggaggaggagaggagaaaaacatattcagcacatcgccggctcgcctctccgccgccgccgccgccgccgtcgccgccgcctgcctctcctcgccgccgtccgatgcgggccctcctgcgcgccgcgtcggtgctccgccgcgcggcggctccggccctcggcggcggccgcgccgcgccgcttccccccaaggtttctactcggggctcctcctcccccccccccctcccttacatctcgttctcctccctcgcctcggttcccgtcgcccgtccggtcgtcggtgcggcggcgggtgtgatatagcgcgtccgaatacgacgcctcctccggctgcttcgtttctcgtcggtcgctgtgttcggggtagggtttaggggctaggagggatttaggagatactgctcccttgtggccgctgtgccaattacttggttgttttcatgacgagaatttgtggttgggtttgatgccgtggagtgcggaatgattgggagtgtaagaaatggggggcactggatcgcggtggggttttggagcaggtttgcacgaccacttagatccaagttatgtgcagtttgagcttgggtgatttggtcaggagacatatcatgaactagtattgcaggattctaggctaggctagctaacatgttaaagtcttgaagaactgttacaatctatcttccatagtgtagaaaatgttccagctacacatgaactagtatgaataattccccattgtagaaaaaggtttaagtggcaataaaagactgtgtaagactgttccagaggttgcgcataatccaactagtagaacaagagtggagaatggatattggttgttttcacatttggattgagatattttcatctgcactcgtattctgtcctgtgtgaatttcgattcagttgggacttattccagttgccttccacctacattcttggcttgtcaaaattctaatcattcaaatttgtgttatgctttgtgctgttgatggccaaattttggtgtctccttagtccatggttttgaatgctatttgggttgaaaactcggctttttgtgtttttttgctcaaataatgctccttaggtatgtatcatggaagtttgatcctgcattgtaattcaggcacttgttttatttgcagaacttgcctgctgtctgtttgaatgggtattctactcttttggctccagcaaatgaagtgctgattccacaagaacttctatccagcaagactgtttggactccagatcgtgagcttggtatctttctactactatatcctttttgcatgtttacgttttgcatgcttccttcttaaaatgctattttctcaagatttacctgctcatgtttctttctagctagcatgaatttgttacatgatacttttgcattgttaaattgacaaatctgacttttatctaatcgaatagaattgtacataattcaaaattcgaaattcgacttcacttttaatagtatgattgtattgcaattggctgatgcctgactggaggatatatgtttcctgaacttggctgagttataaagtaatctgaaattctgtattgcagggcagtatgaagacctagtagcccgagtaacaaacttccacaatgaggataagggcttcatggttttagatggtgatgtttttgatgttccaatcaggaaggatattgttcatagagtagtaaggtggcaactcgctaaaagacagcaggtgcaacctgatatctcattttctttgcttggctccaattctcgtctcccacactattgcgatctactttacgagattttctgaactattgtggaccttcctgcttcacagggaacacactcaactaaaactatcagtgaagtgagcggcacaggaagaaaaccttacaatcaaaaaggaactggcagagcacgacatggtacactgcgcggccctcaggttatgttactatttcgaatattgtctggcataaaagttgtttatggcctgtagaggtatccacatctggtttggatttcattttatctaaagttagaccaaaactgaaacagtttcgcggtggtgcaaccatgcatgggcctaaaccacgaagtcatgcgattaagttgcagaagaaagtacggcgtctgggacttaagatagcattatctgctcgaaccgctgagggaaaggtaactgcagctttactgaaattactgcattccttctttgatgttctcaattgtagttagcgtttgcctcatgcctacaaaacaattgtgctctagatgaattgtttgtattgaatcttcactctgtattatgttcaaggtatttgctaactgcatgcatgactgtctgctttagttcacaaaattttttgacatgacagtttgtcacctgaaagacttccttctcttttttttttgtttatgatggagtgttctgtgcgatctcagttgtagttagcttccccctcatgcccacaaaacatttgtgctctaaatgaattgtttgtactgaatcctagttcagtattattgtccagaaataatttgctgatagtatgcaagactggctgcttcagttcacaaaaattggtggcacggcattttgtcacctgaaagacttccttttttttttgtttgtaatggagtgttttttggggggagtggtgtttgcctgtgtgggatcctttgctgtgaagtttaggaagatggtctgatcacttacatttctatcaatcctcagttgcatcctgttcctctatgtttatattcaaccaatgttatctgcacgccttactgaagataactgtatttatgggattactcgctcctataagctctcctgcatataagctatcttgacattttctggccttcttacaaatgcctatttgacaaatatttggagtcatgagttcattcttcaccattaaagtttgcttctgtcattttttggtagctcttggtctttgatgacctcgaagttcctagccacaagacaaaaaacattgtgcagtacattggccagatggaaggcacaaagaaggttttgttggtagatggaggtgacattgataagaagttaaagctggctacccagaatcttcactatgtgaatgttcttccatccattgtgagtgtctctgaatctcatcacttgattggagtaatgaagatggcatagttttccaggcagattatttcactgatgcttaaatatcatcaaatgcagggcctaaatgtatacagcatccttcaacatgacactcttgtaatgacgcggaatgctatcaatagaattgttgagcgtatgcacacccccatcagccgctagcatgttgagattcgacgtgaacaccactgttttgtagcagatgtacttcgaccccctaaagcttcatgcatgccagttttcactttgctggtgtaaggcattagcaacaacacaattttccttttcctttttgaaaatgatctatttgcttctgctagtgatttcagtgaaccatgttgcgtcagatccaatacatcaaagtaggaagtgaattggtcatcatggtgtgcgctcatgactccagatttctaataaagacagttctgataaacttgacatgttattcctaagatttgctattcattacgaatttgtctgtcaatcatcattttgccctagttcttttttttttgttctgcaagtatgcagtttcgcgtttgattgtggaacacactttggagacatgaacaaaatgtagaatcaacatatgcaagcaagcaactttctgtacttcaaatcatggtcaagcaattccattgtttatgtctgtgtgttaggtggcatataaaacctgggttttagtgtgccatttcttaagttcatattcccttttgttttgtcccagttcataaaatgtaagacatcagagtttaaactatatgttgtgtcatttacaagtcacaagttgccccagataagctttcggatcttgtcatgatttaaattccgcattgacaaagccatattatatggatgtaagaaagatatcaataaaaacgattaaactccacggtgttgttgtacttgcttcattaaatttcatcacaaattttcagcagttgaggctgctccactccaacatggacgtgacagcaggagtgagtgagcaagaacagctttgtacggtagcctttcccatcacaggtacgcaacgcaagaatccctaatcatgtcgtgagctgcttaatcacgccatgcgtgtacgtgatcctaggggattaagtgaattgaaagcaggttaccaagggcaatatactctaaccacaccctctgtccatgcccatctcattggtgccaattgtaattaacagagtgattaggagatattaggatgagataaacaaacataattatgttagctaagctaaaccatgttatttttttgtgccaactgtaatgaagagagaaacttgggaggatttatgttagcttagctaagcacatgttttttagggtgccaattgtaattaagggagaatttatgagagattgggatgagataaattaacactattatgttagctaattaagctaagcacatgcttttgtgagggttaggttggtcaaatggtacgagcgtgcttgctttgggggacaagaacatccttcgtgtactcagaaggcacaagacaaagaaaggggtttttgtacgaaaaggtgaagcttttgtgcctgcttaagggagtaagtaggaggagcacttcacacccgtgccaatgcatgtacactaacactacagtgttaattaatcccctttctaggcaggtggtgatgatgatgcacattgcactacgtgtccttttttatttgtcacgtacattgatctctttaaaaaaattgtcgatttctcttggtgtgaattggagacctgctatggtgctagatagggcctagggacaaagttgctcaacatctccacctccactcaccaaggtttatgatctcgattgatttttctttgctaatttcaaaggaaaattggcacatttagaatgagttttgataatttttccgttgagatgcatagttcgagccttgagacgattggaatcgtaaaagttgatagaaattagtcgagattgtgaagcctgctacttacttggaatcaaatcatggggttgataatctttatgtagcggatgtaggatttatgatattttttttatttttcaatgagccatattttgtaagatgagtttacgaaaattcattggtgagattaggcatgaaagactattagtttagccatttgttaatattctcctctttttggctacgggattggctcaaatgtccaaaaatctcgtcaaactagaccactcatgaaaaaacctataatgagaaaatgatggatgaaagtattaaaatttggcagcaacaaaggcatatgccctttcaaattattattccccgttattttgtcaactctgtaaaatcatgaaaatttatcaatcaaatgaccctatctctcacacagagacacgctagatgacgtcgtgaaccgatggcaccgcgtaaaaaaaatatagtttaagttgtaatcatcctaacataccatgatttaggtccatctttgatcacctgataacaacttagtaatatattcaaacgccaaaaattcaattaggatcacatgatctataaagattagttggtcaatccatcagaagaagtcaaagctgaaagcagcccccatccatccttttttttcctcctcacggttcagacttgagacacaccacaccagtcctctcgtagaccaggtctacagacagagcagcacggttgccagctggccccgtgggccccaccggcccatagccgttgttggctcgggtttggttaagcgcgcggccgcctctctcacctaattaacccgcgtccaccatgggccaggtccacggtgcaccgccgcggcggctcacccgcacgcggctcggccgaccacatcgatccagcgatggccgggtcgggtcgggtcgggtcggttgggcgtgcgacgcaacacgagccgttatccgcgcccggtttccctcctcacggctccacctccactcctgctgctgctgggttgtctgctgaattgggtacttagtagtagtagtatttttctttatacatggtttatttggtgtttggtttctcggctaaaaatattaccatgattgaaaagtactaaggggatgttggttgctatcttcaatgtaccacatgcctatcttagttatgccataatttttttcaatcatttagttcattaccacaaatatggctcgccgcacttttcagtcatatggtctcacgtgtcattgacctatttttttttaactaagcttgtctaaggtttggctgagaatttgtgagccacaactaattgcctcaattgtggtttggcagtgttagctactagccaaacaatcctaagtctaatgtggttttggtgtgtaaaaggatgaagttatttaggttcgttttgggtcctcgagacgcggtacgttacgtctaatttagtacgattacgatgcaaaaaatagacgtgggtaataaaatacgagtaaaagctcgacgcggtgaaataaacgtaggggaataaaataggagaataagcaaatgaactcttggctcaggggcagcgcttggcaatggccacgttggcacgctacctatctgcatcggaccgggggatttttcccatatggcctctaggttaagtcccaaatggttagggtacccacacgcgtgcgcgttcagtggtatgtcatgttccccgtgcatggaagctttagcttctccaagtctttagcttaaagtatttgttggacacgcgtgtgcgtgcatgtgaagttgcatgggtggtgtgatgtgtgtacgtcctttgtatcctctcagaagaaatatgagaagaaagtctttgtgtaaaactaactcagcaatggaattaaatttgttagatggttgttatgcctatatgccatgatatgagaatagtctaaactgagacttaggtcatgtttggtgggcttggattttgaaaaaaaaaaactttccatttctaatttattttctgtattttataactatggatttttagaaaaaaaaatgaattttatattctatattgtttggacgagtggaaaattatgaaaaaaatgaatctgtcaaaaactcttccaaacaaacagctaatttgataggattttttctatataaagtaatacttagtattacatcatttttagtattttatacagtacctacgtattcttagtgttacaccttttgtaaattaacttaatgattcatggctagcatgggtttataaattaatgtttctctaaatgaaacgagggggacaatgccgtacattttaagggggaggaaagagatagaaattcaccagggttttaaaagagaattttgttagggtggcgttttgcttgtgaaaaaaagggtcattttctcgaaatccaaacaaaatcaatgtcaacaatgtatcattgtaacatccgacggcaacgtatcagttactcattctcattgtatagtcctgtaacatggaattgcaatttccttctctttttttttgttgttttctactttttctacctagaagtgtactaaaagtagatagatgtatagtgacgtatgcggctggtctccagctgcattcaggttctttaattctgactttgtgaggcaggttggtgggaccaagtttgacttcccccaaaaaaagagatgattagagcaaatgcagtaaagatcatcaaagagtaaagttaaaaagttaaggcgaatgtgcctcacttaacaaagctgttaccaccaagagaaacttaacaaagctgttaattaattaattactcctacccctggtacgtaattgccattaacttaatgtagcattaccttcctgattttttttctaccatttctatggataagttttcagcataatttaacacataaaattttaattgcatggacatgggagaatcgtataagtaaattaataaccatgacgaaatgaatttatttgcatggacatatatagaagaatcttgcaaataaacaaacaagtcggatgaaatggcacagcgagtgtgacctgttgcatgttggcaaccatgcaacgtacgcgcaactcctagtttattgcttggggaaagaagattagtgcacatgcatgatgatgcaatagaacaccaagaaaaataaatatggccaagacataagacaggtttagaccaggggagcaaggcacagattacttaattaatcggcgttggcaatacttaaatcatttggatagctagattcttggattttgcctagcttagctagtgcatgaatattagaaaatcaggacagcttgaacaaccgatttagggaaaagaaaacaccaaggtctaatttgtataggatccttgaggttgaaaccatttatacaatgaaaaatctgtatggataaacatgaccacaatttgccatagatttaggcttagtttaaaatagtctaaacagatgaatggatgatagattatttaatttttatgatattcaatagtacaaacagataaaataaacaaagctgaaaatttgttttaaaaatattctaagcaatttatatatatataaagcttttgaaaaaagaaatcagaccatttaggggagcttaaaaagcgtgcccgtaaagaggggaaaaaaataagccttagtctttgtccatcgttaaaatctacagtatatgacatccagcttattttatcactgtttcaaaataaaaaggagagcttattttaatttatcacacaaagatatgaccaaacatagcttctcttctaaaggaagatggttacaaccagtggaatttcaccactttagggaattatactgcaaacacaaactgttaataatagaaaaaaaataacaccatagtttattttcttgtcactatctgagtgatgattgatattgattgtatataaaaccaaacaaggctgtaaatatgggtaaatcaagccgttgggagcattgatatacccccggggaagacgatgatccgatcgagagtagctgagccgactctctctctcactctcgtctcttggcagatcagatcaagatcaccatttaattcctacatactcaccgtgaccaaatacgtacgttgaccataaatggccatccatccacaatccatccatctgcatatgcttctctcccaaccccaaaccgcgtcttcttctacctcccgctaagtacacgcacagtacgacacattagtagtcgtagtcctcctcctcaccgccgccgcttctcctcctcctcttcctcctcgtcaccatcgccatattccgaccaatgccattgccgctgtcgcacgaatataacgtatccaaaaagacacacagcagcgacgatgtcctgtatgtgtagtcgagcacgtccggacgatgtacaaaattttaaatttaaagcttaagtttaaaacttaaatttaaacccgtgaaattttatttcttttcatcataatttatttctcgatattgactttaaactcgttaaaaatatatatttaaatattttttaaaaatatattattccttctttaataagtgttatggaaatatatatctaaatatgtttttaaaaatattatttttttgttaataagcattaaataaatatatactccctccgttctattttaagtgcaaccatgattttttcatgcacaactttgatcgtccgacttatttaatgtttttctaaaaaagattaaaaacataagtcatgtataaagtactatttatgttttatcatctcataacaataaaaaaatataaattataaaaaaattcaaataagacggacgatcaaagttgagcacgaaaaattatggttgtatttaaaatgggatggatggagtatttaaagatttttaaagagaaaatcagtggtagccaaaaaaccatgggagccacagcgctgacgcgcagcacagtggccaggtggacacgatggggttaggcttgtcctcgatggatggccgacttaacccccgcaattaacgcggattaatctcgccgcgaccacaacaacttcctctctgtttcactaccctctctctctctctctctctctctctacacgctttgcaattttgcatcgtgccatcgtcctgtctctctctcttcctcgagaaagaaaggaggagaggggataaagcgcacaaagagcagccgctttgtgccaatctctctctctctctctctctctctctcttctctctctctctctctcatcttctcctccccaaaaagaagagatcaccaattctgtggctgcttgtttcagctgcttaggattcccaagaattccattccaaagcagcagctgctcctcctccttgaatcttgggattcagtgcacgcctccctgcttcttccttcctcctcctgccttgcaaatcttggagctttttttttttttcccctcttctcttgtaggagtaggagagtaggaggggttggagtggaggagattggatttggtggtggtgttttgtgcggcggttgggggtagaggaaaggggagtttgtggggggagtggttagttcttggcttcttcttcttcttcagcgagagctactacagctacagctcgtgctcgtgcgccattaaagtcctcgcctttgcgtctcccccctctttctaccagcccacctcctcctcttcttctttggattagggcttcgaaggcggctgctttctctgcggagggggttgaattcttgcgattcttggaggggggatttgtcctgagtgatttggtatgtgggcagcatgaggaagctcttcttctccgagttgacctcctgcaaggagaccaagctccactccgcgccccactcatggcttcccctcgagaaagggaagctctccaagttcgccggccactccacctcctccatgtaagttctctctctctctcttgctgttacatgatgcgtttggcttgttctgaatcctgctactttagttagttacctggtctttgttagtagtactttgtgtagagagagattcacaaaattcagattttactggtatagttctgaagagctttgctggctggttggttggttggttgtgatgttcatcaatttgattcttggtgggttgtggttgtggtgcagagaatcgctgatgaaaatgccggagccggtggttcttccccacttcaagcctgcggattatgtggacatattggcccagattcatgaggagctggagtcttgccctcctgatgagaagtcgtgcctgtacctgctccagttccaggttttccgcggcctcggcgaggtgaagctgtcgcggaggagcctccagtccgcgtgggagaaggcgagcacgatacacgagaagctgatattcggggcatggctcaagtatgagaagaaaggggaggagccgatatccgacctcctcagctcgtgtggcaagtgctctcaggagttcaagctgctggatttcgtgtcgcagatctccaccgggtcgcatgagataagctatgatgatgagtcggatgtgttttggggctctccggtggtacatttccggataagagatgatatgattgcatgcgatcggcgaaagcttgctgctttgtcgactccgctgtatgcaatgcttaacggtggctttcgggaatcacatcttgaggttattgatatgtctcggaatggcatctcctcgattggtatgcgagcaatcagtaaattcagcttgacaggaaggttaccgtatttatcagcagatgctattttggaaatgcttgattttgctaataagttttgctgcaatggcctcaaggatgcttgtgagcgaaagcttgcttctttcatttgctcgaggcaggatgctatagacttcatggagtgtgctcttgagctgggttgttccatccttgctgctgcatgcttgcaggggctcctgaatgagcttccagagtgcttgaatgatgaacaagtggttaggatattctcctgtgcaagtaagcagcagcgatccacaatggctggaaatgcttctttctccctatattgccttcttagtgaagtctccatgagcatcaacgcgacatcggatgtcacggtgaccttcttggaaaaattggtggattcagcatcagattctagacagaagcagttggccttgcatcagctggcgtgcacaagacttctaaggaaagattatgctgaagccgagcgcctgttcaatgccgcctttaccgctggacatctctattcagtagtgggtttggctagactggcctctatgaggggtaataagcatttttctctcaagttgcttgattctgtcatgtcatctcgctggccacttggatggatgtaccaagagagagcactatatttggagggtgataacaagttggaaaatcttaacaaggccactgagttggatcctacccttacatacccctacatgtttcgagctgcatctttgatgaaaagacaaagcgttgaagctgcccttatggagattaaccggatcctgggatttaagcttgttctggaatgcttagagctaaggttctgttgctatcttgcacttgaggaccatagagctgctttatgtgatgtccaggcaatcctcactcttgctccagattatcgtatgattggtggtcgggtgtctgcaaagcagctgcgtatgcttgtgatggagaatgttgagcagtggacaactgctgactgttggatgcagctttatgatcgttggtcatctgtggatgatataggatccctctcggtcatatatcaaatgctggagtcagatgctgctaaaggagttctctactttaggcaatctttgcttcttctcaggtaacttaattaacttattttattgcacagaataagagttagcatgattaaaaaatgatacagcacatcagtgattagcattgtagatgtatagcacatggtttgcattgcctggcatgtcttacaccttntagtgtgtggattcatttggaatgccaaactaccagatggtttatcagcatagttgcacatgcctcctgaccaacttacatcatggtctaattcttgtgctagaatctcagggatgttgtgattaatactattttaacctctttttttcagattaaattgtcctgaggctgcaatgcgcagtttgcagctagctcgtgaacatgctg

SEQ ID NO: 20129 - DNA, 2021 bp, Oryza sativa
cattctgaagtagtcaaacaaaggtttcaaattgggttcttggtacatgaagtgtaattttaccttgttgagttatcttttaataccttcgtacttgaggcataatggcataatatgcatttgttcattttccaaattcgttggttgttatttagatcaggtgttgttgctccacctatgttaggaagttaagatgtcctattcattattgaattattaatgcaaatggcgctctcactattaaaattggctgtcctggtgctcataacatgccaaccatcaattcttctcataggtgcactgcaagcgtgatttgatttcctatcaagtatctaacatgtttctaagttatgagttatgacatctgataccattgatgctactgataattgccaaccatatggatgagtggactgacttaaatgaaactttgctctcttttttttcatcagtttagctaaatggaccgaccagccacaatcagtacttttttctatcagcttaagctgacagtgtacattttatttctgtaacattggttgacccaatctgcagcattgtatttgatttgagatgttcgcgaatggtacatcttattcatcgtaatgtgtgacatcttgtaggctctgaacaaccttgggagtgtttatgtggattgcgggaagcttgacctggcagctgaatgctacatcaatgccctaaagattggtcataccagagctcatcaaggccttgccagggtccatttcctcagaaacagcagaactggtgcatatgaggaaatgaccaagctaatagagaaggccaggagcaacgcatcagcttatgagaagaggtcggagtactgtgatcgtgagctaacaaaatcagacctgcagatggtgaccaaactagaccctctgcgtgtatacccctacagataccgtgctgctggtaagcaccgcttcctgcctagcaaatcttgtttgttatgatataggtatgactgagacaagatttgtcatgatagcaaaccaccagtttcaaagcaggttgaaacttggatataaaatcgtggtcacagtagtttaatttgttagtagatgtagctcatcggtgtccaactcccagaggtttgtgctattataactaaccaactactccttttcctatcataagctggtaagaagtcaatgttgtttggcaatattctatgctcaacttgatcagttggtgtaacaaccacatatttcactcagttcaaaaattagctcatctgtttgatattctcatgcatcttttttcgctgatctggaatcctcagtgctgatggacaaccacaaagagaaggaggccatcgcggagctgacaaaagcaatcgccttcaaggcggacctgaacctgctccacctgcgagccgccttccacgagcatgtcggcgacatctcgagtgcactccgggactgccgcgcagcgctctccgtggatcctaaccaccaggagatgctcgagcttcatcaccgggtgaacagccaagaaccctgagccccccattgttgtacatacaggagctctacatagccaaccataccccaagtgtatgttttgtaccatacacagcagatcaatgtaaggatagtagccaatttaggccctccacccccaaaaccaacccaattccttgtgtccttaattagaatatgttgctcatcatagagtcctttttttagtaaattattatatttttgtgattaagcccccctcctaattgtaccctccatgtgccctcccccaaccccatgttcccaacaagttttgactatctcatgtgtaaatgaaaaatggaagaaaaagaatggagaaggtttgtgtcggcgtctgcgcaaaactgtcaaagttgatgctaatcactgattgcacatgtgctttgtttctcttctgattataaacaaaatgaactgatgaaactatcagaaacaatgccatgtggattaagaagaacttggaattgtttctttgcttaatttgtttattaacagcag

SEQ ID NO: 20130 - DNA, 25233 bp, Oryza sativa
  unsure (1)..(25233): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnaggagtatgcagaaatatcaaaactctgaatttcaagaattgcgcataagaaaactttcaaggagtatatgcagaaatatcaaaactctgaatttcaagaattgcgcacaggaaaatgatgtgtgtatatcatcagagaatatgagaaaaaaaatggagcaacttgtagttgattgcgcacaaatttgatcttttatatttcagattggtagggaatacagacatggtttttttcagacatgtgagacataaataaacactgaagtggtagcagcagcagcagcaataacaaacacaacctgccagctccaacaaatccatggaaatacaggcgctatgggtcagcttgttgtggccttgccggcgactttctgagctatccagccgagcccgtcgtagaggccctcaccggtgatcgcgcatgaggcctgtatgtgccaatcgtggttctttatgctgtggagggagagagcgtcggtgatctcagctggcgacatggcgtccttgagatcctgcttgtttgcgaacacgaggactactgcgccctcgaggtccccatgctgaagcagccggaagagctcatccttgataatgttgatccgagcacggtctgtgctgtcaattacaacgatgacagcatgggttcctctgtagtatgttgcccacgaagtccgtagactctcttgtcctcctaaatcccacacctggttcaataagaatttcagtatcaataacactggcatggaaaaaatgtcccagaagattgacaatatggtaaataaattatgtggcatgaaaaaaatatttgtcgataagtaacatgatattagatatatggaatcaggattcaagcaagccacagaagattgttccaggaaagaagtgaatttcatgtctctgtgatttctgacaagtattgggtatttgggtgactaactgaaagtctgaaaacactaagcagctacctttccttttgagaaagcctacagtagcatgtgaggtattataagccttatcaagaaaacatggaaatgcaaacatcgtagcgcttgtatcagtatactgtgcaggactgcaggcaaataaaaatgttattatgtgattttgctgtacaaatacagcaacatgtacggtgaatctgtgatggaaactagactatggaagaacaagaatatacatgcaaacttacaaagccgaaaggtatcaacaatagcatgcaaactcttaaagcaaagggatacatttcgatagcttcctgtgttggttcactcaactggttactaaactacaccatcgattaattgcatacagagttctcttcttttctttaaagaaaggtatatctttgatctatctgattacacctacctggagccaggaataaaggcgacaacaaagactgaacccagaaaaaaaatgtgaatgcagcatgccattccttacaacaattattacaagaaagtaccaggcaacattttattgacaatgacgcatatcgatttttgtttaattgtttgttactttgccttagatggaccttgatagtgcttagctctttcttataggacaggaaagatggtttgtcccagtgtaagtttggaatccacaatggcttcactcctagtatacatgttacatttctcagagtgtatatgaaaagcccaattcttttattggtccaacagggtaattggcctgttgtccttaagaaatgacatgctgctacttgggtagtgtagagtactatgttgagccaatctctatatcctatgaggtaaaaggatgaacatttgctcattcataaacacccaaaatgatttaagtctaaaactagagatgaacatggtttttacagggtgaatccagtccttaacaataccggaaaaagagcaatgatgaaacagcaaaaaggaattacagtttatcttgatggaataccactagactagatgaagcaaaccgcggctaccggatatgccttacaacaacacacaattctcatctgctatgtacctcactcgctgtcctgaacaaattcagaggtggattgagcgacaaaagctatcttggggccaggctaatcaagtatatcaaaagaaactacggattattaagactcaatcatttttcttcctttccctctacctcttgagcttaattcttcttatcataaaaaaataatcatgttttgaccatgatgttcatatctcaaagcatatatgacaagcctaattttcctattggtccaaaagggttagtggccccattatcgaaaaaaaacagggttattggcctaggtttattggctgagcaatgcccaattccagaaagacatgctggcgtgctgctgcttgggcagttgggctagtgcagagacaatgttgagccgatttctatattctatattaaaggtaaaatgatgaatttttgctcattgataagtgataacactcaacatgattagatctaaaagtaaagatgaagtgatgaacacatttttttacagggtattgttacagtttgtgttgatggactactactagattagatggagaaaccaaaattatcggatagacactacaatagaagaactctcatctactctttacctcaccgaatctcctcaggaaatcgaaaggtgggaattgagaaacaaacgttgaaacatatcttgatctgaggcacccagcgtctctcaaaaaaaaaaaaaaaactacagattacatcaacaaagaatctttttcttcttccttcctctctctacctcttcttgagcctaattctttcttaccaacaaaaactacgttttgaccatgattaccgactacaactactactacatgattgtgccgcaaccaccaccaccaccgagcagcaaagcagcagatcggcgacagctaccctgtcattagttagatcaggcgggggcctgaacttggcaagagaggagaagaaagcaaagagaggggaggggaggagaggtgagacctcgaatcggatgttcttgaagacgacctcctcgacgttgctgccgatggtgggtgcggcggtgacggcctccccgaggtggagcttgtagagcgtggtggtcttgccggcgttgtcgagccccacgacgacgatcttgtactccttcgccgggaacatcaagaaccacacccgcgacatccacgcccccatcttgtccctcctcctcctcctcctcaaacaaccaagagaacgacgaatctgaatctcgcgccgcggcggctggcggctggtggtggatggatctccgcgggaggaagtggactgcgagtttgggggatcggatcggcgatgggggtggaggaggaagaacaagaggaggtcggatttggaggaggaaaggtgagaagggaattgggtgtggatattcgtgctcgtgtcgtgtgcgaagctttcctctcatagctggccgagggtgaaggcggcgagagggagttgggctgggccttccatgggcttgggctgtggaagtagacatggtgagtgagccgccactaaaagaaataagtctattttgcatccctcagctcttgcccttggtttaatcgcatccctcgaccacaaaaccgggtataatacatccccaaatttcaaaaactagtgcaaattgactccttgggtggtttgggaagtggtttttgttgacgcggcgagttgacttggtctaagtgtgctaacgtggcacctaatcatcaaaggagttgaaaacagaacagggtcctacatgtaagtgacaacagtaaaaaagtattaaaaaaggtgaggcccatttgtgatccccttctcttcttcctcccttctatttctctcgcatcgcccgtgacaactgacaacaagcatgggttgtgggtgcgggagaggatattagcgatgcggcggcaattctccttcctcgtggcggtgaggttctcggcgggataagggatgcccgtgttgtccgcagcggcaaagctgcagaggaaaagaaacgggggcagctgtgcatggggaggtggctgaggagcggcatggaaaggacggaggatagcgagcttgatgtcctctctgcggaatccgacctcgccgaagaccatgctgacgtcggggtcgttgaggacaagccagaagagctcgcgccgactagccgcatgaggtggcggtggcaggccaccatggccggggtggtagtagatcttgtactccccgaatgccgccaccgtcctgctcgctctgtgaggaggatctacgtgtttgagtcggtttttaagcccattcacttttgaaaatacatatccgtatttgattcggtttttaagttcgttcggttttaaaaatacagaaagagttttataagaaatctctttaaacaaactcacatgctaacttgagatgatcggactcctaattacagcttatgattttgtaaaaaaaaaatcattcacccgttgcaacgcacgggctttttttctagttattacaaacttgaaaaatggattaattttgttggagaaaaagaacgagacctaaatatcgaattttgggattgtgccgcaaccgcaaccgcaaccaccgagcagcaaagccgcagatcgacgacagctacctgttaacgaccaaatttggtaagatatgaaccaggttcggcattggagtcgaagcggattcggcaaagagatggattcgaagaacagagtatgaatcggctgcgaaggcatcggctggagtgtgcgtcggctgagatggattggatagaagacaaccgatacagccgatagagatgaagcagccgattccgacggtagtggcttcaaggctgtttctagaatcaatcgacgtgcttcacatggattgccatgatggagataaagctcttacataggcaattatatctattaattaggatatcttatgtaatttcctttgagatatgtttgggcaaaagtctgccgcaaagacttatggtatcttagagtttgttagagataagagtcgtgtccggcaaggacatattttgtatctcgggtataaatatgactcgaaccatgtaatcaaacaacacacgttcaataacaatttcggcgcatcgccacccttttattctatttcgacgagttcttgctttcggattgagctgcatcaattcgatcttcaacaggtaaacttgtcatggcggcttgcgttctcgggattagcgcttccatctttatgacactctaatcttgtttatgtaattcctcgagttatcatatatactatataatctttgttagtttcgttatataacttgtcatcggctggtttttactgttagaaagtagccgatagagttaaatctcgttattgatctagattatatcgtatatctaccatctctcagagattttcatcatcttgtttagatcttacagttattttatatgcttaatgttgcatcggttgagttcgatctattaagttctatctataattgtgatatctagcttgttttatgatcatttatagagatagtatcggagtttcagccgatcttacctgatttagctattctaatatcatatgcttaattgttatgctaaatctgccctttatattaagatcttattgctttaaagttatattaagttcttatttgatatatcttgcttgtttcgatatcttagtatagagtggtatcggagtactagccgatacatgctagatctatctgatcgactatgctataaatatccatacaatctttgctttaacgtatatttcgacttaagtgattcatactgtctcggcatgacgaccgatctatcccaatcacttagattaagtatacatcgaagtaaaaactgtatgttgttaatatctatagccgatcgagtagatttagttttattttatttattaatcattgccgatcgattccaacatgacatcggctcaaagataaatgatatgtcatcggcaactagccgatcggctatcgtttatggatttaaccgcaatttttcttgtctttattcttgttgattgcgggatcaaatcaactggcacgcttatgaacctaaaggtgagattttggacctgcacaggagttaaggagatcttccaggccagtatgtgtttttcgcatcaacactaccctgtacttagataacctgtccttagatagatcaggtggggcctgagcttgccaagagagaagaagaaagcaaagagaggggatgggaggagatgagacctcgaatcggatgttcttgaagatgacctcctcgacattgctgccgatggtggggcggtggtgacggcctccccgaggtggagcttgtagagcgtggtggtcttgccggcgttgtcgagccccatgacgacgatcttgtactccttacatccacgcccccatctcccccatcctcctctctgtctctcctcctcaaacaaccaagaaaacaccgaatctgaatcttgcgccacggcggctggtggctggtggtggatggatctccgcgggaggaagtggactgcgagtttgggggatcggatcggcaatgggggtgaaggaggaagaagaggaggaggaaagggagaagggaattgggtgtggatattcatgcgaagcttcctgtcatggccgaccgagggggatttggcctgggcctcctttgggcttgggttgtggaagtagagacatggtgagtgagccgccgtcactaaactaaaatggaataagtccactaatcgtccctaatctttacgtctagtttaatcacatccctaaaccgcaatacgaatcttcacctttcatctttttcaaaaccgttcgacttaggtccgataccagtatggataggtgtttttgttgatgttgtatcctagttaggaaaaaaacatgcgagactcacatgtagttgagtccatgtgttaatcgggctcacatgtcagggttttcttcttctctcctctattcccatctctcttcccagtctccacctatcccctctttccccatctctctctagggaggtgcaggcgacgaatgccctgggggcgggtgggggggtgttggagagctgcagcggcgaggagttgcgcacctggcatgcatcaccaccaacttatgcatgtgatgtggtttggttgcgccggcgaacttcgcggagcttccttcacctacttgcaaatggcctccccctaaccgaactggatagctacggagcacgccgataataacatttgggtttcatggcaagtggatgaaagtaggatatgatgcacaattcgcttcccagtcaccttccaaatactctggatattcatgacctaatgagcaattgtatgtgcagtgcaaggagctgagaactaactgcaacgcacaaatatatacacctgaatgaactctactattgcaggtgtttcacacacaattcttagaaatcgatagatatagattcttggtttcctcccagtgccaatgacgcctcttaataatctctgcaattttcgtgtcaagaagcagtactacaaccccaggtgcttgatccccgccgtctctctcctcctactcgtcgtcatcctcaccgtctctaatacatacttccccttcccgacaactaagtcgcgaacactgtcttactcttccttctcctcctcccacggtgggcagaaggccgccgacgaggcctgcaacatatttaggggagagtgggttccggatcctgatgcaccttactacaccaacgacacctgctcggtcatccacgagcactatgactgtatgaagtacggaaagccggaccttggcttcgtgcagtggcggtggcatcccgacagttgtgatctcccccgtctcgacccggcgcgcttcctctcctccatgaggggtaagaccttggccttcattggggattcccttgccaggaaccacatgaactccctcatctgtctactgaccagggtaaaaaagtgaaaaacgtgccggatttgctacagtactagcttcgatctgacccgtcgatcgcttgatcggacggtcagaaatgggccagcagcaacaagggtgtgacgttttgttggccggcctgcaggtcgccgagccgacgacgagctggccgagcagcgagcacacggtgtaccactacggcggcggctacaacttcaccgtcctcagcttctgggcgccgttcctggtccggaacgagctcatcgacaccgacaggccggcgcacacgggcctatggaacctctacctcgacgagcccgacgcagtgtgggcgtcgcacgtcccggcgttcgactacgccgtcgtgtcggcgtcgagctggttctaccggccgtcgatgctgtacgaggccggccggctcgtgggctgccaccactgcctcctccccaacgtcaccgacctcacgctgcggtacgcgctccgcatggccacccgcgccgcgctccgcgccgtggtgggcggcggcggcggcgtgaccgccgtgctgcggaccgtgtcgccgtcgcagtacgagggcggggagtggaacaaggacggcaactgcgtccgaacgcggccgtaccggcgcggcgagaagacgctgcagggcgtcgagctcgacttccacacgctgcaggtcaattttttgaatttcctccattgatctagtgatcaattatcttgttctttctaggaacgtgcgttctgagcttcgtaggtggaggagttcgaggcggcgaagagggcggtgaccgcgagcggtggcagcggcggcgcggtgaggatgatgctgatggacacgacggaggcgatgatagtgcgggcggacgcgcacccgagcaggtacagggggtggacgcggcgcaagggatggatgaaggagtacttcaccatctccaacgactgcgtgcactggtgcgtccccggcgccgtcgacgcctggaacgacatgctctcacacatgttgctcacatcgcaaagctagttaggttattgatcaaacgaatgtagcagccaaaaaaacagagaaaaaaacattcattcctgaattcagtctagaatttaaaaatcgtcgtccatgatccatgtgaatttctagcacgtttgcacaagctgaactcaaacattttggtcctgtttgctgcattcgcaaagggtaattgtgattccgtctgtatgggcctaaatcgacctgaggcccaatattgccaaaaatttcagaacaaacttcgtaatcgatttggatactatattgatattttgtgacaaatctggaagaattaggaataatctagccgattcaaaagcagtggttgaactcaagttggctgatctcgacatgcagtcaaaagattatcagacagaaagggagagctgctgctaggttagctcatacaggtggccagtgcccctggtctcaaacaatcacacctgtttagcattttgattctttccatttcgccaagacctagtaataaacaggtggttatctcgtactacacgcgtggaatccaccatcccaagtgtacacttcattttaatttcgtaatcaaatcaatattcgtgacgaaaattgcagaaaaaaattcgatgtatatacagcaatctcatttctcatctcatttcatatccatgagctaagctagctatagtgtggatgttgaccgcccaggtcgatgatgaagtttcacgaggtgatcaagctgccatccattgctcattacggcctacgctatgtgctccccgccgccgccgtcgccgcgtgcgttctggtgctcgccgccgtcagcctaccgggccgcgtgccgctgccgccgctgctggcgccggaggtgacgaagaacacggcggatggcgtgggcggcgaccggtctggttgtgatattttcaagggcgagtgggtgccggacatgtccggcgagccgccgccgtacaccggcgagagctgtccggtgatccatgggcactatgattgcatgcggtacggacggccggatcttgggtacgtccggtggcggtggcggccggacggcgggtgcgagatgcggcggttcgacgcggcgaggttcctcgccgcgatgaggggcaggtcggtggcgttcgtcggggactcgctggcgaggaaccagatgcactcgctggtgtgcctcctgtcgcgcgccgagcggccggcgccgtggacgaacggcagctacgcgtaccgcttcgagcgccacggcctcaccgtcgcggcgttctggtcgccgttcctcgtccgcgccgtcgagacggaccccgacggcccgacggggagcggcgccggcctgtggagcctccacctcgacgagcccgacgccgggtgggcggcgcacgtcggcgcgttcgaccacgtcgtcgtctccgccgggagctggttctaccggccgtcaatgttctacgaccgccgcggccgcctcgtcggctgcaacacctgcctgtccccgaacgtcaccgacctcaccctccgttactccctccggatggcgttccggagcgcgctccgggcggcggcgacggggggcgcgcgccgccgcggcgggcgcgccgcgaggaggacggtgatcgtgcggacgatctcgccgtcgcactacgagaacgggacgtggaacgggcacggggactgcgtccggacgaggccggcgcggcgcggcgagtgggagctgaacgccatggagaaggacatgcaccggatacaggtcgaggagttcgcggcggcggcgaggaagagggggaaaggggcggcgaggatgatgctgatggacgcgacggaggccatggcgcagcggccggacgcccacccgagcaagtacaggctgtggcagccggacaagttcaaggtgtcgcgggactgcgtgcactggtgccttcccggcgccatggacgcctgcaacgacatgctgttccacatgctcatcgggtgatggctgatgccgttcttctcattatggctggtcgatgattatgtgcggtttattcgcgccacgattttaaatgtacgattcgtttctttttcaaaaaaaaaacagcattgtttaaattgcttgggagcctactatatggatcggatgtcttatttttttttaaaaaaaaaatcgttggacagtattgcaccgcactgttgaaaaatgtttcatctctcgataaaattgtttcaatgaaaatgttctaaatgtttcagatatataagagaaaaatagttctacgcttgagcataattgtttcaactaagtactctattcaaacatatcaattgcaacactaagaaatcaatgtatgtaatgttgaatcaaaatggaatgaaacatcttaataaagtgtaacaaaaaaaacacaaataagctgcaacatcactaaaattcccaacaaaacccacctctgacttctattccagccaccagaaccaagttcccggatcgacggagtcgagaaaatacactacttgtaagatgattctataaggtggacaatgaaaatgacatgtgttttcctccttgtgaagtgtagatataccaggagaatttggggggccattgcggactgggtcgcttgccgcaatctaaaccccgtgcaatggaaccaagccactacagtggaggactggtgttagatgatcacaagcacgagagaggcgccaaagcaagctgcacataccctaactcttttgatcaactgagagaaaccaacatatctcctagcatagggagatgtcgtcaagcgggcttatctttaaaattaaggaggtacccaagacgtcgcgtgtcgacgccaactgcctccctagacagatatggggaaagaggggagaggtagatactggagagagatgggaatacatgagtggaggggggagataggaggtagaagaaagccaccaagaaaccaaggaatcagagcaaggcaagaaaaagacaccatcgacactagccatcgtcgccgcgacatcaaaggggggggtactcacaagggggcgccagagctgacgggcagcggtgggggcagtgttggcccctggttttatagcacaggagaccatatatatgtgtacataataacaattccatggaccgatagattgacatacacacaatacatatctggtgcatcacattctgcatagcataagtcttacaatatttaatattacatgggttactcgaatagaccgagtatggttgattacattaaccaagatccaaaagatacggtacggaagtggaagctgatctgcgagtgaatgaaattgaatttggtcgcataacatgtatattttcatcaaaaatctcctgcatacaaatatttaccaacacttgtgataatggttagcaataaacgcctatcgctaagtttggtttttcattttatttagttttttgcaggagttggtggtcaaatttagcacttaagaatcgtcaacaacgtcattgtcatgtaggtgccacatcagccgaaaccgtagtccaaaccgtcttaggatcttatttgcactagacgcgtcatatctagtattgcggctcagggacgaaattcggactcggcgacaaattgagggacctaaaattacttgctaagtttggggccagaaatatcccggcctagctagctatctgttgctcttctttcaatgatatcgcatgtttcatgtcttctcgatcttcatcgagaatgaccaagagagcacgacatcgttgaccgtgaagtctcggtacgagaacgagtactcattttgagttgaagtcgggggctactgtcatggttacggataaagcataccttctatcctacaacttatgaaatatacggatacgatataccttctatcctacgacttatggaatatacggatgcggcataccttcgtatgtacgatagacttccgtatacgataagaaaattgacaagagattatggaaataatcctcacgggcaagtacgtaacagagttctactcagagagggttaggattatactatatcgtgcagggtctggggtctccaagttctacttagagactaaggggattcacggtataaatacataccccccgagaggtccatgggatcgaatcatagcaccagccaacctgccaccacaggagcaatccagaggacttgaagcctactcgcttgtagatctcgtcgagactctctcaacaaggatctcgccggtaatctcggaatcagttgttctctattgtactatgtggatttctatatcaatctcatataagctggattagtgttattacctcacgaggggcctgaaccagtataatacttatctccttgtctgcttgatgtcgaatcgtgtagatcctcgtatcaacgttccccaatacccatattatccggtttacgggtatcccccgttgacaccttctgttgacagaaaatccatcccaaatcatataaattttggatcactggatgtgcttcgcaatttgtgctccagtgcttcttcttcaactctggcgagttcctattcttcttcaacgccggtgacaacctaaactcggttagaggaccaacagattagggtcctaggttggggtggggtgtgaggggtaggagagggagggggaagaagggaaatgttgttgggctaagtgagatggccgtgggaggcggcggcctggagtgggtagcaaggcggcaccggcactttcgaaggcacggggttggtagctggctataggccagtattggtggcaagggcaaagcgaagcaacaagttaggaggtaatgagcggtggaagcgaatccattgacggggagttgctggagacgaggaagacggcggggtagaggtacctcgcagccactgaattgagaacgagtagaagggggggaggggagggggggaagaaggaggaggaggccggccagggggagggtgggaccttgttggtgccactgacgccttctgggcagccggcgaggccaggtggtggtggaagtggtggagttgagaggcatcaagcatcaaacatgcggtgtttgaggggagaaagaaaaagagaaagaaggtaggcttaggtttctgcacggatcttaaagcgatccaacgatccaaaaattgcaagattttgatgggtgtttaatgtcgaatgtgtaacagatagtaaaaaaattaatgatcaaatttaaattttagctgcggttgataaggtaacgagtagtaaatggaacaaatattactcatctcccgtctttgcaacataaagtaatatctatcccgtcttgttagtagagatatgaatcaatgtttgaacttttggtttgaaattaatttccaatatttcatgaattttgaaccccctgcacgaaactatttcgtccaaaatttccaatttcttttgaatttattcaaactttgttaaatacagtcaaaattagttcaaatttaataaaacttttgctcaaaatttcctcccggcgtaagtatacaaaacgaaaattgcaaagcctgaaagaggtctaatcgagtggccgatggcatgcatggtgttggtaggattagtcccatatggagaattcaggtaagttgcgatcaatatttaaacacatatgtttttggactaattattttggtgtactgtagtaggaaaaaaagaatatatgcttttggactaattttttttggtgtactgtagtaggaaaaaaagaaggggaggaggaagggggagaagagggaggaggtattgcatattggggggaggggaatgcggggtgatcgcttggcgcgcattagcagtccccccttcccttccgctatttcaaagtatccgtcttcctccctgtccacatgagctaaacgcttcctcttccctgagtcaaagtcttccctatattactactttgtattatagctgggttcactatgttgcatcatctcacagctaacccgaacatcactaacatcgcaatattctccttccgcgcccttcacatcagctacttccaccacctcccatgtttcaaaggtaaattcgtcgtggtggtgagattatgccttccttccgcctcactaacatcagctactataaaagcccttccttgttgcatcatctcaaggagctgcaagcacttcctctctggcagcacttcctcatctcaaggagttgcaaatgttgcatcatctcaaggagctggcagccgtagccggtatacacatgatcctcatctacctctgccgctttctcctccgccgcagccgcaacgtattattcaccgtttccaacagcctccgttttcgcctcaaggtattaactgtattgttgtacatatgtctctcggtcatgctgttctacctgtttggctccatcatgccgctgccgccgtggggcctcgtggtcggttgggtcatggccctcatcgccgtcgagctcgcctacgccttcatctttccatatagctttcgctacatcgctgacaacgacgacgacaagatggttattctccctgtttaagccttcagggcctatatatatagtatatatataaagccttccatactgtctcttcaataaaggctagcttgtgttgtgagttgtatctgtgtacgtattttgtttggttggttatatattgtcacgtaggtatgccatatatatatgtattgctgtatttatatttgttactatcttttgtttttcagataataaaattcagccagctttgcttgcttcgtcgtacgtgtatgctcatcatatcctcatccatcagctgctcatagctagctgggccgtgttatatgtgtgtagtgaccagtcacaaccatgtatttcatcccatgtatgttagtttgtttttcatttttgaaagaaaacatgcatatatgttataactcaaagttttgagatgaatttgatcatctaatttatttctgttttgaattattctgctctgttgttgcaaacttttttttttatgttgggacactttctcctcggtttgattgttatattgaattcgtcgattccagctagtatatatttgctagtttcactcagacaatcatgcctatttgctgatcaggaacaattgaaaacaaccattacagagccagacgaaattaattaatttacactcaccaattattcatcatcacatctctaaacatcgaattctgggattccatcgttcgtccccttcccgcagccgtcggatcgcggatcgacggtgacagatcgcttcgttgaacgtttttgtaatataccatttcttgaggggggtttatgcaaaatatctctatcccttacctcctcctacctcgccggcgtgacgctctcctccctcactcccatccgccgccggcgaggccctcttcgccgccgtgtcctcctcgtcgtcgctgtatggggcgaggccgcggccagcgaggggctcggtggcggcgcggggggatgggggagcagctcggcgtacgtcggcgacgagattcgagtcaacgacgccgcgccgcctctcccctcaaatctcggtagacgagtatatatgaggattgagaggttccgatcacggcgacggaacgaacccctcccttgttcgccatcgatggcttcctcgacgacagacagggcctccggcctcccactctcccaggtttgcattattcccatccctctgccgtccgtacagaccgtgtgagttcgggttgaagctaagcttcctccaattctgcgtgctcttgcacgaatcctacgaattccagaacctctttgctcaaatccaaggcttaaggcctttttttgttagaattaaacctgtatttccttataatattagttctgtttattcctgtacagaggcaagaaagctcaccagagaagcaagcagacaagctaccaattctgaggtgagtacttactcatctgcgtgttcttaattgaactgaaaagtgcatctagatgtgggttttttttttctgaattcagttaatttaacaaggtttccatatctgacatgatgcaaattttgctcaatgctttccaggtataatttgtagattaatgacctgttggatccatttcagcataacctttaggtatattctaatcctgtatttggtgtttgctaatggattgcagtaaacttttccaactccattattatagataagagagaatgcttgcaatggtgtacatgttgagaacttgatcgatgagtatgtgtcaacggttgaggacgtcaatgaaatcttgatgaagctataattttgatctacaagagcagcagaaagaaattgtcctttctattttgcttttaaaactagggtttctttgcttttcattttcacctctgcatggatgaggatcacaaccaggacctctgcttgagctaccctgtagtcacaaagacctttgtcttgataacaagctgtatttttgttaagatcacatatattagttcttgtatcatgctctctcaatactagttgtttcatgttgtcctaataactgagtcactgccttctcctctaagagattaaaatctgaattgaagtctaccattgctccagcgttattgatagcttgtctaagcttgtttttctttacagggcctttcaaacagaaaagttggcaccaccagtatgaacttgaaaaggttgttctcatgtaatattcacttgtgtcattgaagaatggagcaaggtaaattaaacctcctatttcttctgttgtttggagacctcataaccagctatatttaacttctcgtattgcaataattatgtcagtattagagcatttaaaagatcaatatgctttttggtctattctattctattttttaagtttccactaactgatccgcaaatatacatgctgtcattatcttgtgaatttaccttgttcaaccaaattacagggttgctcatcaaatggcttcaacagctcacggactagcagaattacctttgttgatcttgctggtcctgataatgatgaacttgatggtggcagcaagcactgtacaagagaagaaagataagaagcccctgtcaaaagcttgggtatgtaaatttatacgatggcttgtttgggcagaaatttttatgatgtcatgaaaattcatcactaaaatatcttctatgtttatttttcatgttaatcgggttctctttcttaatatgttaacactacagttaactgctttctttagagaaatatattaaacatctagcaataagaataaaaatatgcagtaaagcagaaaactgacttccacattgttacttcaggaaactcatcaatattctatcagaagcaccagagaccaagaaagatgactccccacaagtaatcctgtttgacgcgtgagctgacgaatacactaggtgttgcattcttagagcatcttcagtaatagctcctattttacagtccctaaaagtacaataggggcttcccccatttcctgagtacctaaaaaatacctttaactccagcagcagtcccttttctcaccccttatttcatttcatcttctattttaacatatactttaaagtactaatatatagttctatactctacgctactcctagtatgaaaccataataatccaaccatatttaaattcacaattcaaaacatcacaattcaaattcgattttttttaaaaaaaataaaatggaaatacatatcctagtagcctgtattcatagctcgggtgaaacgagcttctgctgctatcgcgcttccatggagtttctcacatgtgttgatttttcctgtcttctcatccaccaatagacctgctacttctctcgcgaagcaacaaccaagcaaagcaacaaaaaagctgcatagcacatcgcatgtatcactttccccatctaaaaaaaatgtaaaattccattatctaaaaaaatgtatcactttccccattcttcttttgtcccacaatcgcagctgctagtgctaccctgctactactgtctcaatttcgcagcccgcagcagcacttgaaccatccagtgccttgacgccattgcatgactcggtcactaggccatgtttttcatcgagttcaggcggagggtgcaggctggaggagactccaggcacggcaaacgcgtcggccggggaggagcgtcgggcagaggagggcacctgaaggaggacacggtaggcagggaggagccgcaccggccggggatgagcactgggcaggggaagtgccggcggaccaagaccacgtcaggcggctcccgcgcttttccaaccgtggatgggggctgtgcagtagagcccctgggactgtgggggcttggaaaggttatttgggtgcccacctaatttaggatccttgataggggctctgctggattgaattttttagcctcaacactggggctatattcagggtccctgctggagatgctcttatgttccatttcttcagcaggtattttctgtttatgaccttatgtacttcattatgccatatacgacgacgaggagatgcatgcccctgtttaagctttgagggttggggcctataagtttgggggccccaaaatatcccggcctagttagtggcctgtcacggtagatgggctgggccgggaaattaaagcctcccatacttgtgagttggcttgtgattttttttttttgagaacttgcgagttgtatttgtgtatttgtttgtttggttaatattgtcacgtaggtatgccatatacatgtagcggtgtattcactggtggagaaagcgtttgtagtcccggttcgtaaccctcctttagtcccggtttccaaaccgggactaccaatccaggactaaagatcgctatctttagtcccaggtgaaataaccgggatctttagtcccgtttggtaacaccaaccgggagtaaagatggcttggtgttaccaaccgggactaaagatcaagctgacatttttttttttgcatggccctgttgctgcatggtttatatatatatataaaccatgcatatatatgtttcaatacatatgtacatgcataatatatatgtatttatacatatatatgttatgcaaatatatatatatatatatatatatatatatatatatatatatatatatatatatatatgaccaaaatatatttacattatagaaaatgtgtacacatgcatatagaaacatatgtagtcatgtattaattacaatccattatatgtcctagctagctacgatttcgacgtagtagtagtcgctagctcagaagctaaggacctatgaattgtatttccgtcgtagtagaattcacccttgggatcaaggatttgttcgttgatgaattccataagttgttcttgaaccgccgtgataaattccttgtgtgtggtcaggttatccctcatgcgaataaactatatgaatgtatgaaattgattagtaattaaacaacaaatcgatacgtaatgaaattttgaatttatttgtacgtacatcgagctctcttgtggtgatgatttggtctgcaaggcagtggcaatactcgcacacgtagtagccgcacaagttagttccctgcttttgctttgcgcactacaaataaatgacaaacgacgagagatctaattaatatacacttgtatgtatttgaatcggagaaatataaatgtagagcatgtgtactcacaggaaatttgaacttccgcctaagtctttctctccagttgccgcggaccaaatgacggaaccgataccaagccctacatggagtttaaagctatgattcgtagtagcaattaacataacaagattttcttaattaacagaggaacttatgacagtacctgtctataagttcgaaaaccttgtcaaacgtagactcttttttatccattgagtcatatacgttgacggtgtaggccgccaggtcgaagagtaaaagcacccagtggaatctgcaatgtgcgtgggatgcattacatatgaaactcttagcaagttcgtacgggaatgaaatttggtataggaagacagtaaaattaaactaactatgtgttgtacggcaacagtatgaacgtcttgtaatgctgcgccttcaggagatggacgagattgtccactgtggcttgcggatattggtcgagcattgcgacgtttactttccgagggtcgatgaatccagtatcgaaaaccccctgccgtcgggccctttgaatctccattctacaacgataaaagggagtatatattatatatagtctacttatatacaaggacctaattaattaaaggagacgtagtaagaaatctaactgaacgatatacttacaaaatccagcaactcataatagagacgtcgagggcatccagctggtatagttcgtagattcccttgaaattgatccagagaatgtcatctccttgcaagaagtccgtgtccctgatcctcgctccgatcatctctctaccaatggcgctcatctccatgtacagatgatggaacttgtacatttgtgtgggtagggactgcggcagctcaggcttgacaagcggtttaccgagttcgtacatgtatttcacttcctccttttcgattggtgcgactcctagcaattgatctgtagttaggccggtgtcattaataaattcttccattccaatatcttcaccggtcaccaacggctcgatctcctggtttggttgctctccaagctgagggactggtttggactttccagaagatgctttcttcagcgttcgctcatagtccgatagctttatggcctccttggcaggtgcagacatacccctgaagaagttcctgacactcgggtctataggaatcttcttttctggacttcgatgcttgaattgtctcttgacttctgatgccatgtaagcgtcaagctcctcttgcgtgcaatcgtaccccgggtccttgttcttggcggcatcaactttcgtcttcttcgttgcccttgtgtgggcaggcggtggagcttggggggccgttgactttgaaggtgccggaagaggagcctgaggaggagtcggtgcaggagcctgaggaggagtcggtgcaggagcctgaggtggagacggtgctggagcatgaggaggagacggtgcaggatcctgaggaggagatggcggagccggaggagatggtgcacgagacgccgcttgtcgcccagggaggatgatgtaccgcttgcgccatagaataatggcatggcttgtgtctcgtagatgcgtctcaccgtctcctccagggtaatccagctcgaggtcctcatacgcgccttcgaccaactcaactttgaccttggagtatcctgctggaatcggcctgcagtggtaagtatctgaagggtccgttgggatggatgcccgacgccaccttcatgtagtgagaggttatttattagtaatcaacatatataagcagcaactagcggaatggccaaatctaaaatatataaactacgagcttacctttattgataagttcttgaaaggaatatgcagctcacatggtgtccgctgagtgatgtcatcaacggggcaggtggattcgtcctgggtttgcatggcgtccatgctatgtgatcctacctgccccgttgaggcgcagctgctacagtttcctgacgggctcaccattgcaagaggaatggtcggctggggatcatgggaccgatgtgcggccatgcgttcatcaaccttccttgccacctcctcttgcatgctgagctcgtagctcgataccctgaactctagatctgcaatcttcgcctcggtatctctcttgctcctcatccgactcctgtacgtgtggatgtcctccttgaacccaatcttccaaggaatcacccctttccctcgtgttcgtcctggatgctctggagtctgcagggcgagtgacaaatcgtccctctctctgtctggtcggaacgtgccctgagaagaggcttccactgcgtctgttagtcgacgcgcagagcatatctgatcgccgaagaccagtgagccatcagctgggttgagcgttccaccgtgagcatagtaccagaacttcgatcgttccggccaattagcggtggccggttcgatacccctctcaagtaagctagcctccatctcctcccacttcggcatcgcgacgctatagccgcctaaccccaagtggtgatggtacttcttcttggcggcattttctttgtttctttccatcatcgcctgcccttgttcacctgtcttatatgcaacgaactcgtcccagtgatcccttagctttgggaatgtgtcgaagttcagtgtctgcccctttaggatatatttctggtacagatctcccttgaagctctgaaactgttctgccattttcttcagagtccaccttttcactttgtcctctgtacccgcgggaagggtgaatatctcgagcattgtggtccacagcatctctttctccgaatctgggacaaagctctcatgatctccgcgtgcccttgttctgcgccagtacaccatactgacaggcacgttatcccgcacaacccaaccgctgtgacgtacatagttcttggcggcttctgccggggcactaggtcgttcgtcttcgtccacttccgttatgatgtgccgaccctcaagcttcttcgcggcacctcgttgcccgcatgccctcttctgtccaacggagggttgacttccactagcctcctcctcctggttccactccacatccctttccacgtgcccctcctggttcccctccgcatccctctccacgttcccttcctcgttgaaatactggtttggatcctcgttcccctcttcttcgttccagtactggctgcttccctccgcaattgtatcatacaatatatgttcctcatcgcgatcagccatctgttcatacaggaaacatctgctaagtcatgagacatttatgttttaacaatcttatatgctaacaatcatatgctaagtctaggtgacgtatattataggaccctagctagtcaataattatatactaagtctaattacaaatataataatcttatagtaaaactcaaataatcttatatgctaagactaaaatagtcatgtatgctaagtgtaactgtcgtatattagaaccctaaacaatcttatatgctaagtctaattacaaatctaataatcttatactaaaactcaaatagtgatatatgctaagtctaggtgacgtatattataggaccctagctagtcaataattatatactaagtctaattacaaatataataatcttatattaaaactcaaataatcttatactaaaactcaaatagtcatgtatgctaagtgtaactgtcgtatattagaaccctacacaatcttatatgctaagtctaattacaaatctaataatcttatactaaaactcaaatagtgatatatgctaagtctaggtgacgtatattaaatctaatagtcttaattgcattacaaatataacaatcatatatataattacgtcacttgcatgcgcgaattccttcgagggctagctaccactccggcttgagggacgactccgacaacgtcttttctgcaagatacaaaaagatgtattaggataaatgcgaagtaacatatattgcacttgacgttcacgtttcgttcacgatatcgttcacgttcacgttcgttagttcacgttcgttcacgttcacgttcgttgacgttcgttcacgctcgttagttcacgttcgttcgttctttcacgttcaattctcgttcacgttcgttcgctcgttcacgttctcgttcacgttcgttcgctcggtctcattcacgttcgttcgctcgttctcgttacgttcgttcgctcgttcttgttctcggccacgttcgttcgctcgttcacgttctcggtcacgttctcgttcacggcggtgtggcgg

SEQ ID NO: 20131 - DNA, 2745 bp, Oryza sativa
tcgtcgtggcacggcgtcgtgtcgtgacgaggtcggcgtcggcgtctgcaacgagacagccggcagcaaccgagagggagagacagagatcgagatcggagagagatagctgattagatcgagggaggcggcggcggctctcaccccagagatgcggcagcggaggaggaggcggaggcggcggcgacgacgacgagcgcgagacgacggcgagatacggcagcggcgtcggcgcggggatgccctaggcagtggcggcgaaggagaagccgagagagatcgatcgggcaaaaacttctaagtgttggtggagaagacgagggcgcgcatcgggaatatatatatatacccctagatatctttactcccgttgttcttatcaaccgggactaaagatattttcccgttatttccaaattctttttaaacccggttagggttaagaaccgggactactgataagcgcactgaatattattttccattacatatgtgtttctaaaatagaagataatgcattaaaattatttaaagtacaaagagtaatgacaattacttcgaaaaattattgttgtctgtaataaattaagtggataaaacgtaataagcaaatatatgatttaaaattaataaaaattctaataatcatatatacttagcatatgaatgatattaaattggtaaaaactctaattaacatatgtatatacatacggcatgatttaaaattaataaaaattgtaatcatcatatatacttagcataggaattatattaaatttattgttaaaaactctaattaacatatgtaaatgccacatgcatgatttaaaaattttaaaaattcgaatagtcatatataattagcatatgaatgatagtaaattaattgttaaaaactctaattaacatatgtaaatgccacatgcatgatttaaaacttttaaaagttctctagtcaattataattagcatatgaatgatagtaaattaaatgttaaaaactctaattaacatatgaaattgccaccaacgtgatttaaaacttttaaaaattataagtatcgcatataaccagcatatacatgatttaaacttgttaaaacctctaataatcatgcgtaattaacatatgccatacatcaattgatttatatggataatcaatacatccaaaatagtttacatcgtgtacacaataattacggcaatacatcggcggtgacggttgaccgcacgtactttctcctcactattgttccctccttgtgatcgctacgtgagtaaggggtgtcttcatttgataggaggatgctagggtcaatcgtcaccgtgaaagggggttgcccatccaactgatcgtaattatcgtcagtcttgtcttcaactccgacgatttttcttttgcctgggagaaccacgtgacgcttaggctcgtcaggccctctgcccttctttcctttgctagacatgtccttcacgtaaaagacttgcgttacatcattggcaaggacaaaaggttcgtccgagtatccaaccttgttaaggtcaaccgttgtcatcccactgtcatcaatcattacgcctccaccagtcaacctaacccattggcaccggaacagagggaccttgagagaaccatagtcaagttcccatatgtcctcgatggcaccgtaatacgtaccagttgttccatcatgtcccatggcatcgacacgaacagcgctgttttggttcgtgctcttcatatcttgggctctcgtgtagaatgtgtacccattgatctcatattcctggaatgtcgcgatcgacccagatgatcccctcgccaggaaggcaagttgttagttgatcgactcgttacccatgagatgttgtcgtagccacgcgggaaaagtatcaatgtgatgtcgtgtaatccatgcataggacttaccgatgttcctggcgtgaactagagccaagtgctcttcgatgtaaggagctaccaatgaagattgttgcagaaccatgaaatgggctttacggaataaattgttgtctaccgtcattattgctttccttccgagagttccctttccccgtagtctcccttcatggcgtgattcaggtaccccgattgggcgaaggtcttcgataaattctacgcaaaattcgatgacctcctctgttccataacccttggcgatgcttgactctggacgagcacggttacgaacatacttcttcagaatgcccatgtatctctcgaaaggaaacatgttgtgtaggtacacaggcccgagaatactgatctctttgacaaggtgacaaagcagatgcgtcattatattgaaaaatgaaggtggaaatatcaactcaaaactgacgagacattgcaccacatcattctgaagggcttctaatctatccggatcgatgaccttctgcgaaattacgttcatgaatgcacatagctttgttattgttgcccggacattgtttggaaggataccccttattacaactggtagcagttgtgtcatcaacacgtgacagtcatgagactttaggtttgtgaacttcttctccttcgtgcttattattcgcttgatattcgtggagtatccagacggtacctttatgctttccaagcattccaacatactttccttctttgccttggtaagagtgtagctgggtagactcaagtaatgggttcctttttcctttggttccgggtgaaggtccccgcgttgttccata

SEQ ID NO: 20132 - DNA, 765 bp, Oryza sativa
atactccttctgattattacacttattatatggacaacaaataaaacccctttgcctgttagcttcggccactctcaaaaaatagtgcacgctgttaataaactctttggaccgccggtcagcgtacatccattgccgatccatctacatgagtcgaaaaaaaatcgtacacaaataattattcttacaataatgacagtcatacaataattataagataattacaaactctttcaacagtcatacaataatgacatatctttattcatacaaaaatcataaaatattacaccaaataattcttatttactatttctaaagttttaaactaattttaatgtgttttacttcttttaattttcattttagtttgttttctattatttaagattaactttcactatattttccttctcaactattttataaaaccttctttagcaaatcaactaaatttctatatattctttcttccccacacaaattttctctctcatcaacttacaactaaattttggagacaaaaaagtgtgcaaaacatagttgcaaatgtaatatgacaaaaaaaatattggaggatgaagttgcaaaccttttaggcacctccgatttgtatgtaatcaccaaaataaattcactagaaattttggcatgacctcccctcttttttgaagaaattttgaagcttgctcgggcagctggaggaggaagaagacatatatatatatatatatatatatatatatatatatataggggtgggac

SEQ ID NO: 20133 - DNA, 2141 bp, Oryza sativa
caatgggtaagatcatctcccatattttgcatgcgatccgccgatccccagccctgcagaacggcagaaccttcctggtattcaatcctgctgaccccccacctttgtcctggatttcttgagacagttaattaattctaacaggggctttagcagtttgcaacttgatctcgtctgcatccggcctgcaagttctaattcatatgaattcatgcaattagatttgtttaaaataaaagttcatctcttctagcaaattaaatgatcaaaatagttgcatggtcttactggtatatatatagatagtttcacgcacttccaggaactctgtaaaagatattattgtttttgtttatttcacaactatttaaagaaacctgatagattttcttatgtatttctaggtgaaatgagaattttaacctagctgattgaatatatatcttttcactgcttatgagtcgaaaaaatggcattacagttcaaccatttggcaaaaaatagatgataacataaatattgctgctcaggattactagaatgtcatattgtgataataatgctgaaatttcttacattaatgaagtaagtagtgcgcctattggttggctgcttttgcctgactttcctgaaaaatactgatacgaacttctggataattctgatattgatatcatgatatgtctgcactaccaaagtacctacttcaattcctgatgagagtgcacactaattttgaggaaacgattgcaggtccaactataactatctgattatttgttaaatgcattatcataactggttagtcttttgaatatttttttgacagttcaattcagatatccagatcaacttgattcagggttgggcatgcaatgatggtcctaggattacccgaaggtatttattgttagcaagttttgattgctcttggagaaatggataattttgattagtcatgaatctttactgatttgtattaaaaaaaaactttacaactgtatgacatacattacaatgtttttgtaccgatataatttagcaatcacattacatctcattttttttgttcaaattaaaatttagctatgtttggagttgtgttggatccagttttttttaactaaattatattgttgtaccaacatgcaggacggggataggcgtttgcttgctaagccaatcaagtacttttatgagatgcaagagcttttctcaggcagtaatgccaatggctctcttgccatagaccagcaaacatgctacaacattgatagaaaatttgatagcagtgaccatgaaggcttgaatgatatgtccacctatgcacatcctatcaacattgctaaagaagactctgacacgttaccgtcgccaacttgtcctgataatttttctccaggaacatctcgagttagtaaaaagagaccaagagatgtaaagtccccaagtaaaaggcagccaaagcctaagagtcgtttcacagatgtcactgagaaaattggcaatacaatggaccgtttggtgaaccagcttgctagtcctcctccacccccaatgccacaacttcgtgacccttatgctacaatgtggaagaggatggatgcattacccattggttccaaagataaggttgttgttggaaattatttgggacgccaggagaaagagggggtgcgaggatttcttgctgcttcttgtgacacaactttggagacaggtgtaccatttcatgtgcgaccgagatggtgtgtaggttaaatggatctaactgccagcattcgagtatgttgctgaccttttgctaagttgcaatagatgtactaatcagttatattggaaccttatgaaatatcttaggtccgaacaagtagttacttttgggaaaggattagattagatatgggcaaactaattagcttatattgaaatgatgcatgtgaatatgttaggttcaagctgggagctacgtttggttattagaacaactatcactatacagcaatgatgcaaaagtatggaccttatgctctgaatgtgttatgaaaatttctctagtgactgagtattcctcttcacctatgatatttttatttatgctaatgatgtggttttctatgtacatttgtgtctgagtattg

SEQ ID NO: 20134 - DNA, 14026 bp, Oryza sativa
ggggtggtaattctcaccatctaattgattgggggtaaccatattcaactttggcaccaaccaaacagctactattttgccacaaagttaggcatgtcatgtggtagtcatccaaacaatacccttaacaaatttgccacacttttgtttatcaagtatcaaccaaacaactctattttgccacaaagttaggcatgccacaatatcagcaaacatctaaccttaagcatggcaaccttagtcactaaccaaacaaccacaaaattagtatgctttctgtagcatcgtatcaaaccttattaaaactaggaaggtagcccgcgcatatgcgcgggcatcatatttaactgtgttagaaatttgattaggaatatttatgattactctattgtaaatatctttaatttttcaataatttgtgtggtgtttctctgaatgctagtaaccatcgccgacgtataaattgtaaactaaaattacttaaaacaatgcagttttggttttataagaaaaaatatatatgaaactatatatcatttgtacataatgtgtttcttttttaatattaagcataacttaattttgtactttctaaactctgagtaacaattttcttttgtataatatatatgtctttatgaattttaggatatattaattgaagatattttctattaaaaatatgcctaatacgactacatataattatgagctgaatatgttgaaatattgatttagttgtatgtatatagtattgcctacatataattatgagctgaatatgttgaaatattgatttagttgtatgtatatagtattgcctacatataattatgagctgaatatgttgaaatattgatttagttgtatgtatatagtattgcagtatgaaactaacagtttagcggtaaatgtttttctcaatgagaaaatatattagaaaataagacttttatcgctcccaagttgtagtttagggttgtatactttgaactgaaattatgttagattttgtttccaacataatacagaaaaattcaaattttctattatattttatttaaaattttagttattttctttatttcagtactccaaaaatattaaaacattgctatttaggatgggtatcaatttttttaaaaaaaatgttaaatttaggaaaaaaaattcagtcttcaattatttttatcatgttatttttttatagatttccattccatcaagcatctcttaaatattttgatctctgcaatctagaatggaaatataagtgggttaaggctatacaacttggcatgagataaaggtatcccttaaatgttttcaatgtgttgtatatgacaaatagatcctagacggggtacacgttatgacatgaaaaaatgatataattacaagctttttctctaatctattagtgacatcagatatcatatgtataatttagatattatgatcatattaggaacgtttatttatctctaaaaagatcatttatttataaaagtgcatctaattatgatcaagtataagtaaatagcccctatatgcatgttaagagaaattaactacttccactgttgaggaaaaatatatcaatatttactacaccaaattatttttattgaattcaaaattgaatatgtttttataatatgattgttttgtgttgaaaatattactgtgttttttataaactaattcaagtaatttcacattgacaaaatttaaaatgacttataatctgaaatagaaggagttggaagaaggtgattagatgtctagcatggtataaataatgggttaaccgtttatgaaaaacataaggtgatatattttaattttttaatgagaaagtttagtattctattttatttattggaggcttaaagatggatagatatggtccacaatgtaagtcaatacagatattaaattattgatttaattgaaaattacaatagtgtagaaatatcataaatgaatatatgatttaaaattttatgagtgttttaaagtctagtttacgttgtttctataagtgctagcttgaggagaaagagaagaaaagcacatgacacaggggaaactggttagacttgttaggcggaatccatttgtgggagttttttttatcacaaagataatgttggatttagtttctatggaggtaaagaaagaacagagaaggaatggtagggagagaggaatcggaggaatgggaggaacgggagggggttttgggattttcttttaaagatagatctaaccatataaaatagtggatccatccatttaagtggaaagcgatggttagatgttttattttcatttgtcatacttatagatttttctaatgtattagactgttacgtggcgagatcaacttagaagtgtttatgggcgtaccattaggccctgacatttgtagttagaacggcaacacgatctaattttttagataagaaaatatgagtaatatggattttgaattttatatttaattataaataacacaacaattgacaaaaactaagaataaaattataacttgagagtcgtgatcatttagatgtccgaattttttttgatatattgagtgttaatgagaaaataggataagttagctagaaaataggagaggatgggagattcggaggatggaaggagtacgtgctacctttttttaccttatgtacgtaaggtgttggtggtggggataccagatttattttctttgcattggagatctaattgttaaaattaacgggtccaccattttaaaagaaaatcgacggtgtgattatagaataccacgtggtgatttaagagcgtttgtagaaggtcatatggcggcttgagagtatttattggaagtttaattaacttttagtatataagtcccttaaattttttagaaacgctagtaagctgtcacgtgacactcatataaaagcttgtaggtcaccacatgtcatatctctcaattaaaagaattattaaaaaacataagaaaaagaaaaagaaatctaactgtgaattttcacttaaatcggtaagatgtggttttatatatctattaacactacctcctaagctcccctagtgtacgtacgatgtgcggagtagtagtactgttttcagaaggtgtaaaggaaaagtactgtttgcaaaaaaaaaaggaaaaaaaacaatactaacgtggagtacgtatgtatgccgccggaaaaaaaaaagaaaaaaataatagtaacgttccctgccgatccagacctcttgtctacggtgttatcctctttgtttttctatatattattagttagagcaaatatggcaattttttttaaaaaaaagtagggacgccagatttattttttttaatggagatctaatggttaaaattaatgggtccaccgatttaaaagaaaatcgacggtgagattatagaatgccacgtggcgacttaggagcgtttgtaggaagtttcatggatttttagtatataatagatagatattagggaaagcttaatggcactgggcacgctcgtggtggtgattaattgactgctgatgaggacgaatgaatgatgagggaggtgttgttataaagatagatacacaacaaagaaacaaaattttacccagaaaacccttatagaaagaaaaaaactacgtccgttgacatgcgattactattatggagttattacaaacacagagggtacaacggattgttgcacccttcctgtgctggttacataagtatataaagcgggaaaaatacaagagttataatagggaaagactcgaaatagtaataatagaaaacaatccaaatatatattgctagctgaaattcaaataatatatttaaccgccatagtggcctccgactacgtccatgtggaggagatagggagagaaagagagaggagagaggggagaggggagaggggatcttggaagagggaggaagaagatagctaggggatgacatgtggccatattcgcagtatccatggtggattcaatctgtctaggtccatggtggattcacatgcagcgtcctggagtggagaaaacagaaagggacactttcaatattctttacagatttcgtcgccatgtcgtcagctccaatattctctcttcgtggccctttacgtcggtcaaacacccttttctttcagcgcctttagaaaaagtgaagcgcatagatgcttttacgcctatatgaactcaccaaattgggcttgaagaatcattcggcatcgagaccgggctagctagctagcttagttttggcggcgagcttaattagctaggaactaaatggagctcatcaccgcgtgcgcgcttctcctcatcgccgtccatattgcgattgtcatctcctgcccggagccactcgcggccgttgcattagtcgacgtgcccctcctctacctctgccgctacctcctcatcatacgccgcggtgtgatcatcgtctccggcgccggcgccggcggcggcaggttgcgccgcttccgcctcggggcagccatggcgatcatctacatggccatgtcgaccctcttcttcctccgcattgctcctctcacgccatggtggggcgccctcgccgcctgggtcatgatcctgctcatcgtcgaggccatcttcgccttcttcttcccctaccgctgctgcttcaacgaaaccgaaggcgatgtccagaataatccccatgtctgagagagagagaggaaagcttttgaattatgatacgcatatcgtatgtcactctcgcgctcatcagatggtacatgcgatatcaaactcgatctactttctcaaataaacttacctagctagtagtagctgcgtcccgtgtatccgttcgtgtatgttagacttaatcttgttgtttagattttgtgtgtgtgctagttatatgcatgtacatgtgagtgcgttgagtcagtttgatatgcatgctagtgaatgcatgcaaaaggtcctagtttacaggtgcacgttggcctggagttgtggtagccgagtcaattagctggagctgtctcatggatggtggatggattagctccatgcatgtgtgttagttaccaggtgatgctctacatgcaaggagatgagggctgcatgcatggacagaagtggttaattagtggctaagtcaggtgagtggtggccggttagtgccgcaaaaacgtggctagtgagctgctgaacgtgtgtgctatttcaagcgtgtaatcagtgtgtgattaagtgtgtggagaatataaagtgaagtgtgtggtggttcgctggtgtgcagcgacaagaaactgtgtattgttcatcttctttgtgtgtgtttcatcgagtgaaagggagagagctgtgtgtgtgcaagtgagtggctgggccaacagtgtagcggtgtgtaagtgcagtaatcagctgttgggtacaatgtaagtttaagtttgcacgtctttcaattcattttgagatgaaaatgcatactaattcccattttggactacaatgttctgtgtgtttcgcacacatcccgcgggccgttaccccaccttgtctgccgctcacgaactggattttttactttgaaatcggttttaaaaacttattttacaataaatagatcctgaaaaatacttatttcagatatagactacttggcatcaatatcattgatgccgtggaccaatctgatgacgtcaatggcactgacgctgaggatctatttgtaacaaaaattaaaataaatctatttgtaataaaatatatatatttataaataggtccttgaagccaacaacacttacgccgaggaactatttctaaatattttattttgacaaataagttgtttttatttcttttaattacaaataggtcttttctagttttttttccaaaaaggttattggcgacgctgtcgccttttacatcagggacttagctttcgatgagagacgaggaggacgacgccaatgttattggtgctattagattggatcatgacgccaatgttattggtgctattagattggatcatgttgccaatgacaaattttcaatggcatggataggtttgccgtggtaagagatgcagaggagttggcctggacacggcggtcggacgccttcgtctcaatcaacgcaaaccacggaaatactctggcaagttcagttgaagtccgtggtctacacttgtaagtctggatccacgagcgctgcaccgcctacatggagcgggtgcagatgtggagctcctgttcactggcttggacaaccaatggcgtggcggccaaccgttaacagccaaccatccttgatgcggcgtcgatctacacgcttatcggtagggagttggccgtatgacgacgacgatggtgggagggaggcagctaactatagtgcgatgccctcctccctactcccgcccgcaccctgcctcctggcctagtgaggatggggaatagaggggagagggggagagagagaggaggaaagagttggttgttcacatgtggggccagtgtagatcccacgctgacttagcgcagctactgcagtcaaagcgtcacgtcggatgaaaccggaagctatactaccttgggatggaagctgatacagtcttgcaagttcggagacgagttatacctggtacggcggtgaagggatgagacaccaaaagtaaacttactctaaaattgatcaaacgggatggattccaggcccaagtacaggacggcccaaatcagtcggcccggcccacgtacggaaccaacggtctagaatcactcgaccgaaaaacgccaggtgtcagccccacgagctcccccacgttccactcgcgcgcctccacgtcagcacccactgtgggccccacaccccccacgctttccatctcctccacactcttcttcttcttctacctctccactccctccccccaacactcgcctccactccacctcgaaacccacaaaaatggcgtcgcccacccacgccgcctacctcgcccccaccgcccctccccgccatctccacctcctcctccgcctccgcctcggcggccgccccgccgtctcaacctgcgtccgcgccaccgcccgcgggggggatggcgggtcgtcgtacctggacatgtggaagaaggccgtggagagggagcgccgctcggcggagatcgcgcaccgcctccagcaatcctcctccgccgccgccgccgccgtgaaggaggaggagggagaggggaaggctgcggcggcggcgggggacgtggagaggaggacggcgcggttcgaggagatgctgcgggtgccgcgcgaggagcgggaccgcgtccagcggcggcaggtcatcgaccgcgccgccgcggcgctggcggcggcgcgcgccgtgctcaaggacccgccgcccccgcctcccccgtccccgccttccacgccgccgcaggagcgggaacagcagcagaagccggcggcgaccgcgatccaggccggatcagagagtggcctggtttcccgtacggctccgggggagtcggatcgggcatccccgccgccgccggtgacggagacggcgaccgaggcggcgaaaggtatggggtgattggtgcacgtgaggttgcttaaagatcacaagtactctttcttgtgaacgcattatcttttcgatttcttttttactagctttttgaccgtggctaacatgataattgagctaaaaaggacaactcctttttaatctgacagaatgtatgaaactaacaatccaaccataaatcccttcctgaggaatagttgaaaaactgggaatctatttttaatcttttttatgtgtataatagaagtgtttgatttatgtcaacaaaaaaaagtgtttgattcgattgataggtgaatggatttagggaacttgttagatatttatggaaaattttgattgtgtgcactgccatttttgtctcgccattggcaatagaaattgtagctgtgcagataacacacaggtgcctgcagtattggcatcttgttttgttatccatgcatatttcttcatttatctgggtatcaaacatgaatttattgtcgaagtgcgatgctgattccaccaaatgacttactcccgctgtccaataaatgtagctaaaagtagcataaatgcaccaaaataacacctgtagacattaagcatatagaaaaaaaattatcagcatttctattagttgcaagttgcatctgcatttttttttcagacatacatgtattcttatgcgggatacacaattaactgcagtattttagttagtaaggtattgtaaaaccatgctgttcttaatctgcaatctgacattagcaatcagtttcagtgccggactctggtgattcatctcctttcaagaagtcaagttccaagctcggtactccaggcccggacttctggtcgtggttaccacctgtggaaaatagcactaaactaggagaaatcgacactgggttaaaaccatctgagaaattagactccttcgccggtcagcctgatctgctgatggaaaaggaacagtcagaagacattttatcgctcccgttcgaaacctctttcttcaagaaggaagaccgatctcttcctcccttccagtcgtttgctgagcctgaaaatgtggaatccgagcccagtattactgctgatgcagaggagacattcgaagatcagttttcgaaaaacgcagctgaggcagctagagctcttagtgcaagcgacgagaagtcatcacatggggtgcgtccagatggttcattgtggtggaaggagacaggtgtagaacaaaggcctgatggtgtaacttgcaagtggaccgtgattaggggagttagtgctgatggagctgttgaatgggaggacaagtattgggaggcttcagaccggtttgatcacaaagagctaggttctgagaagtctggtcgtgatgctacagggaatgtttggcgggaatactggaaagagtctatgtggcaggtaaattgctgtctcatttggtacaatacaaccatttgttccttgttcatgaaacctacaggttacaatgttacatcataagcattaaattatggctattgtttctattgaaataagattatctggcttgagtgatgcagtcatgtgtagagagatgtgtctcactgtcatgcgttgatttactgaagtatttctgttccgacaatactgatttactaaacttcagatgtaatatgatttgtactgaatgatcgccccattactcgttagaacataactgagtactgcattttttttttaatatttgcaggatttcacatgtggtgttatgcacatggagaagacggcagacaagtggggacagaatggtaaaggggagcagtggcaagagcagtggtgggagcattacgattcaagcggtaaagctgagaaatgggctgataaatggtgcagcttggatccaaatacaccactagatgttggtcacgctcatgtttggcatgaaaggtaagagctgctaaaatagcttctttcagaatgctttctgtccgtactcttatcttgcttttgtccgtagtcatatcacattcaagaaccaacatttcctcttgttaaaagaaatgaaaagagcaaatatttcagcaatcagattgtttgcaacatacatcatttatgctagtactgttgtaacatacgacagcttagtcatatcaatcaactcaatacatttctggctcatcctctacaggtggggcgagaagtatgatggctgcggaggtagtgcaaaatacactgacaaatgggctgaacgatcagagggtgacgggtggtcaaagtggggcgataagtgggatgagcatttcgacccgaatggccatggagtgaagcaaggggagacctggtgggcaggcaagtacggggatcgctggaatcgcacctggggcgagcatcacaactgtactggttgggtgcacaagtatggcaggagcagcagcggtgagcactgggacacacacgttccccaggacacctggtatgagcgttttccgcactttggcttcgagcactgcttcaacaactcggtgcagctccggtctgtgaagaggcagactccaaaaaacactaagcctgaaaaagattagatatttagaatagaatctactcaattgctatcataaaaaatagttggctacatggccatctttcatttttgatcttgctgaagagcccatgcttgtaaaataagattgaatggctgatttcagttgtccggttttatgccaatacctgtaccgagctatgttatcaaaagttcatatgctactatgcaatagaaaggttccttcttttagtttcaggaattgctcccctttgagattgtttgaatagaaaggaattttacagggatttgaattcaaattttatttcaaatcctaacagccactgaacctaatgccaaatttgctcctgaaatgcaactgattaacagttttacatgtgccatcctgccacgcaagcgcgtaggacatcgtcagtgcaggtgacacagtcacgtttcttcatacaaaaatataattctggagaagtgcttccatgttcttcaaaattaaaaaatgagacgaccagaatccacaaagataatgggccaaacaaagagaagcttatgccactgtcagataggttattgtgcaatggaattgcaattagccgaacctataaaccagtcgacatccgacgcccgttgacattctgctcttcatggcaaaaaattggcaaacatgactttgcaatctggtgatctgtagcaaatgagcctaaaagaaaacagaagtgaaataaactaggtttgactaatgaaggttgagatataattaaaccccaatttagtacaaaacgaatatgcacatattctctcacccctgatccctcttctctgacgagaattcttcaagctcctccatgcctcacacttcatgccatcaaaaggcaaaaacaagcaagaaacatctcctgctactatatatctcctacacatctacgacaagaaagtttcacacataccatcgatcgaattcaaggcttgaattcgaaagttcatggagagccatctcaacgagcagcagatctccgatttccgagacgccttctcgctgttcgacaagaacaatgacggtatgtttttcatgtttcctcctctaattttgcattgcaatgcgtttttacatcctaaaattcaggtttctccgtgacaacactgaattccatggactctgcagctgaatgcctctgaatgtagcagcacaaccagtttatgtaatgtctgggtctggacttgattgcaaagtttttcttacttcatattgtgaatgcatgggcttgaatacttgatctgcagttaattgtacatatatttttggatatcattttgttctttttccacttagtctgactctgaagaatgatgaaatgatctgcactgaaaaatctgtaacctgaaacggttgtatgtctgatgttaggttgcataagtagggaggagctggccaccgtgctcacacgcctgggcatggcgccaagccaggaggatctgcaagacatgatcgtggccgtcgatgaggatggcaatggcacgatcgagttcgacgagttcctcgcaataatgaagaagaaactatatgtaaaatgcaactgaaacatgaagaattaaattacaagtatcttttttatgatcttgcctgtaaatagctgggaaaattgaagttcttcttttcattttaaattcaggagaatgacaagggtgatgatgaggaagaactgaggaaggctttcaggattttcgacaaggatgataatggattcatatcacgcaatgaggtatggtttttgcgcaattttatcagcttgcgaattggaatttgtagctaagaaattggtcgattcatgtccatagttaagcatggtgatggctagtcttggagaggagatgacagaagatgagattgatgatatgatgaaggcagctgatagcaacaacgacgggcaagttgattacgaagagttcaagcgagtcatgatgagcacgtaaacgatttttgattctcttcagccagaaattgtatctggaatcattttggatgccatttgatttcatgggagtgtgagaggcaaagttgtggtatgcctaatttttcatgtagtgtgtgcagtgtgctatttgtttgttgaattgggaaaattggttacatcatgccatgtttcatcagttttggtgcagtattatgctgtgtgactgatgactcttccatcatatcatgaacagatggaatatcacagaaatattcaaacctcatgtaacaatctggcgttacaagccatgattgaacaaggaataatgttgtattgcataattatattattacctccgtcccaaaataaatacagccgtagaaatccgtgtccaacgtttgaccgtccgttttatttgaaaattttatgaattttttttaaaaaaatagtcacacataaagttctattcatgttttatcatctaataacaataaaaatagtaatcataaaaaaaattcaaataagacgaacggtgaaacgttggatatgaatagtgtaaaattgcacttattttgggatgggatggagggagtagaaaaaaattatgtatacaatctttgttcttccaaagagactaagcacacaattcaacacagctgaaagttgtaacattcttcttcatttcggttgagcatataatctgtacagctgattctgatccttacatagcctgcatctacctatattgctgcgtacaactatttttcatgtggtattcacaacagctggtaagacaatcgggttggcatctacaaatgattcaccaattccttcgatcgaactcaccaagcaaatgtacactcagcagtaaaatttggaggacttgttataggtcacgagtacgttagatttttatcatgtgtcggttacggtggctcctgaaagtaaggatgagctaatacttcatcgacacttaggcggtcctcctacaagacaagggtaagtatatgttaagagatggaaccacatcaatgaataaagtggtcataaaatagaactgcaaggcatgggctggcctgatagtggcattaacataattattttcaagtttagcaggatgcaaataacagaaacagtaggcagtagcttgtgtgtagttctcatcggtgcattccgtgaaatgggtgctcttaattccattgtcatcttcatatttcaaggagaagcataataaatacaatgcattatgcccacagtttagtatctttatgtacaatgtttcaggtcatagttttatctagagatgcacaggaagagttgaactttcccgacagaaatgattcagaactgtggtggttttcacaattgtatctccactcttgtgtgcttctagaatgtaagatattattctgccgcacttgtacttataaattcttcaaaaaatatacagggtgcaagcataccatttttctttacagattggggttcaagaaacttacaggatgccatattagtaactggcgtgctagtcgcaatgcccatatattaggaaagctggagtgcaacagcaagcataaaaatattagatacaaagatgaaaataatctggactgtaaaagacgtggacaacaaacgacaatacccaccccattttaagaggatctctgatcttcacttgatgcgcaaatgattcttcagagcatttccaagaagccggccgaaactgaccctaaaacaaagagaaagaaatcattgttagcaacaatctcctggaagcttattctacattaaagaaataacaacggcatatccaatgagtttcctttcaagcctcaaagcaaggatgtatagttactatgtactacctccatttctggttataagacttttgactttggttaaagtcaaactactctaag

SEQ ID NO: 20135 - DNA, 6931 bp, Oryza sativa
caaatgaaactagagtcatgcaccaaatatcttgtttcagaacagcatattgaacaatgcagagtagacttttacatgcaacccatagattgtcactttgtcagacagtaagtaaattgaaagccccacactgcatccattacttaagctgggtttaaatccttcatcaagcagggggtagaaccctcttaaaacaatgttttctttccaccatcaaacatgtcaatcagagagggaaaccattgaagttgattaataaagatgttttctctccaccatcaaacatgcccaccagggagggaaaccgttgaaattggttaagaacctaattttacaatgaaagaaatggctttgtgcaaagtttttaaaatagtgaaccaaaaattgtatttaagtttaaatatctggaatattctacaattcacatgcttcagttttgaactagcattgctgtgcaagtagccaagaatccagcacagagtactactaaggctgtgttcgctgctgctcgttcccagcaggaacagtgcacatggaaaacggaacggtccattagcgcgtgattaattaagtattagctatttttttcaaaaatggatcaatatgattttttaagcaactttcgtatagaaacattttgcaaaaaacgcaccgtttagcagtttgaaaagcgtgcgcgcgagaaacgagggaggggttgggaacctggagatccgaacacagcctaaatcttaaaaatgaatttggtactaaaagaacttttagagacacagcagttcaccctaattagtaattggtcctctaggaggaaaactgaagactaaagaggcatcaaattcaaaatgcaggaaataagacagattctatattcaataattcgagcacaaaatacccaaaatgtatgctctaaccaaatggtaaaaggaagaaaaggaaggaatatgatcacacaccgagtaggccctgaatcataaagatgcttcaatgtgaaatcatcaaaggcactgccaaaagtcaataagacgcctgcatacacaacgaaacattttgagaagtgcaatgcaacatcattcttacattattaggtgggtaaacacgactacagcatgccaaacatgcttctgtaggtcacaaattcacctaacaagagcatgccactcaagtgtagcaagtcatgtactgatgtgtaatccaatttcccttttatgtatcagctctaaccatcattttggttaataaatgataataaagacaaaataaagaatttctaggaaatgttcttcactaaatgcattgaataatggagatcccaaggaaaagaattctatgctgagactgataaaattttagccagatgcatgagtgtgaaatttctctaaatagttggtcaaagagccattcagccaacagcaaacctagataaagtacatgtgaagtcaatttcctaaaactattgtactgcagattatatgtcaaacacctaggttcatttcgatatattataaggcactctgcaaacattctgtgggatcaatcaatcccacacctgcatatgcgcctctgccactgaggccaactatataaccataataaaattttgctaatcgaaccatttagaatcatgaaacctccaagtaaaataaacaacaaatagataaagtttttgcaacatctcagtaaaggaaaaatataattccttacatgttcagtttgttgtgttttgcttccgacggaatctctctcaaacactttcctgtctccagatcctcaaagcagattatcatgttctcttgcatggcatacaatgaattatgtcagcatgcctagttgacaaaagttatttctggaacaaatgaagacaagaaatgatttaactagtatgaatataactagagaatagaagtctatagcttttgtaccaggtttaatatccctgtgagtgatattacgatcatgacaagctttcagacccatcagctaaaagaagaaaggaaaaaaacagatgttagtatgtttaaccatgtaatataattaacaggttagccatctcacagattatttgtttcttttttttttgaatttgacaagagccacacacacaaaggtgggggagaaattagtatacacaggctaacaataaaataaagcgacaactttgatgtacttgagaagcatctagaatggtctatggaggcatggtgtttaatttacagtactataaagaatggtgtaaacataccagctgccataagagattttgcatttgcttttgcccagctttcgttgtccttaaccaataccaccactttgatggttgaagaacttgaatatgcctgaccctctcattattgttaccggtaactaactttgtttcttcagctgtatatatcagcttcgataatgagcggccttcattacggtacacaagccatagttccttcaattctgattcaaaagattctataaacctagcaatgtgctttagtggttcttcagtaaatgacatgttattttctgcaaagatatgaggattaagttgactgtccaccgaaaaggctgtggatgactctgcccttgacaaagcttcaagagttcttgaagcatttgaaaatagttccccaaaatatttttcccgcaatccactcaagtaagcagcacgtcctctctccacctgcagtttccaagattgaaataatcaagtcaaagataaggaaataacacttatgtgttgcttagaaaactcaagttacttttagatgtttaaaataacatgcatttaaattacattagaagtttagaaccatctaatcattgtagtagacaaactggagattgtcgatacatgatggagaaactgaccatagcaactatgtctgatgcaagttcaggagattagtgacagctaccatctgccacaatgtgaacccacagcccatggtagtttactagttcatagaatcataaattcatctggtagaacaaaacagttttacctctaatactaattacttggtgccaggaaaaaaatacaaagattgctacacgatggcaggtaattcatcaggaaaagatatttgacttaccattatgcgctttaatatgaataaatcaccatctattgtgtctgaatcatggttttcatcaggcaaagttgtgtttgagcttgtgcaattgtatgagtctggtttaagtatagtgttaaagtgtgaatgatctttatgtacgtctacatcctcagagcagttccaatgaaatgccaaccagacttcaccatatgacccacggtcaaatcttttcttcagcttgtacctgaatatggtcaacaatagcaaaacagtcaaatatgtgcatacatgtccatacataagtattcctttagccaatgcaatatatactactcgagttttgacgtagagaatacttacgcacattttaagaaaaatgatttcagaggaccaaatgaatcaaatcatggctcacctcaacttttcacggtctttgtacctaaccagactaataaaagtttgccatatgaagtcatcttcataaatggccttttaatttaggttgtgcttattcttcattttactcgaaaatagatctttaatgaaaagaaaccaaggtaaagttttgagctctgctcctttatctggataaagggttacagtaccattttttgttctgagaaggcatcattaggctagaattgtttttaagggaaaattgacacaagaaaaaaaatgaacagataacttcgaggggtgaaagtttgattggcgtgttaccaataaggtaggtattcaatcagtgtgaagtttggttggcaagttatcaacttaagttggtgcgagatctgttttgaaatgaattaagcataaaatctacaggcggatctacagatgatctgaaggtacaaagctacttgagatatgaatggtacctaaaatcagatatcttgtagccaaatgaatgtgaactatgcggtttgcttccattatgtgaaacagagtcaagcaatccaaagaaatttgcaaaagcttcaggactatgacaccgtcccatttcaccatcttgatgaccaaggtaccaacaaaaatctctgtccttgtatttatcaagatttcctgtatccatatgtaaaaagaagacaaaaattgatggcatgagcatgatagggaacactaacgaccactaagcattaaatcagaaatccacagctctctcaagtactaatatgacaatggaactcaaaaccatgggtaaacaacctaatgtataagatacatgcatagaaatgtgaatgatccttttctccaccatttcaatcagaggttaatatatactatcgaattttgaataccaaaagtttaagacaggatggtaagtcactgaaacaggattacacctaccaacaagctaacccctgaaggaaagaaacaatggcacttattattgaaaagatcccacccatgtagatgctaacagaaaatttaccatcagaaaataagacagtttcaactagcgagtgatcgaagtcattgactccttcatgctgataggcttctggtactctaaatatatagtccatatcttcatcaagactctcagataagtagaaacagcccagtctcttcatttttgcttcaacctaatttcagatgaagcaaagaaactttcacaacatggagtaacgaacaaggtaacttaatagaggaaagtaagaattctaaaaggaatcttctcgattacttcttcatacagaacatgttatatgccaactgaaacaaattaccagatgacacaatccatctgtttctgttggtctatctttcaggacaggcagtggcataacaagattctcacttaccaagaatcgatggaactttgctgatgaacgcttgtaataatccacgccaataagagctgaactaacaccatcatctgctagccacatgaatatacatatcaacaaaactaaggactagccaattaaggactttgcaggagaacttgaagtaaatgttgagtgtactaagtatagcaagaaagttgaatgggtcagccaagtgataacatatactccctccatcccaaaatgatcatcatatatgtttatgcaccaagaccaaggataatttaaatcgcatcaatcaatacatcatgcacacattctcccacaatgcatgcatcgattacaacaccatgccaattacatcctagcacgcacacattctcccatgtcgcattaattgtatttcgatgaaatccatattcatgcggttatatgatgatcaatttgagaaattttggatttcattatatgatgatcaatttgggaaggagggagtatgaactaaatagcattcaatttaacaggtcaaattcggttctctaatatttacataacatagaatctctcgactgtaacaaaatttggcagcaggatgttaaaataagaggatagcatcatcaaacaaaatgtgcagtttgctcttctgtgaagatttggtatgtctataggtgtccaatatattaacagtaggaaatggactaccatgtaaatttcaatgagcttcaaatttgaagacatacttgaagcaaatagataatataatacaatagcaaattattggagtaatttgttattgctcgaaactaataaaaagctcaatcttctaaataaaacaaaatgtacgaattgcccgagtggttgtgattacaaattgccaagtgaatgtgattaaaaaaaagttattgtacattgaacctaccagacttctgttggtatggaatggtctgtaatggtgaaatagatgtcttggaattttcttcaagcatataccaatcttctaatgtaactttagagctataatgagatcccaatggaacaatcacagcagctacattgtctgttgtccctttctctaaagcaagatcaactacataatctgccaaattccgttgcgttactgcaaaggatcctaattcttggttaacaccaagtttgacacgcaacatcagatcacaaacatcctgcatagtcattttctcaaatacaccatcagaggaggcaataagaaaggtatcatttgctgacagagattgccactctgtcagttcaggtgtcggtattacaccatacctacaaaaacaataagactggtcaattcaacctatccaagcaatttgtatatcaattgacagaagaataattcatatattgcaatatcacaggccaaaagttacaagcctaaatattgttcgcattgctaatgagtgtaatctgtatgtattgagaatctggtgtgttagacagttcttaattagagaaaatcaatgattagttattgtttacttatttgatttctgatttctgtacaatattgtgaggtatggaatggttggtcctcatctggctttttaacgattcctcaccatggcttacatattcatccagtgagggcgatgctaagtggatttgcaagggctagggattcctcaccatggcttccatattcatcccagtagcatgcaattctactgccatgaagtatctattcagatttctttgaacagtctaggcccaaaattcacttcttaggatatgcctgaacacagatagcaatttgcttgggccttcgtcctcacctccccaaaagaaccagaaatgctacatttgaaccccgcaagtactacattccaccacagcatactccaaatctccaatgtgagaccaccaccaattgggcaggtggtgtaacagttttgttttagtttcttaaaatgacattgttagacttaaaggtggtttctgaagaactagatccataagtcctattgcaaggcattgaatactccattagtggtatcataaataatttataactattggccagcaagtcacaacatccagccgatctgggctgcagga

SEQ ID NO: 20136 - DNA, 4888 bp, Oryza sativa
taatattcagttcctgaactcatgtcattctaacgatcggaatttcttccaaacaatgccattatatgacttcaagataaccttttacctgtttttcctactatactctctcctcttttaattatccatttctatttacaggtcatttatgccatgtatagagtaacacacaccatctcaagcataatagaaacataatggaggctttttgagtgaggtaagcatggtcatttttaggtatagcttggtttatgtgagtacaacaaataaatttctgaaaccggtaaatgaaagacataggtagaaattacagaatgtgtactaaccgtttgtaaggcacatcaccaatagctcttgatagtgctagctcaccattaacacgatgcacaccagcccactcaagaacataaccaccagcagcctccacacggcttctctcatcttctctatcaggatgatgatccttggtcaactccttcacattatagaacggtccatcataatttgctaatgcaaagtcatcacgattgttggagtttctctttcttctccgttttcctgatacaacagaagttttcttatcaatactactccacagtgcaagagacacaagcaaaaaaggatgcagagatgaatatgcaaacaaacaagaaaacaaggccacaagggccaacagtagcagcacaggaagcaacagagatgaatatatttcccctcaaaaaaacagagatgaatatgcacagcgacaattgcaagggccctgttcatgtccaagtggctgcattaacatggacgggctgagagtttatccaagaagaagttggtatttgagacagagtacaggaagtctttggtctgttaactggtggtaatagagttttcagtccatagaaggaatcccatatcgctgtactgtaattcactctttatcaagcaagaaaaatatgtctatctccctaattttctagaatcaatccctcaatctctctgaccacgacccgtatatgttcccctggcttctgaaatctaatctccttcaagttatatcgccaatccttcatctgcaaagggtttatcccattgcgaacaaggtttcacacaaagaaatatgatttgggcactccctgttgaaatgatgaaatattttgagcatagatctttccagaacttcaattcatacatgcacccatatttatcttggtgattgcagcctacccagattgttattcagtgacttggcagaaataattccacaaagatgatataaacacgaataaagtactactgaatgaacagagcagctaatcaaagaattaaggctgctgtgcatccaggtaaggtaatgacatgaaatgatgccaccttaatgcatcatagcacagaaggatgcggtaaagaagcgaaacttgaataatcacaaggccatgatgataggagcaaaggaaacatatgtattacaactcacagcataggcaaaaacacctgattgtgctaattcatttatataatggaagaaagaagactgactcttttgatggtacgagtcatgactttctgagcacaagaaagcctttgagtctcccacatttgcagctatgatttggccatcgactatcaagatcacagccgctgttgaaccaaactcaaaattattccgtaaagcttcctgaacaacaaaaggttcattttcagttataacgaaaacatgtgatgcaattcaatttgtaggtcaaaataacaccttccttggagaatgtcaaatcaacatcatgaactgctctcaataatgattccttcagaacttccatgtggaatgatcgatctagaatagcaggtaaagcccaacatgacctgcattttttcagtacagaacaacttaaattaccctgaaaacaaggtttgcatccttctaaatgccattcaaaaatttagtagtttaagatcaaggaaacaaaaatttcattttttttgttactacaaaatttgctagttgatatatcataataatttaagcctgcctgctccaacatgttaaatgatgtaaaaccttgtcatacaaacggcagaattagacatggaaaatactattgtagcaagtaagcaacatgttactcactttgttccataaaggaaagaatctagggaaacaaacaggaattcaggaccaggatataaaatattggtcgcttaacgctaactgaaatttccttcttaaaccctgattagctagtaagtgaaccaagtgaaaaaggttcacaggtgataaatggattatccaccatcaaaattgtactacggcagatgtcatacttagagcagagtatgttatacagacatcaaaattgcatgtgtggcaatactaggcatgtactagcattactggagatattacataggttaaagatcatgggaaagaaataaaaattttagatgttatgttagagttctaaacatgtacaactgtataggcagtatttggcactgggggtggatgtgctaatattgtgaaagtaaagcacatactgttttacatcaaggactcagaaacaaaagaaataatgttgaagtgcctattcacattaccatgcttgttatccaacataaacaaaacatagatagaagaacaacataccccttgctatgactggactggtcctccttgtacagattaatgacattattaagaatagtaacttctttatatgtcagctttccagtagattttctgaacatgatggagtatataccatcaagaagaaaataaacatggagcaagaaatactccagcaaaagcttagaagccatctcactagcctcagccccattatgaccatcaaatactgcaaccactccgacgtccacctctttaatcctcatatgctctgtgttttttggcaggatagatcagatcaaattgcaaatgaaaagagtgcatcttaaagcattaaacacaaaatagggaacaaacaaagcacttctaaaaagaggtctacatgtaagatatttgatatttcaattgaccgaataatagtagcctgtgatctcctgatctctacacatgatacaaccatcttcagcattgagcaaccatcagcatgtagcctttacggcacgcaaaagacattttccatcgataacctcggttggaccaagcaaattgtatgtatatgatacctttctacaaaacctccaacacattaacaaatcatgatccctctagtgtaagtaaaacccagcttcccacagtcccagttggattttacgacttgttaagaaaccactctcttcagagagatgccattaaacatttcacaggacaaagcgcataccgtagaagacctgattttgcactaggttccctgcataatctcaaagttctgattcaatctcatagaatctctcaaaatcctaagctggttttcgtactcagtttgcccatctcatactcaaccatgacacgaaagtgagaatttggatatcgaagcttgtggtatatacctatgaaggggatgcggatgccgagcgcgcagacggcgcggtcctcctgggaccgccgcctgcctctgtcaaccgccacgtggcaccccctcgggtgcggcggcggcggcggggaggaggaggacgacctccggtccccatccccctctccgccgctgccagcggagggtgcgaggagcgtccagcgcgggcagtgcgcggactggaacaccgcgggcgccccgccctcgcggtacacggcgaggcaggtcgccgactcccccgcgcacctccgcggcggcgcgacgaggacgaggacgacgaggcggaggagcgcggctcggagtaggcggcggcggcggccggagcaacccagccgcatcggggagtcgccgccgctcgccggagttgggggaaatggtaggcgaggctttgcgtgtcccgagctcgtggtgggccccaccctccagcctctatgagacgaagcgtcgttacatttttgggcctgaacggggccgcgacctctccatgcggcccacaaatgttgggccggaacgggattgcggggtacctgcagcccatatacgttgggctggaacgggattccaaggttcgtgcggcccatgtataggttgggctgaaacgggaacgtgcagcccatattaattagtgaaaatccaagaaatgttattattcacgaacgcccaagtccaaaaagttccatcgatgattgcgagtttttgtttcatatcatacaaaggactatatccgtaaatatgatcgccctcattaagtgctatagaacgaacatcatatttaatagggcgggatgagtgaaaccctagcaattatagtaattctagggcaaagtcgtttgtacaatgatatatttcatgaaattcacactcatcaaaaagtatttatattggaattagtggcttgtcaatgaaatatcttggattttctcaattgaagtaagccctgacgggattccggtgtacctgcggcccgtaatgttgggacatgaatgggcttaatgtggccgtacgtaatatagatggaaaaagtacaccgaaggtccctcaacttgtcatcgaattacaaaatcgtcccctaaacacaaaaccagatatataacattccttaacttacaaaacagtttgttttacatccttcggtggtcttgcacccggttttgtcctacgtgacgggtaagtcaacgtgggcctcacatgtcaggacgccatgtcatcagctccgtctttcccctcctctcccttcctctttctctcactcatctccctctgggtagggcggccggcagtggggaggaggtcaccgggacgaggaggtcggacgggcgatcggcgatgcggaggcggcgacacggagagaatgggagggaggcggc

SEQ ID NO: 20137 - DNA, 1738 bp, Oryza sativa
tcctccccaccgccggccggcttgcccagagggagatgagtgagagagaggaagggagaggaggggaaaaagagagttgaagacgtggcatcctggcatgtagggcccacgtgggtcccacgttgactcacccgctatgtaggataaaaccggggtcaaaaccactgaagggtgtaaaacgaacggttttgtaagttaagggatgttatatatttggttttgtggttgggggacgattttgtaattcgatgataagttgagggactttcggtgtactttttccaatatggatcaggttggactatcatgggcctgggaaatttaggcccattacgctatgaatgaaattagcaaggcagagcgatagatcgttcattgatacaacaaattcaaacgtttttagatcgaattgaagttggtttacgtaagtttgtccgtgcgtaaaatatagtcttttcgttcgtgtgcaagatatagttaacgcacttgtcaataacttcataattacagctcaatcttgttatttaaccacaatacgcgttagttgctttcaagccaatttaaacccaagtatccacatcgatacaccaggaattggccaatttggcacttttttgtggcaatttggtcaatatacaaaacaagcaaaacttttgacatcaagcacacaaattaaaaccctaataatgatcatgtaaacaaggctctcccagtagtggataactttcaataaatcagtagtgtttgagacgcataggagagcttatcatcacaatctcttatcctctctatccagcctcatcatgtgttctatgagctcatctgatagtcaccacaagcccattaataaacgattcaattcaacgagttcagatttattttctcttagcatgtggctctgagtctgacacagaagcttgcagctgaaattccatcagaaaaaagtgaggcagacagccactacccatgaggtgagcatcctttgacgttttcttgacattttcagatggatatgccaagctagaaatgaaatttaatggaaaaaggcctaactttgtcatgtctgcctggatggttacacctatcatttacctaaacacaactttagatgtgatatcatggagatcttgtgttgtaagttgtaacatgttgtttttataggtgatgaaatccagctttgttgttgaaattgttaggcagaccaagaaaaagatttgcatgaagccaaatacaagtgtctgatatgaaatcttgcatcacaccatcctttcatttcattttatctttttgaccatgtatcgtactagtactatataaaaagcattacctcgtctaacttcacatcaatataattagtagaaatcgtagtgattcatagaaacagctccatcgtttgctctttggcttctcagccacatccaaaatttgaatttttaaaccataattttagagttgattttgatttttttttcatcattggcttttaaattgctaaaacacaaatataaaaattttacccacattttcctctctaataagtgctacggcttataatcaattataggcgaaaaaatgtggctttttaaatccttttttttaacattgcccttttgattactaaaaaactatatatatatatatatatatatatatatatatatatatatatatattctgaagtgttaaaaattcaaaagacaaaaaaaaaactctgtgccttcataaatccaagccatgg

SEQ ID NO: 20138 - DNA, 393 bp, Oryza sativa
  unsure (1)..(393): unsure at all n locations
cgggggagatcaaacgtcgacgaataacgtcgtcgtagcgaggaaggaggaggcggggggaagcgggcggcggtggaggagctctggcatcgcgttgaccgcgggcgcgacaagatgcgtcggcggtagtcggaggtcgccgcggcgagggaggagagatgagcggtggagaagcgggagaagaggagggaggcnnnngcngnancncnanggagatcgagcncgacggcgggcggagtggcactatgcgaagccggctcaggtctgccattgcgtcgaagaacggcgccatcgtcgcgaggaaggaggaggcggggggaagtgggcgaccgtggaggagctcctgcatcgtgttgagctccggcgtcgcgttgaccgcgggcgcgatgagct

SEQ ID NO: 20139 - DNA, 968 bp, Oryza sativa
gtattcaagtttatgggggtaattcgatcgacgcaatagttcaggggtaaaaattattagtgatgaataaaattaaattaaatagtgatgaataggttttttgtaaaaataaatagtgatgaataaaataaaattaaatagtgatgaatagcgttttttgcccaattattagtgatgaataaaattaaattaaatagtgatgaataggttttttgtaaaaataaatagtgatgaataaaataaaattaaatagtgatgaatagcgtttttttacccaaaaagtgagcgcacggcaacaagtctagaatgaacaagatttccctaaacaatatatagattcgtgcaaatccaatcacgaataatgcacggcctgctcaccaattaatggatttccataatcaagttccactgtgtctcgccggaaacatccatgcctcggtttataaggtagtgtaatgttcgttcggtgagcgaggtgggactaaatccgcacaagcacagtagctgcaccgtatgggcctcaaattaagttccgcaaaagcgaaaggcccgcagcccatatgtgtgctgggctcgcacgccggctgagccatcgtcaagaatctgccacgtagtcagagtggtgtggccgtacgtcgtcctgcaaattcttgcatgcgaatgcgatgcatgcattggacggacggactgcgttggctgtcgttttgccttcgatgccacgcgacggtccacacacatacacaccatgcactggtggagaaaccatctttcgtcggtcggccgatttccacaatagcctcggatgcaataaaaaccggggctaaagatgatctttagtcccggttcaaaagggtaacgggcatatttgatctttagtcccggtttgtgttaccaaccgggactaaagatcatctttagtcccggttcgaatgctgtcagggcctgtcaggccctcccgggatctttag

SEQ ID NO: 20140 - DNA, 1097 bp, Oryza sativa
tgcaagaactccagagtggtatccaactttttgtgccccttctcgcaacctgggtacaacgacgttctgtggtcctctaacatcttgtccaatttatgggcccccttttcactttcgcagtcctccttggcatcctgcaacatttgaccaagatcattcgcaacgtcgttataatcagcatctatgtcctcctcgcccgtttgatttccatcaaatccaacgtactgagcaaagtctggaatattgttgtcttccacttcatcttcttccatttcaaccccttgctctccgtgggatgtccaacaattatagctcggcatgaaccccgactcaaacaagtggaaatgaatagtcctggatgcagaatactccttctgattcttacacttatttgttggacaacaaataaaacccttctgcttgttagcttcggccactctcaaaaaataatgcacgccgtcaataaactctttggaccgctggtcagcgtacatccattgccgatccatctacatgaaatgaaaaaaaaatcgtacacaaataatcattcgtacaataatgacagtcatacaataatgataaaataatcacaaactctttcaacagtcatacaataatgacatatcattattcatacaaaaattataaaatattccaccaaataattcttatttattatttttaagttttaaattcttttaatttttaatttagtttgttttcttttatttaagattaactttcgctatattttcctactcaactattttataaaaccttatttagcaaataaacaaaatttcaatatattctttcttttcccacacaaattttctctctcatcaacttacaacaaaattttggagataaaaaagtgtgcaaaacatagctccaaatgtaatatgaccaaaaaaaacattggaggatgaagttgctaaccttttaggcacctccgatttgtatataatcatcaaagtaaattcactataaattttggcatgacctcccctcttttttgaagaaattttgaagtttgctctcgggctggaggaggaagaaggcatatataaagaggggggaactttagtcccgggtgg

SEQ ID NO: 20141 - DNA, 5280 bp, Oryza sativa
agatcaaatatgcccgttaccctttttaacctttagtcccggtttttgttgcaaccgggactattgtggaaatagcccgaccgacgaaagatggtttctccaccagtgtcaagtcgtatcctgattctatggatcaagcaaattgcaacataataaactggaaggtgagaggtttaaatgctgcagctagaagggattgtgttagagaaatgatgttcaagttgtatcctgattctatggatcaagcaatttgcaacatatttaactggaaagagaggattaaatggtgcagctagaagggattgtgttagagaatttgttgagcaactaaaggcaactataagatcccaagtgctctttatttttttctatatggtaagcgccacgtaaataccatgtaaaataaaaactaagtcaacttatcatgtgtgtgtcacgtaggactaaatcatcattcagaccgcccaagaactctatttagacaaatttttatatttaagagatcctatgtaacctgtagagtggatttttttttccttgcagtcatgtgctattttctttctactccttttctttgctgatatagtggttacacatttgacttataaagataattacataaagtctttgcacatggtagttctttaccatatgccttgttttcaacccaactttatcattcgccttccttgactagaccaagcctcctcagtgaacacaatcccgattcttgttgttgatcagaattgaacttcaatgttaatggataaaacatctgtatcgataatattttttttaaacaaatcaaattttcattgacccggctttaatagaaagcccaaaagacagacagagtcttatacaaacaaagaaacaacaaagaaaacagaaacataacggtagccaacagcgctggaactcatcaaaagcaccatccatcctagcgaagatatcacaccctagagatagatctcaaaacgcgtaacaaagaagccaagagcaaattttcacagctaaactactgcagggaggcaacacgacttcaattggttcagtttgcccatcaacagctcacactaccctttcatgattgcttgatcttcttcccttagcagaatacaccaccgctgaataaaagacagacttataagtgaccttcaaaggggacttgaccaaaatatctgaaaaaacccagtcagtcctatttaaccagagcacccaacacactagcaaaaagcatcacccaaacccaagataatactccctccgtattttaatgtacgacgccgttaacttttcgaacaatgtttgaccattcgttttattaaaaaattttatgtaaatataaaaatatttatgtcatgcttaaaaaacatttgatgatgaatcaagtcacattaaaataaataataatcacataaattttttgaataagacgaatggtcaaacgttggacaaaaagtcaatggcgtcatacattaaaatatggaggtagtagtttttttttcacaaactgatcagctatatataaaacaacactcgcacaaatgaggcgtcataaatactgtcaatttttcattgtgtaatttactgaccatgtatgcatggcctcacataacaaactagctgggtggcccgcgcaattctgcggctagtacctaaacaaaatcatatatttttttactatgatttttcttaaaatttattaaatagctatctcattgtcttagactttgaaagaccaaattttatcatcctcgtgtttctaattatatagtttttaaaagtcacaccagttgctaccccttatgccatcttcttctttatttgcttgctcgatctactactattttctatccattcttcttgtaacctttatagtttttagagtttattgtcacgttgggtttcgtttttataatttctagatgtcccgtcaaacgttaccattatattcctttacggcccatccactgtctcttttctttattgtcattgagattttaaaaatcgaacataattatcgtttgggttcattttttattttctagaagccccgccaaaccgtcaacggttttgccattatactcctctacggctcgcccgctgcctcccttctttattgtcattgagattttaaaatcgaacatgattatcattggttttttttttactttttagaagttccgaaccattaaaaattggactagtagtttcattttttataatttttagaagtcccatcaaatgatgccactatgcccctctatagcccgttcgctgcctactctttattgtcattatgattttaaaaatcgaacataaccatcgttggaatttattttttattttctagaagtccagttaaccgtcggcggctctgtaactatactcttatacaccccgcccgctgcttctcctttttattgtcattgagattttaaaaatcgaatatgattatcaatgggttttttttttttactttctagaagtcctggcaaccgccttactcgtttgcttcacggcctgcctgacgtccctccttttaatcatcattaggattcgatttggtgttttattaacagtttttatatgtcgtatcaaccgctaccactctactcctttatagtcctgttacttaatttatctcgtcatgtgttttaaatggtcttttctttcaatagtctttatttttatcataaattttagttatttataaattgtattccgaattgaaatcttatttttatttttctaatttcagaattgtttttgaaaaaaattagttaatatcgtattgtgttcttattgtttttattttttattttcaattttagttatttcaaaattgtattcctacttgaactcttttttatttttttctaattttggatattattttattttttattctaaattttaattaaactcgtattgggttttcatatggattattctttcaatattgcttatttttaattccgaatttcagctaattttaaattgtattcctacttaaactcttcttttatttttcttttgctaatttcggatttatttttatttttattctgaattttaattaatctcgtattggtttcttacatggactcttcttttaatatttcttatttttagtttcgaatttaagctaattttaaattgtatttctacttgaactattcttttattttcttttgttaatttcggatttatttttattcttattccaaattttaattaatttcgtattgggttcttttaatattccttatttttaattccgaatttcagctaattttaaattgtacctctaattggactctcctttcctttttaattttggattttattttatttttatttcgaattttgattaatcttgtattggattcttatatggaaacttctttcaatattgcttattcttaattccgaatttcagctatttttaaattgtacttctatttggtctctcctttttctttttctttctttcttttcctccgattaatgtgggaatttctagcccccacagtgaatgtggtgcctcctttcaaggctgttttaataatataatagatacatagatagatggatagatagatactccctccatactcataaataaagttgtttaggacatcgatacggtctccaaaacacaacttgacttcgtatttctataaaagtattcattgaaaagtgatatatgtatacttttatgaaaatatttttcaagacaaatctattcatataacttttacattttcaaactcaacaactcgagagttattcatgatttatatttccaaggtttaacttaaacattgtcctaaacaactttctttacgagtataacatgccgtcttccatgtactattaattaatgccaaaaccttaggcaggctgctagacaacgtctacggataagagatctatattattctcaccatgcaaattcacaatgtgcgtataataaaccaattaggaaaagcaatgaagcacgtacggagactatagaaaccaattaggaaaaggaaggaagcattgtgtaaccgtcgaatcagcttactagttgtcacacatgcatgaaggacaggaagagttgtgtgcactcataagcattagtacaccgaacaagtcatcagcaaataatatcgaatataataatatatggcagcgcatccaaataatcttatcaagtattactccaattaaagatggcagttaatatatatggaatttttttagattggaccatagcaatcttttctgaacagagataattaaatcttgcaaggacacaaccgacacctccccagctgatttccaagatctaaactgttacgccaaccggtcgatgtgatgtgacaattgatcaatggactacgtgtagcgttcgattgaaaaagtggtcgcggagcccctcctgcgtgttagatttcacgttgtcaacaaacgaacataaacacgcacgaacacattacacaagggaacgtgaaagtggaggggctataaaccgtacactgctgccttctctctcttaaaagtctttctttttctctcaacccctctactgtgtttatatccataataagatagtcatataaggatacatacatgcatatttggtataaggttacttcatccttaaaaaaactgaagaatagaaggaggaggcggtaccgtgatcctcacgatcacggcgactacctcatggtcgctacaaatccgactccttcgggagatcggtttcataataaaaaccctttttacttccagttgggaaccccctttagtcccgggtttctaaccgggagtagcaatccgggactaaagatgtgcatctttagtcccggttgaaataacggggactaaagatgaatctttagtcccggttggtaataccaaccgcgactaaagatagagtatctttagtcccggttgttaccaaccggaactaaagaggatagccaggttttttttccttttttattttctcccaaatctaggtggtatgtatatccttttttattttctcccgaatatgcgtggtatgcatatcccaaatcgaagtaagatcccaagtccacatcacaaattttaaagttctaaaaaattatatcagaaatcctaaaaataattacacacaaatcaaattacatcacaagtttctacaaaattcatcacaaatacatcacaagttcacatcacacacaaatcaaattcatcacatgatcctgcaataaatcataaattcttaaaaaaaaggagcca

SEQ ID NO: 20142 - DNA, 1983 bp, Oryza sativa
ctggcctctctcgctccgatccaagcgagctaaggaagaagaactaaggaagaaggaagaagaaaggataaagatatggagttagagaggaaaaaagagatagagaaagagttcgttgtgtggatgggaaaagaggataagtaatagggattatatagtacgtgttgatttttattcccggttagtaacaccaaccgggaataaagtaagataccaaccgggactaaagatcctagccgcctgacacggtctgacatatagacaaccccaaccgggaataaatatcatctagtcctgttatgcttataaaccgggactattgtggatttgagtcgaccgactaaagatggtttctccatcagtgatactgggatcccgatcgacggtgtttgccccgaagcttcgcattgatgtttagcgagaaatcgcgttctggatgccgatggatcggttcgcatggataacaggaggtctcgcatacacctgatttcgtgtccggcgtcgggcaagccattaagaccagttccagtgtctggcgacgggctcgtgttggagttgccccaaccatatgaatgaggcatccacctgtgagcagcttgacagtgtgcattatccttagttggtaggaaaaccggaagtaatactgcatttgttatctcttaccctatctgtctcaaagaaagaccattcctagcaatgaatctgacacactaggattgtgttttctttgggatggagtagtatgcttttaagtaaagctgggcgtgatgcgttttctctaaaagaaaaatactgcacttgttattaaaaagagaatgttaaaacacaagtaagggtgcaagcctcctccatgcgtatctcttaacgaatgcttttaatttttaaacataaatacacatcgtaattttgcaaccttggttttgttttatttttcagaaaataataagcttaatattggttttgactgacaatataaagttattgatgatatagtggaacaataaataaaacgtgaagtgggacatggaatcaaacatgtaaaccgtttattgcacctttaatttggaacaaacacaatcatggtacgtacaattacattggtcaaccaattggccaattattaagctggatgcgcgtgatcataatagatccttgatcacacatccaaattgaacacatgtacattcttttttccatcctcttctccttgattaattaagctggactactaatatttctcacaaatgcaagcgcgcttaattaactatgcacaaataaatctctctcattttgctaataataacaacaataataatcgacacatacgtaattaattatgtttgacatgatgacgttggttacttcaattttaaactaaccaacgtcatacatgaagtgataattaattgacccttctgcagttggtccggacctcacccagggaagggtcagtgacaggggagaggttgcccatgttgatcatggactgcgcgaagctgcggaagaaggcggactggctggtggcgaagcggtcgacgatgggcgccgtcgtcccggtcgcctccgacgccgacttgagctcttggtccgactggaggaagccgcggttgacctcgatgttggtgtagtagtggttgtcgaaggtgtccggcgtcgtccggtccaggtcgttgagcgccgccgtcggcccgttgggcgggcaccgttgcgacagaaagctccggtaggtggcgtccatggtggggtccggcctccccgtgtgtcttaagttgtacagcctgtccgtcacgaactggcactgcaccctcccgaacgtgtgcccgcctgcatttcgcattattgtcgtcgtcgtcagctccggcgggcatgacggcagaactgaaattgagttcgccggagaagtgatacgagtacctgagagggcgacgaggtcgacgtcgttgaggttgagggcggcgaacttttggcggaggacggtgaggt

SEQ ID NO: 20143 - DNA, 6536 bp, Oryza sativa
atatatatatatatactagaaaaaatacccgtgcgttgcaacgggtgaaggttattttaaatttattatttttatatggtttagttaagatgaaatttaccgtggaaattcgcttggatatatatatatttagaaaatcatgagctgtagttaagagtccgttcgtcttaagttagtatacgagttttttttaagagatttcttatacagctcattatgtatcgccaaaagtgaacgaacttaaaaccaactcaactacaaatatgtatttccacaagcgatccttctgtatttctaatagcaaatggacttaaaaaccgactcaaatatgggtatatatttccacaagcgaacgaacttaaaaccgactcatacacagatgacgtatcaaagtagcggcaaaaacatcttcaatttttataatagtagatagatatatatatatatatatatatatttatatatatatatatatgtatgtatatgttgatgctgatactttgtcctgtcgtaatgttgtccatatatattatacacaaactgtacatgtatatatagtagctagctctacatgtcttcctttccttggataattaagtgtggctttgttgttagcatgtgtaatagtttacagataaggttggcgtgagccgtaaaatgtaattaagattatccaatgatatgatgaaatatatatacggcggcatacatatgcatgcatgcaagcaccgacgacgggcctgtcaaatcactgttgaatgaaaaggtggtacgactgctagacagcactccaatttgtttcttcattatggttactagacctgtctatagagttacttcctccgtctcaaaatataagggattttgtgtaaatataacacatcctagtttagtactataaatctggatagagaatgtctagattcttagtattaggatatatcatattcatccaaaatcctttatattttgagttggaggaaggatagatgcatcttgcaagcacttaattaattcgagagacacgtacaaactaccaataatcatcgatcggcccaaccatatcacacactgtattgtgcaaccatgccgcatattatgatgatattcccacgtagctaatatgattggataccatcgaatccatacaattaagcatgcatgttaatcacgtacttctgtctgtaacgagctactattacgtcctgtgctgtagttagtagtttttattgggctcaagaaatatgtgaagatatctaaattttacgttaaaacttctactacctcaagatgttatctacccgagatactaagtttcatactagaaaattataaggtaactctcaatacttttataatgatgataaaattaccatggtaataataaatgaagttaatgaaaattaccagctcgacggagatctcggcggcgagggcgaggatgtcggcgcaggagacaacgccggggcaggcgtcctcgagcgcggccttgacgtcgtctacgacggggaatcccctcgcggagttgttgttgggcggcgacgtcttctccgacggcatcccggggacgctgtccagcagcagcgacgcgtcgcacccctgcacgaagcagtcgtggaaatggagccggatcaggctcgcgaagatccgggcgtcgctccggtgcgcatcgatcagcacccgccgcacgatgtcgtacgcgtcggggcacgtgcagtcgtagtactcctcgcacagctgcgccaccgccgcgccgccgccggcgaccagcgccaccgccgccgccaccaccaccaccgccagagaggaagaagaagaagaagaagccgccattgctagctagctagctgctacacgactactcctatacggtcgtgtcgtgtgtgttccacgagctaacacacagcgcctctcctgatttatagctgcccaagtgtactgtgtgttgccgatccattatttgatcatttagctaggcagctggggcagctagctagccaaactaattactccctcctattcgaaatgtttgacaccgttaactttttagcatatgtttgaccattcgtcttattcaaaaacttttgtgaaatatgtaaaattatatgcctacataaaaatatatttaacaatgaatcaaatgatagaaaaagaattaataattacttaaattttttaataagacgaacggtcaaacatgtactaaaaagttaatggcgtcaaacatttcgaaacggagggagtattacatttactctcatcgtttttacttatttattgttacgcatcaagttgctgttcgtatttttgtgcatcgttatcggttgacatggtagaatatgtgaaggataagtatatgtaatccaaatggcttggcaataatgctagtctacagagttgtcaaacttggtctcctctagactgagacctgactatgaccagatgactacttgtgcagatacttgcaaataatacgacatgtattattcgtgtgttgggtagtgtacctactggttttttccttaatttgcttttctttaattttaagaaactaataatatatggatatatgttaatctatagctagtggtacgtgttgtttatcttatctcctctagacaaggagcagtccaattctttgcaacgaacatatcacaaccacatgcatttactaatatgtttttgggagtgaacatgaataatatatatgtttaagataaaacttattacatcatgcatagtatttatggataataccttttggcccaatctcacagctataggtttagctttgcttggacaggacaatatgcaagaggcagaaaacgtcactgtcatgtcttgcaaaggccaagtaaagcttcgtttcttttctaatcattccacggcggctatacattaatttatagctttgcatgcatgcgtacatgttagctagctatgatcgatcacacgtgaaataatggagttaattaatcaaagggccatcgtttgttcatattataggtacgtaccgttgtgttttaatttgtacatatatttctcgtaccgtatgatactagtacaaataaatgtctgctaaaaatctctatattttttcccctggtccgggaaagttatcaagaaatgctactagtaaatcattacaatcacgtacaaaacaagtttctatctgaatcagtagaattgatcatatcactactacgaaacacgttttttcctaacggccaaaatacttcttttgcaggtcagcgcgcaccccgccccgcctgctaccaaagccatgtaaaaaattaatccacgatcttcatagacatgccattatcgctcgttaaaatcgattttcatagacggccaggttaagtcaaccgactgggaaaatgattttcaatgaaaaaaaaaggggaaaagattatcccccacatcccattgctctccgcatgccgcaccaattttcatagatcaaacaacaaataaagcaaaacaggaagaccaattcatcataattgaaaatcaagttgctccataaaattttgtattcacaaatccaacctaaattcacaagcaaaaaagggaagcagcctatgtggagctgatgtaacagatgcaggaatctcatggtcacaagccatgcatcacccccatcggatccacttccttcaccactgctggtggatcataagctcccaatcactaccggcaccatatccatctcctccaccaccatccacatctcccctttgctgccgctgccatgtggaaccccgtttttataacaggaatcaatcgtgtaaacagtaccatttccctggatcaagtagtctggtacacacgaactcatagctgaaatatcaagtgcacatacacgagagtctagtacgaattattacatcataagcccgcaggcacagtcttaaatcatcggaccgagcggtccggaatacatttcaaaaacagaagtaggtaaggcagcggagttaaggcagcggcacgccattgccacaggcaacgaccgtaactaagacctactgagcgccatcgtcttcatctccctcctggtagtaggcatagggatcctccgaagcttcatctcccacttctgattaattttatatttgcaagggtgagtaccaaccgtactcagcaagccaccacagcaatgatgcacacgacagaggaattcaaaggatggctatggttcttttgcgcaaagcaagttttgtaattcttttcacaagcctaagacctagcatagactgatcaagttttaataccagtgttcatattaaacaatgacggttctgtccaccatccattgtgatcccaaggatagcttcccgccattgggtcgttatggttttctgaggacgtccatattcccgcctctcaagaagtggctccatcagcataaaaatcatcatgcaatatcccatcccacacaagttaaagaatttagagtctagccaagtgtaatacatgtcccggtgctcaataaccgcgagcacggctattcgaatagatttggtttactcacactgcagtggatgtacactttacccgcactccgcgactgcccaacacatgagcctcgtcccaacacatgagacgcgtcacggcaaagcttttcgataacctcgcattggcagtacccgctccatgaacttaaatcctcatgcactctaggcgtccatgtttctagcagtgtgaggagttctggcgctcccaggaaagagaagtctcacacatattaaattatggtttaagttaagttctctctcatacactcatggcagtcctaccaatggcgacaccgatgtagggcacgcctctcggccctacctcaacggctgtcccatcgtagcgcacctgcctcactcaggggtgaaccatctatgcagggatactgcctccgctcgactatctaatccgctaggtctatacccattcgagaagtacggttgtacgggggtcgtttcatgcttaacttcatggctcggtccttaattgaccagggacggtactagcctttcccagataccacccaaatcctccgtccgccccagtcgaaaacaattgtttaattttatttctcctttcacaaatcatgtcatcaacatcatggcaatgtggcgctcatgtctccacatgccgcatctcaattaccttcccaaaggtaattgcccaatcatatagcatttgataaatatgagtatgcatgattctagaatggcatttctaagcaattgtcataattgactagggactcatacgtaatcatggttacaaggattttaagggtaaacaataatcgaggcatggcataatcacaagtatgatgttcatcattgcatgcaattttatttgtaaacaaaacaatttcgcaattgggatcaacatgttcaaggaatggtgatgacttgccttgctaaaggtcttgcgggtcttggccttcacccggatccgcggctccctcggtttctataattatgtgcgaaagaacaatttgaattcgattagaattcaaacaaaatccaaataaatccaaatgaaagtcgaatgcgaaagtcgattcctttattttaactttattattcgcgaactaaggcaaacccaatttcgattcaaactattttgcgggtataaatgttttgttgtcataagtttttaatttaatctacccgagcattatatccatataataggttagagatttctatcgcgagctaaatatcggacgaaatcctagaaatattatatgatttaatttagtctatgactaaatgattaaatataatacacggctaaaatccctagtaattaaatccgaatttctaccgtgaatcgattacttatagggattacccaaaaataatctataataatctataagaattcatctatttgtttagttattaattacatctaaattactaccgcgaattgatttcttattgaaattaccaagaataatccataatttatattaaattttgcaattctacgactataattaatctataattaaattctaattattttaaattttctaaacttccctaatctccctctaatctcctatttatttccttttcctttttctccctttcctttttttttctttcctttctttttcttttctttttctctttttctctcttttccttttcttttctttctctcctccctcccggcttctttctctcttcctcggcttctccctttctctctctctctcggctccctgctacctggggcggcgacggcgaccgagcaaggggaggaggcggcggcttaccaacggcggtggcggcgacggcggcgcgacgacgtcgcacggcgcacggtgcggcggcacgaagacggcggtgcggcggcgcgagggcggcgcgacggcgacggcggcgcaagacggcgacgcacggcgcggcggctccggggcgacggcgcggcggcttcgaaagtggcggtgcggcggcacgacaacggcggcgcggggcacgaggcggagacgggacgcgcggcgaccggacgttgac

SEQ ID NO: 20144 - DNA, 6080 bp, Oryza sativa
  unsure (1)..(6080): unsure at all n locations
aattcaccctagattaatattactcatattttatttttatataatttatttgagttttaattagggttaattcttattccatcgtatttaaatttaattgatccaaatatggtcgcgataatattttatttattactatccacacctaatctttatttttaatttatatttattttaccaatttgtttttttaaggtttattcctgattaactattctttactcacgattaataatcttcaaaaaaaaatccagataaaataggcgaataagatcagcatgatgcaattaatttaaaaaagtttttgaaaatccgtatttttagagttttgattttgtcggtccaattttcagggtgttacatgccacctccccatcttcgctttgcagccgatgccgtcactagtatcctggagcgctatcgccaccacccttctctggatctctttgacggagagaagtagagaggataactctaagggagaaggagaaagagggaaagtctaatattctaggagcccgcatataaaattatttttataagcaatatttttagagggccgtatgtataaatagagttgtttttatacatggttatgctaatacgactgtctatttctacaaagtggggttttttcttagtctgcctttgaaaataaatttgaggtgctaccaaaatacttttcttatagcgtatcacattctaagacaagtttcacttactttggttaaatatataggagtatactatatatacatgaaaaactaggcacgcttgcccaatggatgcaaatacatacattttgaacgttcaacgacatgggaccagtgctttaactagatagtgctataattaataaaaccgggcaaccggccacaagctggtgaggaagaataaacgatctggatagcttaatttaattttaaatcataattcttttttatcaaattgttattcttcatccatcctagcttcatgcagtgtaacgaatatatgatccttgtcttcacgtacctcttaattaaagctaagttgtgagctgttatgttacctctctagtcaatattgttatgttacctctctggtcaatatattactccattcgttttaggttataagatgttttgactttggtcattaagtttgactaagtttatagacacatataataatatttatgttaccaaattagttttactaaattaataattaaatatatttttataataaatttatctttggtcgaaaatattattatttttttctataaacctagttaaacgtaaagctgtttaacttaaacctgaaacggaggtggtatataggagtatgtgtgtacgtactgtacgcgtgcaatgtatttttgctatgaacgtagtacaatataggagtatattatgtggctgctatatatacacattgcagtgagcatactctggccacatcatcagccaattaattgttcatcacaaattaagtgatcatggatgcacattagcccacaaattaagacaaagatcgctactgttgtcttgaaagtggcttctacgtaccaagcttggatttgtacatataatgcaggcagacatagctaacaaggccaactggcatatagatggttggcagatagctctttcccgttcatgatatatatcgaccgttttcgttaaacaactaattggctgcattattcgaggtttctatatattatgctagatatatatgtgcacaaatgtacgtgtgtatatatatgttcacacatgtcaataaagcagaaaaataagaatatactccctctattttcatgttataaaacgttttgattttggttaaagttaaattactcaaaggctgtgttcgttttagcctcttcttaacccatctccatcattttccacgcgcacgctttttaaactgctgcatagtgcgttttttgcaaaaagtttctatacaaagttgcttaaaaaaattaaattaatccattttcgaaaaaaaagcaaatacttaattgatcacgtgttaatggactgctctgttttccgtgcggaggaaataagttcccaaccgcctgaaacgaacacaacataagtttaactaactctatagaaaaaagtagtaatatttataacaccagcatagtttcattaaatctataattgaataattttttataatatattagtcttgggttaaaaatattactacttttttctacaaaattagtcaaacttagagtagtttaactttgactaaagtcaaaacgtcttataacctgaaacggagtgagtactatacttttcgtatatagtcacagatttttttatatggtttatttatcaagtgtatatatatgatacttgttttctatttttcatgtgactgtttttattcttatcaatcactttttttcaacaattaatagaatattaggattcgacaacttgcatatctattaagtttcaacaaccagaaaaataaaaaaaagtgaatataattttgagtttgtactgaaaacttgcatcgtttttatataaagcaattttaagctagatttacattttgcaggtttagttgagtgataaacgagaaaaaaaaacatcgtgttgtgcaaatttagatgactgaaaaaaaagaaataaaatagataactgataaataactaatatggaaatttttattttttaaaagtatatatgtttgtatggtagctagccagcatatgcatacgtatacacacacgtgtgtgtacgcgatacacaaggtgcttcgcaaaggtgtttagagggcttttagctgcttcatttttttccagaatcaaaagttttctccaaacaatcttgcttcaggtccagattctagaaaattgtagaatgaaaaaaataaactaaaagcaagaagctgaaaaatctagctttttccgattctcataagccggttaccaaccagctaattctgagaattttaaactcctcaaacagctcctcaaactggctgattcttagaattctcagaattaattcgatgattgtaggttgttggtcagcagcgtcagattttaatcggttgttcgtatgacacattcgatcgcttgtcacatttctagacggtacgcgttgagcactggtagcctggtacagcgctagtatacataaatgtgcctcgatttcgctatctatcgagaaataattaattacacccccgatcaatatgcctgcctccactagttcttaatacatacccatatcatctttacggaaaatcgaactataactaattatgatttttttggataatatataactataagtaatgatagtgaaattgataccctaaaggaacttaattaatttgttgccctatcgatcggtacagaaaaaaaatcctaataatggtgaaatgggtaccaaaaggtactttgttgtccctgtcggtaaaccatacttaagtaacattacctctacgattccttgaaattttcgttatcgactaccaccgaaaagaataattagctgtaaatatatatgagcactcatgttagttaaatctaggatttattaatttgaacctaggtggagtggtttccttaaaaaaaaatctaattagctgagttacattcacttcgcagcaatataatggtcgattggtcgtacggtcgtgtgcttccatttgatttatgattgattaacgtacgtacccttcaaagtgagtggtccagtatgtgttgatctagccttattattggactcattatttttcctagatgccattgtataccttgaggttcatggacggtccttaaacactagcacgtgttatcttgttcttaaactttcaaatacaaattcagatctttaattaatccatcacaagtccaaaagtgtcatgttttctactccttccgtccctaaatataaggaattttagttggatgtgacaaatcatagtacaacgaaactaggatagcttgtctagattcgttgaaatatgatgtgtcacacctaaccaaaatcccttatatttagggacggatggattatcttttatgctactgccttttgtgacttagctacattaattttagttacttccttcatttcatattacaagaatttttagcattgcccatatttatatagatgttaatgaatctatatagcaaggctataaagtcttgcaatatgaaatagagggagtactacgtacgcaccatatgtttggagcactggccggcgggatctagttctcgacaaattcctaaggaaagaaaaaaatcagcattaatttttattaatgttttagatcacatatgttttaattatatttctccaaatttgccccatttattcactcggccagacataaattggtacacatgtgtgtaatagttgagtctaaagcattaccaacagatcgaatatataatccgctctcaaaaatttgttattgggtttttaaattgaaaattggaagtgaaaaaactcatctgagaaaacctaaatttaataaaaactaaaagtgagcccttgttattttttgcggtttttgcaggaaaaaagtgagcccttctattaaattaccaactaaaatctttgtttttccaccgtccccgcgcggaaaaagatcactcctccagccagcccacacgtgggaaagaaaaaaaagcttgcaggaaaaagaaattgggaacaggagtggtgtcgatccacctcaaatgaagagagcgatgaatgcggtgatagggttgccaaaacattactccctccatctcagaatataaagagttttagagttgacactgttattaagaaagtaggtcgaagtgaatggtggaggattgtgattggataagtaatggaggtaggtggaaaaagtaaatggtggagggttgtgattggttggaaagataatgttgggacaaatcttaagagttaaaagttgtaatatttttgaacggaaggaaggagtagtatcagcataggacatctgttagaggttttcttttaccaaaatccaaaaaagtcaagatcggggatgaaataagggtattgatgatgctataagctagcagtgttaattacttttttttaccaaataatgatgaactccaacccagctttcataaacgtttcaggcccttctaaggtctagctaggtacccaccgtgccatatcatgtcaccattcaagaagtcaagtgcatattttatttagcaattttactgtacttcaggaggtaccacgaggaaccattttttctatggacgtaactacatagctagtggtagctggtttgtctaccactctatctataagagacaccattcacctatacttcaaatacaattttctcttaaactactcatccgatctacgatccgattacaccgttgtgtttgtaacaattaaatcttacaacaagatctcacatcattatattttgaaaaaaatcacaaattacttttatgatatgtctaaattacttttagatttcactaagttacttcttagatatataaaagtaaattcagtaaagcctaaaaataatttacatatattatagaagtaacttagaacaaaacgaatgtaactttggcatgtcatttgaagtaaatccggtatagagataaaaacattactctatctagaaattaaattaatcagcacaaattatggaattaactaaaaacaataataaaagcaatcacctcagagcattatgaatatataggaagtattttaatcaaatctaaaaataaattatatatatgataatttgttcaatgaaaaaagacattaattaaagttactttcttttttgttataagttacttctatataatatatgtaaattacttttnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20145 - DNA, 16907 bp, Oryza sativa
  unsure (1)..(16907): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnttaaccaagctcttacaagttcttaccaaagcaagtggaatggtgacatacaccgactcaaccaagcaccccaccggagtttggatgtatcgatgccttggcaaacacatgctgtacggctgtaatcaaatctgtagagctctgggtaggcttaaatatgtagcaaaggaatagaaaatgctcaatctagagaataaaaagttgaatgatcattcaaagtcaagtaccgtgcttgtcctaggctagaatgtactagagacgcgagcctagtacacaaacgaacgacaagatagcacaactcaagcacaactctgatacatgaaaatggtctaaaaatacaactgattttctttttttttattctttctttgtttctttcttttttttcttttctttttctttttcttttttttggtgcggctttttttttgcttttgtatgcacctttctgccttttctcacttttttttatttttttctgcaaaaacgactcaaggacttcaatgcaaaattacatggactcaaatgtaaatactaaaattacagggacttaaatgcaaaagtccaaacccaaaattagaattatacaaaaatggaatgctgaatttgtactggttctgtttttccaaacggatctccaatccgacactctaaaaattttcactaagctatgcgggaagacacggtatggatcttaaaccgatagaagagagggaggagtcggactcagagggaggaaggtcgcacggagaggtggagctgaatattgcggccagcactagtgtttggattcgatgcacaaaataaaaggaaacggatttccacctaatccaatcttctttttctttcctattcttttctttccttttttttccttccacccaaccgaatccaaacagatcttctatattcctttccccttcttcttcctcatgggcaaaacagaaccacgccacaaacactaagcccgggtaaacaacaaacccttgatgcaacaccaaaaccgaccgataaaaacttctgaaaactacaaaaatagaaccgtggcagcaagccgattccgttttcgtaggtcccgacgacaatagagacacggaggcgatgacgactgtggtataaaacgtgaccaaaactcgaaactctaaacgaactagatgctaagaccagcaacacgacgagacgatgcaacacaaaattcaacaaagcaaaaactgaatagaacaaagcaattgcacaaagatggctaggtacaggatgcaatttttttttgtggctattttctgataataggtagataaaaactcaccgagcaacgaaagctctaataccacctgatgaaccctgagctccactcgagacactcaaggctgttgttggcccgatctttcggtgagttgatgataactacgatttgggagaaacgttgacgatccgactacaaccgtacaagacgttgcgttgcgccttagcgatcgatacacctctccgtgggttgttgatcttgccggtgcagatcaaccttattcctgcaagcaatcgagaacaagcaagaacaagatataaagcaactgaattgctagatagacaagatgcacaaagatgaattgatacacgataaagtggggttccgaacaagcagacggacggtttagccgacacgcacgctgcaagcgaagtagcaatggctaaacttacaattaattaaaacccaagaaaccctgaaggggtacctacctatttattgaggtgggaggacgaccaagagggtccaagggtcgtgctccaccagattggggcgcaccccacatgggccagggtcccaaacaaagttacaagcccattggcccaatacaggtgacatagcacattgcttatgtgattgcggccaaacaagatagaattccgagatgaggctggattcgttggaaggaggacttcgagagctttccattaagtactcacgggcccaaaacggagcacgtatgtagatttggcggccgtttgaagtcagcaatgtagcacgtggccgaatcagattgcagcacatggaggacttgatcttgatgtcttcttgttgattcatgatgtgagcaatggtcgtatccatagtagccatggtcacatcacttgaggccaaaattctttgtaaaagctaacagagaacccatctggcccaggagccgtattagtcttcatttctctcaaagcaccctcaatctcttccatactgaatggtttagttaattctatattgtcttctgaagaaagtctgcctcttccctcccacatattatggctaagacagaatttaggaggtaattccattccaaacagtttcttataaaaaccataaatgtgctctttcaactcatcagcattctcaataggtccctcctccccttccaaactccttattgtagttttccttttccttccattagctactccatggaagaaggctgcgttggcatctccctctaacatccatttctccccacttctcccttgccaataaatctcttcagagatgaaaatctggttcaaagcaccttccagctcatatctatgcccccactcttcacatgtcagttctttcttctccacttcttcatctattttctgtatttgactgatgagctcctctttttccttgtttatctccttcttcttattcatagcccatcctctcattttccttctcaagatatatctctggcacttccagtgatctaggatatgttttttcctcctctcaggccatatgtcaattatccaagccttaaaaccttcttgctgaatccaccctttttcaaatttgaaagatttaggaccagaaggggttatttgattttccaactccaccagaattgggttgtgatcagatcccacccttgttagactctgaaccacagttgtagtcgaaacgacaaccgcacacgttgaaggacgtggtcactcaatggtggctgaaaagaagtgaagtatattaaattgagaatttttctgatccccctattacatgacactatgggactatttatagccccattacaggttcttactactagggtttaggttatacaggggattttacatggttgtccttatgaaagggacatttacatgggtatacattgtaattgaagtttatgggctcctaatgggccgtcaggcggtcgttggcccaacggccactaggcttggcatgatagttcggcctcatcggcccccgtgaggccgaacttgctatggcgaagttgtctcccttcgacgtacactcttcgccatacatcattcgcccaagaggccttcggcttagtgagatccgcgcgattctctgtccctcgccgtcgttgttccatagtcttcgccatgttggcttcgccttgactaatctagatgccttgggcttgaatcctcgctggtcgcatagtttcggcaggcttggtcgaagggcctcatgccatatcgccaacaagcccctcacgggcaagggtgagataggagcttcggccgagaccgtgcaaaccatgtggtatggtatgtgacgccctctttcgaccgatgctcctgccgaaacctatattattcctgcaaataaaatttgttgtcttttcggttgatattgttttcgcagcctccgcctcctgcggatggtcgaattatatatatattttatttttcccgggccgaaagaaatagtaatgggctttcccttcgtgggcttattattgtgcggctcggtcaataggaatttaccgtttcacctacccttgcgacacgtggtgctttcctattggtgggtaggcgaaccgtcgcctacgtgggctatatattccccccctttttccttttcaccaccacacttgctgtttttaccgcacacgctctcttcctccgttctttccttcgccaccgccggcacacccttcgccatggcccctcgcaagccaaaccctgtttcggtgaaagggccagaccccggccgaatcgacgacgacaccaccgccttcttggggctctctctcatggacgatgccgagctggcgaagttggtcagctctggagcattggtggaggggcaggcttttgccctggggaaggccgtggtaccgaagcccgtcgacaatcggacagtgttgttcgccgtcttctttgaggcggggcttcggtttccgtgcaacgtgttgttgccggagatccttcgccttttctaggtggagctcccacagttgagtccgtcggcgctggtccggatcgccatcttcgactgggcatgccggacatccgggtttgaacccagcgccgagctcttggagccatatttttcgccaccgtgaattcgaagacggtgattaccctggccggaacgaagaagacggtgtttggtagcgtgaactttaatgtttgccccgagcgctccgatctttggccggtgaatgccgccatgtcgaagtgggatcgccatcggatggtgaggtggttctatcacaccatccccttcgaggctggatctgagtcggtgaaatccctccggtgtcggcgcaaggcgattgcgccgaaccggaaacccaagatcaccgtggacggtgctatggaagcacggttcgtcttgctgcgcaaagtttactcccgccttagctgtcgcgacttggtagaggagttctgcatgcttcgcatttttcccctctcccagtcgtggtaggtcgcggttgaccaaagcgaagaggtcgatggcttgccgaagctggttcttcctgaggggacgaacggtgagactgcacctttcgctacacacttctgacagctttcgctattttgcctaattcgacgcttaatatggctaccgatcaggccgacgccgaagcccagaggatgatcggcgacgtgtcggttgtcgagtacagccagttgcttacacgacaggcggccggccgggcaaatcgggtttacgacagcgcgggcaagtgaagctggcccctaggaagcgaagggccccttcctcctctcattctgacgccgacgacgaggacgacgtcgaagatcgtgacgacgaggaggaaggcgaggaggaagaggaggcggaggccatggtcggaagggctgcggacgacgcggtcgaaaaccgcgttgaaacccctggctacactcccactccaagtccggggcacaatgagaccggggtagagtcgaatagctccccccttcatcgaagggattcggaggtggcgagagcgctaatcgcgttttcagctggcaaggtggagaaggggagtccagttaaaaaggccgccaagaagagaggactcgtcaacgttggtcgtgtttttagcgacgacgagtcttctgacgaaaccccgacttcgcccgccggtcattgcttagatctttcgaccgcccccgttctttcgatcgacgttagcagagcgggtggcagtggcgctgccgtggcctcagcctccgctgatcgcgtcgtgcaagctgcggctagggttttcggaagccccttgtgtcagccggtcgtttcgccgctggtctagccgaaggggaagggggcggccgtcgaaacatctgcctcggattattctctcgtggcgccccactttgcccctggcgattttgagacccgggcggagctcattccctttgtcgagtgggtaagcaaccttgtctcgcctgccagcaccccgagtctattcaccgaactgaatgagttcgacgaggggtgttccgctatcaaaagcttggcgctttgggtatgcccccttttttttagctctctttttgtttattctttgtttctttcttatagaaccctcaatttacatttgctcccttcgtctgattttccttgtatccagattcttgcggctcactgttcgactaagcgaaccgtgtgggcccgtcttgatggattcaggaaccgacttcgggccaaggatgacgtgttaggccgcaagggtttgcagatagaggccctcgctaacaccttcaaggaggcgaaagccgaaaacaagcgactccaggcagaactggagaagggaagagaggccagagctgaggttgatcgccttagggccgatgtggataaaggaagagagtctagaactgaggtcgaccgcctcagagtcgaacttgaaaaggaaagagcccattccgtggcgctgactgactattacaatctcaccgagctgaagatggaggctcttcgcctggaggtcagtaaagctgaggcgagagctgcggaggagtcgcagcggttttcgcgggagatggcgaaagccaccgcttctgcgaagacggcgcgccaaacacttcgccttgccctctccgacatgggggcgtgggttcgaggagttcctggcgaggacgcctccgtcttcgacttctcggagtggacccaacaagccggtggtgcgatctcggattgtgccaccgcgtacggcgattgctgtgcgcgagtgtcagtggccttcaccatgggccttctgcagtagtgcggctgcgagcacgtgtcgcgaccgagaaaaatacattttcccgaacgctagtgtattaatccccgtcccaggaaaagccggggtacaccacacaaacatgatataaaagacacatctttattatatcgataatatttacattattacaaaggcacttaaggcctgacaataaaaaataaacagcagcggactagcgggcctacggctccatcttcacaggcgctcaactggggtataagccaggactccacctaagacttcttctccaaagcttctcttactgaagggggggaaagattgagcaagaatgagtacaaccacagtactcagcaagccacaccggcagatgcatgattaatgcaagggggtacaaggggtaataatataggggttaagttttgcagaaaacagcatttaaaagtcacttagttgcccaaagccattttataaagacgatcctagagttacacagtgttattaatcaaggccgtgaaccctcacgaacctgccttaacccaaggcctacgatgattcagaccgagctggcaacccgaccctgggtcccagcttgtcccaagccaacccaggccacccattccacattttagttgttaagcaggttttaagaattaaaacactaacttgggtacattgctaggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaacccacctacggccggaacctccaggacaggcaggcaggattgagcccctagcagcaggacaccagccctgtgccatgacatctcgactaccgggccgcagctcgtgtagcctttatttgtcctagagatgtccatcgacccccgacttcatctatctccatccgtgtacttttgtttataaccagactgagccacaaactaagctttacccactagacatgtggaagtacggtagtgctttacaacagaggcccgagcttaatccttataatacccgaggtacgactaacaaaacccaaccacgcacctcgagcccagcctaaaaccattttgggggttttgaatagagggggaggtgtgtgtccaattccaacataagccaaccattccatagtgtccaaatgatatgagaattcccaaagtctaaagttataaaaccacctaatgttgcctaattaatcagcgaagcatctacctaaattcatactagtggaaccatgaatagagtacccactagttggggttttgtttatcctagggtgaacaaggtaataataacaatagcaataataataaggtcataacaaagataaataggcatggctaaataaaacaatgataacgcgggaatttaaataaagcgataatgcattaatttaaatcaaaataattttataaattgggattcaatatgttcaaggatgatgtgacttgccttgctcagagataacggccttccgaaccttcggcgacgaccgtaaaccacgcttcgggaacctccggaacgacgaagactacgcgaagcacacaagcaaagctacaagcctataaagaagcaataacaatacataaaaagaaagcacagggttctttaggttataacaaacattaggagacttgaacggatcgattcggagctcgtatgaccaagacatggtcatccgaagtttaatgctgttatatggagatttgcggattattataattaggttttgcaactataaaacatgtgcaagcactagcctggaaaagacaggaaggctgcgccgttgacatgcggaccccacatgtcaacctaaaggaccgcggtagaccgagtacacagagacggtccacgggtcgacggaagcggaccccgtgtgtcaaccgaggcgagtggccaacaaacggactccactagacaccacgcgggctgcacacgtgaaaccacgcggctaccgagcgggcacactaacagggtcaccacacgtacaagcgaacgactaccgacaccggtacacgggtactggggtcgacaaccgcacaacgggtacggggcgacaccgaaaggatgaggacggggcaccgagaggagagatccataccaccacgcgacgaggccagggaacgacaacgacgaacgggcgcggcgtagacgaacggcgagggaacgacttcggcggcgatccttggacgaaggcgagacacggccggcacaaggcttgatgacgcggagccgaggacgaagacgacaacggggctgccacggctcgcttgatggacgcggacgacggacgagaacggcttgacggagggacgaacaccacgacgatgaggacgacgaccgggaccggcgaggaggcaacgagggcagccggcggcagctgcacagagactaggacggcgtggaacacaccgctgcgaatccgacgacggaggcggcgcagcgagacgacgagccggcgaggaggaacgaccgaccggaggagtcgtcgacgaggacgaacggagacgacgataacgaacaccggcggggttcagatggaggggaggcgaggtcgagggcgaccctgccgctgcgatgccggaggtggtggtggtgcgaccgacggtgcacgggtggaggaagggccgaccggggaaattccggcgaggcggatggagaggttcgcggcgatgtgcggcggcttccgggcgaatccgaggagtggatgaggtggagggctacgtcaccgtgccgagggaggagacggcagcgccggctgacgcacgggcacggcggaaggggctgccgaaggaactccggcgaggcggagggcgagaccggcgcgggcgacgacgttccggcgaaattcgagcgatgccgtggcctggccggggaagaggatggcgctgctgtgccgggagaggcagcgacgatggaagacgacgctctggcaaagcgacacaggcggctggaggtggtacagtggcggcaacgccactgtacaccagcgaggaagcgtctccgttggtccccgtgcgaaacggagggcaggccggcgtagaggggacacctgcgaggccgaggaaggtggtggcgacgtcagccgccgcacgggagaggcggcacaggcggctggagggtagccggcgccgaggaaagagaaggaggaggcggggagaggtggtgcggccacgggggagctcgggaaggggctaaaacgagggaacggagcgagggggttccattttataggcaaagggaaggagccggccacgggaggagcggggaacggcggcggaaaactcgtccgacggccatgaaaggtggccggggttggcgcgtccgttcctggcgatttaaggcgctattcaaggggaaaattaggggcaattgaagaggaaggaatggggattaaaaccccctaatcaattttggaaacctcggtttgaatcgcgtggattttggggaggattggcactagggtttgcacgggagagagaaaggaaggaggccgggcgggaggacgacgacgacccggggatgggacccatgcgggcgcgccgtcagcgcaagcacatgcgcggcacgggcgggagggcgccgctcggcttgggcccggaggcggcccaggaggagaggagggagaggcaggcccgggagagagaggggaggggagggagctgggtcgggagggggagggaagaggtgggccgggaggaggaggagagggagactttggctgggcttggcccaaaggaggaaggaggattttagtttttctttttagtaaactttgttaattgttgttgttgtttaataaatattttcggtgctctgaaaattcaagtaaaatttgagggctccttttagaccaaggagaatttaacaaaaattcttcggaccacatttgaatttttctggcacgtattttagtgtttgacaatttcttttcgaattttaattaattctattattccttttagggaatgatttttatttcggaatgaatttatcaggacgtgacaacacgtcaccgagttccccaactatgtgaaaggggactgggagatcagtgcagaggacgtttcgctcgcgcttcgcgcgtggcggagatagttctggcagaaggacggccaatttgccgccaaggcgcaccttctggagaaactagcgaaggcggaggcggaggaccagggcgaaggggaggacgcggcggccggagtgggtcgaggcgatgcccaagatcacccagaggtgtgaggccctccgccctctccttagatttttgtagcttttcttgtgtttgccacggaaggcgaacaatgtacatttggccgatggcccttttccctccttactgtagccgaaaacggccttttggatatatggaatggatgactcaaagtttagccacttattatggtcgatgtcttttggtatatatgcttgcatcattctcgcattatttttgtatgctgcagagtgtttactcttttcgcccactctctccctgcagagtcctaactttgcacttcgctctttgccctttctgcacttattttagcagggtgttcaccgaaaattgtgtgttcggccccctcttggtgattggcgaagcaggaacaagaagttcgtggctgttaagggtttgccaaaggcgcgatgtgcgttttggcctgtttatcgcgatatgatgataaacggcaacatctatacggttgtgaaggttgccggctggatgcgggcgcaccctgggcagaccctggaggactacgatcatgttcatacaaagcgtttggaggacatggttcgcttttggcggaaccatcagaagaccgatcggcaggaggcgatctcccagcgtcgatacagtctagcctgtgttttgcccccctcccctctcagggtcatgtacgatattagtagtgatgacgaacccagctcacccaaccattccttagggggcgaaggtggctgtgggggcgaaggtgtaatttacttgtaagctgggctgtatcatgttgtaaaacttgtattcttcgattatttttttgaaactaataaagatgtgttttatttccttttcgctattcttcgcattgtcacattttgcgctttcgttaggtcagagcatgtcggcccctttgcgtatattagcgaaataggtctactgacttttcagctttcggcgtccgttttcgatctgtagcgttctgtgctgaaagaagcacttttttttttcatattaatcgaatgtaagggtgttcggttggttgcttcccaaaacaagctgttgcggtttcgacattcggcgagcgatgtgaacggtctgaacttggttggccttttgggggttgtccgaagggcccagagaacagacagcatttcatccggccatttgcccttcgctgccccctcaagccttttctttagtgcttctagaatcttaccatttgtgcgttcggctgccccattcgactgtaggtgcgcgaccgatgcaaacctgatttccaggtttagcccttcgcacatctctctgaacttgtcagagtcgaactgcttgccgttgttagtgatgaactctttcggcactccgaaacggcatacaatgtttttccatacaaacttctatactactgccgaggtgatcgcgccgagtggttcggcctcgatccaccgggagaagtattcgacggccacaattgcgaacttctacccgtttcgcgccaccgggaacggcccaatgatgtccaacccctatctggcgaaatgcctgagtgcgatgtgctgcagctcttattggggcgcagttgggcttcggccatggcgctgacagctttcgcatttcttgacctgctcgacacagaccttcagcacggtgggccagtacacaccttgttgaaacacttttgaggcaactgctcttacgtcctggtgtgcgccacagagcccctggtgtatttccttcgccattttctcgccttcggcaaaagagatgcagcgaagcaaaggttgaagcaccccggaacgatatagttggcccgagaccatcttgtactttgcggctctgagttgaaggcgctttgcttctgcttcatcttccggaagccagccacaatcgaggtactttacgaacggtgttcgccagtcctctggatcattgcccagttctgcctggtcgattgccatgacctccaagctctctatgggcacacttggtgcgtataggacttcaaaaaagatgcccagcgaatgtgggcccccacaagcagcagacttcgccaaggtgtctgcttcctcgttctggcctctaggtaaatgttcgaccgttatgcctgcgaagcatttttccatagaccgaacagccttcaaatacctcttcattccttcttcctttgcctcaaaggacttgtcaacatgaccttctaccagcttgcatgaagccatcaccagggcgtaagcaagtttttccatttcaatgtatcttgtcttcgctccttgcaatgctttagagacgaaatagaccggtttctggcctgactctgtttcttggacgagggcagcactgactgctactggcgaagccactaggtacagtagcagttcgcttcctggtgctgggctgatcagagcgggtgggctttgcagatattgctttggctcgtcgaatgctgcttggcattcggttgtccaggtgaattttcccgcgccctagagggtcttgaagaagggcagacctctttcggctgcctttgagaggaatcgactgagtgtcgcaattcgacctgtgagctattgtacttcacgtacactcgacaggggcttcatttgctgaatggcatcgattttctcggggttcgcctcgatgcccctttcagaaacaaggaaactcaacaacttgcccgcgcgaacaccaaaaacacacttctcaggatttagtttcatacccgccgcacgtaagttgtcgaaggtctcctgtaggttggatgcatggtcgatagccttgcggctttttacgacgatatcgtcgacataagcctccacatttcgccccaactgcttgtaaaggaccttgtacactagcctggcgaaggttgccccggcattcctcaggccgaaaggcatcctgaggtggcaaaaggtgccgaatggtgttatgaaggctgtcttggggatgttggccgggttcatgtggatctggtgatagccagagtatgcatccaagaagctcatgagctcgcagctagctgtcgaatccacgggctggtcgatccgtggcaaggggaaattgtccttcggacatgacttgtttagatccgtgaaatcgacacacatgtgtcatttgccgtttgattttcgcactagcaccgggttcgccagccactcagggtggttgatttcttgaatgaacccagccttgagcaatttttggacttcggcttttgctgcttcttggcgatcagcggacatcttgtgtagcttatgtttccttggcttggcatccggcttgactgccaggtggtgcatgatgagatctttcgaaacatctcccacctcatcaggtccccaggcgaagatatcgatgtttctcttgagcacctctaggatattcttggcctcttcttcgcccatgtcacctcccagcgatacgagttttgtggggtcggcatcatcaatctgtatcttgattaccttgccatgaggggcgggttttggtgcgtgcttcggccggtcatgcggttcggcctcaacaatatgcacagctctgattatggccagatcgccctttgaggcggccgaaggctggagccccataaccacgatcactcctgtcgggccaggcatcttgagcttaagataattgtggtgggaaatgacttcgaacttgttcaaggtcgcacggctgaagatggcattgtatttgtacgggatgtcgacaacatcgaacaatatttgctcttcgcgtctgttttcgcctgtgctgaaggttttgcctgagtaacgcgggacgggtgggaacttgaactggggtgggattggacgattcttgattcccccactcagtggtagccccttttcgtcccctaccctgttcacggcaccttgctgcgggtatggcgtggcgaagggtgaagtcatggcttgcgcatgaggttgtatcatgatgttcggctgcccagctccgattggtgatgcttggtgaggcgccatggatgggtcaaacgtagtctgggtccatgccatggcgacctggtttggtgcttggtttgtcccgaagcctggtgtcggtgcttgtggccgagcggttggtgccggagcaacattgacgaagtcgaactgcggtccttgactccaaggcgaagcccccggacccggctggttcgacggcaaccaactaggcgcaccttgacctgtatttccctccggctgggccgaaggggttgtacttgaaatgttgtggggttggttgaattgctgaaggaaagcttgaagctgtgcttgcagagccgaagccccttctgccattgcttgcgatacttggccaggtggttgagagtgtgcttgggcagcgacacgctgagcttgcggctgcacgtgcagggctgcagtcgaaggctgcccggcgaagtacactggcgcttgcgtggcctgtggcagaaggggctggatcggcgcttgtggaaagacttggggtgggacatagcctgccgaatactgtaggattagggccgaagcggccttggcccgcctcgccgcctcatatgcctgctgctgttcttgcatctgtcgaagcatgtcttggagttgtgtcatgttttgccgcatggcctccatgtcggcttcggcttgtgtttcagggtcaggattgacttgagcggcggcaagcgcagtcggtgccatcgccggctgtgctgatacagtttgggacaccagcggttggcttgtcgaaaggacctccgccctggtctggagtgcccttgccgccgcggctgccttcgccatgtcagctgtgttcggcacctgcccagagacgacaggagccgaggtcggtaatgatggtgcgggtgcagaggcaggcggcggccctccctcttcggcaatggacgccgaaggctctgctccctcttcgacggccatatcctccccggcttcgttttcctttcgccttgtaaccttctccttcacgaccctcttcggtggcatttgctctcagtggtttcgctcagaggtccccaaggtcggcaccagctgttgtcgaaacgacaaccgcatacgtcgaaggacgtggtcactcaatggtggctgaaaagaagtgaagtatattaaattgagaattttttgatccccctattacatgaccctatgggactatttataggctcattataggttcttactactagggtttaggttacacaggggaatttacatgggtatacagtgtaattgagattcacgggcacctaatgggccgtcaggctgttgttggcccaacggccactaggcttgtcgagatagttcggcctcattggcccccgtgaggccaaacttgctatggcgaagttgtctcccttcgacgtacactcttcgccatacatccttcgcccaagaggccttcggcttggcgagatccgcgcgattctccgcccctcgccgtcgttgttccatagtcttcgccatgttagcttcgccttgactattcttgacgcctcgggcttgaatcctcgctggtcgcatggtttcggcaggcttggtcgaagggcctcatgccataccgccaacaacagtgaaggggtccagattatcccagtaagcagacaccaaaaccctatctagaacttccctcactggatttgtttgtttgtttgtcctggtatatttgcctccccctctatgtaactctcttaattcagcagtagaaataaaagcattaaatttggcagcccatctcttgttgattatactattagacttttcctcagcacttcttactaaattgtagtctccccctatcattacagcctcttgctccaccagcaccatctcagtcaattcatggagaaatctatcttt

SEQ ID NO: 20146 - DNA, 7870 bp, Oryza sativa
tccttcaacaaagtctatatccacattacctctgccgttgcattagcaacagctttatattctgcttctgtactggacctggagactgtagcttgctttgtagcactccaggataccagatttgatcccaagtaaacaacaaagcctccagtagacctcctatcatcaacagatccagcccaatcttcatctgaaaaagcacttacaagagaagaagaagacatgttaattcttaacccaagattaacaatagacgtcacatatcttaaaatcctctttactgccatcgtgtgttgcactgttggacaatgcaaaaacggacaaaccttattgactgcaaaaggtaaatctggcctggtcaaggtcaaatactgaagagctccaactatacttctgtactttgttgcatcatttattcctaattcagaaccattataagctgagagtttctctatagtagagtgaggagtagaaacaggtttacaagcaatcattcctgcccttttcaacagatctgaagcatacttttcttgtgtcaataacataccatcactaaccttttcaatgccaagaaagtaatgcaaatctcccaaatccttaagggcaaaatccttcttcaaatcacttaacaaagcatctgttgccttctgtgtggagcttgccacaatgatatcatcaacatatattaaaacaaacatattaactcctcctttactttggaagaacaatgaaatatcagcttttgatgctttaaaaccaagatcacataatttgctgctaagcctagcataccacaccctaggagcttgctttagcccatataaagccttatcaagcttacaaatatgattgggtttactcttatcttcataacctcgaggttgtttcatatagacttcttcctctaacaagccatgaagaaaagcattctgaacatcaagttgacgaagtgaccaacctctagagacaacaatagataaaatggttctaattgtagctggcttaacaacaggactaaaggtgtcctcatagtctataccatatctttgtttaaatctctttgctactagacgagccttgtatcgatctaaagttccatcagacttgtgtttaatcttataaacccatttgcaatctataacatttttttccttacttggtggaactaagtgccatgtcctattattcagcaaagtactatattctagatccatagcatttttccagttttgattacagagagcttcatctaggttttgtggtttaccactagcagcaagtaaattatacctgactgttccatcagtgtagaccttctcctttctaatgcctctctatagacatgtcaggggacgtgacggctgttgctgatcagatgtcgttgtcgacgactgctgctgctgtgatgctatactactgcgactgccatcatgactgccgccatcattgcccccctatgtcgcacggcgactggcgctagcagccgacatgtcgccactagaatgggcgacatcaccaccagatgttgtgtcaggctgcacagactgctgtggcggtgatcccagcatggagtcaggaccaggaggagcgggagaatcgccctgggagtcagcgccgtcaggatcttctgcggcaatttctagatgatctgccgcttcattttcttcactattttgtgcactgttttcgtctgaattttctgctgcatgctcaatagagacattagaatgttcaggagaatcaaacatatgatcattcacatttacacccgcactagcaacatcaggattcaacaagttaggtggaagaagaagaatttcagaccgtagtcttgcaccgggcattggaatgcatttgagagaagggaaaatttttttcatcaaagaccacatcacgtgagatatagatcctgccggtagatggatccaaacatttgaaccctttatgaatgtactatagccaagaaaaacacattgtgtagatcgaaattgaagtttgcgggtgttgtaaggtcgaaggttaggccaacaagcacatcaaaaggttcttaaggaagactaatcatgtttctgttttaacagacgttctagaggtgtggcaaattggataactctagatggtgtgcgattaatgagatatgtagcagctaggaaagcttcatcccaaaattttagaggcattcaagcatgagcaagaagagcaaggccaacctctacaatgtgtctatgcttatgctcagcggagccattttgttgatgagcataaggacatgaaacatgatgactaataccaattttggtgaagaaagagtgtagcttttcatactctcctccccaatcagtttgtatggcaattatcttgtgatcaaagaccctctctacaagttgctgaaaatcaaggaatttctgaaacacttcagattttttctttagcaaatatatccaagtaaatttactaaaatcatttataaaactcacataatacttcctgcccccaaaagaatcaggagcaggtccccatacatctgaaaaaataagttcgagaggcacacttgacacacttgacttaggatatgggagtcggtgactcttagctttctgacaagcatcacagactcctgactcacttatatctcctaaacatgggagactattattcttcacaatttttgaactattgcaaaagaagaatggcgtaaacgactgtgccattgggtgaagctaggcttgatggctccaagggcttgcttgaatggagggatcgacgactgtcgtaggagatataacccattgcggcgaggtcctctaagaagaagattcttggtgtccagatccttaatagcaaagaaatgagaatgaacctcaataaaggcatgattatcaaaggcaagtcgatgagcagaaataagatttttgtgtgcatgcggaacatggagtatatttttgacacataaattgcgtgtgggtgtatgaatttgagaatggcctatatgtttgatttccataccttcaccacttgccgtgtagatctgatctttgccattgtatttttcatgggtcgtcagcttctctagctctcccgtaatatgatccgttgtaccggtatcgatatactagttttgatcaacattatatgatgcagctgctgctaccttggcatctggaacaaaagaatcatcaaacctgtgccaacagtcggcaacaacatgccctatcttgccacagagctagcacgtggggcacggcttggagttgttgtagcggccgcctccattgtagccgcgcccgcgaccaccgcgatccccgcgaccgccattgttgctgaagttcccgcgagctgcgccattgctgccgccatggttgaaggcgaagccgccgatgctgccaccttttccaccgccgccgcgctttgcgctattagcgcaggaatagccatgatttgctgcaatctgtcgcagcttccctctggactcgaaactgagaagttgtgagtaaacttcaaaaattgaaactggttcgtgtttgcctaccaaactggagaccaccggttcgtagtcatcaccaaggccgaccaaaacatagcccatcagttcttcgtcgacgaggggcttgccggctgatgccatctcgtcagcgagtgttttcatcttgctgatgtagttcgatacgctgaggtcgtctttgcgcgtcgtagagagcgcaagccgtgtgttgagggcacgcgatcgcgactgggaggacaccatctccgtgattgccctccacgcctgcgccgccgtgtccattgtcacgacttgcgtcaggatctcctttgacaaggaggagaagaggtagccgaggatttgctggtccgcagccaaccaggcttcgtacgccaggttcatggtttcggtggccctgccaccttccttctccgttggaaccatcaccatctgggacggcgacttggtggcaccggtgagatatccttccatacgtgcgcccctgatcacggtaaggaagttgctgtgggtaagtttgtctaggatcgcttgcctagagaggggattggaggtggcactactgatggaggaagccatcgcccatagatgcaacctcggcgtggcagataggccctgataccatatagaaattatgtaagcattatcacctcgtctcgaggccgcgtaattgtatttatatgagttgggaatagctcccaaacgtggcttacaagaatgagatcggatcagccagagttcggttgtaacagcccaaccttatgtcaaccaatccatatcacatgtgatatttcatgtaacaaactaatggctaaacattatctctaacagtgccctcccctcctccagatccgatgggaggggatacggcggtggcccggcggcggcggcctctccttacctcctcgtcgtggcctgtgaagactagctctacccccccctctctcctctcacctcagtggccactagcgtggaggtgggccaccggatctacccacttctgcgatgttgtcctgctgcttctacctccggtgagtacatgtgccgacgcacatcctctttctctttccatccatctctttctacccgcaccatttctttcccttaacattatcttgatttctagatttggaagaagcttttctctagtagatccaaccgacgacgcgcacggagggatggaggcggagcaatttttgaattttttttaacactaattttggatttattttttatggctgtgaagcatctgctcggcccaaattgagttgagctagttttttttttcaaatcatatacatcaaaggtgccggttcttaaactgacacctttgagtcattctcatcagtgtcgtctccatggtgccagttgggaaatccggcaccgatgggggttacccaaccagcaccaatagcccattctttagtagtgcgaatatcaccatcaatactggttttatctgttagagaagtcactatgcccggttttacggataaggaatataaataggattaaacttatatctgagagagttatattggcctttttccttagtaaaatgcccaaaacagaaaaccctggtcttaacctctcatccgttacgctagcattgctcctattccataaaaagataaaaatgaagaaaaaagtttaatcacttctaaataacgattatacccgttcaaacttttttttataataatacaccttcaagtttatactgccactaactagagtggtaatataaatagatctaaatccttctatcaaatgagatcgacggtttagattgcttcttactaccagtacagagcatgagcatcctagtgggactataattaagtgagggtgtgagatggagtccaggcgttgatcccaacgaggaggttgcacgtatgcgcggatatgcctggctcatgagcgaagctcgatttaaacattcctggcgtcctagctcgggagatacgggcctgcctcgcacgtgcatgcatgtgagctacatgcaaataccccctccgtactataaaaaattcaatcctaactacttcaatcctaactacaaacctgacttgttatttttggacagaatagtaacaatactctctctattcaaaagtctaacacctatttattttattaccaagattaggaagtaattaactcatccaccatatgaaaaaacttatgagcgtgcaatccataagtactaaaatgacttcttttttccgatcaataatttaatttagcacatagtgattaccaataagatttagagtttgaaacatatcaaacaattttagatttctggatggaggaaatatataatatacctgcacgcgggatgcgagacagcgacgaaataccaaagcttgccctaattaaataaataattaattcgacgaagactaggaacgaccaatgatatctattggccaaccatataacactgtggaactgcatatcgaccagtatatatgaaaagtcacggaggaggccagcagccagcagccagcagccagcaggtatgtatgtatgtgtgtttatagcaaatccgttatattatatggttgtaatctctatagtactagatctgtatgactactgtattaattatatgcttacgtgatcctaacttatcaatggtagaacacccagacggatattaatttagaatgagtattgtggtgagcaagtcagcgccggtggtcgtccggccatcggagccggccacatcgacggccgacaagatccttctgtcaactttggacaagcctgttgccacgataccagtgaccgtgctacttgcgttcgaccaccccatccatgacgccaccgcggagaccatcaagacggctctcgctcaatcactcgtccactactatcctatcgccggccgcatttcctgcgacaatgacgacggcggccatttctacatcgactgcaccggcgaggatctcggggtcacgttcgtggccgcgtccgccaactgcaccatggaggagctcatgtgtctcgtcgacgaccaggctcccgacgacgagacagcggtggtgcagcagctcgccttcaactgcacgcccgacgaccttcatcaccgtctgctgtgggtgcaggtcaccactctcaactgtggaggcttcgtcgtcggggtgacatggagccatggcgtggctgacggtcccggcatagcacagttcatacaagccgtcggcgagctcgcccgtggcctgccatcgccgtccgtcgtcccggtcaggttggacgacaagatcgcaacccaagccgtacctcccttcaccatggccgttcatcgcttcatatccggcctcaagccagtatcaaacctcgacgtacgcaacgtcaccgtctcatctagccttatcaaccacatcatcgtcggagctcgtcgtcgtgccaccgtgttcgaggcggtcgccgccgtgctctggcagtgccgtacacgggtggtgatgacggatcctgaggcccccgccgtgctgctcttcgcggtgaacgcacgcaagtacctcggcgccaaggacggctactacggatgctgcaccgccatgcacatggccgtgtccaagtccggcacggtggccaacggcgacatcatgaagttggtcggcatcatacgccgcgccaaggagcagataccggagcagctgaaggcagacgacggcgagatgatgctacggacgatggtaggggagaagcaggtgaatggatacgagagcctgctctacttgacatcctggcgaaacatcgggttcgaggacgtcgatttcggcagcgggaagacggcgagggtgatgacctacccgccgaggatgctgtccatgatgcccaggattgcgcccatctgcttcatgctcaaggccacagaggaaggggtcagggtcatgtcagactgtgttacggctgaccacgccgatgccttctatcaagaaatagccaagctcaaagccaccacctgattataactatatatgcgagctatctataccttcttcaatatgccaattatgatttatctacaataaaaatttgaatatatataccgtgcaagagcatgcatgaacaagtaattctatatgggactcttctacctgtatcactatttcactatacatttatggttctttaatttttagatatggaaatttattactggccactgggctatcaagtgcacatagcctacatctatatctaattaaacaatagagtaaaatgcattagcggtgcttaaacttgtaggattgtgtcatataggtctctaaactcttaaaatacatatctaggttctagaacttgtcaaagtgtatcatttaggtctcaaattgacacatcccctctaggatcctacgt

SEQ ID NO: 20147 - DNA, 29359 bp, Oryza sativa
tctttttcgttttcttctcattcttctttttttcctttttttctgcacgggtcacagagaaaggagaagaaagggaaaaaaagaagaaaaaagaaaaaggaaaaaaaaattaaatgggacccatttgtcagtcaaaataatgccagccatatcatgtccgtgtggcatgccacatcaacgccacgtaggatcctgaaggggttgtggcgatttgggacctagatgacacactatgataagttctaggacttgaatattcattttgagagtttagggacctagatgacatacccctacatgtttaaagaccacccgtacactttactcaaaaaaatacataaggatttcgcgactactttcgtccatcgtcgttatcatacgtatacgtgatgggaaattctagtgaaacggactctgagatgagaaattctagagttcgcttatttaggataggcctcgattccaagcacgatacgatgaggttttgctttgattcttcagaaaatggaaagagtatgagataaaaatcgaaacccctcaatctcagttttggattatctccaaggatgccaccagatttcatggtggagacgattttagacatcgtcttgaagctgcgggagtctagctggaggtaggagacaaacctgtagcactaggacccacgcgacagtgagaggagcgaagcgaggactattagacttgtggttgcttgataggcttggtgcgcttaagggccagaggcggaggggaggagaagggaagaaagcgtgccggctcaactgcagtttgacagaagaaatgggctaaaagtggcccagagaaaaagaagggtttttatttagatttttatttaaataaatgctgaaatgatatttgtattattaaaattaacaattgaactctgaaaattctgaaagaatttcagatagtgtaattaattatggagaatttaataaaaattaaatccagctatattttatttgggaaattttatttcccacatttacatcaccggaaaattaattgaactttaggataaattctacaaataatttataaaatgatttataaatctcttaaacaaaaatcaaggtggacagtccatcccgttctcaatttggattaggacgatacatacatatatcctataccccacaagaatcatgcatcattcaaaatttctgttgtcgctgctcttcaaaatagaggtcaatgagatcaatttaatgaaaatgacttgatgaaaatacgttcttgagatctgtgaactcaatgatgtcatctcttttcaaaggagatgtgcaactaagacgcaacattacatgcaactccaatcgttcgtccgggcgtttttgattcagcgtctatctgttgaccgtgtgttcatgtgtgtccttccatggcagtctcacgacaaaacaagctagtacagtgatgctagacctacgttttctgtgtttctgtgtttccttccatggcagtcccaacgttccaagcacgactgctttatcaagccactccaaaactagatagtacagtgatgttagaccaaacacatcgctagacctaacatatagccaggtcagtttagaattcatttttaattattttcttcaacatcatatatatctgtaattgcgattttcttatttagcagggatgaaaatgcaattacagagacacacacacatatagtttcttcgtataaagaagatggtgaatttgaattttaattaattacataatgtaaatatttctcaatatttcctcaatttattatattttcatcccgttgcaacgcacgggcacttttctagttttttaatacatgccatagcagtacaaacaaagatgaagaaatattaatcgtgaagaaagcatataactgaataatacgaaggcacatggtttctattattgtacttccatcgatacattgtgtagagatccgatccagtcaagtaatctattattcttttaacaaatcggcacgaggcggtgcccattcattgaatatagcacaaaaaagtttacatcttcatatggtttaaactcaagcaagcgcttctctctagcgagcgaccatgttctagctctcttcattgtctacctccctcttcagatcttgaccctcatagaccctgtatcccattaccagtagagaaaacccatgaatacatcaacctttagctatgtattttttagttggtcccaagaccactcttgagatatgcctatgtggcatagtctgttggtggtttctataggactaggatgtgtatttgtgcgtttataaaggagagtacgtgcgtgtgtatatgaacgctcgtaacgtgtttccagaacaaaaaaattcataggaaagccactctatccatttgtttatatttattaaaccgagcactattcatatttaaattgtgttcgtttgtcttttctgaaagaaattctaaatccataaatatgtagatatcatattatccaagaatattactacatgcttaagtattaatttttttatcattatgctctaatcatttttttgcgaagactctaaccattttaaaattacggttacaatagtatggatcaatggtgacagttatattaaaccgagggagtagggagtaccatataatagcctactcaaccaggcaaaattaatgggcaaaccgatcaaagctatgccaaacaaaagaaataagaccacttttttatgggctttatctacctacggtatttataaagtacggaggacgttgatactaggatatatgtgagattgtatctagacaaggacaagggtttatactggttcagaccctctaaaaagagtaatagctctaacacagtttatacgtatatctaggaaaagactacaatgattacaaatgaggagaatagactagctaaggcaatccgtcgattagaactcgccgagtatgacttagcgagagcttatcagcaaatagggcttcggtttcctctggattgtctactgatgtggttggtggttatggctcgtaattcaatgatctctatcctcataagggctttatatttgtatcgataattgattttcctccaattagaaccgatgattgacttttaatttttctacaagtagaactcggagaccctaaatagaaaattaaccatgggaaccttgtgttttttgaataggactttagagccttccacccagcgaagacagtttccgtccagaatcatcaattttattactgtttccaagggcatcttcccgtataatattaggtttggtattaacatacaacaaaaacccacatataggagatatgccttatatataatcctgccaatttgactcctttaaatataggtcctatctgattcgtatccctcaactgcaataccggatatctggaacacccccgccccaaaaaaaaaactgttataacccatgtaatttaactcacaagacaatattgatggtggtatttgtagatggcatccacatggcaactaggtcatcaacgaaattaaaagattgatgtgggacctacatgcaagttactcttatttagtcatcttcttccaccaccattcctctctctgatcgagctggcggcgatggatacacacattgactacggcattgggcctgacgtgatttttcgccgacctcgctgtcacactcgaagtgctcaagaaatcctctcaccgacctcgttgtcagcctcttactcctttccattcaagttatccattcattaattaacacacacaaatatattttaagttacaaaaaacaattacatatcaaccgttagggcaacagcaatgttacttgcccaacttggtagtagtgtgtcagtagtgtgggccagggctacaggcagcagtaagcaatcatgcactctacaatgtatcagcatatcagtgggaaacaaggtagggccagcttcagaaaaaatcatggatggcagtctctagccgtgacttctttctataacttttgttaggaaaactgggcatagtttaattcctgttacccggttgtagtcgtgttaccgggctgcatctacttactagtctcacaatggttgctaccgggtaagaagagggcatttaatgcttattacctgctgaaatgctacattgtggatgcccttagagctagtataatagtatagcccactaatagctccaattcatctatagctaatctaatagtcaatttatacaatagttgcttactatactattaatatatgatctcacctatcgtacacacagtgtgtcttggagtctgtgctgcagctggctatagatctgtagcccgctactcttctctctcatcgtttatctcattaaaacatatttacagctggctaagagcctgctattgtacctactcttgggatcggtttgaagcccttagagttataaaatagcaccataaaagggctcatggctcattcgtctttacgttgcttcacgttctctctgcggacagccacggcgggttaatattgctatgatgcttttgttcctttggtggcatccaccttccttgtgacgactcgtctctgattgccattgcaggttgcacataatatgctcatagtgtggcgacgtacgtgatgattaacatcaacagtagagagggtattaattaatttggacgtaataccgttatggtgttaatatgtatacctataataaaaccatatttaatattggagcgctagtagataagaattaaactatttgaaagttagctatagcaagtctgcgtgaagaacgtgcatgttttcttattagagagctcaagcataaaccaatatataacgaatgatgtttattccttgcaggcacggccactctcctagcccatactaccaattaatatttgatgggacagtctctagtcatgcattatttgattactaaagaaactttgtagagaggaagttataagaaacttgttgcttctacttaaatgtaaaattgaatctatagtaaggaaagttctcgattttagttttattgcatcaaaagtttacaattcaccatataatagcatctaacgtactttccctcagctatacttccaagtcacttccgtctcttccaacctgatttgctatctgttgggaatcacttcctagctagatagactcgcacacactcctgataaacacacacacatttagaggcaaagaacagtggagtttggtgctgcacaaacgcagcgtttttctcttttttactcaattaacaaagatgctaagtacatgcttaaatagacaaagttagaggccaaaacgtgcgccactagcagccgcatgctactcttagccacacgactagatcatccatatgcacacctagtaattaactaagatcctaatggcccggctattatgctaatgactctactaaccagccactatttgtgtgctcctgcagcatctcacatacccggccgtctcgcacggctcttgggcctactcgtatacggatctcgcgtactactactatagcttcttcgggtaccttatcctatcctgctacctatacatttatttgctacatgcgaccaaattaagcaaacatgattatgcactaataacaagattatttctaacactatcttatttgacctatgttaactcagctacccacttagaatgacattctaaatttgtcatccattatcttctaacaaaatcgatatgccccctaccctatgtgtatatcgtcaaactcattctgtgtcacatgtacttatatatggatatccatctctcggtgaaccggtgacagtcttctttggctcgtggcgtgcatatgtggaggagagagataataggtactaactcttatgtaagagttacctctacctatactagataagtgagaagaaaagaaaggactatgataaaaataaagaaaaccttatagctaagccattttacaagttgactaatattattttcagatgagcttatagctagtatttagctctactattaaacttgctcttacgtgtattactcttttccattaaagccattcatttattgattgacagatatgcaaacatattttaaattaagaaataattgtatgttaacggttaggatggatatgaagaccttaaaagggctcatagctcatcagtcttgacattgcttcgatcacttttgtctcgtcaattccatagaggtaaccagtgctatgatgcttttgtttaaggattgtatggttgtatacatgatctgtaattgcttgtcctaacttattctcagagcgagctagagcctagacatagagaaagtatgagcattgtggtgagcaagtcggcgccggtggtcgtccggccatcgcagccgccggtgaagactacctccggcagcaagatcgttctgtcgcctatggacaagcctagttccatgatgccaaccacagtgctacttgcgttcgaccatcccaccatccaatcagagtgcacggcggagaccatcaagagaggtctcgctcaagcgctcgtcccctactatcctatcgccggccgcctttcctgcgacgacgacggcgatttctacatcgactgcaccggcgaggagctcggagtcacgttcgtggcggcgtccgccaactgcaccatggaggagctcatgtgttgcgtcgacgaccagcctcccgacgccgagacggcggtggtgcagcagctcgccttcaactgcacgcccgacgaccttcatcaccgtctgctgtggatgcaggtcaccacactctcctgtggaggcttcgtagtcggggtgacatggaaccatggcctggctgacggcttcggcatggcacagttcatacaagccgtcggcgagctcacccgtggcctgccatcgccgtccgtcgtcccggtcaggttagacgacgacaacaacgccacccaggccatacctcccttcgccatggccgtttatcagtttatgtccagctccagccacaaggcatccatcgaccacaccttcaacaacatcaccgtcccgtcgagcttgatcgaccacatccgattccgaggacgacgaaccaacgacgacgtcaccgtgttcgaggctgtcgccgccgtgctttggcagtgccgtacccgggcggtgatgaaaaatccggaggcccccgccgtactgctcttcgcggtgaatgcgcgaaagtatctcggagccaaggacgggtactacggaaactgcagcacgatgcacgtggccgtggcgaagagcggcgcggtggcgaacgccgacatcaacgacattgtagacatcatacggcgcgccaaggagcggataccggagcagctcaagatgaccggcggcagcgacatgacgatgctacgggagctcgccgatgaccatcgtctggatggatatgagagcctgctctacttgacatcatggcgaaacatcggattcgaagatgttgacttcggcagcgggaagacggcgagggtgatgacctacccgcagagggtggtgctctccatgtcgatgatggtaaaggctatgccgatctgcgtcatgctcaaggcaacagagcaaggggctagggtgatgtcagcgtgtgttacagctcaccacgtcgatgcattccatgacgaaatcgcaaagctcaacgccaccgcctgattaataaactatgcgaagcatttccctaaatgaataaaattggtcaaacccctactactgttattatgattatatcccttcttcaatttgtgatatttaattatctacagaaaaatttaaatgtatcatgcacgcatcaacaatttatatggtgttgacagaaaacacgaggcctggaagatctgcttaactccagtgcaggtccaaaactcgccttcggatatatgagcgtgccagtcgatttgatcctacaatcaacaaaaaatgaagacaaagaaaccgtaattaaatctataaatgatagccgatcggctgggtactgatgacatcatttattttagaccgatgtcatgtgtgcatcgatcagcagtcatgaataattaaggaagaactaaacctactcgattggctgtagacattaacaatatataattcttatgtcgatatatacttaaatcaagtgattgggatagatcggtcgccatgccgagacagtataaatcacttagatcgaaatataaatcaacaacaaaactatatacgttaatagcgtagccgattagatagatctagcatatatcggctaatactccgataccactctatattaagatattaaagcaaatagaatatatcagacagaagcataatatacttaaatgcaacaagatcttaacataaagggcagatttaacatgtcaatcaagcatataggataactatagttaaatcaggtaagatcggctgaaactccgatgctatactaatcggcaaccaggaagcaggctagagattgatattctaagcacgacttgatagatcaaacttaactgatgcagcattaagtatgaaaagaagaacaatatctagacaatcaagccactggatgtttcatagagtggtaagtatcttgtacaatccaagctaacaccgctatttaacctaatcggctgccttctactaacagatgttagctgattgtaggttagatgacgatattaccgaagattatacaagatatatgataacttgatgaattacataaacaagattagagtatcatagagatggaagcactaatcctgagaacacaagccgccataacaagttttacctcttgttgaagatcgaaaccgatgcagctcaacccgaaagcaagaactcgtcgaaacaaaacgaaagtaaaagggtggcgatgcgccaaaattgtattgaatgtgtgtgttagattaattacatggagctcggggtctatttatacccgagaattacaagatatgtccataccggacacgactattatctctaacaaactctaagataccacaagtctttacgacagacttttgcccacattaatctgtaagaaatttacataaaatattctaattaatagatataattgaattttcaggactctatccatgcgtggcaatcatcttgaagcatatcaactcaacccgataatgtacaccgagtcgtattcttggaatcggctgtatcggctagccctgtctgactcgaactctgccaatcctgaccgtagccaatccagactctagccgattcttactctgttttcgcgacagcccttatcttcgattccacttcgatctaatctccttctccgatgctgatattaccaaatttggtcattaacacaagccccccaagttcgggagatttggtaatgttccggatttgccgcgtatcaactccgagtaagtttcgcactccgccgttttctaaccgttactccaactctttaaatactaactgttgtccttgagaaatctcacaccgttatttccgccttcaccgctcaagcgaaactttatgctctctctctccggcgattcctccgacgcataaggcgatccccaggtgacttcatccccgaccagatttccgccctcggcgatgtcaacctccgccaatccgtcctccgcaccatcggctgagtatgcaaaggtaagtacccatcggctagatctctttctttcacagtagattgattttctctcgccttatcctgtattcttcttctctatccctacttgcatctgtagcatctgtccaatctggttgcaattccaagtctgtcacacgagaaccactattttcttggtccaatcggtagtcttgatcctactgaattcatcaatggcgaaaccaataggattcctttcagattggccaacccagatctaggtcactgaaagaatacctttaaatcttggccatctctagagaaaacctcacccgagaagagctggatcacatggttcaaacgcttatcggccagtaaaagagttcattgggatgaaattggaatcggccaagcactcgaccttaccatagccaactcagctaaggacgaacccctaatggcagctgccacttatttctggttcaacaccatcaacgccttcctattcaaccaagggccgatgaccccaactctcatagatatcatcatgatcacaggtctagatatcacctcatcggctaaccctatgagcctgaacacaaaaaaccaatatgacttcaagactaagagcataggcggctggtcgggctatattgcagcatacatgggccagggtccggtcaccccccgagaacatgtggctttcttgctgatgtggctagagaaattcttcttctttggatcaagctgtggccctacaaccaattggcaatctgtagccgaagccttagaaacaaagagacaattccctttaggcaaaatcctcctcggctacttgtaccaaatgctaaataatgcatcggctaagttagctgtcggctcagtagtcggagcgggtggaccatggtggctactgcaatcctggttgaatttagtagtcatgaagtttgtcaatcggccatttgtaacagaagctgaattcccaagactggagccgattaaagacagtgacagagaagaacgcactcatcggagatgcacctccttcggagaatatgcctccacaccaatcgatgcaggagcaaagctatcagccgaactgctcaaagattggttttgcagcttttatgaaggattccagaaagaagctcgagtctggttcctctatgaagattcaacgcttctggaaaatcctttggactttagattcgaagacatcaaccatgacagatatcagaaacccagagaaattttctcaactgcaatcagcccatgtatccttcctgttggcatttatcaaggaagaaacacttacgtctcatatgaattttatcatccaatgagctctgctaggcagtttggaatgggccaacttccaattggcttattttttgccgataagatccaatgccgagggaaaatctcatctaccttaatgatgaatcggctgcttaatcttcaaggacctccattgggcagcattgaaaatatagagttggcaagattcaggagtagaaacttcgacagatggtggggtgaatggaagctgcatcttttccatcaaccggcttcaatgttcaagatagacctatttccagatattgttccttagctatgtctttattttattaatcgtatttgaacaattattagccgattcatcgcttgattaatctaatcctctgttttatagacaacagaatcttctcccccacaccagagcaatagtggcaagatatcgaatatgccccaggaataattccaaatggaggtggaccatctcctccattcatcggctatgatgcccccaagacttcggctcttctccaaggcttaatcagggaaccagctgatgcaggcaagaaaagaaaaaccagatcatcgactatggacacatcagctccagctctcaagaagaaaatcaaatcaaagaaaaccaagccagttgatgatctgtctgccctagatccatctatcgaacaagcgctagatgaagaagagattgaagaggacattgatcaggctgcagccgaaatgagcgatacagagagaacaccatcggcttcacccaagcagactcctccaactccttctgccccagctcatttttcgagagtaagcatctctcttcgatttcctctgtaactactttacctttcagccgattactcatagatgtataatcacagaagaagaaaactgccgtgaggaagaaatcggcagcaccaactctcaaaccggctccaccagtaagatattctaagtcttctcattaactaatctcggccggaattatgtctaacatttatctttttatagcctcctcctcctccttcacctcttgtgcagcgagaatcaagcaaccgtactccatcggttgcagacagtcataacgtcgaagaggaagaacaaccagctgctcctgttattccagtaagtttttgttgatacaaatctgagatcagccaatcatgttttgatccttaaccatccataatattatctcttgcaggtcttagccgatatgttttctttcgacatcaaggattatctcgatgaaatagaggaagacaccaccagtaaagctgtagctcctctgtctgatgatgtgaagagaatgctcgaggatatctctcatcggctagaagcatcattagacaacttagtgaccaactgtggctcgatccaggccaggttcacagatatccaagctctactcccggatgaactaaccgatgcccttactccagccgtttaccttgagcaacaccaattcaagctggagaaggccaagtagagattagccgatcgccgggaacgcaaaaacatcgaagctacaatccagcacaatcggcagcttatgcacgaagagaagtccaagcttgatcagccgtctgagggcccgatcaagtcaaatattgatcggcttgaagctcgtaagattgatctcatggcacaacttcaagaatgcaacgccgagctggatatggagcacaagaagttagccgatctcccgtaagctatcgaagaacagaaggcgaggctgaaatcggctatcaagaatatcgctgatatgaccaagtccttgaaagtcatccctggaaccgatgctcaagatgcccaagccatagaagaagtagaacaaattaggcagagggctatatcggctatccaacgatatttgtcttagtgatattctgtataatagacctcaagaaattttttgtactcggctaagataccctagtgctattattcaacttgtctagataatcctttgtgccgattaacataactgccaaatatgctcaaaaatttgcaattttccatgtatgtgcccccctaattttacaatgtcaaaaacattgataaaattataaaaacgactaagggcaatataaccatatcgaccattgcacatcggcaaaccacaaccgattacaatatgaaaagaactaagtgcgatataaccatatcggtcatctcaaggcaatgtaaacacatcggctatcatgcatcggcaacatcagccgatcatgcgttaacccaaaacacttgggtaatatttcttcaagtatttgccatttagtgctctgccataaacttctccatcgagtccttgcaacatgtaagcccccttagataccaccttatgaatttggaacggtccttcccaatttggcgaccatttgctgaatttgctatcccgagtcccaatcgacaaaattaacttccatacaagttcaccttccgaaaaatctttgggcactactttcttgttataatgccaagcaactcgctccttatccttggtaacctttgcaagggctcgtaaccgtgattgaaccagatcctccctctcatcggccataaggttgtaatactcatcggctgttaaatcattttgcaattccgttcttctagagtcgattctaacttcccatggcaaaacagcttcatgtccataaacaagtttataaggaggaacctgtgtcgatccatgacaagccatccgataagaccacaatgcttcggctaaacgagtatgccattgccgaggataatcagaaatcttcctcttaatcaacttgatcaagctcttgttagatgcctcggcctgcccattagcttgtgtataatacggtgaagaattcaacaatttgattcccatgctatcggcaaactgaacaaactcatcagacacgaaaattgaaccttggtcagtcgtaacggtttgagggataccaaatcgatagattatatgctcttgaacaaactgtatagcatcccagaatcaactttcttcaaaggaatcgcctctacccacttggtaaaataatcggttgccaccaatataaacttataccctttacttgacggtggattaatcatgctgatcatatcaattccccaacctctaaacggccatgatttaataataggattcgtagtcgatgccggcgctctctggatcgctccaaatttctgacaatcttgacaacctttataatatctgaaacaatcctccagcatcgtcggccaaaagtatccagcacgtcgaagcagccacttcattttatgagccgattgatgagtgccacatatcccttcatgaatttcactgattgcaacttttgcctgatcggcactcaaacatttcagcaacaccccatcaatcgtccgataataaagctcatcgtccaacaatgtatacttcaacgttttatatcttaacttccaagaaaccgattgagatggatcccgtaaataccgatagacatcatatctccaatcatcggctgttgtgacagcaacttaaatctgaacatctttgatcatcggcttatatcccgatgccccttgggctaaatcattagcttcaatattctgctctcgagatacatgcttcaaagttactagccgaaattccttcatcaattcttggcacttgtcattataaactatcaacgtatcattcatacattcatattctcctgccaattgactgatcaccaacaaagaatcccccatgatttcaatagtatcagcttgaacttccttgagtaattgcaaccccttaagaactgcctcatactctgcttgattattagttgcataaggtttaatagtataggcaaactcaaagcatgccccccgaggggagattataactaagccgataccacaaccatgagtacagactgacccatcaaaaaataaagtccacaacacaacctcaaccaagccgatagaatcatcacgatggtcaacaataaaattagctatagcttgtcctttgatcgccttctgtgactcataccaaagatcaaactcagtcaatgaaaatatccactttccaatccttcctttcagaataggagccgataacatatacttgacaacatcggccttgcatatgatagtacattcattggacagtagataatgtcttaacctcatacatcaaaaatataaacacaagcataactcctccacaggggaatatctagtctctgcatccaagagccgacgacttaaatagaacacaaccctctcttttccttcaagcttctgaatgaagaccgagccgattgacttatcaccggccgataaatataaccaaaaaggtattcctttctgtggaggaatcaaaactggaggggaactcaaatattccttaatattatccaaagccttctgttgttctgccccccaagtagattgctgatcggccttcaatctcaataatggtgtaaaaggttctaaccttccagacaaattagaaataaaccttcgaacaaaattaattttgccgatcatctcctgcaattctgtcttgtcctccggaggtttaatcatcttgatcacattgatacttctctgagttatttcaatccccctctcatgaacaagaaatcccaagaactggccagccgatacgccaaaagcacactttgtcggattcatcttcaagccatatttcctggtcctctcgaaaacctttcttaaatcggcaatgtggtcttctatttctttagacttaacaaccacatcatcaatgtagacttcaaccaaccagctgattaaatcatgatatatataattcatagctctttggtacgtagctccagcactctttaagccgaaagtcattacaacccactcaaacaagccgattgcactaggacacctgaaagccgtcttatggatatcttcttcagccataaagatttgattatatcccacatttccatccataaaacttaatatcttatatcctgaagcagcatcaaccaactgatcggccactggcattggatattcgtcctttggagtagctttattcaaatctctaaaatcaatgcacaccctctccttgccgttcttcttgataacaggaactatgctagaaacccattcggcatatcggcaacgacgaataaaactagcatcatataagcacttaatctcagccttgacaggttcgagcatgtcagctttgcatctcctaggaggttgttgatgtggcctaacccctggttcggtaggtagccgatgttcaacaatcgatcggctgagtccaggcatctcataatattgccaagcgaagcaatccctaaattctttcaagagctctatcagcttggttctaaactctgaagataaattctgactaataaatgtcggcctcggccgatcgcctggacctatatctatgtcttccaaatcatcggccgacataaaaccttgaccttgcttgtcatcgagatcatctactgtgtccttggtgtagacgtttgaaccctccacgatgccctcaaagtaatagcttgggttctccatcttcaattggctgtatatcagaatcggacacttttagaaaatctccatcccaaactttgccggataaacaatcaaggccgtccatctcccaaagagctaaattggcactagcaacattgactgacctgtcggctggcacgatttctatcttgtcgccttgccattggatcaagcattgatgcatggttgaaggaatacaacaattggcatgaacccaatcccttccaagcaacaaactgtaagaacccttcccatcgatgacaaaaaacgtagtaggaatagtcttaccgccgactgtcagctccacatttagaacacccttggtttctgatggattgccaccaaagtctttgagtaccatgtttgttttgatgagatcttcggcgtttctacccaacttcctgaacgtagcataaagcatcaaatttaatgcagctccaccatcgaccatcatcttagacatcggcttcccattaacatagtcatttatatacaatggtttaagatgccgattctctgcaccctcgggctttttaaagactgcttgttctggtgatagaatcaatttagcctattcttcttctgtttcctcaacatcggcttggtcgatcctaaattcggctggcaaggtaaaaaccatgttaaccgacgcaatcacaatgcctttccctttggccaatctctttgcttcatcggctacaggagcttgtttcttaacgcgccattcctgcttcggctttgttttctttagccgttgattgatctcttgctcgacctcctgcaagcgttctcagtttctcaatctttgaacccttctcttctgattctttgtaaatatgccaggaggacaccattgagtcttcctgttttcatcatcctccgggtcatgatcctgatttaccgggcccaatctttgatgaacaggaacccttgcatgcttcagtcgattgcccttaatatacgaccggcttgaactctctgcaacgttaccgcatccaggatagtcttcaatatatggcagcctcataccctcattccaacaaaatctaaagaactcacaaccccaatgaggatcgaaaccatcatcaccttcctcgtaatgcttctcctgttgtttattatacttcctttggtacttattgatgatcttagccgaattcatttgaaaaccccttgcacggcccccatcggctgtttggccagctgtatgaaccatatttacgggaaaaggattaccatcaaccttcatcggcttcttggaatcatcaaatttgattttgcctccttcgatagccgattggatctgctgcctaaagaccttgccatcattggtagtatgagatccagaattgtgccacttgcaataccttttcttgcctaattcctcagccgatggaatagtatgaccagcagggagctgaatttgcatttcccagagtaatagatcaaaaatcttgtcagccttggtaatatcaaaatcatacctctcttcttttccagaattcttcacccattggcatggcataacctttttgctccttacccactcggctgcagctatctcagaatcatcatcctcatcgtccgatccacacatataagaacagacatgattaaccttcctagaattcctcctagcttcagcaaacctctgctcgtgcaaagttaccttttgtgtaagatgcggtaagctttcaaagtcttcagacgagaatttctccctgatcggagcaatcataccctgaaaagccaaatcggctatctgggcatcagttaagctcaagctaatgaacttattcctcatctctctgaacctctgaatatattcatgcacgggctcgtcgtgtctttgcttgattgctgtcaaattgtacaacttcatctcatgtaccccactatagaaatagctatgaaactgcttctccagatcggcccagctgttaatcaacccatagggtaaagcagaaaaccaagtaaaagccgatccagccaaagacaaccggaacaacctaaccctcaaggcatccacagccgatgcttcaccacactgagctaaaaatcggctaatatgctcataagtcgatgtactatcttgccccgagaattttgaaaaatctggaactttgaaccggttagggagagggactctctcaaacccttcaggatacggttgtcagtataaatttccagtctcttttggtttaagcccgaactgttccctcatcacgtcagcaattacatcggcccacggtcgttgttgagctgctccttgcgattgttgctgcatgggctcgaattgactgtactgaggagcaaattgaggctgaattaatcccccttgctgatattggtcttgcggggaaggaggttgatattgataacttaaattgcccccctggtaattctgctagtttggctgaatatttcgtaccaagtgctcagggacaatctgaggtactaccgtatgatccagctgcacgtgatggaccaaatgctctggaacaacctgattcagagtatgttgcccagccgatggattcatcaagccttgctggtgaatcggttggatagtctgctgtcttgatggcgtctgctgaatcggatgtacaatctgctgccttggtggcgtttgttcaactgactgcacaacctgttgctgaattggttgtacgacctgttggattgggggtgtttgttgaatcggctgctgctggactagatcaacagtaggttgaagtggtagaaacatggtagcaacctgatcctgcgttagccgattcgcaacctgcccactatgctgtgggttctctctcatcaactgccgaggattaaccagctgacctggtgccgacattgacggagtagatggggaaatcgataccggcgccgtcggctaggctgatgatgcaatgggaggaaccgcttgaataggtggatgaatatcggtgaccaaaggccgataattcggaaaggtacctcctggcaaataaactgggcctgcagcctgatgtttagctattgaaccatcggctattgacttcatcatgtttgacaaggtattgactaataccccagattgattgatgaaagcattgtgcacagcatagtcaacccggtcttgaaaattattgaaaaattcctgtgacgcactgccatcttgattaagacttcctcctcgtggcccctgagtgccatcaccttgaactccatgtactccttgagagtggtcaccctgattctcctgagccgatccatttgtagcacctttgttgctcggttgagccgagccacctaaggcttgtttcatctccccatccttggaagaaccggtcccggggacatcagccactactcgcacctgatacttttgcaccactgttcccttgcgggtctgcatgaatgagttcaagaactggttccgtgcttgctgcatcattgcttcaaactccttctgatcaggtgtcaatttgtccagagtgatggtcatgacgttgccctcattaacctcagataggtctaattgctggatcttctctttaacagaacctgggctagccgaagacggcgatggtggcggcttctcggccatgaggaaaactgctttctgacttctaatcagtcccaatgggcgtgccaaaagcgtgttgacagaaaacacgaggcctgggagatctgcttaactccagtgcaggtccagaactcgccttcggatatgtgagcgtgccagttgatttgatcctacaatgaacaagaaacgaagacaaacaaaccgtaattaaatatataaatgatagccgatcggctgggtacagatgacaaatcatttattttatgccgatgtcatgtgtgcatcgatcggcagtcatgaataattaaggaagaactaaacctacttgatcggctgtagacattaacaatatataattcttatgtcgatatatacttaaatcaagtgattggttaaatcacttagatcgaaatataaatcaacaacaaaactatatacgttaatagcgtagtcgattaaatagatctagcatgtattggctaatactccgataccactttatattaagatattaaagcaaatagaatatatcagacagaagcataatatacttaaatgcaacaagatcttaacataaagggcagatttaacatgtcaatcaaacatataggataactatagttaaatcaggtaagatcggctaaaactccgatgctatactaatcggcaaccaggaagcaagctagagattgatattctaagcacgacttgatagatcaaactcaactgatgcagcattaagtatgaaaagaagaacaatatctagacaatcaagccgctggatgtttcatagagtggtaagtatcttgtacaatcctagctaacaccgctatttaacctaatcggctgccttctactaacagatgttagccgattgtaggttagatgactatattaccgaagaatatacaagatatatgataacttgacgaattacataaacaagattagagtatcatagagatggaagcactaatcccgagaacacaagcagccataacaagttttacctcttgttgaagattgaaaccgatgcagctcaacccgaaagcaagaactcgttgaaacaaaatgaaagtaaaagggtggcgatgcgccaaaattgtattgaatgtgtgtgttagattaattacatggagctaggggtctatttatacccgagtattacaagatatgtccataccggacacgactattatctctaacaaactctaagataccacaagtctttgcggcagacttttgcccacatttatctctaaggactttgcataaaatatcctaattaatagatacaattgccttttcaggactttatccatgcgtggcaatcatcttgaagcatatcaactccacccgctgatgtacaccgagtcgtattcttggaatcggttgtatcggctagccctgtctgactcgaactctgccgatcctgaccgtagccgatccagactctacccgattcttactctgttttcgcgacagcccttatcttcgattccgcttctgtcgaggagtgatcctctctagcgggagatcgtgggatccccctttcgtgagttcgaccgggggaaaaggcccgcctctgaaaatcacgtatccgcccactagactaccaggtagtgtgcacacaacaagattatacaggttcgggccgcaaaggagcgtaataccctactgctgtgtatgggatttaggcacaagttacaaaggtccctaagccctggagattgcccttacttcctttctcattgagctcaggttttttcccttggtcccccccttttcggtgggaaggtcctccttttatacctcaaggggaaaccacatgcaccgactctactattcttctctcgggtgggggggagcccacccttccttgaccggatcttgacccgtgccttcgcctggaagctaagccacggtttgtccttgagtggggttcagcgccgtcccttgcctaacacgggggacacccctgtcaatcccccattaatggatgaagaattgtggtggccgtcctctcatggggaggacctcgaatgacccttccgatgggacgggtcatacctacctccactctgccggaggtagatgtgacgtgggggcacatctgtccgtccagtcaaatgtgaccggtgacaggccggtcacagatcagatgtgaccgacgacgggatgtgtgagcgcaagcccccccatcgagagtggcgacagttccctgaggtacctggaactccagaccctcgctgtcatcgccatcgtcggcgggggccttcttcttagactcctctcgctgatcattggctggggtcgtgagggctttgccctcccgtcgactctgccgcttctcctcatcggcttttcgaaaccgctcggccaagttcttgaccgagcggcagtcggcaagactgtgccgataagtattgtgcaccgagcaccacttgtccgcggaccgacccttaccagaaggggcggtatagctcgtcttgccgtcggtggccctttccctgcgcggggcccgcgagggcccatcagccgcaaggacgtggccctcgtcatcagagcgggctggcttccgcttgccccttctgtcccgccgcttggagcggggggcagtctcgggggcggccgctgccgccgcaccggtgctgggggagttccaagcccacgcctcctccttctgagccaccttgtccgctagctcgaagagctcagcggtggtcttaggctccttggaggcgatcttctccagcttgcggttgtgccgcacgccgttccaaaatgcataaacgaccgcgtgggctgggatgcatggaataatgttgcggacctagcagaagcgctgtatgtatgagcggagggactcgtcgtacttttgctgcacagcgtgtaggtccgcctcctcccccagacgggggtatgtgccctggaagtttgtgataaactgctggcacaggtcctcccaggagtggatggagtcggggggctaggtcataagccatccacgcgcctgacccttaagagccatggggaaataattcgccatgacccggtcatcccctcccgccgccacaatgattgtggtatagatctggaggaactcggagggattgatgctgccattatatttctctgtgaggttgaggcaaaactttgggggccaccggacgttccggagactcgccacgaaggccttgtaaccagttccccctggggtggacgtgaggggcgggccgccgcgcgaggagaaacgcggcactccagacgaggaggcgccttctcccatgcgggtagcgcggcgctcgtctcgtcgacgctcaatgttgactcgagcgtcctgctccccgtataggctatcgtgacgcctccgactttccgaggcccctgacgacgttggggcccgtagatcgccttgaggctgtggctatccgacgggccctcctccttgctgacgaggagagggtggtggaggtacgtgatgtacctgtggcggtggaacggccacttacggccaaccgccgctgggcagtggtgaccaagttggcgacgtcgtccaaccatcgttggacgggggcctccggctccacgttcaccggggggtgccgcaggagggctccccctgcctaaagcgcgccctggggcgagctgccgtcgcggtaggtcaggcagcggcgcgctcggacgtgccatggcctccccccatccagaggcggggagagggccgagccacccgatcaggcgtgaacctccctccgcagggggtcggagaggggcggagtccgcgagccgcgtcggcggtgacgcgggttgcgactcccgctggcaccttcactcctggaaggagtaagggtctgcacctccacctcttcctctaaaacctccaccatgatcgttggggccggaggaaggcttggagcggaaggaaacgacttctcttcgaagcgcgcgaaatccccctacctggcgcgccagctgtcgaggaatgatcctctctagcgggagatcgtgggatccccctttcgtgagttcggccgggggaaaaggcccgcctctggaaatcacgtatccgtcccctagactaccagctaatgtgcacacaacaagattatacaggttcgtgctgctaaggagcgtaataccctactgctgtgtatgggatttaggctcaagttacaaaggtccctaagccccagagagtggcccttactttctttctccttgagctcaggttttttctcttggtcccccccttttcggtgggcaaggtcctccttttatacctcaagggataccacatgcaccgactctactactcttctctcgggtggggggggcccaccctaccttgaccggatctcgaccgtgccttcgcctggaagctaagccacggattgtccttgagtggggttcagcgccgtcccttgcctgacacgggggacacccctgtcaatcccccattaatggatgaagaattgtggtggccattctctcatggggaggacctcgaatgacccttccgatgggacgggtcatacctacctccactctgcggaagccagatgtgacgtgggggcacagctgtccgtccagtcatatgtgaccggtgacaggccggtcacagactagtcattcctgaccatcgcgcgccagttgggcatgccgcacgtctgcccctaccgcattgaatgcggcagggggcagttggggcgctgcgttcattaaagaaggttcggcttgggccccctccccgcttgctccccccgccagatggcggataggcgagggcccgaggggcacgacgtgacaccccgaggcctcggggcaaaacgggcgagggcccgaggggcacgacgtggcaccccgaggccccctggccgctcctgcgatccgcggggtacgggggtagggccatgctgtaggtcatgcgccaggatgggaaaggtaaattcccctcattccacatacccccgggcccacttcaccgatagcttcgatctaatctccttctccgatgctgatattaccaaatttggttcgttaacatatgtgccttgtatcaatgtatatttaaaaatgtgtcaatcaagctgaatataataagaagcaagatgatctctattattgtactgcaccaatgcatatcgtgtagagatccagtcaaaagtaatcattttttttaaatgaatagacacaaagacggtgctatttcattcattgaatatagcaaaaagaaaaattgcatcctctaagggctgcaaattaaggatctatctaaaccaattcggtttgaagaaaaacaaagaatttagattcctaatgattaactactacaagtgccattcggtttgtaggaatgaggtatagaaaaaccaaagaaatttttttgttttcctccaagttgtagagagaaaactagaaaaattttcatttaatttactctaaactcttgaaaaaatttcctatggattggtgtgtgcatacatttccactccttcacttttcctatttctgtgagtagaaacttctcataggattaggaaaagtggaggaatagaaaagcatgcatacttcaatccgtaagaatttttccatgaggtttatgtggatggaaagtttcctttcttctctctgcaacttgtagaaaaagaaaattttctttgattttctatatctacattcctacgaaccgaatgacattcataggatccttagaaatccaaatcctttgaaattcctcccaaacgaatacaccctaaaccaaacaatccctcagtataaaaggaagaaaaacatgtgactaaacatggttgaactcaagcaagcgcttcactacagcgcacatccacattcttgcgctcgtcgtggcctatctccttctcgaggttttgactcttgacactatagcctataatcccatgtgaatgcaaccatggtcagagttcctttgacatggtagttgtttcaatcttttttctctccatcccaaagtgatggtggcagctaatgtttcttggacatataacagccttccagtgcctcatcttcttctctacttcttaataatgataccctggtcagggttgtggaacctttagggtcaagggtattacgcaaccctcctgctacacaaagcagttcaagagggtcccgtaattctacagaaaatattggagacacaaagtttaggggtgagactctctttactattcaatcctccaatcaactgtacaaatgattagccccctcctctctttatatagtgcattccaatatatgaaaggttcgttgatgggcccattaagtgtatttgggccaggccttcatcggccaagcctaaagtttcttaacactcccccttgggcactcaccgcgtgatgtctatgcctcgttaaaactccataaaaacccagtgggaaaaattgcagaaagagtacatagcatacgcatgtatgtcacatagattgccttattaaaaaccttgataagaaactgcaagaaaacttatctaagggaaaaagagtacaatttacccaaattcttgtatcgattttcttaatcgtttttgggtacttgattctttagttcatgcttttgttaatagactggcagaattccccccttgaattttgcatctcttttaagtgtgaaccatcaaaactcgttgctcttatgttttcaaaagatagtccgagtgatgcttcaatggtcaaatcttgcatgatttttccataacttgtagagatcatacaatctattagtgttggtgtgacgcacatatcattatcttcttgataatgattttggggtttgggcaaagctcgaaccatgttacttgctagaaatggtgaactatatccaaggaacctatgtattctcacattctgatattctatggttcacttcttcatgtgttgtaggtttatgagccaaagaaacgtaggtttctacctattttatctcaaacttgttcggaaagagtgagctttctttctttatgcgatgatattaagatcatcaacttggtttgggacttttaatgcttgtatgcgagtgcccaatccaaaatttctttaaccattcattgtcaactacaggtcagctttgcgggttgatcttttagttgattttaaactccaggttgactgccaatgatttgctgtatgaagagaatatttcccatagcaggtctcattaccaattcctattggttgtatgtgacacttatgtgagtatccatcgatatatggggatatgcaattttcttatgcttctattctttgacatgggcatgatcctttcattttaccggcattggtgtgcactccaactgctggttttcttccttgataggaagatgtggtatacatgttctgaggttccataccatttgccagctctgaacaggctccccctcaaattctggggttacttttagtgactatgagcttgaaagttcctttcgtcccattttcaccatacgtctccagttactttagagatttaaggagccggagttcttgtcctatttattttttgaggcatctggacaagatgaggtatacctttgcattcttcggtatttcaccctcctccggtgcattacattcgggtaatgcaacttagtcatgctctccagatcacaaaagtgataggtagttatccaattcttatgtgtgctttccatactttcattcgctggttcttgattaaatgtgcatccatcctttctttgaccatttttcctgacatttatcattttaagggttatttctctccccctaaacgactgaaaataatccttcttattgtcaaggaatttaggataagttcgtacctctgttaaaaatttccattttttttcggtgggagcccttatggttgtgggacatgcacgtgtgtcgagtcaacactagtattcttttaagtggacaacacatttcgaatagtccggttattgatatttcgttgtctttggagctaagagtccattgaagtggcaggaatttcaataatggtgcggtggacatttttagtcctattcttgtggacgtccggtacttagtgcttttcttaatgtgctgatgccaacatgcatgatcttgcaggatcgatttggcaagagcgtagtgtcaattagacacaattgaagcttttcataagtgcagtatgtatcggatgatccattaatgggctaaatatgtatgtgaattcatgtggcatgcgcgaattcattccggtatacctttcaaggtatgtcgaaatttatgtggtggtcgatgtttgacatgcatccgatgttcgatggtatgtgcgaccagagtgaccacgggttatgcagccgatgcaactatggcgcatggtaggagttgcatggcgcgacctaatgtggcatgattcgtccagtcccccagtacagcaaggttgctagttggtgcatcgtacagcatttagtgcacggagctagtagcggccttagtgttcatcatgatgctgtatgatgcatgccaatgtctggtgcaagtctggcgcgaggcgctcaggcagtgcgcgtgacaaatatctcatcgtggcgatacgacagatgatgtgagattgtttgtgctatattcatttgcaagatactaaattctaagaaacactgactatgagatagcctattttagcctacatttcttagtgaggacattgatctcgcatgcttaggtgatgagtatgcttctctcatcttctagttcccacaagggaacttttctgcgagagtttgccattctcaagaaatttgaggtgtaatcgtttttctaccgaaaaacaatatcctttacaatcattgcatgcagttgtgaaggtagttcacgtctttgcatagattgaacttgtctcatgtctctcaatattacactttgtggtgcttttgttccacaatgttcctctttaccttaggctatgcatattgtctatgtgaataaagtaaaatatcactacttcaaggcaagaagtaaaactttatcatatagcaaaatgcaacataatattggaaataaagtctagccatgcaaggcgaatcacgaaataaatgttgtgctctcatagagcttacaaaaccattattcaaaaatgttcataatgcaacttagctcaaaataaaataggagcatcaaatactcaaatggaatcaaccagagtattgagctctgcaaagatctgctcctgggtgacggcctcttcatttgcttcgcctgctgcagctgtaggggcgtcaagtggagggagtagccgcagtgacggcctcacccatgtgtgcttctgcggacgccttgggcttcctgctggcctggtatgcat

SEQ ID NO: 20148 - DNA, 10079 bp, Oryza sativa
tcatgagattcagacacgtgcatgatgtcgatcatctcgtcatactccttgtatgacgcttgcctgtagttacaagcgctctgcacagtgctagggtggaaggtggagagtgtcttctcgatcttctccgtatccgtgacaaccttgtcgcagagggagaggttagtacagatctggtgcagcgtggagttgtactcggagacgctcttgaagtcggcgaacctcaggcgagcccagtcctgctctgcttggggcaggatggtgtacttcaacttctcgaaccgcttcttgagtatggtccaaagagtgagtgggctccgcaatcccatgtactcattcttgagcgtggcgcaaaggtggtgccgtaggaagtgcagcacccgatcgttctcatcaggggtaggcgctcggtcctgcggggtgcccatcccgatcgtctggcggagcttcttggctccaaggacgatctagacatcggatccccaggtcaggtagttctggccatgctaagctagttcggcgaactccttattcgtgatccctgacattttattgcaaaagtactacaataagatagttgcaactatttcatgctttttccaatatttatattcatagggaatgcgaataaaaagtgcaaaatattaaataaataaatactagagttcatattaaaatgcatacaaatattcatacaaaaagaaaaggtgcaaaagttgcatatattcatataaatactgaaaacgaaaaattaaaaatattcattaacagtaataaatgccttaataaatttaaattcaaattttataagacagaaaatgcttaaatatggaatataagcgacatttgtaaaattcaagggcctatttctaagttttacatgcggggaatggataaaaatgaacgtttccgaaattctacggtcctatgcgcaaaaggtttccacgctgggagttatgcgcgtaatttttagaaaatctaggagcctttctgcaaaatcgccaatctatttccttctttcttcttctttcctgcggggccatgcggggtgcggccggcggcggtgcgcggctgcgcgtggtggcgcgcgcggcagcggcggcgcatgcggcagcgccatgcggggcgcggccgacattgcggcgttgcggtgcgcgcgcgggcgctagaggcgctgtgcggtgggcgtggaatcggccagcggcgctgtgcggggcgcggctgttggaagctcgcggcagccgcgcgcggcgtgcggcgacgccgggcggggcgcggccggcggcagctcgcggcaatgcgaacggctgctacgacggcgggcggcggtgccgtgcggggcacagccggcggcggctcacggcggtgcgccggcgtggtcggcgtcgcaacgtgatgccatgctgcgtcgtgtctccgatccgtgcttgcattggtgaggttcgtctctgccatgatggatgatgccgagaaaaccccaatcaactagatgccgacgactccacctcggcgacggcggttttcatcgggagttacaaaaacggaacgaggaacatgcaaagatttccttttttctaaattcaatctacaagatgcaaagaggattcacgaagcacttcaagagggtccagtagagcttcgtacccgataacgtattaagcaaccctcatgctacacgaagcagtccaagagggtcacgtaattctacagaaagtggagacataaagtttaggggtgagactctttattatttaatcctccaatcaactgtacaaatgagtagcaacgatggtcagagttcgtttgacatggtagttgtttcaatcttttttctctccatcccaaagtgatggtggcagctaatgtttcttggacatataacagccttccagtgcctcatcttcttctctacttcgtaataatgataccctagtcagggttgtggaacctttagggtcaggggtattacgcaaccctcctgctacacgaagcagtccaagagggtcccgtaattctacagaaaatagaaacacaaagtttaggggtgagactctctttactattcaatcctccaatcaactactctatttttatagtgcattccaatatatgaaaggttcggtgataggcccattaagtgtattttggccagaccctcatggtccaagcccaaagtttcttaacaaggggcacctttgccctgagtaattagtggtttgggccaagggaccagatcatggattgggccttattgctcaactaaaaatggatcatggtgctaatgaaattctatttttgcctatataagtcactcagcctactcaaccaggcgaaatgggcatttcaattttttttcctttccgtggaaaccaggcagaccgttctgtgtatggcgaccaacaggaggaatttcattttgcctctctcaagtatgccacgagttctattaattcatctccctcaaccacaaaagttggtgtagagactatcttaactattaaaaccaaatcaatttgccttcccatacggttttaatgttaagtgtctatacataggaatcgggaaaaaaaaatccagtgagacgttcaacagattcatcacacacttgctatgcacactcatatagtacaaatagttgatacctcacgctttactgcgagatatacgagtgaatgcatgctatacgttataatcaatcaataactcccctaaccgtaccctttttctccgcgtttttaattattttcgggctatctcgttgctttacacatcgctcctcctcctcccggctcctcgcacgtgcctgcgtgcggtcaccagtccaacaattttttgggcgctgtaggggcgtgcgcacgcgtcggtctcgacggcaggttggaaccggtttcattagtaggctattttgtaaaaaaagtctttgcgtttccacaaaatatcgtatacgtccttggactggttcacaacccgttgtgtttgttacgaaaaagccctcctatttcacaaaaatacaatgtgaaaaatagaaaattccgttttaggggtagcgctataaacataaaaaacaaaggggtttttccaaaaaacaaccacatataccccaaaccctaaccacgagttgttccccactccccacatcacggccgccgccccacccacgccctgcgcctcgtgctcggcgccggcgccggcgcgggactccccccacctccgtccgccctcccgcagtcgcctccctcgtcgtccgccctctacccgccgccaccgatgtcatccgtcctccccccgttctccgttgactctccttgcaagccgtgcgacggcgcggctcgtggcctcgtcttcggtgccgccgtagtcagatccggccctcccgcggctggatccagctccgctgccgccggatctggcggccggaggagacggcgcgacggaggaggatgaccgcgataggttcgtacgacgaagcggcggaggccgatgggtgtggcaccatcgtcgccttcatcgtccgccttccctgcgacaccacactcccccccttgttctccccccaccccacccaccgacaacgaggcttgtggcggcggcgcatccggctgtgcacgggcgctgtgccaccgccgcctgtcatctcaatcgggtgcttttttggcccgattgagatggcttccttgtgacggcccactaatttcaggtattttagaggccatcatagatgagaggatctgtactagtataagtatgtttgaataatgtgaaaatgatgtggagataatgatgtggcattgcttgcatattgagttctaaaaatacaacaaaattataaatgatatgtcatatttgcatgatatttgaaatactctagataataattactagtgtgtgtgatgatgtggtagcttgcatgtgattgaaaaatgtaattaatacttaagacttgtagcgagaatcacgtgaaaaaattatttgctcgagcactaatccttagacacatatgagttaatattggttgtgatatctctcctgttacttatatcagttatgaatgttcgtggggtaacatatgacggaataacctatgcactgtcaaatttgctttatattttactactggtgagactatttggtcaaaacgtagttaatatatttataaatttctagataaacgatgagtagccactgttaattatttagaaaaaaaaaagagaaagagagcatgactattctatgtgataattttttaatatcaaatatagtcctaatattttccaacatacgtctagtttattagagaacggatggatgtttgcttgtaataagtataaagattcgagaagagaagtacggtacgtagtatgtacagtacatatttatatgtacatgttagaattgtttttagttttttgcggtgaacagaagtaatacgtatgcatgaatgtttctctcgtacgtagcaattaggtgggacagtcccaatcgtaattaaatcgtaagtacatttttttgttcgtttttttctgcgagtagtaagtatgtatgtttacatacaactattcacggatattttttttattcaggaaggttagctgagatgtattttaaataaatctcatttagtgtccatcaacttaaataaaaatcaagaatttgattttttttcagagtttgtagtaaagtaactcgttaattacagtgccgtttgtagagtacttatgtatatacacgagagatttattttctcaatctagtgaatcactagtggagaaaccgtttgtagtcccggttcgtaaccccctttagtcctggttgtccaaccgggactacgaatccgggactaaagatagcgatctttagttccgggtgaaataaccgggactaaagatcgatctttagtctcggtcggtaacacgaaccgggactaaagttcggtcagatacgtggccggttgattcatctttagtctgtgtaccattttttttatttgcatagccctgtttgctgcatggttgattatatatatatatatatgtattctatatatatgtattgtatatatatatatatattacaatacatatatatagaatacatatatatatatatatgtatctgtgtatgtgtatatgtataaatacatatattacacacatatttataatttaaagcacttaacattttatgtgtatatatgttaccaaaatatatattaacactaaagtaaatgtacgtacatatataaatatatatatataaatgcatgtatagtacaatttatttgctcgctagctatagctacgacttcgacgccagcgttacgtcagaagaggaaggaccgacgttatggattgtcgatccgtcgtagtagaattcaccatcgggaataaggtcttcttcgttgatgaaccccatcagttgttcttgaacagccgtgataaaatccttgtatgggagatttttcctcatgtgaatacgctatcattcgaaaaataatgacatatcaatatatgaaattaatatacaacttaacaaatcgatacgcaatgaaattttgaatggtttatgtatacatacatcgagctctcgtgtggtgtatatttggtttgataggcagtgggcatactcgcatacgtagtagccgcataagttagttccctggtcctgctttgcacactacatgagaaacgatgagagatttaatatactctttatattaactgtaattagagattcaattcaatataattttggatcatgcatgtactcactggaaaatgaaacctccgtccaagtttttctttccaagtcccgcggaccaattgacggaaccgatcccaagccctacatgtgcagttgcaagctatgattaattaaatattacccgagatcagcataatagcaacagagtcccgcgactttggaatagatggcattatattacatatctatcagttggaagagcttgtcaaaaaccttctcctctttattcattgagtcgtacacagtgactctgcatgcgtccaagtcgaaaaagaacaggacccagtggaatctagaatatgcgtgatatgagataaatatcagaatgtacatgttatatgtatgggaacgaaatttgttcgaacgacaataaaaactcactctgtgttgtacgtcaatagtatgaacgtcttgaaatgctgctgcgttaggagatggacgagattgtcctctgtgtctttctcgtacttgtcgagcatttcggtgttgattttccgagggtcgatgaacccagtatcgtaaaccccgtcgggccctttcaatctccattctacaataatgaaaggaaattattattgcttacacatatgccaggagctaattattgaacgaaacaaatcgaactcaaagatacttacaaaatccatgcgctcagaagagagacgtcgagggcgtcccgatgataccgatcgaagacatccttgaaatggatccttagaacatcttctccttccaagaagtcggggtttctgatcctcgctccgaacatctctctacccttggcgctcatttccatgtaccgttcatggaatttgtacatttgtgttggtagggactgcagctgctcaggcctgacaagcggtttaccgagttcaaacttgtatgccacttccgccttcgggattggtgcgcctccaaccaactgagcaacagttagaccggtgtccgaaatgaaatacgttatgccaaagtcttcgccggtcgccaacggctcgaccacttggtttggttgtctccaagctgaggaactggtttggacttcttgtaataggctttcctaagtgttcggtcatagtccgatagctttaaggcctccttgtttgtggtggacattcccttgaagaaattcttcacgctcgggtcaataggtatcttcttttcaggactccgaggcttgagttgcctcttcacttctcctgccacataagcgtcaagctcctcttaactgcaatcgtacggcggctccttgtttttggtggtgtcaacttttgtccttcttcgttgcccttgtgctggcaggaggtggagcttggcgagaccgtgtcttggaaggtgcaggcggacacggtggaggtggaggcggagaagccggaggagccggaggagatggtgcatgagaaggcggaggaggcgtaggagccggaggagatggtgcaggaggtggtggcggaggagctgaaggagatggtgcaggaggagacggtggagccggaggagatggtgcacgagacgccgcttgtcgcccagggaggatgatgtaccgtttgcgccatagtataatggcgtgccttgtgtctcgtagatgcgtctcaccatctcctcctaggtagtccaactcgaggtcctcgtacacggcttccaccagctcaacttcgaccctcgagtatcctgctggaatcggcctgcagtggtaagtccctgaaatgtccgttgggatggccattcccgacgccaccttcacgtgatgagaggttatctattagtaatcaacctaagcagcaacttgcggaacgtacaagtcaaaaatcatatattacatcgaggataccttgattgataagttcttgaagggaatatgcagctcacatggtgtccgttgcgtgatctcatcaacggggcaggtggtttcatcatgggtttgcatggcgtccatgctatgtgatcctacctgccccgttgaggcgcagctgctacgattacctgattggctgaccattggaggaggtatgtacggctagggatcatgtgaccgatgtgctgccatgcgttcatccaccttccgggccacctaatcttgcatgctgagctcgtagctcgataccctgtactcaagatctgcaatcttcgcctcggtatctctcttgctcctcatccgactcctgtacgtgtggatgtcctccttgaatcaaatcttccagggaatcacgccttttactcgtgttcgtcttggatgctcgggaatctgtagggcgagtgacagctcgtccttctctctgtcgggtcggaacgtgcactgagaagaggcttccactatgtccgttagtcgactggcagcctcacgtatctgatcgctgaagaccagggagccatcaactgggttaagcgttccaccgtgagcatagtaccagaacttcgatcgatccggccatttagcggtggccggttcgatacccctctcaatcattcttgcctccatctcctcccacttcagtattgcgacgctatagccacctaaccccaagtggtgatggtacttcttcttggcagcgttttccttgtttttgaccatcatcgcttgcccttgttgccctgtcttgtcagcaacgaactcgtcctaatgatcccttagctttgggaatacgtcgaagttcggtgttagtaccttcaggatgtatttcttgtacagatgtcccttgaagctcttgaactgttctgccattttcttaagagtccactgtttcactatgttctccgtacccgcagggagcgtgaacgtctcgagcattgtggtccacagcttctctttctctgattccgggacaaagctgtcattatccccgcgtgcccttgttctgcgctagtacaccttcctgacaggcacgttatccctcacaacccaaccgctgtgtcgtacaaaattcttggctacttctgccgggacactaggtcggccgtctgcgtccacctcagttatgatgtgccgaccctctatcttcttcgcagcacctcgttgtccgcgtgccctcttctgtccagtggagggatgacttccactagccgcctcctcgttcccctccgcatccctctccacgttgccctcctcgttcccctccgcatccctctccacgttcccctcctcgttcccctctgcatccctctccacgttcccctccttgttcaagtactggtttggatcctcgttcccctcttcttcgttccagtactggctgcttccctctgcgattgtatcgtacagtatctatttctcatcacgatcagccatctgttcatagaagaaatatttgctaagcgtaatattaaaactctactaatcttgtattaaaactcaaataatcatatatgctaagtctaagtgtcgtgtattagaaccctagataatcatatatgctaagtctaattaagtttcgaatattacatctctaataatcttatattaaatctctaacaatctctaacaatcaaatatgctaagtctaattaagttccgtatattaaacctctaataatcttatattaaatctctaacaatctctaacactcacatatgctaagtctaattaagttccgtatattaaacatctaataatcttatattaaatctctaacaatctctaacactcacatatgctaagtctaattaagtttcgtatattaaacctctaataatcttatattaaatctctaactatctctaacactcaaatatgctaagtctaataatctaataatcactaacactcacatatgctaactctaataatctaataatcttatattagaaatctaacaatcttatattatatctctaacaatcacatctttacatcacttgcctgcacgaattccttcgagggctagctaccacttcggcttgagggacgacgacgatgacgtcttctctgcaacatgcaaaaaaaatgtattagtctaaacgcaaaggaacatataatgtatttcacgttttcaagtatatataatcatatatatatatatatatatatatatatatatatatatgctaagttcaacaatagtttaattatctcgttcgtacacgtttcgctcgcgttcgttcgcgttcgttcacgttcgttcgcgtttcgttcacgttcgttcgtgttcgttcacgtttcgttcatgttcgttcacgtttcgttcgcgtttcaatcacgttcgtttacgtcgttcgcattcgttcacgtttcgttcgcgttcgttcgcgttcgttcaagttcgtttgcgttcgttcgcgttcgttcacgtttcattcacgttcccctccacatccctctccacgt

SEQ ID NO: 20149 - DNA, 14043 bp, Oryza sativa
catcggcggtgacggttgtccgcacgtactttctcctcactattgttccttccttgtgatcgctatgtgagtaaagggtgtcttcatttgataggaggatgctagggtcaatcgtcaccgtgaaagggggttgcccatcaaactgatcgtaatcctcgtcagttttgtcctctactccgacgatttttcttttgcctgggagaaccacgtggcgcttcggctcgtcaggccctttgaccttctttcctttgctagacatgtccttcacgtaaaaaacatgcgttacatcattggcaaggacaaaaggttcgtccgagtatccaaccttgttaaggtcaacatttgtcatcccactgtcatcaatcgttacgcctccaccagtcaacctaacccattggcaccggaacagagggaccttgagaggtccatagtcaagttcccatatctcctcgatggcaccgtaatacgtaccagttgtaccatcgtgtcccatggcatcgatacgaacaacactattctggttcgtgcttttcatgtcttcggctcttgtgtagaatgtgtacccattgatctcatatccctggaatgtcgcgatcgagctagatgaacccctcgccaggaaggccagttgctggttaatcgtctcgttatccatgagatgttgtcgcagccatccggggaaagtatcaatgtgatgccgtgtaatccatgcatcggacttatcgatgtttctcgagcgaactagagccaagtgctcctcgatgtaaggagccaccaatgaagattgttgtaaaaccgtgaaatgggctttacggaataaattgttgtctaccgtcattattgctttccttccgagagtcccctttccccgtagtctcccttcatggcgtgattcaggtaccccaattgggcgaaggtcttcaataaattctacgcagaattcaatgacctcctctgttccataccccttggcgatgcttgcctctggacgagcacggttacgaacatacttcttcagaacgcccatgtacctctcgaaaggaaacatgttgtgtaggaacacaggcccgagaataccgatctctttgactaagtgcaggagcagatgcatcattatattgaaaaatgaaggtggaaatatcaactcaaagctgacaagacattgcaccacatcattctgaagggcttctaacctatccggatcgatgaccctctgcgaaattgcgttcatgaaagaacatagctttgttattgttgcccggacattgtctgggaggataccccttattataactggtagcagttgtgtcatcaacacgtgacagtcatgagactttaggttagtgaacttcttctccttcgtgcttattattcgctttatattcgtggagtatacagatggtaccttgatgctctcaaagcattgaaacaaactttccttctctgccttgctaagagtgtagctggctggactcaagtaatggctgcctttctcctttggttccgggtgaaggtcgccgcgttgttccatatgcttcagatcattacgtgcttccagtgtatcttttgactttccatctacacctaggaagccaaaaaggtttacgcaaaggttcttagtaaggtgcatcacgtcgattgtgtggcggacgtccaagaattcccaatagggtaacacctaaaatattgagttttttttccacatcgccgcgtgaccatcttcgctctctataggctggctgccaggcccctttccaaacactactttaagatctttcaccatagcaaatactatttttccgctgcgatgtttaggcttcatacggtggtctgccttatgttcaaagtgcttgcctttcttccgtactgggtggtttgcagcaagaaatcgacgatgacccatgtacacaatcttcctacagtgtttaagatccgtactttctgtttcatccatacagtgagtgcaagccttgtaccctttgttggactgcccggataggttgctaagtgcaggccaatcgttgatggttacgaacagcagcgctagtaggttaaattcctcctgtttgtcttcgtcccacacggggacaccttccttcttccataatagtttaagatcttcgaccagtggtcttaggaacacatcgatgtcgttaccaggttgcttggggccttgaataataatcggcatcattatgtacttcctcttcatgcatagccaaggggggaggctgtagatacagatcgtaacaggccaagtgctatggccgctgctcatctctccaaaaggattcatgccatccgtacttaaaccaaaccgtatgtttcgtgcgtcttttccaaagtctttaaattttctgtcgatgtttcgccactgcgaaccatctacggggtgtctcagcatcccgtcctgttgacgttcttcagcgtgccaacgcatcattctagcattccccttgttcctgaacaaacgccttagccatggtattatagggaaataccacatcaccttagcaggaattctcttcttcgttagctgcccgtcaacctcacctggatcatctcgtctaatcttgtattgtagtgctttacaaacagggcatgcttctaggttctcgtactcctcaccgcgatataggatacaatcatttggacatgcgtgaatcttctaaacttccagtcctagagggcagactatcttcttagcctcgtacattgtatcgggcaatttgtttccctccggaagaatgttcttgacgagtttcaataaatcgccaaatgccttatcactaacaccattttttgccttccattgcaagaactccagagtggtatccaactttttgtgcccctgctcgcaacctgggtataacgatgttctgtggtcctctaatatcttgtccaatttatgggcccccttttcactttcgcagtcctccttggcatcctgcaacatctgaccaagatcatccgcaacatcgttataatcagcatctctatcctcctcgcccgtttgatttccttcaaatccagcgtactgagcaaagtctggaatattgtcgtcttccacttcatcttcttccatttcaagcccttgctctccgtgggatgtccaacaattatagcttggcatgaatcccgactcaaacaagtgaaaatgaatagtcctgaatgcagaatactccttctgattcttacacttattgcatggacaacaaataaaacccttctgcttgttagcttcggccactctcaaaaaataatgcatgccgtcaataaactctttggaccgccggtcagcgtacatccattgccgatccatctacatgaaataaaaaaaaatcgtacacaaataatcattcgtacaataatgatagtcatacaataatgataaaataatcacaaactctttcaacagtcatacaataatgacataccattattcatacaaaaattataaaatattccgttaaataattcttatttattatttttgaagttttaaattcttttaattttcaatttagtttgttttcttttatttaagattaactttcactatattttcctactcaactattttataaaaccttctttagcaaataaacaaaatttctatatattctttcttttcccacacaaattttctctctcatcaacttacaacaaaattttggagacaaaaaagtgtgcaaaacatagctccaaatgtaatatgacaaaaaaacattggaggatgaagttgctaaccttttaggcacctccgattcgtatataatcaccaaagtaaattcactataatttttggcatgacctcccctcttttttgaagaaattttgaagcttgctcaggctggaggaggaagaagacatatataaaggggtgggactttagtcccggttggtgttaccaaccggtactaaagatcagcgggatctttagtcctggttggtaataccaaacgggactaaagttacgatctttagtcccggttggtagatccccggggggcctgacaagccctaacagcatttaaaccaggactaaagataccaaccgggactaaagatcaaatatgcccgttaccctttttaatcgggactaaagatcatctttaggcccggtttttattgcaaccgggactattgtggaaatagcccgagcgacgaaagatggtttctccaccagtggatggtagtacgtatttatatgtatgattctctcttagcaattaagtggtaccgtggagggctaatccttctttttttcaatcataaatcgggactaaagatcatctttaggcccggtttttattgcaaccgggactattgtggaaatagcccgagcgacgaaagatggtttctccaccagtggatggtagtacgtatttatatgtatgattctctcttagcaattaagtggtaccgtggagggctaatccttctttttttcaatcataaatcgtataagtacgttttatttgttcatctttttccatgagtagttgtacgtacgtgtattgtatacgtacaactactcgcgatagaaattccgtttctgttcgtttttctcacggcaacaagtccgtttctgttcatttttttccgtgagtagtacgtacgtatatgtattctgctcattttttccgtgaagtactacgtacgctacgtactacatagtactactcacgggagcaattcagttttctaaaattcaagggaggttagctggatgtattttaaataaatctaatctaataatttaaaatataaaagattcactaattaaattaaaatcaaggattgtatgtttttttatagatttgtaaggtttctctaatttattagagtaccgtgtgatggcatatgagcatttgtaagagtgtcacatgttggtttatgagtgtttttaaaaaatttaatggacttttagtattagattatatagatatacgatattattttcagatgagcttatagctagtatttagctagatattattttcagatgagctatagctagtatttagctgatctactattaaacttgctattacgtgtattcctctttttcattcaagccatttttttaatagacacaagcaaataaattttaaattaaaaaaacaattacctgttaacagttaatatcgatttgaaaagacaagagcatcttgctattcaagagaggcctaaacaggttttctaaaatgtaaattttaggatttatatcaaaatcaggcctctaacagattcccagccaaggtcctaaaatttacccacacctaaaagcagtgccaatctcgcccagaacttgggaacatgtacgccctcccaatgacactcgattatcgcgccacttttttacctgtccatgctaatttctttctattggcaccattttttcttctgcctgcttccttttttccccttctctcgtcatcattttctttctcacgctagctcgcacacgccgccgtcacttcgccacttaggatttccactgggtcgcctccaatcctccgtccgtgccgtttcattcgccatctcccgcgccgccttcattccatccatagtgccagcgaccgtccatctggtgcaccggcggccctcgtattggtgggcagcggcccttcatcaagtgcgccgaaaacccctcctaacgtgagggtcgtctaggatattaacctgcagactgatgacacagccgtgtagaggatcagctaggccttctgtttttcccacattagaggcaaatctgtcgtcaatacaaccttctgtttttccacattataggaaaaatcttgtatcaatataaccgtggccggcgagggattctcttacggcggcatagaggtaagatagcactttaaaagggctaactccggcatgtatggttctatatatacatgatccgtaatgcttgtcctaacttattctcagatcgagctagagcctagacatagagaaagtatgagcattgtggtgagcaagtcggcgccggtggtcgtccggccaacgctgccgccggtgaagacttccggcagcaagatcgttctgtcgcctatggacaagcttagtgccatgacgccaaccacagtgctgcttgcgttcgaccatcccatcatccataaccatgagggcatccgatcatcctgcattcagatgcaggccacggcggaatacatcaagagaggtctcgctcaagcacttgtccactactatcctttcgccggccgcatttcctgcgacgacgacggcggcgatttttacatcgactgcaccggcgaggagctcggagcgacgttcgcgtgtcatcgacaaccagcccactgacgccgagacggcggtggtgcagcagctcgccttcaactgcacgcccgacgacgaccacctacctcactgtctgctgtgggtgcaggtcaccacgctgtcctgcggaggcttcgtcgtcggggtgacatggaaccatgccgtggctgatggtttcggcatagcacagttcatacaagccgtcggcgagctcgcccgtggcctgccatcggcgccgtccgtcaccccagtcaggttagatgaccaaaacaacgccgtttctcccttcaccatggccttcatgcagttagcagacaggcacaaggtaccagaccttaccttcaacaacgtgaccgtcccgtcgaggttgatggaccacatcatccgaggacgaacgaccaacgtcaccgtgttcgaggcggtcgccgccgtgctttggcagtgccgaacccgggcggtgatgacaaatccagaggcccccgccgtgctgctcttcgcggtgaatgcgcgaaagtatctcggagccaaggatgggtactacggaaactgcagcacgatgcacgtggccgtggcgaagagcggcgcggtggcgaacgccgacatcaacgacattgtagacatcatacggcgcgccaaggagcggataccggagcagctcaagatgaccggcggcagcgacatgacgatgctacgggagctcgccgatgaccatcgtctggatggatatgagagcctgctctacttgacatcctggcgaaacatcggattcgaggatgttgatttcggcagcggcaagacggcgagggtgatgacctacccgcagagggaggtgttctccaagaaaatgcccatctgcttcatgctcaagaacacaccacaaggggctagggtgatttcaggctgtgttaaagctcaccatgccgacgccttccatcaagaaatagccaagctcaacgccaccacctaattaactctgcgagctacctacagtattatataacacatgactctcagatcataataagtaaataaatccatcaaacaaactatatatgcctggtgttatcatgtaccctctcaatttgtgccatttatctataattagatttatcattatatcgttcacgcataaacaattcatgagcctatcctatctgtataataacaagccaggtgctcccttcattttttaatgtattatgccattgaattttttaaatacgcaagaccatttgtcttattaaaaaaataatctaatattcatttgtttttattgagatttgattcatcatcaaatattttttaagcatgatttaaatatttttatatttgcataaaaattttgaataagacaaatggtcaaactttgataaaaagttaactgtgtcagacattaaaatacggaggtagtaatctctattattgtacttcatcaattcgtcatgaagagatctactccctccgttcatattatatgtcgtttgatttttttttctagtcaaactaataaagtttgaccaaacttatagaaaaatttagcaatatctgaaatatcaaattagttttattaaatataacatggaatatatttcgataatatgtttattttatgtcgaaattactactatgtttttatctaaggtaggccaagcttaaaagtttaactagaaaaaaattaaacgacttgtattatgaaacagagagagcagtaaagtaattcttttttaaaaaaataaatcatcacaagacagttcctatttcgttgaatgtagcagcaaattccaaaaacattccgtcaggagagcggagaaaccatgtgctctgttagccctgacaaccatccttgccacctcagttggcgcccctcgccgctgttgcatcgaatacaggaaccaagccaactagagagaatgaatggttggaacacacttttagtggaaataaaagtaacacttaaacttgacaaagtttaaatgcaccgatcacacggctggattgatgtcagtctgaccgcagtactccggccgttctgaccaccgccttgagccggttggaccacctccctatcgccggtatgaccgcctgctagttagaccatacaatgaactccagtcaaaccgtcgggatctagaaaaacacgtatcgatgaaactcttgaaagtagatctactttattgcatcaatatgtgtttacaaagtgcatctaaagctagcattcctctctcaactctttaactaggattgaagcgtcgaagaaaaccctaacttttctctcccaaaaagtcgatttcttctagcctcaacccctcatgtatttatacccacaacctgcttcttgtcactgtattactgcaccaagtctgctgcgccccaatgcagtaatgcttgaagtgtttctcccaggatgcaccctggccgtgtttcagcaaacttttggatatcttaccacaaacaaactgaaccccccctgaaccagatgatgttcacactggtggagaaatcgtttgtagtcccagttcgtaacccccctttagtcccggttgtccaaccgggactacgaatctgggactaaagatagcgatctttagtcccgggtaaaataaccgggactaaagatcgatctttagtcccggttggtaacacgaaccgggactaaagatctatgtaccattttttttatttgcatggccctgtttgctgcatggttgattatatatatatatatatatattacaatacattatatatgcattgtaatatatatattatgcatgtatatagaatacatatatatatatatatgcgtatgtatatatatgtataaatacatatattacacacatatttataatttaaagcacttaacattttatgtacatatatgttaccaaaatatatattaacactaaagtaaatgtacatacatatataaatatatatatacatgcatgtatagtacaattcatttgctcgctagctatagctacgacttcgacgcctgcgttacatcagaagaggaaggaccgacgttatgaattgtcgatccatcgtagtagaattcatcatcgtgattaaggacttcttcgttaatgaaccccatcagttgttcttgaacagccgtgataaaatccttgtgtgggagtttttccctcatgtgaatacgctatcattcgaaaaataatgacatatcaatatatgaaattaataaacaacttaacaaatcgatacgcaatgaaattttgaatggtttatgtatacgtacatcgagctctcgtatggtgtatatttggtttgataggcagtgggcatactcgcatacgtagtagccgcataagttagttccattgtcctgctttgcacactacatgagaaacgatgagagatttaatatactctttatattaactgtaacaagagattcaattcaatataattttggatcatgcatgtactcactggaaaatgaaacctccgtccaagtttttctttccaagtcccgcggaccaattgacggaaccgatcccaagccctacatgtgcagttgcaagctatgattaactaaatattacccgagatcaacataatagcaacagagtcccgcgactttggaatagatggcattatattacatatctatcagttggaagagcttgtcaaaaaccttctcctctttattcattgagtcgtatacagtgactctgcatgcgtccaagtcaaaaaagaacaggacccagtggaatatggaatatgcgtgatatgagataaatatcagaatgtacatgttatatgtatgggaatgaaatttgttcgaacgacaataaaaactcactctgtgttgtacggcaatagtatgaacgtcttgaaatgctgttgcgttaggagatggacgagattgtcctctgtgtctttctcgtacttgtcgagcatttcggtgttgattttccgagggtcaatgaacccagtatcgtaaaccccccgtcaggccctttgaatctccattctacaataatgaaaggaaattattattgcttacacatatgccaggagctaattattgaacgaaacaaatcgaactcaaagatacttacaaaatccatgcgctcagaagagagacgtcgagggcgtcccgatggtacagatcgaagacatccttgaaatggatccatagaacatcttctccttgcaagaagtcggggtttctgatcctcgctccgaacatctctctaccattggcgctcatttccatgtaccgttcatggaatttgtacatttgtgtcggtagggactgcagctgctcaggcctgacaagcggtttaccgagttcaaactagtatgccacttccgccttcgggattggtgcgcctccaaccaactgagccatggttagaccagtgtccgaaatgaaatccgttatgccaaagtcttcgccggtcaccaacggctcgaccacttggtttggttgttctccaagctgaggaactgctttggacttcttgtaataggctttcctaagtgttcggtcatagtccgatagctttaaggcctccttgtttgtggtggacattcccttgaagaaattcttcacgctcgggtcaataggtatcttcttttcaggactccgaggcttgagttgcctcttcacttctcctgccacataagcgtcaagctcctcttaactgcaatcgtacggcggctccttgtttttggtggtgtcaactttggccttcttcgttgcccttgtgctggcaggaggtggagcttggcgagaccttgtcttgggaggtgcaggcggacacggtggaggtggaggtggaggaggcggaggagccggaggagatggtgcatgaggaggtggcggaggagccagaggagatggtgtaggaggacatggcggaggaaccggaggagatggtgcaggaggagacggcgaacccggaggagatggtgcacgagacgccgcttgtcgcccagggaggatgatgtaccgcttgcgctatagtataatggcgtgccttgtgtctcgtagatgcgtctcaccatctcctcctgggtagtccaactcgaggtcctcgtacacggcttccaccagctcaacttcgaccctcgagtatcctgctggaatcggcctgcagtggtaagtccctgaaatgtctgttgggatggccattcccgacgccaccttcacgtgatgagaggttatctattagtaatcaaactaaccagcaacttgcagaacgtacgagtcaaaaatcatatattacatcgagcataccttgattgataagttcttgaagggaatatgcagctcacatggtgtccgttgcgtgatctcatcaacggggcaggtggtgtcgtcatgggtttgcatggcgtccatgctatgtgatactacctgccccgttgaggcgcagctactacgattgcctgatgggctgaccattggaggaggtatgtacggctggggatcgtgtgaccgatgtgctgccatgcgttcatccactttccgggccacctcctcttgcatgctgagttcgtagctcgataccctgtactcaagatctgcaatcttcgcctcagtatctctcttgctcctcatccgactcctgtacgtgtggatgtcctccttgattcccatcttctagggaatcacgcctttccctcgtgttcgtcctagatgctcgagagtctgtagggcgagtgacagctcgtccttctctctgtcgggtcggaacgtgccctgagaagaggcttccactgcgtccgttagtcgattcgtagcctcgcgtatctgatcgctgaagaccaaggagccattaactgggttgagcgttccaccatgagaatagtaccagaacttcgatcgatcaggccatttagcggtggacggttcgatacccctctcaagcaagcttgcctccatctcctcccacttcggcatcgcgacgctatagccgcctgaccccaagtggtgatggtacttcttcttagcggcattttctttgtttctttccatcatcgcctgcccttgttgacctgtcttgtaagcaacgaactcgtcccagtgatcccttagcttcgggaatacatcgaagttcggtgtctgcccccttcaagatgtatttccggtacaaatctcccttgaaggtctagaactgttctgccattttcttaagagtccactgtttcactatgttctctgtacccgcagggagcgtgaacgtctcgagcattgtggtccacagcatctctttctctgattccgggacaaagctgtcatcatccccgcgtgcccttgttctgcgccagtacaccttgctaacaggcacgttatccctcacaacccaaccgctgtggcgtacaaaattcttggctacttgtgccggggcactaggtcggccgtctgcatccacctcagttatgatgtgccgaccctctatcttcttcgcagcacctcgttgtccgcgtgccctcttctgtccagcgtagggatgacttccactagcctcctcctcgttcccctccgcatccctctccacgttcccctcctcgttcccctctgcatccctctccgcgttcccctcctcgttcaagtactggtttggatcctcgttcccctcttcttcgttccagtactggctacttcccgatgcgattgtatcgtacagtatctgttcctcatcgcgatcagccatctgttcatagaagaaatatttgctaagcataatattaacactctactaatcttgtattaaaactcaaataatcatatatgctaagtctaagtgtcatgtatttgtatggtagataatcttatatgctaagtctaattaagtttcgaatattacatctctaataatcttatattaaatctctaacaatcaaatatgttttgaatattacatctctaataatcttatattaaatctctaacactcacatatgctaagtctaattaagtttcgtatattaaacctctaataatcttatattaaatctctaactatctctaacactcaaatatgctaagtctaagtgtcgtgtatttgtacgatagataatcatatatgctaagtctaactaagtttcgaatattacatctctaataatcttatattaaatctctaacactcacatatgctaagtctaattaagttttgtatattaaacctctaataatcttgtattaaatctctaactatctctaacactcaaatatgctagtctaataatctaataatatctaacactcacatatgctaactctaataatctaataatcttatattagaaatctaacaatcttatattatatctctaacaatcacatctttacatcacttgcctgcgcgaattccttcgagggctagctaccacttcggcttgagggacgacgacgacgacgtcttctctgcaacatgcaaaaaaaatgtattagtctaaacgcaaaggaacatataatgtatttcacgttttcaagtatatataatcatatatatatgctaagttcaacaatagtttaattatctcgttcgtacatgtttcgctcgcattcgttctaacacttttagttcaagtgcattcacgttcgttaacgtttcaatcacgtttgttcgcgtttcattcacgttcgtttacgttcgttcacgttcgttcactaacactcacgttcgttcacgtttcagtcacgttcgttcgcgttcgttcacgttcgttcatgtttcattcgcgttc

SEQ ID NO: 20150 - DNA, 3697 bp, Oryza sativa
agtaaagattcgtaacaacaaccgggattaaaggtcttatctttaatcccggttgttgttacgaaccgggagtaaagatatctttactcccggttcttctcaccaaccgggagtaaagatatttttccgctatttccaaattcttttttaaacccggttaggattaagaaccgggactaaagttaatagcactgaatattgaatttcgttgcatatgtgtttctaaaatagtaaataatgcattaaaaattctaattaacatatgtaaatcccacatgcatgtcgtgaccgagaaaattgccttttcccgaacgctagtgtattaatcccagtcccaggaaaagccggggtacaccacacaaacatgatacaaaaggcacatctttattatatcgataatatttacattattacaaaggcacttcaggcctgacaaacaaaaataaacagcagcggactagcgggcctacggctccatcttcacaggcgctcaactggggtataagccaggactccacctaggacttcttctccaaagcttcttttactgaagggaggaaagatagagcaagaatgagtacaaccacagtactcagcaagtcacaccgggagatgcatgattaatgcaagggagtacaaggggtaataatataggggttaagtttggcagtaaacagcatttaaaagtcacttagttgcccaaagctattttataaatacgatcctagagctacatagtattattaatcaaggccgtggacccacacgaacctgccttaacccaaggcctacgatgattcagaccgaactggcaacccgacctgggtcccaactcgtcccaagccaacccaggccaacctttccacattttagttgttaagaaaattttaagaattaaaccactaacttgggtacattgctaggcttgcccatatccaagggcacggctattcgaatagatttactctgatcagaggtgtacatctttacccacaagacacatctttactccgcattccatggccttggaacccgtcgtaaacatgtgacataacccttcacccatcctagccgtgaataaaagtaccgacccaaccctgcctacggtcgatatcccgggacaggcaggccaggattgagcccctagcaacaggatctagaccgggtgcgccacacgcataggggtgagaccacccgcgtactagtccagtgccatggcatctcgactaacgggcaccgacccgtgtagtcttcatttgcctagacatctcgattaccgagccgcagctcgtgtagccttcatttgcctcagagatatccatcgtcgcaacgacttcatccatctctatccgtgtccttttgtttaggactagactgagcaccgatttaagccttacccattagacatgtggttagtacggtagtgctttgcaacagagacccgagcttaatccttatattggccggggtgctacttcccataactggcatgcacccaaaccccaccggaaaacatgttttaggggttttgaaagaggaagagaggggtatgtccaattccaccataagccaaccattccatagtatccaagtgatatgagaattcccaaagtctaaagttataaaaccacctaatgttgcctaattaatcagcgaagaatctacctaaattcatactagtggaaccatgaatagagtacccactagttggggttttgttttcctagggtgaacaaggtgataataaacaatagcaataataataaggtcataacaaaggattaataggaagtgctaaataaaacagtgataacgcgggaatttaaataaagcggtaatgcagtaatttaaatcaaaataattttataaactgggattcaatatgctcaagggagatgcgacttgccttgctcagagagaatggccttccgaaccttcggcgacgaccgcaaaccacgcttcgagaacctccggaacgacagaagctacgcgaagcacacaagcaaagctacaagcctataaaaaagcaatagcaatacataaaaagaaagcacacggttctttaggttataacaaacattaggagacttgaacgggtcgattcggagttcgtatgatcaagatatgatcatccgaagtttaatgctgttacatggagatttacggattattgtgattaggttttgcaattataaaatatgtataagcgctagcctggaaaagacaggaaggctgcgccgttgacatacggactccacatgtcaacctaagggaccacggtggaccgggtacacagagacggtccacgggtcgacagaagcagatcccgtgtgtcaaccgaggcgagtggccgacaaacggactccactagacaccacacgggctgcacacttggaaaccacgcggctaccgagcggacacactatcacggtcaccacacgcacaagcgaacgactaccgacaccggtacacgggtaccggggtcgacaaccgcacaacgggcacggggcgacacaaaaagaatgaggacggggcagcgaaggagagatccttaccaccacgcgacgaggcgagggaacgacaacgacgaacgggcgcggcggagacggccgggaacgacggagacgaaaggcgaggggacgacttcggcggtgatccttggacgaaggcgagacgcggccggcgtaacgcttggcgacgcggaggcgaggacgaagacgatgacggggctgcggcacttgacggagcgaggacgacgaacgagaacggcttgacggagggacgaacgccacgacgaccgggaacgacgggaggactacgacgacgatgaccggggctggcaaggaggcgacgtgggcagccggcagcggctgcacggagacgaggacggagtggaacacgccgctgtgatgccgacgacggaggcggtgccgcgagacgacgagtcggcgaggaggaatgaccgaccggaggagtcgtcgacgaggacgaacggagatgacgataacgaacaccggcggggttcagatggaggggaggcgaggccgagggcaaccttgacgctgtgatgccggaggtggtggttgcgcggccgacggcgcacgggtggaggaagggccgactggggaaattccggcaaggcggatggagaggccggcgcggcacggcggtgttccggcgaaaccgagggcaggccggggtggagggtgacgccgcaatgtcgacgaaggatacggcgacgtcggccgacgctcgggcgcggcgatcggggcgactgaaggcggtacagtggcggcaacgccactgttttgctggcgaggacgcgtctccaggggtctccgcgcgaaacggagggcaggccgggggagaggaggctgctgtgacgacggggaaggcaacggcacagccggccggcgcgctgacgcggcggcaggggcggctggaggcggccggcgcgggggaaagagaagggcgaccgcggggaggggtgatacgaccacggtgaggctcgggatgaggctaaaacgatagaatggaggatggggattccattttatagcggagggaagcgagccgagcacgggaggagcggggaaaggcggcggaaaaggcgcccggcggccatggaaggcggccatgaatggcgcagccgttccggtcaaaatagtgcacgatcaaaggggagattaggggaaat

SEQ ID NO: 20151 - DNA, 2471 bp, Oryza sativa
gactttggccgcggcccgagagagagagaggactttgggccagacttggcccaaaggaggaaggaggattatttttaggtttttctttttattaaactttgatcatagttgttgttgcttaataaatattttcggtgctctgaaaatttaagtaaaatttgagtgctctttttagaccaaggagaatttaacgaaaattctccgggccacattcgaaattttcttgtacgcattttaatgtttgccaatttctttttgaattttaattaattctattattccttttagaaaatgatttttatttcaggatgaatttatcaggacgtgacaatgcatgatttaaaacttttaaaaattctaataatcatatataattagcatatgcatgatattaaattgttaaaaattctaactaacatatgtaaatcccacatgcatgatttaaaacttttaaaaattctaataatcgtatataattagcatatgcatgatattaaattgttaaaaattctaactaacatatgtaaatcccacatgcatgatttaaaacttttaaaaattctaataatcgtatataattagcatatgcatgatattaaattgttaaaaattctaactaacatatgtaaatcccacatgcatgatttaaaacttataaaaattctaataatagtatataattagcatatgcatgatattaaattgttaaaaattgtaattaacatatgtaaatcccacatgcatgatttaaaacttttaaaaattctaataatcgtatataattagcatatgcatgatattaaattgttaaaaattgtaattaatcatatataactagcatattcaatacatccaaaatagtttacaacaattacggcaatagatcggcggtgacggttgtccgcacgtactttctcctcactattgttccttccttgtgatcgctacgtgagtaaggggtatcttcgtttgataggaggatgctagggtcaaccgtcaccgtgaaagggggttgcccatcaaactgatcgtaatcctcgtcagtcttgtcgtctactccaacgattttttttgcctgggagaaccacgtggcgcttcggctcgtcaggccctttgcccttctttcctttgctagacatgtccttcacgtaaaaaacttgcgttacatcattggcaaggacaaaaggttcgtccgagtatccaaccttgttaaggtcaaccgttgtgatcccactgtcatcaatcgttacgcctacaccagtcaacctaacccattgccaccgaaacagagggaccttgagaggtccatagtcaagttcccatatctcctcgatggcaccgtaatacgtgctagttgtaccatcgtgtcccatggcatcgatacgaacatcactgttctggttcgtgcttttcatgtcttgggctcttgtgtagaatgtgcacccattgatctcatatccctagaatgtcgcgatcgagccagatggacccctcgccaggaaggccagttgctggttaatcgtctcgttacccatgagatgttgtcgcagccatgcggggaaagtatcaatgtgatgccgtgtaatccatgcatcggacttaccaatgtttctggcacgaactagagccaagtgctcctcgatgtaaggagctaccaatgaaaatgtgtcattatattgaaaaatgaaggtggaaatatcaactcaaacctgacaagacattgcaacacatcattctgaagggcttctaacctatccggatcgatgaccttctgcgaaattgcgttcatgaaagaacatagctttgttattgttgcccggacattgtctaggaagccaagaaggtttacgcaaaggttcttagtgaggtgcatcacgtcgattgcgtggcggacgtccaagaattcccaatagggtaactcccaaaatatggagttttttttccacatcgccgcatgaccatcttcgcactctataggctggctgccaggcccctttccaaacactactttaagatctttcaccatagcaaacactgttttcccgctgtgatgtttaggcttcgtacggtggtccgtcttatgttcaaagtgcttgcctttcttccatactgggtggtttgcagcaagaaatcgacgataacccatgtacataaccttcctacagtgcttaagatacgtactttctgtttcatccatacagtgagtgcaagccttgtaccccttgtttgactgcccggataagatgctaagtgcaggccaatcgttgatggttacgaacagcagcgctcgtaggttaaactcctcctgtttgtcctcgtcccacatgaggacaccttccttcttccacaacagtttaagatcttcgaccagtggtcttaggaacacatcgatgtcgttaccaggttgcttggggccttgaataataatcggcatcattatgtacttcctcttcatacataacctagggggg

SEQ ID NO: 20152 - DNA, 674 bp, Oryza sativa
atgttcgcctcacccaaaagcctttgacctgccaggggcctaattgcaataatgccttgtccaaaaacgcattgcgaaaacaaacattagtggaacctcacttcctgaattttctgatcttcagatcatccatgtggcagacacacttgctctaatctctctctctctctctctcttttcccccattctttcatctgcttgaagaagcatcgcaacttggattccaggatcgtgccactgcgatgatgatgatgagcatgattttgcagtagcaacgtgcgtcgttgtgtggctgcaagctaggatgcgagctggtgcgtgccaacaaccacgcgaggtcactgctaccacaaataaatcagagaaaaaaagacgtggagtggacggaaattcctctctcctctctcagctgttcaggcaatcatcgccatggagcttggaccaaaccactaatctgtccacttcttttttaataaaaaggatctcccaacgaaccacctaatcagcaacacctcaactgtttccagtacgggaaattccgacccctcaacatcagccactaaccacgtttcaaaagccaaaaaaaaaaaaagaatcagaaccttcctctgttcaaagaaatcggagacgatatcgatttttcagctggttttgcacagaatctctccgaaaga

SEQ ID NO: 20153 - DNA, 387 bp, Oryza sativa
ggaggaatggaaggtgggaggggttaaatactggcgggagcgggaggaagaagggagttggggggagttggtgagcggggcccggagaggatgacgtgtgggacccacctgtaagcgagaggagcattgggttggtgagagggagggggggttcgttgactggggcaggggtgccacgtcaacgtcgtttaccaaccccattataccagcgggtgtttgggtagggtgggaaggggatgggattttacggaacccccatcgcattggtcgctcgcttttttgttggggttggtgaccattggcttttctggtttttccagttttttctgctggcagtgttgggttgtgctcgagtttcagcctttcactctatcaggccactggggt

SEQ ID NO: 20154 - DNA, 116913 bp, Oryza sativa
  unsure (1)..(116913): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnctagagtcacagtttgttgcttcagatggagcatttacttgaagagtcttctttcgtgtattctcttccatccatccagtgctgcccaccttctggagagcaaaatagtattcctataaacatctgtacttcctacacaggcagaaagtatgttttgcttcctgcgatttgtaatgtacataattaccattgcacctttattttgtataatttttttatatgtattttaatgttcctaaattaagctatataatctctttctaaatttttatttctattgtagcatgaattactccgcattctttatccactatttttccactgcttcatggatttagtggcagagggacatacacaggaaggtaatgctagtaggtggatatgataatgaatcttctgtcagtttttttttttttttgctttctatcagtttattcggggcagttctttctttgatacactaactttgagcactgcagcttgctcatttttccacacatttcgtgaagaccatgaacactcgagggatctcaagaagctggaaagcatcctttctcctttacatttggaagttagtgactcagcttttccacattgcactaccctattttgaatgaagacttattttttgtttatttgattctatctcctcaaagtttacaaattatggcttatccttctaaatattgtaatttcagcaaatggaagtggctcgatctttaaggcagaataaattcagaattaagctatgtgaggttgtataccatttccaaatcccctttcatttcaaccctgtaccatgtactattttttggggcagcatttcatgatagccactgtaatttcttgattgctgcaaaattgcttttctggaaatataatcagctgtcccaattaaagtttctgtctttttttattgcagtattcatatgaattgcttctccagtatctccacaaaacacaagctcttgtggtgcttggaataatcaatgaacgcatagattttcaaggtaagtttccccaatctgttatgactcatgattagtgacctaaatgttcatcctgcatttgctccttgtgagttatctgaatcttctgttccaactttcctttacaatattgatagtatcccctgggcagtctccattaatcattgatgactcggatgctgttgttctgattggaactagcaaggacttgacaaaacagataaatcagaaggaggtgcattggggggtatgttctgtaccagtctggtggtttcccaattctcatcatttattttatcaatagttaaggatacagcctaaacgaattgaaattatatagatcgatcagttaatatttaatgggattctagccgtttttattatttgttcactatgctcagacattttatttttgtgatttaaattctgtaatgcagatacttgaagattcacttgaagaacgtatggagaaggcaatttcagattctgataaaactgaaatagaaagcaaggatgcagacacagaagacaacaaggcaagaaactgttttgtagtatgccagtcttttttttcattttgcttcctatgccctcggtcattgaaacacaagctttccttttttttagtgcgtgcgattctgttagcaacttgtgatttttatggttgctttattataaaaacagtactttctgatgtgcactggctgtcagctgtatatgatatcaatgtttcattgatttgttccactatgtaattctgcattctcctttgttcagtgctcccgtaaatgctagcaggcagactggttagaacctagcacctgggaaggctaggcagctgcatagggggaactatgttcctcactcaccattgatgtttcttagccttctcatttcactcttttcttatttttgctacagaaaagatcctcagaaggtggaaagcagggtggctcacataaaaagatcaaaaaggacaagtttgtaggaaccacagggaaaaacatgaaatctgaaactagcatggtttctatagcaccacgagttaaaccagagctaacgcttccaatgacgtacgtcgtacaatacatctttaatcacttcaaattttcttttgagaagtccaatttggtcatctaattttgaatattgtctggtttgtgacctaaggttaaaaagttctcctgaaatgattcaggattttaggttatgataaaattataacttcctctgcatccatttcctggtccgtggttgggaagaaggcaaccacatgttttttaaattcatgtggccattgtttcatttttcctgcagactgccccttttgaaacgcaggattaaaaaacttaggaatatggaaaacaaaggaattttgtaggttgattggaccgtaggaaaaacatagcaatgggcttggattataagagtaaattgggtttcttatctacttatacacatcttaccctcactaattgaatagacaagtggccatgagctactagatttgccttgatccaacgcgagataacaaaaacatgagcttggaatggatgttaaatttcctatgttttcctctagatttgtaggaacaggaaaatctcctgtgattttcctttcctcattcctacaaatcaaaggcatgaacaatgatcttccctataggatttcaattcctttgttttttctccaattcaaaggggcctgcatattctatgcaccaacatattgcttcctcatccacactgttcaaatgatttggttatcccatgtccacctgccaatatgttattgcttagatgttgtttaaccgtagaatatttgagctgttcaaaagcacttttgtaagacattaacaaaaccaaagattatatttcctttgccttccaaactatcatcacgacatggccattaaggctctgttcgcaaaaacaggttcccaacccaaacagtacgcacagaaaacggagcggtccattagcacgtgattaattaagtatttgctatttttttttcaaaaatggatcaatatgatttttttaagcaactttcgtatagaaactttttctaaaaaaaccaccgtttaacagtttgaaaagcgtgcgtgtggaaaacgagagtagggtgttgggaaccagctcttgcaaacagagcctaagcccactgataagattttctatagtgatgtttttttcttatattaagttgtaataatttctttgtacacatgtttacttttatttgttggacatctttgttgactcatcagccttacctttatctgtaagaatctgatagacgtttactgattattttttttcaggtctgttgaagttgagcagtcaattcttgaggacttgcgaaaccgtgcacaattgaatagcttgtcattgccatctgttagcttctatacattccttaatacacataatgggtaaacttaactatggatcaatgcctgacaatttttattttcaatttttcctccttcagtttaatcattatatgtggaactcaggttaaattgctcatcgatttcgcatgatggttcattggtcgttggtggattcgctgattcatcagtgaaggctagtccttttaggtggcatcttcttattatgtgatttctgtattaattcgtaatagtaaaaagtgtaaaatctccttggtgttcactaggtttgggatatgtcaaagattggccagccttccaaagcatgttagttgttcttcactccttatttttgattatttgttctgctttgtgttatgctgaaacacttatataaatttgcgtctggtttatgtgactaattggctattgccttcttaaaaatactataatggtacattcatttgtatcattcgaagttccagttacaagtcctaagaagtatgatgtttttcagtcatacttgctggatgtactgatgcacttgtgtcattacagtatttgactctggaacctgttcagaaccttatgatagtcttagaacattaatcctcctagcatcaaagtcaattatgcaatgatggtatttactgattgaagaaactataattttcagcttgttcacaaggcgagaatggaccctcccagattgagcgggtatcgacatcagatgaagcgcgtaaatcctgtacattattccaaggtcattctggaccagtttattctgccatgtttagcccaattggggacttcctcttgtcatcatctgcagactcaacaagtaaagccttctcattgtgcttgttttgtatcattctcttccttgttactttattaattagaattcacaatttatctatatttttttgacttgctacagttcgcttatggaacaccaagttgaatgctaatcttgtttgctacaaaggacacaactaccctgtttgggatgtccaagtatgtgattaccagttcttttagtatattattagtgtggatacaaagctgttttcaatgccaaaaagaaaaaaggaagcatgggtttctgtgtgctccttatgaactattcctaactagtatttcatcgttagtactctccatgatggagtactaggtacttatatgtcctgtgaaaagctcactgtcaaattcttttggatgcaagttatctgattctgttattgtagtccttgtgctatgatagttgttgacactgttctgttttcttttggcagtttagtccagttggacattactttgctagtgcttcgcatgacaggactgctagaatctggtccatggataaaatccagcctttgagaataatggctgggcatttatctgatgttgatgtaagtgtactcatggttttggtcattttcttatatgggatcacttaatgttggaatatttccatacatgcttattctctaatttcctatattgatgtctgcatttttttaaaaaaaatacttttgcctgacagtgtgtgcaatggcatgtcaactgcaactacattgccactggctctagtgacaaaacagtaagactatgggatgttcaaacaggtgaatgtataaggatgtttattggccataggagtatggttttatcattggcaatgtctcctgatgggcgatacatggcctctggagatgaagatggaacaatcatgatgtgggatatatcttctggtcgttgtgtttcaccgctagtgggacataactcttgtgtgtggtcgcttgcttacaggtaatcatcatttgatgctggtcggctggtaaaaatataatatctatctagccgatttctttaatatgccaatagagtagtattatggaactacggcactacgctagttataggcttatagcatggcttggcaaactggctagtgcatatgtagcaggactgagttttggaaaatcaattggtttatttgaattgagtaagcatgatctatctatatacaagaaatcagctcatcgtttcttccatcctcatctagatgtgtttaaatgatatcactcacaagggcatcagaaaccagatctggctgcgtctggtttttgccttttcagttttagagttgggctttgggatttacactgtatcagtggaagcaaattggagtatttttgtatagaacttaaatttgaaaaaagtgttattagaggggtgaacctgaggagttctaatggtagcaaaaacatccacatagatgtttccagtttcaaggccagttaccagctgttaactggtgaaatttacggccaacagtttgtcttttttctttgataatctgctttgaatttcttgaataaatcaatgagattaatacagacttcaaagtattatcattgcgttggcatgtcaaaaccttgctgttagcagcaacacaccttcttttggggagaacaatagaaacgtgcatgttgttggttacaagtgattacatatggaatgttttgtttagactatcctgtaaatgatcatttgttgttatgctttgctttatttaagcttgcgatttaaggacttctttactcgcacaatgctttccatgtatggtgcgcatgatttgtgtatataaatgctcgctgttatttctttcagagggagtcatgtttgctgttttgtgatgtctataatctgcgttctgttgtagtttaaggaaaagtatggttgatcttagttaatacattctgccattattttagctgtgaaggggcattacttgcatctggatcagccgactgcactgtaaaactatgggatgtcgcctccagcactaagactcttaagatggatgatacgtgagttgatcgaagtgtttataaagatgcttgtaccaaatcattgccttactcttgttgtaaaatgtccttgtacagcaaaggtggttcagctaaccgactgaggatgctgaaagccctccctacaaaatcaacccctgtttacactctgcaggtgagaatttttttccctcctttagtccattatgttgccttaagttatggttgttaccttatgcattgtaaacataactgctttcatcttgttgcagttttctcggaggaatcttttatttgcggctggtgctccctcacttggctcctaagcttctgtatgttctatagagtacaagtagcattctttcagtttttggttttagtaagtagtaaagttgatgtctactggggtggcaggtgtcgtagcatctacattttcccttagtgatcccagtgaacctaggggtaaattgtagcactggggcactgcaattcgttgcaatatgtgtagtgatgtagcattagccagttcaaaatatatgcaatttcccgtaatgatacatctaactttactctacgtgtgccatactgtttcaaccaatcattctttccactcaaattctaccctttgtatggatggggtcaaatctgaaccgaggtataaccgtgtaacctcattttctggatagaccatgcccgcgcgataactccttctcacagagaatgattaaagcagagtttcttatgttcggatttctgccaatttaaatttggttctaactctcttggtaccaaacagtaagctccataggcactgatccactgctcttacctgctagctgctactgttgctcactgattgctctactgatggccaagctggccaccttggcaacagtcgaccaacagcccatggcctaggtgctgggatgaacagccctggatcttcactgttaaaaaaattttagagggtgagagggcatgaggcaaactcaaatctgtcaatctaccaatggtcatgtagtgtggtatagtagagtgcagaagattcatgtatttacctgtgaaaatgatggtggatttcggcagaattgaatcggagacgttgcatgtcttgtagtttcaatgttcaaatgatttggtctcccggcacctgtgtccatgcaaacacactccatataccagtgccaccgcgtctctgtctcccagtgtacaaggttatggatctatcagcctgacatttcactctcagctgcaaacttatgatggtccacgctttcagctttctcccatcacgccactgctttcgccatccgtccaaaacgagttttttatttttttgctttttctttttcaaatataaatataccctgacaggtgaactatttttcctgtgaagttcatgtaattgttttttgtttctctcacagcttgtctcagtgagagaagtgaatgcctagatcaatgcttggtggaagtggaactagaaccttagaaactttcaactgtttgctagaatatgtgtgtgcaccatttatccaaatccttgtgttggccatactcgccagaaagactggacacaccaaaccacataaaaggtaaatttgtattcatctgcagagtttacaagcaaacaactggactgtcattgggttttggatccctcctagcatgcatgtgacttttttcttagataaatggaaagcaatgcatgtgactatctggctacctaacacatattttgctggtatcctggtgaatatttggtagaatactcaccacttcatcagaggatgtcacaggcataaaactaccatattactagcaggttgccatcaatcagatgagatccctcatgaaacaaagttaatcccttcacaattatacacagcccatcttgcaggctgtaatctttttttgagagcctaattagttgatcaacatgattggcaaaaaggctcaactttttcatatccatctaaaaaaaccagttggcattgtgtggatgaaatgtagctttcaacatcctgcatttcataatttgcattgcctgcttaagatggattagagagcaaggagggtcatcctccaacctccatgggacctatgtcccaaaggtgagcagcctacctagttggtacatggcaggatcagcttgcagcctcataagctgtgacagtgtgagggtactgaggtcccctctacctctgttcaccatgtatcatacacagtgccagcagcctttttggagtccagacattgctccattattgtgtatgtctcctaggctagagtactagacccttggcatttggcctcttcttctaaggacaactgccatgaatctcacatatatagtgacttgcatggccttttttcagctctggtgttgttattatagccaacattcaacattttggtttaactggatttgactgttagtttaactgaagatgatttcagtgcaaatattgcatttttcaaaatgacattgaggatatagatgcataggatgctgccactattagtgtggatggatagctggagtggtgatggtgaaccaaacaacccctaacatggtacgttctatccacgtacgttttgagtgatctttgcgagtgctccgtgctaagaatattgaaaggatgaagctgatctggtgataataagctggtccttgcacatctcctaccgtccacccacttgtggtagggcatgcctcttatcattttgtggacacaagtgatttggcaacttgatcacactaactattcagatcatggtgcttaattagttttttgcaatattccccttggtggttagggagcaaagatgacccttttataagttgtgtggttattgatcaatccatgatgtgagtattgatgtcttaaaaggttattggagaatgattggcatatcacagtggcagtatagcactagcaagcagcagatgcatttgagtattttgagtgtctgaaccattcaaccaaaacaataatatataactcacctgccaataaatttcaaggtattggagcagtcactgatcactgcatacatttacaattttctgtaacactatatgcatgcatcatcatgtgagaatcttcactgtgcattcctgtcatccccatgaagtaggaccatggtgccctaggtttcttccattttcaattcattccaagtttgtgttgcagccttgcaggagctaccattgctctctgaacaacacacaagaaagatgatggtaggaagatcagaaggggtcactttttttgggctcgatgacatgagtggacaaatctacccaagctaaggttagtgggagcagcccatgtgatgatgtggggtgcaattggatcattgtcatcttaccttttttttcccacccccttcttttcatcttgtgtggcaaagtgacatggcctcatgtgatgatgcatgggagaaaaggaaatttttttttagtagcaatgcaaagtgtgctctttgctgaaaatgcaagaggaaagtggcttttgtgcaaatggcataaaaccttaagatatggggggtgaatttcatgagtgccttgcattatagaaccatagatgtgtagctagcctttttgtggtgctttgttttgataattgtggcagtgcagatgcacagtggcatcaatctacctgttagtgcaataattcattttggtgaaccagtgttattatggttttgttagttgggatacgacaccacatatgttaacaacatgcctaattttatttataatgaaatagcaaatatcaatattttttaaaagaaaaagaaaaattgagagagctctaagaaagatgccttttaagttctgttgttacatgaaaagtgaacttgtgttattatggttttgttatttgagatatgacaccacatagtgttaacaaacatgcctaatttcctttatttataatgaaatatcaacagagagaaatagagacaagtctaagaagaaagatgcctttcaagttgtgttgttacttgaaaagtgagaagattgctatgccctttttcttgtgtgaatggattccatctcttgattgatatggctatatatgccttttaggaagggatccatgccgtccatcttcaacaacacgcaaatgatcaagaaaacatggccgaagttgctgcccaacaaaccctagctagcgagtttccttggatgaaagaatattagcacatcatcatcagaaagcgagctttgtcatatgccctagctacaagactatagggatatggacgcatctcacttcactttacgggtacccattgtcacacaccatatacacaataatataggataagtgaattttagttgattttgcttaactagatggatggtaagactttctagcattgtccacatacatatagatgttaatgaatctaaacacatacatatctctagatttattaatatctaaatgaatataggcaatgctagaaagtcttacattgtaaaatggaggaagtattaaccttgattgtatatagttcattattaatcatagaaattaggtaaatgtagctatatgctattagttggtttgtctctgaacaatgaaaatcagtcccttcatctcgtttatggttgattattagttataacgcttattaacaataaaaatgtacatgcgttaaaacttgtgtatgtgttatatatcttagtgatttataagccgatgttaaaaataaattacgctaaaattattaaaatcaaaagtgtttgatgcagctaataggctaagggcctgtttggcacgggtctaactgcacctcccctagagcccagtaagatagtttcaactccatctaaaataggagcagagctaggtaaagcgttctcataaaataaactagagaggttcagtttggtttagactgctccacaaaattccactccaaacctaactcctagagttaaatttagaagttaaacctctaccaaacggaacctaaggctgcctttgaaagtggaggttgagaactccaattgtttgcatgcaaaacggaacgacaaataacgttgattaattacatattagctaaaataaactagaaaactgaattaatatgaatttttaaagcaactttcctatatgaactttttaaaaaaacacatcatttagcagcttgtgaaacgtgtgcacggaaaaagatgaagtagaagttgggaaaaggtgttgtcgaacagaactaagatcaagtttaataatataatcaactactagtttcaaaaattaacatattatctataactaacttgatagctcacttagagcacccgcaatggtaaagtaaggtgctatctataaaacatgtacacctcaacaatagactagattaatagtaaaccacttcaatggtatgtctacatgggtatctatagctctctaatccattgtctcgtttttctctatagactatctccatgttagtagatagctttgctctctctcttcatttaatctctttcaagtaggaaaatatgctgacatggatctcttgtagagagcttatagataaccattgtgggtgcccttataccatacttacttatagatatatactataccattaatgcatatcctatctcacataggttattggagcttgtgttgtagttgactacaaatctttaaccaacttttctctttccttcaagtaaacacaaatatagtgtggtaatatgtagaacatacttgcatcgtcatattgagttgatttggtttgtggcctaaataggccttaccaaattttgtctaattttggtaaggtaaagttgtatttggattgaagtcaaaatagcctaagtttactattgaaatggtctattttcttagacatgctaaaatttggcttcaaaccaaatagacagtaaatactattgaaattgtcaaatattggtaagtctaatttaggcctcaaaccaaaccagtccattatactcgctcgggtcaaaagaggctataggcagggtagagtgtcatttggaccttgaacattttaaagaacaaaacattcaagttaatattttactcctgatgagagagttgctgttacagagtgtgaaaaaccttaggattcctgaacatattttactccctgatgggtaaaaagaacagagtgattaattaatgtctgatgctgggcccatccaagaccaatcatggtggagctgcagtaactgttactccaatattgaccaaatgtttgtgtgtacgtactgtagtagtagaatgtatgaccagctagctagtcagattccaaagaaagatagtactagtagtaaaaataactgaaaacaggcgtactatagtagtaatacctagtactactgagtgaaagcagggggtgtactcttgtacgtgtttcacgtgctatatgtaagagcaggtacaataacaaattataaataaaaaagaaaataaagaagagagatgagcaattggctatagatttatagccagctacaatatggactcgaagacacaatttatatataacatgtaggatcagatattaatagtatattatatatttgtaggtaactattatataaattggctataaatgatttggagctattagttggctatactactattaaacttgcttggctatactattaaacttgctctaagcagaagtggtgaacaaaagccgggagtacaccctcagttcctaagtagagcaatttttggttgaaagagatacagagtactttcctaaggatgaatttggacatactccctatctaaattcataatattaggatatatcacatctgacagagcgtggggctcctcaccgggagaccgcgcaggcccccctttgccggttcggccgggggctcagggtgaaatcccaagctctctctgtatgtggaaagatcgcgacctatcgaaagagcatgagacacaggcgatgtatacaggttcgggccgcttagaagcgtaataccctactcctgtgttttggtggatctgtgtatgaaggagctacaaagtgtgagccagcctctcccttgttctgggttccgaatctggcccccccccaaatccccccttttctaaatgggcaaggtcctccttttatatttcaaggggataccacatgcacccccctctctcccaactggacttttcttctcttcataaatggacggagatttgcatggttgccctccgaatgaccttctgacgggacggcccatacctacctccacttctgccgaaggcaggcgcgtcgtgggaacgtggctgtctgctgacgacatgatcagtgtcagaccggtcacaagtcggtcattcttgtccaccatgcgtcagcttagcaacatgcatgtttgcccttcttcacacaacatattgcttgtaatggttaggatgaagcctggcatatatccgaccggggctaacgtgccatctctgggaggtaacacgctagctccagctggggacgagtgcctagaagctctcgtcttgacgggatggggcgaagcgtgcgtcagaccgcctgtcgccacctaacccgcgatctgaccggtctgtgactggtcacagaccggataaaccagtgcactgcactgcatttcgtgcggcgtgacacgtttagccgagccgcaataaatgcggttaggtgagccccgctgtgttcacctaacccatacacgcggagtagaacccgcgaggggtcggggcgcctcggccctcgggggcgaggcaggagtggtccgacccccctgggggagaccaagaggtgggcgcacacatcaccctcgggcccgacgtcccccgagggtgccaggccacgtggtgtaaagtatctcttccctcgacagtcgtctaaggtccctctatcaaatactagtctacattctcacacggattctgataatatattgttaatgtaaaatttaaaaataaaataaaatccaaaaagagaaaacactgatttttactactcatatcaccagtttttaatcggaatcctgagctatatatcaaacaatgactaagttccttttattttctttacataattctcgccttctttttatccttataggctaggttaatttgtaacacattttgctaccttaatttaattaaggaacaaatggtatatctccgatacgcagcaggaagccaccaaaataaaggcctatttaatattgactagctaacaagagtaagcatgagataagtttaagactgcttaagtttaactctagttcttttgttgaagttctcaactcaacttaactcttttgtttttcacgtacacacctttaaaactattaaacagtatgtttttttaaaaaatatatacaaaagttgctttaaaaatcatattaatccctttttaaaaaataattgatacttaactatcgtgatttaatgagtcgtttctttttacgtgcgtgagagatgagttttcaacaccgagcaccgaactcagcttgaagctttagattctaagaaacaatggatgaaaatctagcaagtaattaattaatttagagaagctaagataacaacttttatctttcagtttgttatctaagtatagtatcttaaaattttaaaaaaagctaaattatttggaaaactttagttcttaaaaaaattgtagatgctaaagtcttcgtaaacatgtcctcaaactcgggtggggatggtctaggtatgcgattgaactaattaaactatggtccagctctgctatatatcttaatttactttgacacgtgaacttgtcatgaaaaatatataatgcaaaccaaatatgtagtgaaacttgaaaactatcgttggattaaaaaaataacatttgagattgatccacgtcacgaaaagaaaaaaagttttcaggagtaaagtttttactcatgatgtggacaaatctcagccatttattttcagatctcacgatagtttccatatttgtattacatatgtggtttgtattacatattttcctaatttatcgctggccggtgaaaaaacatgttgaagtttgtgttcttgtggcaaacacatatcttagtttatgatttgttttttataatcgatggtattgcttgggaagcttaagattttgagaaatgatagttagcttttgagaatattgagaagctcagattctgacttctagtttatttgggattgtttttgactctagaagaagctatagatgtcagaagttccctaaacggactcctaatgcaaaagaatgcatttcacgaaagaaagttaactttcctctattcaaaggaaatgcttgacatcgggaaaaacacaaaggtgttcatatccaaagcatgattgttggatatttgtttgggatcatatggctatatgtcatgtttagagagcttgatatctgtaactactcgtggagtttttcactgactcaaacaatcaaattctcgcttaaattatatgaatcagtagctagctttttcttattcacctcaaaatatagttttagagcttttattcaccagttttgatgtatacaactttcgatagaattttaataagatcatggatgcaatcactggtttgtctcttaaaatgtgtgttaggggacgcattcacgggagtgcgagtgtagtgctacatatatagtggtgtgtgtccgtgtgccatgtaatcgaatggcctgtttatattgtacccaaaataaaccttataaaattttgacaatgacaaaaatttggcaatttaataatatatattgccaaaattttggtaggattttttatgtatttactaaagtttggcaagaaactaaatgaatgtgtttatttgacaactctaaaaaaaatggtatggtttgaaatgacatcgatctgaataggtccgaaaataaaaaaaatgttgtatgattttataaggtataggaatactgccgttgtgtttgtgtagcgcaactgtgcatagtacagtgtctcatgttctcatgatctcgtccctttgccatgccagacgtacctgcccgcccagtcacctcgcctgcgtaatctctgcatatgcatcgcaattcgcaagaggcgagagggaggatccaatgctgctgacacggtgggtcccacataaactgacaccgtagcacatcagcacgctttctgagcttctccctctccggtctcacggtgtcccccgccttgagcctggtgaatgacaggtgggcccgtcctgcgcgtgggaccaaccggtcagggggtcggtgcggagctctgggctttgcagctgcaggtcgcacgtgtcgcggggctccatagcggattggatgtgggccccactctccccagccgctaagagcatgtacaatagcagactattagccagctacaaacatattttaaagagataaaatatgagagagaatagcaacgggggctacagatctgtagccagctgcagcacggactccaaagacacaatgtgtgtatgacatgtgggaccatgtactaatagtatagtaagcaattattgtatgaattggctattagcttggctatatatgaattagagctagtagtgggctatactattaaacttgctctaaccacacgcgggttttggttatagacttcataattttgcacatccttttacagaaaatctatcgtacggtattctgtggagacggaatagtagtactgccttatctccttttcctctctctctgtatctcttcccctccactcgctctctctctctgtctcttcccctccactcgatctctctctctctgactaccacccatgagcacggaggcggcaacggcgacgacggtggtggcaacggcggcgacgacgatgacgacggcgatgccgtcactactagcccccgcggatgacctagacgacagtcggcggaccaccacgggcgacggccgccgtcgagaagcctcctcatcaagctcctcaagccgctcctcctcttcatcattcttgtcgctggcttcctcgccgctgccgccctcctcctcctcggctgcgctggcgcctcctacagtcggggagcgcttggcacaacatgagcgacgaggagctgctctaggtggcgtcaatggagctacgggttcggcggtttggagcgaggcacgacgacgagcgacggaatggcacaaggtaggcaccagatctatcgcctcctcttcctcttcctccgccgccgcccagctgctcgacctccccgacctgcaactcctcctcctcctcttctctcttgagatatcacgctgatacccaggtaccaaggcctgatacctaggtatcagctcgatacctagggtaccaggtatcagtcgataccagggtactagctgataccagtgtactaggtaccacctcgataccttacccaaggtactagggaggattggataaggtggaatcacaggatagcatggacctccccacgaaattgactatgcgtattaaatctctcgggattttagttatcctgtgactgctaggagcaacggaatcccgtggggtagcaaccctcatccttttattaccgatggtgtaatttccccgtactgagctggatcacgagtcatcaaatattggtcaggatgcatgcatgttaaattatacggagtacttcttgtatcctaaaataaatagtaataaacgtaacacaaccgaaatataaaccgacttaattgcatctaagcgcgaaatgttcagaattatacccctaaccaacatgtccgtgtgagcacgtaatttcggttgatcagacctccaacggagtaagggcatgttcaatgcgtagcccggcgagtggctctggctcacggtgtcgattttttcggtcggagccgtctcccagcagagggccatgacccctctgcaggggacgcgcctcctgtgttcctccgctcctttttgtcgagccacaggaccgggcttcacgttggagacaccgtggctaggggagtggctcatggacactgctctcacccacggattttccccttccacccctagccccagcagtctcgtgcttaatagatgcttcattagcgacggcgaagagggaggcgcataggagagaggcgacgaggggtggtgcgagagagagagaggcgatgacgatgactagatctggccaccagccaatgacgggcagagagggaggcgtacgcggtggtgcctcgttgtcctctgcgacgggagagagaaggagagaggcgacgatgggtggcaaaagagagaaagaggagagtggcgacggcgacgaccagatccggccattgcgcgccgtggcagccgtccgtcggccaccagccggcgaggggcgaagggcttcctcacgcggcggcagcgaccagatctggcgcaggctgtcggcgcggcggtggtggctagggagggtgaggagggaggcgacagcggtggctagggagggcgaggagggaggcagcggcgagcggcgggggagaaataggcgacgcgctcgagagagggggagagattggcgatgcatgtgcgcgagagagaggagaagtgtcggtagggaaaaaaagtcgtcggtgagctggaggatagaggagggtagtataggaaaatattcactgtgggggatttttggttggaacacccactgtgggcctgagtactttcacccaattgcctcatattttaaagagcctatctagtgtagcctttattgaaagatgagtgtctctgagaatgtcctcagttagtgagaacaatctaggggtggctttgattttacatgctctaagtgggctgccaattccctttttttcctagtaactcatggtttgtgttgcatatggggatagattaaaaaacaatctagtttgtttactaaataatatccaacatagattaatctggttggtagcattctacaaaccagattaatctattttggatatttagtaaaccatgctatttcagattaatgccatttcaaaccatgatattatttggtaaaaatgattatgtggctatatttagtaatgactatggaattttgacaatattatattgagcacatcctactaaaatttggtaatgttgtcaatttatcaaaattttggtattaccaaattttgaaaagttgtattttgatatcaatctgaacataccttaaggtcctctttgattcaaaggaaattcataagaattttaaaggattttatttctatagaaaattttcctatatagccctttgaatcaaaggaatgaatcctatgcaatcctatgaaattcctatggaatgcctcttcctatgtaattattggaggaaatttagcatgaggtagaacctcatgttaagaattctttgagtctttatatctactcaaattcctgtatttttcctacggcttaatcaaacggtcattcctatgtttttcctgtgttttgtaaccctctgttttacacttatatttctgtgagaattctatgttttttctattcctccgtttttttatttctgtaattcaaagaggccttaactcagttgtttgttagtagtagttgtttgtgtggccactgtacaaatttcatgtcactgcgcgcatataccagaccaatcaaatgagtaagcacaaagcaatcgatgcgctaacatgtacctactcctgtattacattgcgacaaacaagatatatattgcgaatcaaagcccattaatatcttggttactatttactccctccgtcaaaaaaagacaaacccggatttccgtgtccaacgtttaaccgtccgtcttatttaaaaaaattatgaaaaaaattaaaaagacaagtcacgcataaaatattaatcatgttttattatctaacaacaatgaaaatacggattataaaaaaatttatataagacggacagttaaagttggacacgaaaacccagggtttgccctgatgccctggcacaacgagctgaacttggttttttttttgacggagagatagttaaaaagacggccaatttatttcactgggcctggtgaaccgaattggcgtgctcacactagcatgttggttagaaaaataattctgaaaattacatgcttggatttgaaattacgtggttgcatgtgtgtttagattaaaaaaaagtcatgacctggtttcaataactgattataataagtactccctccgttttttaatatatgacgccattgactttttcttacatgtttgaccattcgtcttattcaaaaaatttacgtaattataatttattttgttatggattgttttatcgttcatagtactttaagtgtaatttatatcttatacatttgcataaaatttttgaataacacaaatggtcaaacatgtgagaaaaagtcaacggcgtcatctattaaaaaacggaggtagtaatgtttattagaaataaaaagataatttactagatgtttcacgagtaaaatttttattcatgatgacgtggataaacctcatagatctaattttccacatctaactacacatttctatttaatatgtgtgatttgcaccgcatactttccccgacaatagatcatcctgtgcgcgcttagagcaggtacaataatagactatatatcaactataaacacatatcgaggagatggaagaagggagagatgagcagcgggctatagatttgtagttagctacaacacagacttcaagacgtaatgtgtgtataacagataagacccgatattaatagtgtagtatattgtatatatttgtagataactatggtatgaattagctattaaatcaactataattagttggctatattattaaacttgatcttaaataattaacgaaaatcatcgaggtaggcgagggcagtttggtcagaacacacacaaaaaaaaaagttaaagctcggaaacggcaaaagctatggcgaccgaccggtcacttcccactccccagttcccagtgaacagagcaggagcagcctccactcctcctctgccactccactccccaccaccactcgcatcaccatccatccatccatctccaacccaagccgaatcacaccaatcgccatcgccatcgccatcgccgtgcgtggtcgccggtgccggcggcggagggggagggggaccaagggaaaagagagaaggtgagctgagctgagctgaggtgaagtggtgctgaggcgagtgactggggggcaatggcagcggcgtgggtgctggccgcggcggcggcgttggcgctgtgggcggcggcggcggagggggcaaggtcgccggcggcgagggtgcaccggcacctcaagaggctcaacaagccggccgtcaagagcatcgaggttgggtggccagttcttgaaaacatttgcttctttttattattatttcttttgggggttatcgctcaactttgtgttgttgatgcattgttacattgggagttcaaaatgttagtattttcatttcacattcttttttttttcacttttgtttctatgagttttggtctagcattgatttgctaagattttgagatggattgatttgcagagaagaaagtttgcccctcttttctgtgcttcttttgggctgttcttggtagtttttctcattgctgctttaaagaatttttcgaaaaagttgcaatcttttggaggtacattttggcaactcaagcaaaagaaggcagaaaagacgtgtcctgctttcaggctggctctggcaaagttgtattattctccaatgaaaaaaggggttgaatgaacaattcctttttttaaatctttctttacatttccgaacaatgatttctgcgttttccaaaaagttcaaaacctgaagcgtttgtcttcttttttttggtattattgttattattatttgtcatgaacaaatgtcctatccgtttgaaactgttttgcaaaccgatgcagagcccagatggagacatcatcgactgcgtgcatctctctcaccaaccagcatttgatcatcccctactcaagaaccatactctccaggtaaaatgcttcactttgcaatcatttcaaagtactcatcaaacctgcatttaccacagtacatctgtacatggtccaatatgttgcattcaacatttttctaaaagaaagctctgtcaaaaatctttatccttgcagatgaggccggcctaccaccctgaaggcttgtatgatgatgacaagagaagcgtggcctctgacaatgccggcgagaagccgatgctccagctatggcatcaaaaggggaggtgcccggagggcaccgtcccgatcaggagaacgaagaaggatgatctgctcagagcgagctcgttgcggcggtatggcaggaaacggcataccgccgtgaacccgctgtccattgatcccaacatgctcaatgagggtggtcaccaagtatgtccgaatacgatgtcatgttgagttgaaatcaaaatggaacatggtaatggcatcggcatgtttggtacttaaccgaaactgttttcttgttgcaaattcagcatgccatagcgtatgtggagggggataagtactatggtgccaaggccaccattaatgtgtgggagcccaagattcagcagcctaacgagttcagcctgtcccagctctggatcttggggggttcatttggtgaggatctcaacagcatcgaggccgggtggcaggtactactgggaagaaaacctgagctcatatgagcttcatcacattcatagttacgcgaattgaatgatgaccgttttcgcggtcggctgtccccctgccatgatgcatggatgcaattgcaacctgtgctgtgtgtctgatcatttgcgctaaccgccgtcctttgattcatcaggtcagcccagacctctatggagataataacactaggctgttcacatactggactgtaagtttcacaaactcaacaatccatatgcttatactattgatggtacattgttatactattaatgttctctgtactctggcaacagacattctgttgttgatgcattaacttcggtgtcccttacgtttgctttcgcattggggtcttttttgtagagtgatgcttaccaagcaacagggtgctacaacatattgtgctccggattcattcagatcaacagcgagatcgccatgggcgcgagcatcttccccatctcgaacatcgccggctcacagtatgatatcagtattctgatctggaaggtgagcaattcttaaactattaccaaggcatcatcacataatgacatgcttagtgccttgagaattagcataagaactaatggggccagagaatctttccccacttgctctaatgctccttcacacacctggttctttgaaaaccattttgtccaaatcacatgtactaggcatgcataactaacactaatgtggcatctctagtgactatattatcgaaaaaaaactctaattatatagtaatattctatgtgcttcatctgtggacaggacccaaaggaaggaaactggtggatgcagttcggcagggagtatgtcctcggctactggccgtccttcctcttctcctacctcgtcgacagtgcgtcgatggtcgagtggggcggggaggtggtgaactcggagcccgacggcacgcacacgtcgacgcagatggggagcgggcggttcccggaggaagggttcggcaaggcgagctacttcaagaacatccaggtggtggacagcagcaaccagctgaaggcccccaagggggtgggcacctacaccgagcagtccaattgctacgatgttcagaacggcaacaatggcgactggggcacctacttctactatggcggcccggggaagaactcgaattgcccatgaatttggtgatgaagaagctgatgatatatatatatttatatatatatatataatatatggtgaagtgtgcaagtgtaaccaagcattaatcatgtgtggaatacagattgatctgcatctgtttcttaatttagccctaggtagtatatgtgtatctttcctactgattttctttttcttctcttcattagttttttcttcttctttttctgatgtgccatgtaaaagtttctgaagagaagcatggcgtgaggtggtggtgcaggggtgatgatgacaattgatttgtgggtaatttgcaagtcaaacggcttgtgatcagtactacaaatttattagctgttgtgttagctgataaaatgacttggtagtagacagtagttctgtagaaacgtgagaaaatttgacagattcgaaatacaaattcaaagcaacgaggaagggagctgggctagactgtcagaaatccaatgtacacgaagagaaaataataaattcttgaggtggcctaccttctcggggaacatgtttgttctcagaagagtgttggtagctgagaaactctgaatccatggttcacctccattttatatcaaactagccaatagatcgtgcgttgcaaggaaaaacaaattaagtttatagcttattcagtcaattaaacacatatttagtctaagtagtacttttatgtttttttattgaacaagtagtttcttttttagataatagaaatgtgttacatctccgatctctgcccgtaggcacacaacaaaaagtctagaagtgaacagaaaaaagcttaagaagtacggagtagttgatttcaaaatttaggaagagccatgtataatagtatagattgtggtataataacatagatcgttagacccaaatgtcagtgataagggtggtgtgataacggccagcactactagtaacattttaagtagcataaatgcataccgatagatatatgatgacattttaatgcaatagctgtatcagggtctttgggaggaaaagcaagagtgatgaatgccaaaatttatatgaagatgtcaaattttatatgacaccgttgatttttgacgtgatatttgatcattcgtcctaattaaaaaatatatataaatgctatttatttcattgtgacatggtttctcattaaataaattttactataaattacacttaggcatatttatacaaatgttttttaaaaaagaatgatcaaacattatttttaaaagtcaacgacatcaactgttaaaaatggagggcagatcaacagtgttagcatcagtgtcaggcgacaccgacgactttcgacaaaacctaaattattatttttagatccgccactgaaacggaggtagtatcaattacagaagaagagcgagaggaaaaggagggcaagcagtggcggatccagaaaatcgattcgttagtgtcagaacgtgtctatcggtgtcatagtatgctaattacacttagatcatggtgttatagcatatgaataagcagtttcgctataggttttgccgaaagtcgtcggtgtcgcctgacaccggccctataactatagatccgcccctgagggcaagtgtgaggcaatggaggagacctaaccggcggctcaccatcaccggagctgtctgccagtcagtctgccgtggccggcggtggcatggggcatggccgaagcggagcctcctctacttaggccaaaatttggtctggtctgaggcttcagctaggtcacaccaccattcattccttcattcatcgctgcccaaattaagtttgtaatttgcacccctagtctctccaattttacaattcttaacattttagacaacacatggtctccaaaatatatctttgactatatatttctattataacatactagtcgcatacctgtgcaacgcacaggttattatcaatattttaaacattgtttacttcttggattttatatttgaggtgccagtcacttttgtcatataatagccctatggttctcatcactaccctatcactgaaaacaaaaattcctttctaggataaaatgctggaaataggctactataacatacaaaaattttcaaaactacggaacattaacttataactcataacaattttttttaaaaaaaatcaaaattacatataaataaagcaaacaacaaaatgcagttaaaatgatctaaaatcccacactgcatagtgcagttttgaggactaaaaagttacagatttttaggcgccttaatcaccttgtttcttattcataattatatatgagtaaaatatatggctggtccctaaacttgtgtggtggtgtcacttaggtccgtgaacttggtttaatgtaccatcccggtccaaatgtcctttaactgcgtttgaccgcatgccacgtaggtaacacttttgctctcagccccctccacatcacaatacatcgcatatatcttcttatagctatatatagtaacactagaatccaaaaaaaaaaatctcaaatcgttctcccatctcattcttctcctttcatgtatagaaaatgcggttccgattagcaattgctattgctccatgctccaaaataaacttattcttacacaacgggcacttgatcaacaacacattcttcccgtgacttcaagatgggggtgagcttgtagaatccatggggatgcctagcgtgcaagccgcattgcgctgcctcctatcgcaaatctggccgcactgtgccaccgctaatcctgctataccctgtattggcgctgtctcctgccgctaatctcactgccaagaccgccacaaccactacctttcggtctccttccgctaacctcaccgtcgaaaccctagatgatttagggatatttttggggatttgggttgaaatgcatttgtcagggcaagttatgtgcgaagatatatgtgaagggggctgaacacaaaagtgttgcttacgtggcatgacacattggcggtcaaacgtggtcaaaggacgattgaacgggggtggtacattaaaccaagttcacggacttaaatgtgcaatttttaagtttatggatctaagtgacaccacctcacaagtttaaggaccggccatatatttcgctcattatatattgttctcatattcacaaatatcttgatcagaaattgctgacaaccttctgtagaaaaattgtcattcctcctatttggaaatgttaaagcattcctcttacaacaaaacccaataaagcatcaagcacgtggatatcccttcaacaaaacataaatcatcgaaaggatatcagacgacttaacgaagcataaaagcggattggaaatggacgactatttgaagaatgcctaaagatcacatattgataagtccgcattaagtcgtcaactttggatccgactggggatttttgaagaatgtttcatgaaaaaattggaaagcaatgatgttgatgcttgcttatgaaaggacatggggggcaactaaggtcttgttcgtttctccaacaagatggagatgaaattttggttattcgtggcacgcttattaaactgctaaacggtgtgtttcgtgcgaaaactctctatatgaaagttgctctaaaatatcagagtaatttatttttcaagtttgtaataattaaaactcaagtaatcacacgttattaccacctcattttgcgtgaaacacttaatctttatcttcaggagatacctaagcattgaacatcaggaccatgaatatacctgataaactcccaccgaagaacagatccagaggtacttctctgttgctctgcgatatggtcaagaaagcgcgcatagatcaccagattatttacatccattatatatgacatggcaggcactaaaaaacaatttatattaattattatgattaaagagtcataagctaggtaatcgatcaatcaatgttgtttaagatgagaaacatgtgaagaaagaattaaattttgaaaaagggttcaaatcaaatcttgcatcagttgagaaaatagcatgcaatagtagctgcataggattgatccatcgattatgaaaccggagggagcaacttctcttgactttgagtgaaacccccagcccaacttgcatttgcgttggtgagtgaccatgtacattttacacgttgggtggatgttgcatacaaggaattcactccactagtgtaacttaatcatattcagcacatagaattttattccatgaatatcaaacaatgtggatatttcttttttttttgtggtcctgtactcttgttcgtttctccaacaaggaggagatgaaattttggatactcatggcacgttttttaaactgctaaatggtgtgttttgtgcgaaaactttctatatgaaagttactctaaaatgttagattaatctatttttcaagttagtaataattaaaactcaattgatcacatattattaccacctcgttttacgtgaaacacttaatctttatcttcacctttatctttagaagattcaaacaccaccttaactgtacggggaattgtgtccttgcaaagtctaggtttgaagagctactgcagcagtgtgttttgtatctccaagtccaaccgtttaattggaacaagtgcaagttctatctatcgactattagcgcaatttgcaatatggtttttcaaatggtgtcctgcgctattccaccgttgctaaggttttatcctcatccgccatagcaaatgttttattctggttttgcgatagttaaggttttattctgcatcggtcattgaagaagccatacatagtaagccataattgtcttttatctttttttggtgtgttaataaaattaaacaataggatcagaggcattgatggtagggaattttccgaacaaaacgatatatatatttactggttttttttctctttctatacttcttctatctataaatatcaaactcggacctaatgtctcatacacacatcaattacaatacaatctggcatatagcacatattagctcatcagtaagaaatggtgaaccacagctgccaaggacttttgttacttcttctagtgtgttctgccatgcctgcacttatcgagggtaactaatgaatcttctattttacttttgtaggaagggggctctaatttgcttttcatttatatgtcgttttgatggcaccacacttaaaatttcatcttgaatagattaatcgaatttacatgtacattattgcattttcattctattttgacaatatgtatgttcccttgataaacaggagctgatgttaaagattgcattcacaatcccatggaccctcatcaaatagataagaacttttgttgtgtaaaggataatgagtgctggatgtcgattcaagagtgcctggcaaattgcccatgtggcaaaaattgttcgacgtaatcatatgctcattagttagatctgacatctttagctagatactacgttaattatctctactacatccggtaatgctggcgagtgccaagtaaaccaaaggtccggcaatggtgttgtcagcggttgtgtgtgagggcgaccgatgttttcctttttctccttgtttaccgattcaacctaactaagatgatgtttttggtaaggatgatatttttttcttttgcatttattaatgtaagggtgaccaatgtaacccctgaatttatctaaaataaaatgaagaaaaaaattgaactcccatttcaaaatggtagttcaatttttttttcttcatttgattgttacctttgtttctatgaattttggtttagtggtgtagccgcatttgttaagattttgagctggattgatttgacaagttgtgcattctctaattcagaaaagtttgcccctcttttctgtgcttcttttgggctttcttggtagttttttttcttcttatagctgcttgaaagaatttttcgacaagagtaaattgcattcaagatacacgaacttgtaaaatgatcgttttggtgcatgagcttgtttggtgcgtgcaaaaaaaggtgaaaagaacattaaatggataatcttattgatttaagggctgattatgatactatataaacatatatttgagaaggttgctattagccatacacctcttcaataaaaatatagaatgggctatagtgaacgcagaaaaatatatgaaaaaatgagcaatgatataagggttagagatatatgacattcatcatttacacgatgaaggaaaaagtatagaccaaaattataaatattatatgctttatgcatactcattacacatgcacgtcacatagtcaacatcagctttgtaaaattagcattgcaagctattttggtccccgttcgcacgagctagacaagttcgtgtaccgaaacgagcattttacaagtttatgtactaaattgcacccatctaacaagtttgtgtaacaccaatgcaatttactctattcaaaatctaggataaagtggttgctgctctaagcaaacgggcgaccggtcgctttgtagtcatgtacatatagaaaatcctcaagaggatggtaggggtatagatttgtaaactttaaaacagaattatacttttgtaaatttttcaaaaagaatatataaatatgaaaattcctgatttctactttaatggatcttgatcctacatatttgggtccaatctgttcgtgtagccttttcggtttggcccgatttgggctgggaattatttatttgtttcatcctgcccaaaaaatacaaaccagatccaaatagaccgaaaaaaaacagaaggaaaaaaaaacgatacccagcccaaattgggcacgggccgaaaacttgggttagtgcaaattgacccatatataagtaaaaagaatgacaaaatagaaataaaaaaaaagagcgtgcgcgcgcacacaacaaacccacttgggcttagggcacaacgaagttacggaaaaatacgacatgtaaccatagtaatagcattgaagcataatgcaaggctataagctaaggaagcaattgtagtagtggatggagggaggcacagtttaacgccttacgagctgtctagcgaatttatttatttattgaacttagctgcctagcgaatttaacccatggtaagagaatatgtacgcagagtttaacccctctgaactgaatatcgtgccaagttgagcgaacgccaaataaatcagcttcagttgatgcagcagacagcagttctgattgccatctgtccttggcaccatctttgccactgtttgctgataatgcgatgaagagtagatagtagtcagatgttgcagttagcgatatctattgactaccacttccaatggttgctgtgttatcaccatgtcacgtattgagctcatatattcccatgagtcctacaaccaaaatagagggatctaaagaggtcttgtgttcttccggagccagtcgagagaatggccactcaacaaaggggaaacctgaaagtgaaaatgattgtggttaagcaacgcaatggttcatatgatcttggaatgatgtatacgaggaataattttgcttcccaagaaacagtcgacgattcgcatcctagtgaatactacctccgtcccgatataagtgcagatgtaggtttccgtgtccaacatgtaactgtccgtcttatttaaaaaaatatttatgattagtatttttgttgctattacatgataaaacatgaatttatgtgtgactaattttttttatttttttcataatttttttaaataagacgaacggttaaatgttgtatacggaaacccacaactgtacttatattgggacggaggtagtactgaatagtgacataatacattgggaaaaaagctagtacatgacaatcaaaaccatgcgcatgtgctgcatgcaacagtatgtcctaaatattgcgcaacaattgacatttaaaaataaaaaaagtgctctttcttatttaaatagccacacctaatgcaggcttagaaacagatttggatatcaattgttcaaaaaataattttgcctcaatgacatatgactcaccttttcccagacttcgtcatggtattcattgatccaattgatctccgaaggtgatagtaaggacaaatcaacaagcttgctctgaagttaccaaagaaacgaaaattaaatgtacaaggtggatgataataaaaagaagtgtacatatagaacagcacacaaagactcaggttaccagtccttaaaataattctgtggtaagttattaatttcataggccaacgttaaattactcagacttgattactcattagtaagaaagtaatatgtggatcaatgccattattgcaatatgtttccacaaaaaatagtatcaaatcgagttgatggtatacctgaattggaacaaaagttaatttttcaaaaccaaggtacgagacgccaccaaacgaatttggcaaattaacctctttgaccagaagaagattctgcaatattcaagaaaaaataatgagaaatggctattcaatgtactatctgcacaattgctcaatttagtcctaaaaatttaggagactgacatgagcaaagagtggggaaacctacctctatacgaatgccaaaggaattgtcttcgtaataaccaggctcattgcttacgatcatgcccttctgtaaagctgtcaaatttccatatcgatagcttatgctctgagggccctcatggacatttagtgcagctccaactccatgacctgtgcctggaacaagagaaaaattgatcatcaatttacgtagcatcacatgccataacttccagcattcagagatttttgtgtgcttagaaaatgtaccatgtctgtaatccagcccaatcttccacagagaagagcgtgcaagaacatctaatacaaagccaggagttctctctggaaataccgcctgatcgagagctatatgtccctgaaacaataaaactttatgactcgaataaagtatgaaacaaaaatcaagtgttgagtgagacaagtatcatagcacactgaaggcaagacatactaaataactgttacaattgagtaaaaaataactgttacaggtctaaacaaaattaaacattacctgcaaaacccttgtgaagcattccttttgccttggggttggctcaccaaagtgaacagtccttgttatgtcagtagttccatcaatatattgagcaccactatctaacagaaagagattgtcgcttccgacagagctgcagctctctggagttggtctgtagtgtattatagcaccatttgcaccataacctgagtggaaaatttgactacatattagaagtcaagaactgcagacatcacacggcatttgcaaacagcagtagtccaatgtcacattaaacattcccatgatgctcagcatgaaaattgagataagtctaaaccataacatgcattgtactcctaccatatatcaatactcgttttaaaagaaacaaggcagttgtggcactgaatctgccagcacaccaactctgcagtacatttgtaccaagtacttcttaagtttgttaatattgttagtatcttattccatctctaaattcatggaaaggtttatggtgacaaaaattgtcacatatatagtataaatgctaatttacaaatagagtaatgcaaaaagttgtctaagtgttcccttcaacagaagtaacaaaaacatggtgggtgagttcaatgaaaaaaatcacgcaatttattcaaacaatattagcacatgtagatccattttcattcgtagcaacacatggacatttagctagcaaaactaaataatgaaaaggcttagataaactgcttgagaatagtaacaaagttccagatcgattggttcgaggaacgtgatatgctacttgcaagaggtgtttacaaggtggtacgaaaatgtccacgtgttcccaggacattcctggtcaaggagctgccttcgacccagatcatgactaaccattaatgtatgcataattattccctaatatatacaatgaaaaaatgcagtaggctcaagctgagtgaaacatgttacacccctccctatcaaattacgctgtaataaagaggtttgagaaaggcaccataataaatacctaaagacactctaccaactacaaacaatcaatccagataatagatagcaataacaaacaaatattaacatttgaaactcaagatactggccatgtaaaacagttctcagggattttaatattgcagggaaaagttgaaatataccactgatagtgtcaaagcttgtatctataaagccatcttgcttttgacgaaattcaagaagcttttcagcaacttgcacttctgtaagtggtacactttcacgaacttgcccttctagccagcaccagaattctgctaaagcagcagcatctctgtaaatgtatttatgtgccagtatagacaatgcagtggtcagctggacccaaaggccacattaacagaaaaaggaaaaaaaaaaagaagatgcttcctttacaaaatgaaaaaaaaaaaaaaacacccagccgctgcactggtaagtgcagaaagccaaacaacaagaagatgatgaatgctgaaagtgatgatgaataaaaacccattgctaatgaaaaaaaatagtaacaatggtagtaggttaaggatctccattttctgtggagaatgacatcatctaagtacatgtctatggatggagctttgtatttgatctctactatgagttgctcactacatgagaatttggcacgtgatatccatatccatatttaggatatctatttgtgcacgatgaataggtaagcaggcactgtgtttccattgcaaattttgtgacctagtcgtatatagtgggaaactgatatgagatatattagaagcaatatcatttattgtacatcagtacactagtatcggatttgtcggagtaaggggaaagattattagacatttttccatgagtgaaattgtcatatcattagacattttttacatgtataaataattatagagcttactgggcaagtataaagaaaaagaataattgaagtgaacaatccgtacagggaaaatcacatttatattgttgctacaatgcaataaccagactatatggttgcctcaggtatggttctttcaattccaggaaatcaaggttctgtcttcactcttcaggcatttttcaactgacgaaaaaacaaagaattcaaaaacattttttaaaaacgataccttaggtgtgaactcttcataccctcaacttctgcttcattcttaactgctttggctagggtggctggtgaaactttgtatagagcatttacagttccattctgaacaccagagcttccagtagctgggtcaccttgagatgattcttttccaatttgtctccctgcttttcctctctttttcacgtatctctcacagcttgatctaaacacattaactatggcagcatttatacttgaagaatccagccaaagctttgcaccattctctgccaatctagaaaaggaaaagggaaacaatttccagactaagataatcatggaggagtttaagaggtgaacattgacaatttaaattagtctctttcatataatcacattttaagttagagctactaaaatacaattataaaatttaatagaaattggttcaagaatactgactggaacagcacacaagtactgaaccagaccaaggactggtaaagttggcacattattataatcaaataccatggctaaatgccctttacaaattttgggatctcaaaaacatgtttggtgttcaatcagtaacaagctcaagtccttttgtgaggtatacgtgcaataatgcgacataatcattatgtatttctttcaaaatcatgtacatgattttaagttcacagatgaacataaaatcaatatgtgacaggaagaacaggaaatcctaccacttccagggcagagaagaatttagataaaagctgttgaacacggaaatgacgtaatgggtcactggtttcaacaggttatcaactcacaaaatttatgatcagaattgtatatccgattggctaagactaataagcacgctcaactaccaaattaattaaaggtggttcttatctaattccaaatataaagggagatgatatgacatcaatatcagaaacaataattgcttttctgaagaattacctctcaacatcggacaaaatcgcttcatatggttttagttttactccagccttttcgaggtgctctaaaacatcttcagatactttgttgttatccacaaataatgtagcagcggtatcctccacaataaggtagctataaaatacaggtgaatttggaacatcacttcctctctgcataccaaaatgtgacaaactgactagcttaaccataataaaccaaagtgcaagcatgctcaacatagtagaaaaaaaaacaaactctgaacacgaattatcaagtgtgaaaagtgctaatatatcatgccacctcccaattatggattaatgaccttcataatttgcacaataagacaatagtacagaaatgtatccgataagcagaaaacaagtttacaaccataaaagcacaaaacataaaacatccttcaaattatgaaaagaaagtactaagtgctaagcagaaagtttggtaaaaacaaactttggtaaatattaatcttgagctacagatagttgagaatccataaaaaaggaatatagcaataaacataggtgtcaagtcataagaaacgatataagtaactgtgagagccaaaatattagtaccatgtttaacaaccatgcaacttcatcaagcaacgaaatgaccacagcattacacccattttcagcaagctgtgatctaacaaaggacaattttgatggcacgtcaacgccagcatatttgattccatgcactctagtttgttcttttgggggctctggccttgattctccccatatttcatcaactagattcaaatccttgatcaaaactaactcatggttcttctcggaaatagcatcttttagttcttcagctgcatcaaatgagaaaagaaactgcatccttcaaacaaagtaagaaataaagtattaggacaagaataaaatgaaacaaaaatatcaaaacataaacaatttttcagaatgcacatttatctgaaacttagtaggaagactaaatggaataaagttcttggtcagaatgtaacatttacaaagtaaacacaagaaggtttcaaatgactgtaaattttaccaacagtacacattcataaaacggttaacttcttgtgagggagatataaaatttagataaaaaaataagatctcaaattttaagatgcatgtgtgccacaaagcagtttcaggatacgattttgcaatttaatttaaacatcaatctattctttacttctaacatccatacactagtttgtcatttcatgggcatgtaagaatttgaagtacaaaaactgcatgaaaagaagcccaactaaaagaaaagataattatttatcacatgataatggcatgagaaaaggcatattagcaaaataatccatttttagtttggttgatgataaaacaagatctcaccgggtcaatgccaactcggcaaccagatggtaacacctcgttcaaccattcgctagtggtaggaacaccttgatttccactgcgcatgagtgtccaatcatggctcagttctttctcagcctactcaacagaagaacagatgaatgattagccaatagccacataaaaccatggttgctaagaaattaatttgccgtgtgggaattgagtacctggagaaagtaccggccatcagtccagagagcagctttatcttttgtgaccacagccgtaccagcactaccagtgaacccagtcaggtaagcacgcctcatgaagcattctgcgatgaactcgctctgagaataagatattaacaaaagcaggtaagtgggagaggggcatgtagtttcatgagatcaagaatgcattgaggtttttctacttcctagtatcatggagcatcaatagcttcacaaacaaacagtgtagacactatatatcatgtgctcccatgcatacatgaatccttgtttcagatagctagctaacgatggtttactgaaaggccctgacatcaaaatcaggccatagaacatgactacttgccagatacaaaaagcatacatacgcatcagtagttgtttccactaatatcaacgcacgatcgaaacagtcaatctgcaactgcaccataatcaccattgctcaccatttctgcactactttctgttgtctccattagtgtatcatcgattctccgtacggaatgatcgaataattgggagcaaggcagggtgtactaatagacctggtgggcgtcctgggaggggacgatgtaggcgtcgatggcgacgtcgggccgcgcgaggaggcggcggagcgagcggagcttctcgtcctcaccaccaccaggagcagcggaggaggaggatgatgcgccgccccggcgcttgcggagctccgacgaggggagggcgacggcgcggccgtccccgcccgcggcggcgaggaagcagaggcggcggcggcgcggggggagcaggagcgggagggcgcggcggagggggagggcggcgggaggagcgccgcggcggccgaggatggcggcggcggcgagggacggggagaggcgcgcggcttcgatcgccattggagcggaaagtggggacgacgacgatgatatgataagggagggagggattggaggctagagagtagagagagaaccccggcttgctttgtgatgtgatgtggcacaactgggccgccactcgtcattgacgggccggcccgggctggactgggccaggcttgggcccaaacgataagcggttgttgttattataacatctataaaataaatttggcatctataaactaaaccacggtatcccgtggggacgggatagcgctcatcgacccgagccccatctatttgtcgctctcttttcagataattttgaggcctcgtcaactcagctccccaccgacatggccagcggcggcgacgacgactctgtctccgcgctccgacgacgccccgcacgagctgttcatcttctccacgtctcgtcggcagacgacgacttcgcctcggtgctccgacgacgccttgacggtggagctggagcgggaggcggtgggtggggtcggggagcacgagcggctcggcaagcgatgcgcgcaacgcgtccaccagcgacgccgccgccacgagcggggaggtgtgccgacgcgagctttctcgaaggtgtggtccaggtgccgcgctaccgtcgtcttgcctccatgctccaccacgcgtctgccttatcctctctctcctcctcctcgtcctccagactaccaggtatcaggtatcacgagtacctaggtaccatacttggtacatgtgagtattaggcctgatacctttcgtcatcgagatggccggcggcagcggcggtgaggtatgtagtgtggttatacatgacggcagtgtattgcagtagggaagggaacatggacaaacttgatgtgggcgacgtcctcgacgagcagctcgaagtggcagccgacgcacgttaggaagagtcgtgtggctgcgcagctttgttggaagcttgcatgtgggggtgaggtgcgcgacttcggggatatatgcggcgttaggctgtcgccccgagcaatgcgaagggcatcccgttcccacggaatcccgtggggtagcagccctcaagaaagaaagataatagaaaaacttggccagattttgttaggaaagaactcactcttgttttgttgcgcagggctggtccgataaacgatgcatgggtgggtgatcgaccgacggcatgtggccggccaggctggcggagtccgactcccgaattcaatttggtgtttcttgggtttccttgcgtggacttgagatatctcgagtcttaattagtttttaaacctaatatgacgtggagagggtcttgtagcagacatgaccaactcttttataagggatatggctggttcaattgacgaactgatctacaatcaatgctattagccaattaaatcattattttaaaatcacaaataccttttacctagtttttagcctacttcgtccatcttcttgatttgccctgtaagccatctgtctttgtcgcgagaatatagatcctcctataggtttatcctaaaaacctttcattttgcccacaaggcggatttttatcttagtttatctaaaacagctccagtagccggttttgatttctaaacccatcttgatcaggagttttatcaaggtcgagttgattgacgcttcgttcaaccccgtaaggctttaggtgaatcccgatcatgtgcggtggtgtgaccgaaaatggcgtcgaaaatggcgtcaacagatggtaatctttatatttcaccatactattgtttatacccttagtggtttaaaaaccaaaactgaaaaagaaaatggtgaaaattcatgcataataatttaaaatgaagttttaaaatttaaacactcaaaatatagcattcctaggagtaaaaatgtcaaaattcaaaaactggttaggactctctttgagagagctggagattctaagtagttagaatatgaaaaggctgggattactagcttctgattctagtttatttgttaaattatacggtaacaaattctcagaatctaagttatggagtaagttataaccaagaccgtttggggaagatgggagattttaggaagttggcacaatctccctccaaaggcaccgcaagcagcaagcgccacgcgtgagttcaccaacctgctttttcaccaatcttcatgctgaggggttgtttggttcttaactaacattgtcttaactcacattaggcaagtgtggcttgccatacttttttggcctacaaattgtaagccacacttgtggcaaagtgagacaaagcctatgaaatgtagggtaaggtgttaaaaagtgtggcttaccacaactacggcaataaaccaaacacaagactaaggggatatggtaacctaaactgtggtatggcaagttaaagtattaaaccaaacaaccctttaaggaattgcactgatcagacagtacttcctccgtcccaaaatgcagatagttttgaggttagcacaagtattaagaaattagatgagaatgattgaatgaaatgcgtgattggttgaaaagagaaaataggtgaaagagaatggttgtggttggttgagagggggaggtaggtgatgttagaaatagctatattttgagatggagatagtaggtactactagacagtcgttgtcacaatccagatacacgagtaatcaacaaatcttggtatcatgtcaggtcacagtgctttacaccgtgtatgtatgtcagttgcttgtaagggggataaagggtctgttgggggagcttctagctgctgcagcttctcccataatcagaagctccccaaacagtacagcttttggtccagagtctaagaagctatagttgtagaatttagaaaatgaactaaaagctagaagctgactaccaatcagctgcttctcataattttaagctcccccaaacaggcccaaagagaccattacatgcatggacaaagatggtgctcccatttacataatgataattacatttgaagttgtcaacagggaggcttctctttctggttcaagaaagacacctctttttctcatagaccacaccaattccgtgatgatatactctccaatttgcagcatttgacacaagttacatacacacatacatgtatagctcgtgatagaggcactgctccccacagtttcttctctacacgttgcaatggcaaaaacaaacaaaaaagaattaacctatatatatgtatataccgctatacataaagaacgaatcgagtgggtgttgaatccggttgaccctctaagaccatgcacacggatatgcatatattcctctttcaaaataaacggaaaattgccacatcattcggtttattatcggcttgagatttcttttctttgctcatctatgtgaagaacttggtggcatgatagacttgctgctgcaggctcaacctctaacaaccagcagccctgcgaaaattgtcgtatggacttgatgccggcaacctcaggaaatgttgctgggcttgctcataagttggctgtggattggcttcgttcatgttcatgtactgggggtaaccatacaggttatcgtcgacgaacggattcgtgttcggcaccccaacctgctcagaatcaaattattggccttaatttattatatatatgaaaatgcagtatatgtatatgcttttgtcagtggattgacatggtaaaagaagaatggcatttagagttgaaattgtttgctgtgcgattcgatctacctgaggcggatatgggtcatggaaaagggacaaatccgtctggaacggctgattggttgccatgggatccattgtcatatcctgcgagaagctcatgaaggaggccattttctgatgtttcctgacagtgagggcttcgcattggctactcatctccttgaatggcatgtctgttgatacagacactcgttctgtatgaggtgccgggtctgtgacaacctgtgaaaatgccagaggatgaaaacataagtcaaatcggttatcatgccaagtgaaacgaacttatagatctagcattctttacttttcaaacaggtgttgttctttaattaggacgttgatgaaacaaataggttaatttgacatatggttagacaatatagcatttcaggcatggatcatttgttttctcccaatgataggaacattgactttgatgtatcacattggtgcaggtcttggttgaattttgcaaatgggaatcctcgccattctgctgagatcttgtaactttcaaactactactgtatacctgctgaaaacttggtgggtgttttcctaggtatcctagaatgcagaatatcacacacaatagtaactttattcatgccaggttacctcatcagaagagtacaacaagaacatagaaaatgagtttaagagagcaaggcatactgtttcaagaagctgatcgatactcagaagatctgttacaggcacagcatttgcagaagcagctgtactttctgaagcttccccaaagatatcgtggtcatttcccaggtcgatcagcacagcctattgaaaaaaaacacaactttagcattttaagtaggacacaaaatatatttgcgagcctcaaaatacctctggatggtgatcattatcatgagatcctggtgatgagttatcaccagttgcttcaaaaaaatgagtgcttgttggacacatgtcatcgggagagaaatcgcttagcagttgattcttcacactattcaactccgcctgcagaaacagagaagtcatcagcggttgcactttttagcgaatacagcagtttcattgagctcatgttcaaacaatgaatttaggagaccattgagaagatgaacattacctctagcatatttgttatgttgttcatgattgtggagacaatgcattctcgggattgactctctgatagttctatcgctgaaagggacttcagtgcgttagtattatcctctggtgatccgtagattttcgacggatcatccacggaatctttcacagcctgaagcttgcactcatccaccaaacggaggaatggatcaccctagacagaacaggacacacatgtcaaaataaggactatgctattcatgaagtcaagatgccgcaaaaatgcctctaataacaataagatgattaattgtggtttgcttatctccagactaagggttcctttcaaatgcaagatagagaaaacagaggaataagaaaatcataggattttgacaggaacgtaagtacaaaacaaatgatcgtttgaatagaccgtaggaaaaatatagaaatcagatgagagatagactcaaaaggaagttttctaagaggttagagctcttgcaaactttactaaaaaatctgcatgcattgaaccattccttaggaatttcataggatttagaaagcttcaaccctacgtttcaaagggccaaataggaaaaatttcctacaaaattcctacacagatcctttgattcaaaggggggctaaatatagatgcaattgaaacccaactttgatatatgcattacacaaatttggggatatgattttaaatcgtggtttcaagcccgctgtgatattattatcaatgtactcttaccatacttacaaagaaaagtatatatagcataacaaggataacataaaaaaagggatggataaaaagattaaactaatgcaacataacaagcttaatactaaagagtaaattaggtccatcaacttgatactaacatgtattcttaccacttcaaataggtaaacatctcagtttgcaaaattgtctttgtttaggaggttacactatagaaggaaaaaaaatgcactggacaatattttgaatatacatactgttctctcattcagcatttgtttacatattggaataagaggtaacacgttgaaagttcttgaagagaaaatgatcatagctgtagcaagagtaaacaaggaacggcgccgacatggtggtaatgaatctgcaagacttacaaaaagaaaagttaggcatcctcattcatttacaacatgggaccaagttttcatgacgcatggaacactgcatttcaatttactattagtgctacttcaaggcaacttggctacctggttcagtcagtgaatagcccctcagtgaaaatgcaacctgaaaactctgagtaagagcctcaaaaactgatgcctggaagagcaaaagaagggagaataagaaaataggaaatcatgatagatatccttaagcttggcaaaaattaatcaatactagcccctgatagtagggtttagttaggatgatcatcaataacgcgtatgatagatcatagatgtaataataaggaggattaccttggctccagagaacaatagaagcaaactataagtgtgagcaatggcttcatagtttgctggagtattttcaggagatgttgcttgagcccaaatggatgaaagcaaaagtgtgatctggcgactgctcagcttcagcaaaactgattcctgagtgcattcaagataatgcagaaacaattatgtgattttagttaatacatatagagtttaagaacaagccatatttgattaaggtaccatttcatcttctggatggcttgaggaaccatggtctgcctttatagacatggaaggtgctctcaaagacatcgaagtaactctgagagatatggaaggggctctcagggctactgaaggagctctcatagccattgaaggacccctcttcatggaaaaattaggaattttcatgctacgtcggcgactttgagacacaggtaggttcgaacgtttggcattactagactcttcactgatactatgcaagccactgctatcaccttgtgagttgtctgagtgcttgtcctttttcaacttgtcaaagatggcagctgaagatgaaaacaccgagacagccctagagagtgtcctctgcatgtcatgtttcttagcctgacctgatacacttgcttgaatcgagggggcaacggaagaggggaccaagacaatagcgaaaatgcggtgcgcagctactcgagcttcatgatcagggtggatcatcgttaagagcaactgatgaaacagagcttctggaaacacctgacatcatacacaagaagataagtcttcaaaacagaagaaagtactgcagcaaggagatagtcttctatcttctagttttgacagtataccttattctgataggtaatatttggaacagaagcaattatttgagctgtacgataaacagcagctgcagttgatctagctacaacaggagtgctagcaatattttctagcatcacggccatcatgtccagaactggtccagcatcagttacctgttcaacaaaatacccttgataaaccttctgtgcattgtggatagatcttctgaaactaatcatagcattgcacagaacagaaaacaggttgctgaggggcatcaattgaatcaatcacatttatataaacaatatgatggtgatgtaacaggtataggaaaacatagaagttcgcagagggagagaaaaagaacataccttctttgccagctgtcctagacaatcatctatagcctttcggaacttttcattccattttactagctccgaatctttgctgccgagagtaatatgaaatgtccttttcaaatgcctgacaagatcacttatggcacctatagttgctgctgaagcctgagcgatggattgttctgctagggtggctgctacctccacgatactaagctgcatctcctgttgcttcaccatggtcttgtgttcaatatgctttatcagtagagacaacattaagtgcatgttttgtcctgtaggaagtattttatcaaaaataaatatctaggttctttgcatatgataatgttagtatctgtgtggaaaagatgcaaatgaagcacctgcgttttccactaacagttgcatgtccaacaatacacacagagcaagtccattttcaggtgaccatgaactgttgttgccgaagtaccgaaacaaagactccaggatacgacggaatgttgttgcctccctggaaagcctagccatattgtgcacacatattctggaccaaaacttaggatcctttgcttcctccctgcacatcacacaagtatgttcagaaaccacctactgaaaaagaagaattgacaaaccaaatcaacagagtagaaagagataatattacacagtaaggttaactccacccttaacattaactatgttctcccacaaggggacagcagagatgacaaagggggaagagtcctccgttttggagtcctctgctttggagtcctccgttttgggggcttcttgctccaactggtcgcttgaatccttggtaacttgaccatcattttgcatcttctgaggtcggtagttttcaagtactacttgaaccacctaagaatgaaaataacaaagaaaaaaccatgatggaacatttggaactgtaatatgcttgtgctagcaacctactacctgaaattagccaaaatggagagcagaaagaaaactgtatgcatcacccagttacataattatttcaataatatttctgatcatcttatgagcaacaactagttgatgtttggctaaatatgcataaataaataagatttaaaaaaccatagtagctggtgtaggatttagatagtccacctcaaggggacagtcctaactattatggcagtccaagtccacagattatccagatccagctatctaaaaggtttaattacatatattccatttttgagtcgtatgcaatttaaagtaagatgctatctgatgattatgaaatacataagcacaaaactaaggaaatgaactactaatcagatataacttacattatcgaattccgatgaaatatgtgagagctctcccatgaaccaaatctgcacagcataagaaactaaatgatataatcactgtcaaaaatatttggttcgctaagttataaatgtttagaatagttggtgcatacatttgaagcgaaataaagtagacaaaaaagagaacaaagcatccatttacatcattattgtgaaagataatttacagtaaagcaataaagcactatactgttgcagattagttttacgaaaaaaaaaatatggtgggaacaaaatgtatcaatctagaagttatgttgcaaaatagttcctggaagtaagttgatagtaataatatatgtagttagtacttaatgcttaatgattatgagctcccattcgtcacgtaggaatgcaagaaacctcagatgcaaactaatgtgttttgcagcatacgtgttagtgtttgcttagaagtgaagtgtaatttgaatctcttctgacacagtagttggacattttttaccttcctagtcacttcttcaccatttttgcaatcagtgctagacatgttatatgtgaagtatgatttgaatctcttctggtaacagtattcccatacttttgttttccttcctactcattcgttcttcattttaacaataggttgaagcatatgacgaaagtttgatatggcttaacagtaaagtttaccatagctgaaagggcttgcagggctgcagcgcgtagggcaatggtctgctcatcctctcctacttcttgagatagctcacatagtcttgggactagcccttccaaattgaactgatatgtaccatccacctaaaatagacggaaataaaagcatgaaccagatacatcatgtctttcaaaagaattctgctggtgaggaatggtatcactgatcaccaggcaacggaaatacctgattaactgcaaagtcaaacaaggtttcacatcctatgatgcgcatatcatcctgcctcttttgatctaaaagagtgtgtacaatacttaataagctacttgcaaatagtggcctgcattgagcaaaccaaatgatagtattaacatctgatgaatagaaccagcatgttacaactcgttaaaggaaaagggcaaaacaaggggaaaaagaagactctcacatctgctctttacaagaaaccaacaatctacggtatattagcatcaccacttttgcaaagccatactgttcacttctcaattccttgtagatcctttgctccaaggaaaccgtgatctgctcatacatcaatttggaaaaaaaaatggagtcaactgagcttgaaattttcttgagaaaagattgaggtgaatttgtgtcaatcaatacatgactaacaacaacaagagcatgacaggaacaatctgactattgacagaaacatttttagctccacaagaaggtagagggcgtgaaccttgggcactcggagagggttcctcgagcaatactcgcacaacttcccgatccttctctcattcggttcttcatcctacatcatgataacatacgagcagcaacaacaagtaaattagctaagctgcggagcatcgattagtccgataatgcggcttccacacatgaacagaacaaacaaacaagacagagatgggggatgcagcaaggggcccaacctacctgcgttttggggaagatctcagcaaggatcgacttgtacctcttaacaggctgccttgatcttgccctcaacccggggcagaaatagcagaggctcccgcacgccggcaggaccttccgagatatcacgcccatcccctactactgtaagcagaattgatttagcagagcaaaaaacaaaaaaaaaagctaattagaataattgcaaacacaacaatggcgatcaaatcaagggattccacctccaatatgcactatctagctacgaattttctccaaagcaagatacattaataattgttgttggcaagttaaaaccgagcaggcgaaattcataaattttggggggaatgccatttctaacggaaatcaaatcaaaacgaaaacaaaaaaaattctagcggcgttcgatctcgcttagcggcggctggcttggtgctagaccttctcctaggttgcgtgtttgtttgtttttctttcatggttacagccttccatggctgcaatcttgtaaaaattatttttcatattatatcaatataaaacttagcaaatgtataatgcaggcactttaagaaaagaaaaacaaaaaaaaatcgagcggcaacctgcaacaacagaagcaatggttcgaaccccaatctctcgaccaatcaaacataatttaattaaaacgctatggaaggagatcgatagatcgatcgatggaggagggcaaaggaggttacgttgctaggagaggccgccgcccggcgggcgggctgggcgccgggggggaagaaaccgcggggacggcgtacgtgcgtacggccgcgctctcctgccgatccggccgatggagagatgcggggcgggtggggaggagaggagactcgggggtgggagggagggagagaggagggaggctgtggcacggcgggcgcgcatggccttgggcgaggaatggggggtggccgccattggtgcgggcgaagtgggcgccggaactcgaggcgcctgcacctgcatgacctccgttgcgccagcaaatgccaggtgggtgcatgccggtgtttgtacaatcatagtgatctcggaatacggcaggtactatagccatccaagtacgagccacaagatgctactggctccgtcctaatttgtatagcaccttctttttaagaaaaattaaacctgataacttttgactaataaatattatgtatattatatcactagatttatatttatgttttaaagtactttcacgtgatactaattttatatttatcggaaacataacatgggataaattgatggtcaaagtatgtcattgaagaatgtataaaatatataggccttataatttgggacggaggaaatacatagtagtactaaatgatgaggtggaggagataagaaagataagagcgaaatattcacttctcagagcaagtataatagcaggctataagcgagctataaccacatatcgagaagaaaagagaagagagagagaagaaagtgggctacagatttgtagccaggtgcaacacagactctaagttgttgtgtgcgtatgagaggtgagaccgggtattaatggtgtagtatgtttttataggtaactattatatgaatggattattagattagctatagataatttggagctaacatttggctatactattaaacttgctcttatgcaaggagcaacccctacacaaactttaataaatatgtgagagtgttagagatattggagattgtgtggtagaggcaacctattacacatgttacctcttaattaatttaatagtatatgtcatgtatgaaattagatgtggtagtaacttctaccatgaagatatgtatattgttctccccactcattcccctatagaaggccaccgaagctccggattgttggtactagaatctaagagcaggtacaataacatgctataagctagatataagaatattttgtgaagataaaaagatgagagagagagaacagcggactatagatttatagccagccgcagtacggactccaagacacaatatgtgtatgataagtgtgaccagatattaatagtaatatagtatatgtttataggtagctattgtatgaattggctgttaaatcgattatagatgacttgaagctagccgttggctgtactattaaacttgcttattcgtaccatgcatgattaacaactaaaaatagcctacatgggtaacagatagataaataaactgtaagggagaatcctctataatattttttataagggttcacaattttaacaaaaaccagtcgaattccacgaaaaaccgaggttttgacgtagcccgaaagtagaagccgtttagaattttgatgggtttcatccaaatttaaatttgaattgataaaaaggaaaaaaaataaaaccctataaatagtatgatatttatagaacctatttgggtataaatttttcaaaaaattggtgtattcggtgtatttcttaaactttatagtaggaaagaaaaagaataacaatttaaaaaaaaggaaaacactttcctgggccgaattccatgcagtaagcccacttagtatttagcccagataatagaatagagaggggatgtagttctacacctgatttcgctcggaatttcgctaaagctgactggtttttgcgagcatactggtaaacttagggaatttgtattcaaattttagtttatgaaatttgttcaaaatctaccggttttcaacctgattttgcgaaaactatcataccgccaaagcccggaatagaaggtcatctcggaatcgtaaaccctatgcagatacatgatagtcctatagcttataattcagtgaaaatgcagcagttatatgatcatgccaacgctgatcagctacctgaccatgtaagatatatatctaaagttcatacaaatacttgtatccctgcatttttttcgaacgtgcaaaaatgattacatgtcagtatattagaaaaaaaaatcttttatactcttatacagcgcaaccggccagacggctattgcttggggacaaggaaaaaaaaagagaaagaaacagaaagaaagactgctagagtaaaaaagtacgaaagagacacgttgctcctatagaaaggagggtgccggcggagccccactacgctcccaacattaacattaacagttttgtatccctgcattaacagttagctgatcatctgaaacaaattaaggatgaaagaaccctgtgcagatacatgatagtcctaatccatcatctgttctggatttcataaattgatttcacatagccctgagaaaagttaccgacaagggattggaaacacacgcactcactatataactttgattaacaaaatgttctcgtctagatttacaaatagaaaacaagatcatttatcacctatggatgtacataaataattaaaagcatccctgaaacttgatgcaaggaaacagttccccttatccacctatctcccattcagcaatttacagtgtgaaccaagaaaattctgtttgaagaagcaactttatttcattttcccacttttgggaacatagcaagcaacattaaccagcaatctcgccggaattttaactgaatcctgtgaaacgcaagtaatttccgtgaaacacattcgcatgcgatgcatttgggaagtgatggcattcatccacttcaaccaattgattgttgaatggtgatattgacggtgaaactcactttatatttcagttccccataattgtcacaagtaagctaggaacaaatccctgatgatgagatcgatccttttatgcatttgtaacatgttcttgtaaaataaatagactttgatttgtgatgccggagtactatgcacatgcctagtagaggtcctagaggacatgtttttttccccaatacttgtttttatttttcttgcctaacctctatgcctttgtttaatatgcatgatctgcccaaaattaatgaaatttataatggttcattactacgaactgtaaatacttgtttttttacttgcaaagtacacgaatctctatctgtcgtgaatatgaatatcgtccaagaaaaaaaattagtaacatccacgacactaaatttgtttcactaaatttaatattgaatatatttcgataatatgtttgttttgggttacaaatattactgtatttttctacgaatatgatcaaatttaaagaagtttaactaataaaaaaaatcaaacgacttataatatgaattggagggagtatactactgccactgagttaatcatagttgaacgatttacaactgacagggttttaaatgatgaagttgtaggccgtccaagtttgctgaggagcagagccaatgcttaatctgtcaagaaaactatgatgggtaactaccattcccttggtagaatcaccacaagctcttcgcctcttcctactagtcttatactctagatgtaatccatgaaatcccatgaaagcttgtactaacaatgatcaggattaattaaaacaatgaataaaaaagtagtgagtaagaggtattaattattgactcatttggttcatttgtttcataagagaaattatgcttgagccatttgaacctaaagtctggccagtctataaatttggttgatgttaaacctattttgttttaaaataactccggttactgctctatagatttctacggatttgatgatgtaccgtagtataaggtgaaatttgattttgcacgctctgttgcgaagtgaaaatgtgtgctaaataaggtgcaaaaatatatattaaaaaaagtgcactgtacatggcgtaaaatgcagtacactcataaatgtcagcgatggatggaattcacaacatcaatttctttcacgaggtacagtgacagtgctacaatttcactgcatcccctgttaaaaattgctggagtgagggctctcattagtcattactatccattcacattaggaagaccttaattgctggcattcggtagtgtgaagtctcaacaccatacctgcattttgtaccctctcactagagagccacagtacaactggcagcagtgaatgacaattgacagtataaagctgcatttactagcaacagtggaaggcaatgtgcagcttataaggtgtatacatggatcatctctaaaaccacaactatcaaatcaattgcttttcccctctcacagcagcacatatttttaccacgatcttgtgatctaggcatgggatgcatcaggagaagatacatcggttgttctctcattggatgccgctctagagtccaaagaagctttggcatgcatgctgctctgacgatccagttaagttagtaccttgcatgattgaacatgctccattgctaacacatcaacgaacataaggtgaaggtgtctatctataacctttctgtcccttgagctcaacaacacccttgacctcaacaatatgaaaaatctgtgcatcgtttgcatgggatgaatgatatctaaaagtctacattaaccaacagcctcctgcacaagaatggagatgactgaatatcttgatcaagtaatattccatcttgctttaattaataatggctatatcgagagaaataaaatgatttggaagcttaagataccgcttaagattaagatcttcatgtggtacttacttaaaggggttgtgttaaccaaagacaatttagcaagacagaattagaatggtagtttaagatgttgtttttatatgaaaaatgagaatattcaacatcttttcatggattgccattatgcaaggtttatatggagagcaatacaatattcttttggtctatgccctcctagtagtatatcatatattttttatggttagcttttggtggtggacaagaaaatgagtaagcttatatggagtaagcttatacttgtgggggtctctgcaatatgttgggctctgtggttgagtaggaatgatttggtttttgacaaatcaccatctattacatatatacatgtaattttcaaggcaacaaattggcttcggtgttgggctcagctacaaagttatgatgaagatgacgagtttatgaaggttgcatgccgtaggcttgagacaatagttatgcaactttttgccaattatggttggagattcacaaatagatttcaataatgtgttctccttatcttagatggattattttttattttaagtgcgtgttctcaatgttttgttgaactacactcttttttgagtgtaactttataataattggttgtaactcgttttgagtaaaggctgggatattctattccattatcttaaaaataagtaatatttgcatgtatgcatctgggaagaaattaggggacagccacatgcctccacttgaaccaactgattactcaacattttctctctgtacttgaaccacatgccagttccatcaatgcctggattggatggaacttctgcattttctttttctgtactgaaagatatactgatggtattatgacttgggcagatataggagtagggcagctactcctaggcccaaatatcgattgaaattacacttcaaaatttgaaaaagaaagtagaatatagaagacaggtttttgtaggttatactagttcgtccatactcttagagcaaattcctccatgactgctccaagctcctacgaacttactccctccatcccattttaagcgctgctatgagttttttttttcaactttcatcatccgtcttatttgaatttttttatgattagtattttatgcgtgacttatgtttttcaatattttcatttttttaaataagatggacaattaaagttactcatggccgtgcttaaaatgggacggagggagtatatattagacccaagagtagataaccagcaaactccagtgatccagactgccatctatttcttcccttacatattcagtagttcaacagaaaacctgaggcttgaagttttagttaagcagtgcatcagcttacagcaaaggtgatgtggctccaggagatgtgaaactgtgaaaagtaaacatgaataccatagtgtaggaatgagaaacatcgagaaggattagaggagactcagggcttattcgtttcaaaggaattgcaaaggaaaagcatagggataaaaatgggttttaaactaccattcgtttcataggaatgaaccataggaaaactataggaaagttttccattcctccatttttgaaggaaaagcataggaaaaaacaatccactctaacctaatatttgcattcctttggttggcttgctcaacaacataggaaaaattcttgtattttttaatccataggtctgcacatgtattcatatagtatttctacgtttattctatttctacgttttgaaaatgctgtgaaccaaataagccctcaatgtggcaaatagcatagcgttgggcattaatatcccacatgtagagttgagtttagataggttgaggaccagcgtataaactttttgcagtaatgccagttctagctagttcatctgggttaactttaaaaaaaagggatggatgggatttactacaccattttaaaggcacatatatagtatatatgctttgatttcacctacacccccttcccagaaaactagcatgaaggccactcatcagtctgtaggatcgaatcacaagaactaagccaaccagaggggggtgaatggttggtatacccaagaaccgaaaacttttagcggaaataaaagttaccctcgaattcgacagaagtcggtctgaccgagattgatctgccagtctgaccgagtggatgccgccggtctgaccggtatagatcacccggtctgaccgccgatgtcgcctgctgcgcctgttgccgccgccggtctgactgccgtgctcccgccggtctgaccgccgcttgccgccggtctgaccgccggtgagttgccagttagactgccgaaacccggtgaaacataaatcgaagaactcttaaagtagatgacgactttattgattctctatgtgttcacaaagtgcatcaacatcactccttacaaaaatttcgactaaactcgaaaccctaactaaactagcaactcaattgctctccaaagtgataccaaaaagcgatactgggaagcctcacgctccccctctatttatacatgaggtaggcagcctaaaaccacgaaccaaactcatactaagagtcctaaacaccttaggaaaccctctagtacaagacacaaacttaacataaccaatcgtaccaaatttggactccttccaaattcgactccgcatcccatacacacacaatacttccaccgtatgccatatggaatcttcaccaaccacgtgcatcaactctagccttagtatcccgcatgatatctgaccaccacggacatcgttttaccaccaagccgactcccggtccatcaccgcaaatactctgccgaggcatcgagtcacctacacatgaaacaaacaaagaaaccatattccgagaccaagctatcctcaacttgactcattgttagcaaacaacagtattacatacgtatagtatccatctagaagccataaccatgaaacaatcatggatatccaaagaaccaatccgaaaccgaaaccgactcagcgttagccggtcagaccgcgggcctggccggtctgaccgcacacatagcgccggtctgaccggcaacctccgcccggtcggaccggacacataaaataacagaatccgatcatcacctgaaaattgattatctccaaaaccacttcgacgataatctccaaatatcaaaaccaataatcacagatgccaattgttcatcacagaataaggaacaaaacacactttgatcttacacaatcatcactactccatccatcccataatgtaagggataatgggtagatgtgacacatnatagngcnatgnntnngnnnnannnngngtcacattcacccattattccttatattatgggacggagggagtaccattcacattagcatgaacttatggacactcagtagtgaacaagtctctcatgaacaccacacctccattttctaccctctcactagagagccacaagtacaactagcagtagtgcatattaaatggcatagccgcatttaattactaacaaagtggaaggcaatgcaagcttataatgagtacatggatctctgaaaccacaattacccaatcagtttcctttcccctctttctaccacaatatctcattatctcggaatgggatgcatttggagaagataaaagggtagttctccccattcatgctgctcaagaggtcgtagaagctcgggattgttggtatagggatctaagtgagcaccatgcatgattaacaactaaaaatagcctccaccggtaatagataaacaaacatgaagggaggaccctctataagattatgtccctacgtagcagttatatacttatatgatcattgaaatgttgttgcctacctgatcatgtaagatatctaaagttcagtatcctagaattaacaggaagctgatcagatgaaacaaatcaaagaagaaagaaccttctgcacatacacatggtaacccatcacatattctggattaaatagattaattcacgtagacctgagaaaagttgccaacatgggactggagattggacatgcatgctcgttatatcacttttattcacaagttcttatctagatttacaaatagaaaaaaaagatcattttacaaaataattattagcatccctgaaacttgatgcaaggaaaggaactgctcctatccacctgtatgaaccaataactctgtttgaagtacagtcataatgctgcaatttcaccacgtcccctgccaatagaagttctggagtgaaggctctcattagtcatcactatccatttacatttggaagaccataattattggcacttggtggtgtggagtctccgttgatactcaaatttggtactagtttggatttatagcaacttgccaaatttggaaactatcgagtctttcccgcgaaggccggtctgacttccattgttttttttaggaaaacgacggcaggagctctgctggaatttgattaagaaggaaaacagagtgcaaacagatcggtctgacttccgttgtgtggccggtcaaaccggacaatgaactgcagtcagaccttaggtgtccgcgtggtcagaccttcaacacaaagtccgagtccaattaagtatttctcgtgtttccttttttgagactaggatttctcgaatcttagttgatttctaagccgaattggacatgaaaatgaccctgagaaacaagtccacccctcctacaaatataaggggtcaaaaccgattgaaacaacaataaattaattatcaaaatcaatttattacccaaaccctctatattctacatcttcctccttcttgctacctatcccaaagtctattctactcaaattccccaattgcttgtcatcctcgtctctacggcttagaggacgtcctaactggcctgccggagtctaggacaaactggcgcgtgttcaccctaacggggtccctcctgggtgttcttttgagcatccaccgctccttgaggcggctcgtctccgggtgtgccactgcgggttgcacataatgtgctcaatgtgtgaaggcgcgattcgacgtcaacagtctctaacaccgtacctccattttctaccctctcactagagggccactccacaccacgtgacaatacaaccgacttagtgaatgttaattgaaagtatagctgcattcactagcaaagtggaaggcaaaatgtgcagcttataaggtgtacatggatctctggaaccacaactatatatccagtcaagtgcttatcccctctctttgcatgacaaattttaccacaatcttgtgaccttggaattgaacgcactgggagaagatacatgcatgggttgttccctctattcttgcctctctagaggccaacgaagatttggctggcttgctggtccaaggatccaagttagtaccttgcatggttgaacaagatccacttctaagatatcaaagaacctaacgtgatggttgttgagttgtgatccaaattcatttgcacttaataaaagccagcttctgccctagtgaagcggaggctgaagttggcccattgggttgtgcacctggggacgcccgggggtgcgggggcggaggccccgcggtacagatcgtaataccttttagggttccacctcatatatatacctctcgtaagccgccgtgcggcgttgtaacctcaccctcgatatagtaaagatttttttgctggctggcatccgtggttttttctctcctggtttgggagggttttccacgttaaatctcatgtcttctgtgattgatctattgttctttatcgtttgtttgcctatcgcttcctaacaatggtgtgtgtctgtaacttttccgtccttgagctcaacaacatggaaagtctgtgcatcatttgcatgggatgaatgacatctaaaagtcaacatcaaccagcaacgtcctgacaagaatggagggacataatttgttctaccgatgattttattattctagaggaggtaccatactcttttatatcaatttgcattacctctttagacatctcctgaacaattagaaacatcaccactgcactccttcaaccttttcacttgctgtttctacatgaacagatgaaattcatgaaacagagggagagtgttgatttaaggaaatacagatatcaacaatgatatgttatagcccgtattggaatgtatgcatgcatagggaaacggggtagccaaatgacgatgatctttactagggagcaggggcatttagtagacatggaatgtattccacttaatataaactttggttcagatcgaagattacaatcatttccaggagcaacgaccccagagaataggtgtgctagcaagtatttggcatgaacatgttaaccacaatgatgatgttgtgccatgggaatggaatgatacacatatgttgaggaaaagagagaaaccaaagagaaaaacagcacgagcaattcagcatcagaagcagtcgtagtataaactagatagcactggctacgttgtatatatagacatccaactgaggagaaacatgaacactgttgctcactgcttaggtgaagtatgagccttaattaataattttgagtaagaaaatgctgacagcatgttgattaattttgaagtatcaaaatttttcggtatgttggcattcaaaattctaatattatggtagactagtggtccaatggagggcacctatatacctatatataccttccacacatccagattccagcactatttaatcaaatactcatatctaaagtcacaagtccatctatatctgatggttattccgactctatctagggtgtatatataccaatttatttacaagctagtagcaactcacacaaacatggatcagatcgagctcaaactacctaaagatgatgcagatcaactgccagtggcatcacaaatataggcgtaggatgcatttgggaaggagaaaaaggacgtgaaacaaagactgcatcgatcactcgcaatccatagagcgtagtggcattgactgacctcacacaaccttttatgcagtaagacaccagaaagagtagcaacgacctgtatgttcatagttgcaatttctcatatactccatggatttatcagtaactagattaaattgtaccaagtgatattgtggcaccagctagctagtttaataaaaatgttggaatagttgtatgatcaatgtcataatgaaaataaattctatgaattgaaattgaaaaatgtacaaagaataggtaaaacaatagtaagaatgcttgatggaatgatggtattataatgactaccatattattatagctacctatgctatttaaatttgaatagcagaagtagcttttgaatagaggtagctgtgtattatgggatggaggtagtagtaaactttcattagtacaattattagttacgtcttcagtttcttaagggagattactaccattggatgatataccaagtgtaatattatattatactaatgaattttcattaacgatctttagtaatttcattgtcagatccatcaatgcctagactggatggaccatatgctttttttttattttttctgtactgaaatatttcggtattatgacttgaaatatgtcgacagaaatgaacttcacacaatgctccttacctcctaccaacatatatataagatccaagagtagataactagaaaactactgnnnnnnnnnnnnnnnnnnnnntctttcatgagcatcttttctatccttgaggagataccacgaggtactatgaggtacgaggcaccataaggtaccaatctaatctaaccgttggtttaacaggggtatgatcgggcaaacaaaaataagctctcctctcttccttctgctgtatcaggtcgtccatgccggctgtctgcgccgtgccatcgtcgcatcgaggccgtcgcgccgccgtcacccatcaagatcgtcgcgccgccgtcgcccatcgtggtcgtcgcgctgccgtcacatcgaggttgtcgcgccgccgcccatcgaggccatcgtgccgccgtcgcatcgaggccgtcgcgccgccgtcgcatcgaggttgtcgcgccgccgccgtccaccggggccgtcgcgcatcgagcctgccgccgcggtcgcgcgaagatgcttgagcagtaggaattctgaaggttgccgtcgcgcatcgagcccgccgccgccgtctccgccgccgtcgcgcgaagttggttgagcagtaggaattctgaaggaagctgaaggttgtccaatcgaagatgcttgagcagtaggaattctgcaagagatggcagtttcttccaatttttacaacctcccaaatctaggctgataagattattcactgaggcttttgcaatccagtatgggattttagcaccaacataacctgaaatctttaggttcttcagaatagaatttggctcaaggttatcaagaatgattgaacaatcttctctgctgttggtgccatcatcctctgaccattctagagataatgagccgagatgccgtttttcctccagcttcgcattcttggcttcttcttcattctcaatattctctaggtccttgataactagtttacagaggcacttactgtgtaaccttttgcttgtcggacctgatagtcttctaacatctctcctagtttgatgtatcgaaggtgctttaactttgccagtttgcccataaaatcagatgtatggaacaataccgttttaaacagaccataaaataaatgcatgcaagcagcccatgctgcataggaatttaatactgaatagaaggagataatcagttcatatcggtgtttcttaggtaagaaagatcatcgatcaacgcttatgttagttaacgttggtcctaatatgatcggttaaaagctgtcaaattttaattaaaaaatttggcagaacctcgccagtacttgtgaacattcacgacaggtagtttataagcaatcagtcataaagtcataatcacatccagacacaaaataacacaaccaactccaagactaaacaacacgacaagtacagatcaattatgtactgagattacatagtttcaaattacataatgttacatactgacaggcctaagcctcagataagcatacaaaagagagttactggccacatgcaaatattcttcaattttgatcatctaggatcagctgtgagcctgtgccacaatggattgtctgcatgcctttccttttctgctgaacagagagagaaaaaaactgcacaagtcagaaataaaacttctcatgcctaaacatagctgaaacatttttattgagagaacagaaactaatctagaatttgagaggccagcatgtcgtttctgacaatgccaagaaacgatgagaccgttaattatatacctataagacagtcagtaattataccatgggcattccgtcgaacgccttgagtgcaaaataaacaagagaagttctattcaactaagatacaatttccatgcacacacatgaattgacaaatagtgtgcagttcatctgcaaacatgcaaatgaatagctagcaattcgtaattcatatctatacacaggatatatattagcagctggaaaaatcttaactaattaagtgtagtgccaaattgcttacctgttttcaggtcctataatagtcccctaactgaagatatgcaaatgaaattctaactgaagatatatcaagattatatctaacccacattttccatttactcttgtgatatgataaatacaactacaatccatatatctcttcatgttttgtgagtatgcgacatgcaactataatgcacatacgtttaacacataaaacatttactatcaagaattattacacattcaatttgaaatgtccccatatagaatcgacccaatggttcagtcttgtctacagctgtggtattgggataattttactgacctagtgaccttaacaggaagaggaagggaaaacgtagatgatgaactcggccgtggagagtctatgaccagaggaagaaactcggtgggtcagggcctcatgggggcaccgcaaccatcctaggaaggcgagggggcggacaatcggatcgcacagtcccggtagcgctgaggatatggttggtgaggagcagcatcaccgaaccgaggccaacacaaccccttaccctccccccggtcctccctgcggagctcgtcggcatctggcgcccttgaccacgggggcggccggatctggcgacgaggtggcaggagtggaggcgctagggatggggagggggagggtgccataggatgcggaggagcggaggagacggcagccaacggcatcggcgtccgcgctcgaacgcgaaaggaggagatggaagccggcgcccggcagcatctgttcttaggcggttgtcggtgagagagaaggggaaatcggcgttcgagagaggcgaggagccggggagatcgctgggttgggtgttattgcgaaattaccaccttacccttccacccatgaaatgcattcggtaccgccctcggggagacgcgggtaccgataccatccaggccgttggatcgcacgaaattgacggtcaggatatggtacctccttccctcaaggaccgtaaaaaatctcttattccattacatgctcgatcagtagtgaaagaaatcagaggttagaagtttatacagtagtgcatcagcttaccacaaaggtggaatggctctaggagatgtgaaaatgtgaatagtgaacatgaatgccataatgtaggaatgaggtacatcgaggaggattagaggagactcaatgtaacaacccagccgagcaataatagtcccacatgtagagtttagattggttgagcaccagcacataaacccgtgcgttctaactctgtatggattaactcttttacatatagccagaatagtagaagtatataaattcctcgaaagagctgaggtgtgggcttttcagaaactaagatagcagcaccgacactaactttagtagagaggtgaagagcctgtaagttctgtcatttgtgatgaagaagaaatgatcagattctctgtgagctcacaaaaccaaaatgagcaagtacttccggacagtatgctcatgcacctacagcacttcatttgaacttgttccacaccttgtttaatagagtttcttattctactagaaagagaaaccattgtaaaacatctatattttctcacataggatcccccaaggaagagactaatattagaacagaacaatcatgaaagtcttcctcttcaaaaaatataaggggaggggggtgtcattaggatgtgacaaaatttggggaaaaaatacgatgccatgataacagaaaagaggaataatgtttttattttgacggaaaaagaggaataatgttggtaatacatgataatcatttcagaaaaaaagggaatgtgtgcaatacatgtgcatatgtgattatcattgaccccttgaactagtcaaatctaacaccaacttttatatatgaatttgaacataacctatgtctagatttgtatacaaaagttaatttattttgggatggacgaagtatatcaatattgcgaatgttttcaatcagagaagtggacagatatgaacattttggtttacacataagaacaacttatcatgtcgtggtcaattcatgtttgatgtctaggtcttttgtcttctggaacaaatttttattcctggtacgaaatagtatcaaataattataatcttgaaaccatcgaatcgtgtgaataaaaaaaaaccagaactgcagaaacacacaacggacatgtctcaaatttcataagttattgaacagaggagtaaattataaatatgattgatgatttctcaaaccaacaggtggtgaatgtaaaaggtgaccataactctcagggaaaaaaaagcattcaccaacctaccacttattcatatcagttataaataactaaacacctgcctttcatttttatcagtgccacttcgttgttttcttcctttctacagttacaagaactaaacttgaagcagttgccacacatcagttaaagagcgaggagtaatctctaccacaaaatgcatgggtatgcaactgtgagcttaattcattggttcacaccctcatttatctgatctgttgtagggatgggatgcattgaggaagataagaaaaggcacaacgataataccgggagtgtttcagcatcgatcggtcctgattcctgaccttctttcagcatgaagtgcgacacttgcatctcacactaggacagatgtcatgacctcagaccatgacggaataactacagccgggaagatagccgggcagcgtcggctcctggagaagggatgtagattcaggctaaggagaagaacattgctgggagagagagattagattaattgatattcattgcttaattgataatagatacaatcccatccttatatagatggtacaaacttgatccctaagtaagaacttaatcttatcctatcttatctctaactactaactaactaataatcttatctctaacttgattggtttgggctgcctataaaccttgacctacggcccaatgcccataacattgtgtgaggttcaactcatgagctcgtcaaccaaagaggtagctaacatagctcactctaggttaatgagaaagacgaatttggagcagcatatgtttcttttccggtttctttgcatgggaaatgtgaaagaaggttctggctgatttttttttattggcaatgacacaactgttcaaatcactgatgagatctagatatcactaacggcaagaaacattaaagatttgcccttcaaatcactgatgagactagatatatcactgtttcaacatttaaagatcgacagggtttcacaagagagtaaataaatattgtgtcgttagccgctactatcctacattgggtggtatattttggatcatgtgtaatgccgtgttacaggttttggtaaaaataaataaatgtttgacagcaatgtgaaaaggattaaaaaatattagtaagttgaaaaatgtatattaacatggaacttcacatcgtagaaaaaatatgtttccaaatattaatctcattgtttttaaagtatcacactattaatttatggagttgatgtttgacaattcgtcttattaaaaataattttagtacatatatgtaaaaatataagttatatttaagtaactttagtgattaaacaagttacaacattacttacctaattttttaataagataaataatcaaatgtcatgtccaaaagttaatattatacatttcaaaatgaaggtagtactagcttgtacaagtgcacacacatctaggttggcaattaatatccttagtgctggccatggcctctttatttaggtttaggcttattgacttaaccttttaaatcagttttttggcttatataatttataagctggtggatttaaagtcctaattttaagagtggagtcatacttctttctcttgtaagtaaaaaaaaacttcttcaacctagctagcttttagcttaatagtataaaagtggcttatggttttaggaaagacaaacaaaaaattattatttatttaggcttagatattttaactcataaactgacttgtaagtctaaaaaaagaccaatgccaagatatgcttaggatttagaaccaacgtggccaacatccacgtggtgttgcatgcacatttctgcttttcattgtggagggttgccgatatatgatatgtcacccttcttgtcaagcaaacccaagtaagacactaattaagaaatctggaattttccctaatgacaaaaccaaaagaaataacaatataataataataataataataataataataataataataataataatatacttttaggtagcaccagcacacacagaataaaatagcgacacatacccataaaaactcccgctgcatctcatgttctatcctgatcctcaatccaacaccactttactaagcaaaagttatatgcgcgaaaattgttgtgtttacgatacacaaaattgcaaaacaaagtgctgctgaattctataagaatgggaagcattcagaaagcaagagtttttccaagagaggcagtactgcagtagaacaagagcatagcagcttggctccaagggtagacccatggccgagcagccgaggacacggcagaattgtggccatgtcgcatgaacagcattatttgatgactccataggttagcccgctgtaatagtattttcatgggctctagatgacttcctcgacgagccactaaaagataactagcctcgtttctagttcaaacgaaatgaaggtgtataccgtcttagttatgagagggcgtgcattctcgtggttacagtgataatctgagtagatcggataaaaataaccattctaaaaaaaataaaaaaagaagatgccgtcttagttcgccaaggagcagagacaatgtttaattatcaataaaattgtgatgtgtgatttggaaagggaactacgtaccagcctcttggtagaatcaccacaagttctcctttctagtcttgtagatctgaaaatagaaactaaggtactcttgacgtaatccatcaaatactaccaaagtttgtattaacagtgaccagggttaattgtaactatataaggatgggaacggttggaatcgtaacatctctttggaaaggacgcttggccgatcgatgatttttagtatttatcaatttaacttgttgatatcaaaacaatgctaaaagaaattagagaaatcaaatctcatgtattgcaaaaaatggaaacggtacaacttacaaggaaagaacgctcggtctgtcaggaatttccatagcaattttcatcgttaattaaaactatgaagtaaaaggcatagtgattaagaggtattgttgactcatttggtataattgtatcataacagaaattatgcttgagctctttgaaccaaaagtttggtgggtccataaatttggttgatgttacacctactttaaacaaaaagtgcgctggctgcaattgagatttctataggcaattgttgatgtacgctagaataaactgaatttggcatactctgctgcagagtgaaattaaatctgctaaatatggtgcaaagcagtgtacaatgtgtaaaatgcagtttactcatcatatattcaatattttaacacaatggtataggagtagttccttaatttgtttttatcaagcgatggatggaattcaatacatccatttgaggtacagtgatagtgctacaatttcactgcataccttgccaaaaaatgctggagttatagcccactatggtgtagtagaaagcaatctgaatcactgatctcatttgatcgaagggtttgcatctatttttactaccatcctagttagcgttagtagaaacatggagagacatatattttccaaaataataggtgctgaggggcataatcgtcattagcagtaactaaacatttgttttcctacttttttggcttttttgatggatatatgagtgatgccagcataatgaatgaccacaaatcaatctagccggaaaaaaaaagacaaagttagtcattttaatatcgatctagcttcattgtattagtaaattactaatttacccttaatatcaaatagtttacatcatttctacttgtactaccagtagagagtattggaggatcgcttctggagttaaggctctcatatgccaaaaatacctccatttccagatttcttaccctctcactggtgagcctcggtacaaaaagcaggagtgcatatttggcagtattgactaacacagtgcaagataatgtaagcttataaggtgcacatggatctcaaaaaccacaactatcaaatcaatttcttttcccctcacgctgcaggctgcagcacaaatgttaccacaatctcgtgatcttaattagaatgggatgcattaggagaagatataggggtttttctcaacgcagaagctttggctttctgctacgaggatccaagtgactaagtgagcataatgcatggttgatcaaactcacctgatgatagatcaacaaaccgaatgcggcggtgtgtataggatatctgtccgttgtgctgaacaagctacagagaaatcaggaaatgtatgcaacatttgcatgggatgaacatcattttaaaatcagcaaaaatctctacacccaacattttaaccccagcagcctcctcatatgatttggagaaactaacaggactgatgaatcctgggagatgcagataatttttgtgatccagtaatatttgcatggatgcatttgggaggaaattaggggatcagacagccccatgatcattctgcaggttagatggatccaactaccaatctaccatgcatgctgggtatgttcatacttgcaattccttgcatttgccatggattatcagcaatgtgaataaattgtccagcagatattgttgtacactaatcctagctagttgaacaaaaatgttggaatagttgtatgatcaatgctacagcgaaagtaagttttacaaaatttaaaaatgtatgataattggttaaaaaaatagtgaaagtgattgatatgataacaagtttgtactatcatatactccctcctttccaaaatataagaatttcttggttgtttagcaagtactatggttaggccaaaagattactctttagttactttaattgttattttttgaattttgaatggattagattccctttcaaagcatttggttggctctggattcatccattgaagttatttgaatagtgggaatcagtgtagggatctccttacatcgtggtacaaaatttaaatcctagaaatccttacattttgaaacagagaaagtatatattagctagaaatctttcatcaatatggtcagtaataatgccttcggtttcataaggcatatacagtgctccaattagatgatatacgtacggagtgcgctgttatactagtgagctttcatcaacggctttagtgattacattgtcaatttcatcgatgcatgcttgggttggttggaaatctgtcaatagaaactttgcacaatgctccaagactccaaccaacatatatatcatataaaggagtagatcgctagcaaactcctatggtctaaaccactatgtattccttcccatgcatcattaatagtgcaaccagaagctagaggtggtagcacaccattgcatcagcttaaagcacatgaggatagaagttaacgtgaatgtcgtagtgtaggaatgagatgcatcgagaaggataagaggagactcaatttaacaccacggcctaatgagtattgatggattagtctcctcagatgcagtgattgcatagatagcttgagactgcatattaaccaatgcattttaactatacaactctttccggttgatccttttgtataaagtcagaatgaaagcgcaagggttcaatgatcatcaccatttagttcagtgtaattcaaaagaagacacacaaccacagaaacacacaagggatgcacctaattttcataagttttgaacagagctgtaagttttaaataattttctatttgcatgaaaactgcaaactaatattatagctcttttatatcaaaggaacaggtgccataagggtttccacttatatgaatataatgtagaaggtgaccacatgactctttctttacaaaaaatatgatagcttatgcctagcaattagggaacgtatcatatgcacacaagtcttttcatgtatacactatgcatagtaactagaaaatatcaacaaaaattctataaaaattatacatgtacttttaatagtattaaatttatatcttaagtcccatcttcaaatttattataacagatttatactctcaaaactcagaattcttatctttttttatgactaaaatataatgaatttgagattaagacttcacataagtgtattattattggaagtacttgtacaaatttttctagatttttttggtaaaatttgttagttggtgtgcatagtatgtacatgaaaagactttgtgcacatgatatgttccctagcatttatatatgtattgaaagggaagtagttacaggggggaaaaagtttttcatcagttataaataaccaaacacttcgctttgatttttaccacaaccacttgttttcttcctttttctacacctgcaagcaccaaagttgaagcagataccatgcagaaattgaactgttgaaccattacaaaagaatgggagaggaatcaagacataaggagtagataatgtggatacagcttcaactgagcttcattggggttcaatcttgttttgttttgtgagaatgggatgcatggaggaaaagaagacaaaccagcaccgcattacctggaggatcttaggagaaattggtacggcatttcaaacaggaacatcaagctcgaacgacaagtggtaagtgagatatacaattctcagcatggctggagggacaagtgcaatgtgctggagggatcgatgagaggagaacagaattgaagttgtcaactgaaatcatcaccaagtttggttgctggctggttcttgttttattttcgttgctagcaaaatgcatgtacgttgttacagaatttagaaaatcacatcgccacattgcaaaaaaagaaatctattttcagtttagagcctaatttagaattaaattatatgtttttttttcatctttttatatctcagctataaaagatttgaaatggactcaactaaatcattaatgcataacttcctcccttaaaaagtatttggtttcgagagggatggacatgtgagttccacgtgttatagtttgagggagttggtggtggcagaccgaccaacttgaaactcaaacaagatcatcattagttttatgtgtagctgctctgagcctccgttctccatgtctctctttttgcttttgcctagttgcttacttgcttcctatttacaaaatggctttcaccactctttctcaaactaaaagaaagaaatcaactaggaacggttgtactaaggttgaactgtgacatcctggctcaattaggatgaggcatttgtggcccatgagagctatgtgctcatgtttaataccacctcactagtttagcaagaatggaaccaacttataacgacttgttcctccaaacatatcactcccggataatcccttttacatgaagcgatggtgaaagtgtaaatgggtagtatgtataagtaggcccacccgtcagatgggctggctacgttgttctagagggtggactgttacaaactgagctcaaccaccaattataccgttcccaatgtgggaccaccaaagaggtagctagcaaagtacactacctaggcagcaagagatcaccagcggcacaagaacaggcctctagctcatggcttgaatgtgtgagaatcatagattatttatttctaatctataacatgatggctttagtctaaaatgatcaccctaattctaatgcggaattggataatggacggtgttttgttgacagacatggagatgttgttgatgctatgaatagtcgatagttttaagttggttatttaatttggatatagactgacaaatgattatattcttctaattgattaaattctacttttggatggttgataggattatttacaagttattggaagaacttgcagcatgtggggtatatggttatactacgtgacatatattcatgagtggagttcagagttttggcttgtctccaggcatacatatacctaggcacaagtccagcgcaaaagcatacaaggaagatcataacaacatgtttcccttctctggaaaattttgttggcaacagatgccttctccttctttcagcttctgcttctttagtcagtttggaggaagcagcaaatagttgatgatatgagaattccttctacatcggcttaggtgtagcaacacgactttattattattattattattattattattattttacaaaaatataaaatagatcagtccctcaccacaagtagagcaagttggtgagttattgtaaagttctacaaagctaatttaaaagttattgcattaacttatttcatattacaaacaagagtgtcaatggaacaatgaaaaccatatgacatactataattttgtttttattattgaaattatataattcaaagagaataaatccacatagccgtaaagttctacatgtggtgcattaccaaaatatatatagcttacaaaacatgacaagcttagtttgaaaaattgcaatccttatcacattgacacataaagtgagtgatgagtcataatattatttttcttgctacccatcatgtatatatgatagccacaaagttactttgatgatgatatcaaagaacatttttaggtgcacctaacagaatatccaaataatatgactcacttagatcataatagagcatcaagtaaaactaacactctaaagcaaccgatgggaaagcatctataaatagacaagcacaatgaaaatcctcatcatccttcaccacaattcaaatattatagttgaagcatagtagtagaatccaacaacaatgaagatcattttcgtatttgctctccttgctattgttgcatgcaatgcctctgcgcggtttgatcctcttagtcaaagttataggcaatatcaactacagtcgcatctcctactacagcaacaagtgctcagcccatgcagtgagttcgtaaggcaacagtatagcatagtggcaacccccttctggcaaccagctacgtttcaattgataaacaaccaagtcatgcagcagcagtgttgccaacagctcaggctggtagcacaacaatctcactaccaggccattagtattgttcaagcgattgtgcaacagctacaactgcagcaatttagtggtgtctactttgatcagactcaagctcaagcccaaactctgttgaccttcaacttgccatccatatgtggtatctaccctaactactatagtgctcccaggagcattgccactgttggtggtgtctggtactgaattgtaacaatataatagttcgtatgttaaaaataaagtcatacatcatcatgtgtgactgttgaaacttagggtcatataaatctaaataaaatcatcttacctatttaaatagcattcctctatgaggataaatcctattacattatcgtagctaattaccatcacagggactttacaattttactatatgcatgcatttgatcctaagctgctttggctattagatataaatgaagtgcattaagcaagttcaacctttcattcccaataggaacgaacttgaagcacagatgtcaattactatacccctaacaattgatacactatagcagcggttgtagccgcagctggaggattcgctgtcgagcagaccatatacctgaatttaaaccatgtcaaatatccgtaatgaataacaaataattttatattgtgcatatccaatgaataatcaaacatttgcctttcgactgtaatgcttgcatggcctgctattgtattgctctggaaacacatctttaacagatgttgtattatcacatacattacattggaggagaaggatttaagtgatcatatatagaacagaggatatgatgttttagaaaaaagaagattaataatgtcaagaatactttgtgaaacagtgcatgatgcaggcacatcacttgatacattaaaagcgctgtaaaaaatttatgctggggaactaatgcactactactagcctcactaatatcatcagttcgcggtatgtaacaagctaacattctacactgcaccaccccatccattcttgcttttttctatagaacacaagaaggaacatcagtaactggatgcatgtgtgcaccgccagctgccacagtgttggccattatctctttcttcaaggcatttcttcccatcaactcctgcttgacacaagcaggacaaaaatgtagctttggttaagtcaaggggagtcagtccagctatagatgaaccagcgcccttattattgtgattactgccctagctcacacaccggaaatggactcaaatcttaaaggcatgtgagcttctaacgagcccacattccatctaggtaacatgatatattgtaaggctctatttttttcagattattaaaatggattatttgctccatgctttaaaatatatgtttgctccatattctaagtcaagtattttatttagggtaattattttgatcctagaggagacatcctaggatttctctaaacatcatgaaaatagttatagtaaagaaatttcgtaatatttatgtggtgtacatattccaccctcacaaattaattttcaagttaagctcagtagcaaatcgacaagtaaaaaaggacaggtccagcatataaacgttcatgtgcaatgtacatacgaatttatttattttgtttctcaatgttcagatccaatttaaacttggttttttcgttgagtagtaaattgtcattgtactctatattgtcattttgttagggaatctttcattactgtgtgcactgcatcgaagagaaaaaaagggcgtgtaaatgcatatcctctattaaaatccgacttctatatattttgccccattttctctataatttctagtggttattgattgagaacagctacaaattacttactaagcacctttcatgggcactatataactcatgcaattcttaaggtttacgaatgcgaatacaaatagaaattcgctgtgccgacctgttttcaaagattaaaaaattgaaacatcaatcagaaaccattccagaatgggccaaaatttggaaaacaaattttgaattccatggagaaaattaactggctggcaattgcacatttgcactgctttgcccctataaacatcttcgagtagccatttcattattcccagtaaaatattaatactccttaatcaagaactgccatataggtcatttctcttggtacttcagttcgctcatttatttctcataatttaaatttcaaagtaataagcgatagatcaggatccatgatttgaacatgcaactttaaagtaatgcagtaagatatagatcggtgtccatgacttgaacatgcatgaacagtaaccccactcgtgagttaaaaagatagatccatgatttaaacatacattcgcagatatttgatcattatatgttgtaattatattctcataaaaaaaactaaaaatgcttcatagcatttgtatattatgccaatattgagataatttcgatatctcatatgttttagattggaacagatcacgaaagtttttcttcgaaaagttatggtcattaggacatgatggatttgaggtaacaaaatagatgagatttattaaaacccttgaaatagtccaacaatccagcgctaacatttagcacagtgtaattcaaaagaagacaaccacagaaacacacaggggatgttttaaactccaatttttatatatttggcattattcaaattgcaaacaaatatgatgactctctttctcaaagaaacatatgccgttagggtgatcccagcgcttcacttagaatggtttttcatagcattaaatgatatgccacgtaggaaaaaacatgatgtgccattttattaacttaggaaagagaagaaaattgggtcttctcaaaatgatcatcatctaacaaaatgtctctttgtttatttgtgcaaagagtaaatgtgcatcgtgcaatgtcatgcatgctgccaaccaagattaatttctatttagttgaacctgtgcaacatttaaagtgtgaagtaatttttgttggacttgaagcgacaaagcaccttggtcgattaggccatccccaacccatggtgtccatgggtggtgtctagagcagtgagagatcaataaatgcatatatggacactacctccccattgcatcgtttatataccagttttcataggcaaaaaaaaattagtagctctttgcatgtaacattaacagaggagggtcagctgtggcaagcaagcaagcagacgcgggaggggaggcgcgcagcaggcatggtgacggggtagggcgcagcggatcgagatgcgaggatttttttttgggggggtggggtggggggagagaaacgagtcatccaacccaacgcggatttagctagtttccagtgccttggaacagccgccgaaacggtgtcgcgcatgcgacctggtttctatgtttttgcttctttctcttcttttattccgttgccacatcaactttttgtctagttggcagcctaattaattctatggaaaccaggtgacatggagggttggggacatggtggaaaaaaccggaacgggccgacagttcaaccggaaaaaaccagaacccgttcagttcaaaagaaagaccggacatgcatatgacccgctttgaaccggcagaaccggtcggtttttctatgaaccggtcattaaaccgtccccggttagaccgaacaagccacaataatcttgaaatgggccttgatgtggcccaattggtctgcctagagcgttttggttggcaaaaatcaatctcctattctcggcacgtgtgatatacaatggtaagtgagatatacaattctcggcacggctacattacaaggtgtcgcattgtgtcaatgtttggttaatttgctagattcacataatacatgccaggaagttcagaacaatgtgttgcctttcaccggaaaactttgttggagcaaatgccttcttcttttttgcttctgcttcttgagtccatgtggaggaagcagtagatagctgatgatatcaggattccttctgtgtctgtgtaggtgtagcaacaccactataatttttatttagcaacacaatatcaatttggtctataaaagtatgaattaaatcaatccccaaccacaattagagtaagttggtgagttattgtaaagctctgcaaagttaatttaaaagttattgcattaacttatttcgtatcacaaacaagttttcacaagagtattaatggaacaatgaaaaccattgaacatactataattttttttcttactgaaattatataattcaaagagcataaacccacacagtcgtaaagttccacgtgtagtgcattatcaaaataatagcttacaaaacataacaaacttagtttcaaaagttgcaatccttatcacattgacacataaagtgagcgatgagtcatgtcattatttttttgctcaccatcatgtatatatgatgggcataaaagttactttgatgatgatatcaaagaacatttttaggtgcacctaacagaatatccaaataatatgactcacttagatcctaatatagcatcaagcaaaactaacactctaaagcaaccgatagggaaacatctataaatagacaagcataatgaaaaccctcctcatccttcacacaattcaaacattatagttgaagcatagtagtagaatcctacaaaaatgaagatcattttcgtatttgctctccttgctattgttgcatgcaacgcttctgcacggtttgatgctcttagtcaaagttatagacaatatcaactacaatcgcatctcctgctacagcaacaagtgctcagcccatgcagtgagttcgtaaggcaacagcatagcatagtggcaacccccttctggcaaccagctacgtttcaattgataaacaaccaagtcatgcagcaacagtgttgccaacagctcaggctggtagcgcaacaatctcactaccaggccattagtagcgttcaggcgattgtgcagcaactacagctgcagcaggtcggtgttgtctactttgatcagactcaagctcaagctcaagctttgctggccttaaacttgccatccatatgtggtatctatcctaactactacattgctccgaggagcattcccaccgttggtggtgtctggtactgaattgtaatagtataatggttcaaatgttaaaaataaagtcatgcatcatcatgcgtgacagttgaaacttgatgtcatataaatctaaataaaatcacctatttaaatagcattcatgtatgaggttgcattatcatagctaattaccatcacaaagaactttacaattactatgtgcatgcatttgatcctaagctactttggctattagatacaaatggagtgtattaagcaagtccaacttttcattctaataggaacaaacttgaagcacatatgtcaattactatatccccaacaattgatacactatagcagtggttgcaatggcagctgcaggaattgctagtgaacccaacagcccatataactgaattgaagccatgtcagacatccgtaatgaacaacaaataattccaaatagtgcataaccaataaatacttaaagatttgtctttcaacactaatgtttgcatttcatgcaattgtattgctctggaagcaccttttaacaggttgtatcatcacatgcattacattggaggataaggatataagagatcatatatagaatagaggatatggtgttttagaaaaagaagatgaagaatatacattgtgaaacagtgcatgatataggcacatcacttaatacattaaaagcactgccagaaatctatgttggtgaacaaatgctcactggttgtctcacttatatcaccattcaccaagttcaccgtatgtaacaagcacttggccccatggttccccttaccgtttttgacgcggttaccacatggttaccgcaaaaaaccgtgtggtaaccgtgagacataccgtggtttcaaaaactaaaaaggttaccgcgtgtgatagccgcgcagttttgtaaaccctgcttggccctacaccaccccagccattaattcttgtccttctctgtacaacgcaacgaggaaatacatcatgggcatagggaataattagcaagtttagcaaaaatgaatggcacaattgtatagcatgagtgatgatgcaatgaggaaacataagaacatcagccaggtgtttctccccctcaactcctgcttgtcccaagcaaaacaaaaatgtagctttggttcagtcaaggcgagtcagtccagctagagattaaccaccttattattactatttttttattattactaccctagcttacccaaaaaaatgaacatttttcatttttaattttaaaaataaatccatccaaaacttattttcaagatttgaacatttgaccacgccaactaaactggcgtgtcaaaacaataccgtcatgccactcccgctggtcacaccggcggggaccgacctcactggtaggggtggacaaaaaagcttgggctcgtgagctcggctcaagcttggcttgggctcgcatagctcggctcggctcgaaagccaaacgagccaagcccaagcctccttcctacctcgtttccgaaacgacccaagcccgagctggctcacgagccactcgtgagctcgcttggcttggtacaatagggtcatatgcaaaaaaaaattacaccttttctaactatttatttgttgaaaattataactttgattgtcatattatctatttatgtgttgtgatgacatattaaagaaaaatatcgctttattacacattctatgtggtaaaatattgctcaatttctcctagtcttgcttgagatttacttgatgccaggctcgcttggctcggtacaatagggtcatatgcaaaaaaaattacaccttttctaactatttatttgttgaaaattataactttgattgtcatattatctatttatatgttgtgatgacatattaaagaaaaatatcactttattacacattctatgtggtaaaatattgctcaatttctcttagtcctgcttgagatttacttgatgccaggctcgcgagctagctcgagctggctcgagcccataaacgagccgagccgagctgcagttttagctcgttgtttgtagcgagccaagccaagccgaggttcccttgcaccaagctttcatgattccacccctactcactggtgtggcagcgttatttggccacgcgtggcaggataaaaccgtcacgtccgctacaggtggtgtgccagtgtcatcttgtcacactagatgagctagtgtgcctaaaaggttcaaattttagaaataattttgaaagggtttgtttttaaaatttaaaattaaaaaggttcaaaaaattaaaaaaaatccctagcttacacaccggaaatgaactagaaacttaaaggcatgtgagcttctaacgagcacacgttccattaggtaatctggcatatgtgacatatagtaagggctctatttttttaattatttgctggattattaaaatagattattttcacccatcccatagctggtgaaaacattccccacgctgttccgaataacaatgccgacgctaccaatttattttcacccatcccatagctggtgcctgccacacacctgccacttgggttctttccccgcacccattcacatcactttgtcttccctccgacacaatttttcctttctcattttccagcgttgcactgccagacgggcacaaggaattccatagattcagaaggaaagatgcagagccctttaccgtcgcttgcccagaaccgaagacacagtcattacgcaggtaccaagctcgccataggacaaggagaaactgcgcccgctcgttttcgctcagcttatcgagtcccccaagaagccaccctgggcctagcttcgacagggaacgcttatccggtaacctccagctcgcccgcagagtttcacggagggcccttggccgggtacatgaaatcaccgcgtgaaactcgtcttcctccccctggccgcagatagtacaggtcgcaactgcttgcagctttcgtttacacctgttcttctgggtagccagataatttcgggctagacgccaggcgaaaatacggacctttggtggcacaggtgtactccaaattcttcgccagatggagcgatcaccgtccgtttctctactactgccttctccatccggatggaacttgttcagccacgctaaacgataagcagacctcaccgagaaaatccctgatttttcgtagtgccaagctaggaaatcctcatcctggtatggcgacaaattgattttcaggatctcttccacatcaagtgggtgacagacgtgcttgatcagatcaacgtcccagctcttttccccttgtttcagcagctgcgagacccagcgaagacggcagcgtccgctccttcccataagcatgagagaggaggctcggggaatccatttatcccgccaaatcctgaccttggtcccatccccaattcgccatataagtcctgtcttcagcaactgcaacccatgttcaatccctttccatgtcggagacgcttcagccgggaagaccgcatctactagttcacaattaggataatacttagcttttaattaggatatatatatgtatatatatatatgtatatattgtaatattccagtattccacccccccccccccccccaaccccaaaacaacaaatcagttttcaagttaagctcactagcaaatcgacaaaaaaaaaaagggcagtccagcatatatatataaacgttcatgcacaatgtacatgtacatacgaatttattagttctttttctcaatgttcagataagttttgttgagtgataaataatcactgtacactatattgttatttttttaaggaaatctttcatcattgtttgtactgcatcgaagagaaaaatgggtgtgtaaatgcacattctctcgcgagagattaaaatccatcttctattttgccttttttttctctataatttctagtggatatcgattgagaacagctagaaattacttataagcatatttttcatggattctatttaagatacaaaactactacacatgggtacatgctaaccaaggtttacaaatgcaaaagcgaatagaaatttgctgtgccgagctgtttttcaaaaagattatattcttttctcccaaagatgaagatgaagattaatttttttcgtaaaacgaggtgatattagcatatgattgattgagttttaattataacaaacttgaaaatagattaatataatattttagaacaactttcatatagaaagtttccacacgaaacgtacagtttagcagtttgaaaagcttgctacaaaaatcttaatcttcatccaacaagaagaacggaacctaaacgatagatctgaatccatgacttgaacatgcatgaacagtacggtgagttaaagagatacatttcgatccatgatttaaacatacatacataactgggtgcagatatttggtcattatttattgtatttgtaattatatacgtactcataaaaattattaagaacgcagtaaattcataaaattaagcagttttcatggcgaatctaataacattattttcacatataacattcggatattttgcctatcatgagatagttcgtatatctaaattaatccccaacgattttctagcagtgattcagatatcacaggctaatctcgtaatacataaagatgattatgttcaaaacatgatttaggttaaaaaaattccaagcgaatccgtaaactatattcatgtttcagatagccggcctttggttgattatgaaaaacgattatattattcacattttaaatagttttgtgctatagacatgtatatgaaagacaaaacgagttaaagaaaacttttttagaaaaaagaaactgtgtgaccacgatcttgatacaggaaaagtttgaattagtatgttcaattctgttcatgtacatttgctatatatattattgccttcatttgcaattatactgaatactcgctcgaggaataaatcggtacatgtacgcatgcctctcaataatttgaatgtgaatttgagagtacgtagttcatctcatcataatcatccacacccaaataaattactacattccgattactcataaataataggtaaaactaatttcaatttgacttgatttcatcaatggatcttcaaatcaaatcaaatttcaaacccatccatcagcagttaccaatcctgccatccccggcatcggtgaagaacctcttccagaaccaatggcggcgccacaccgtgtcgaccatctcgtcgatgggcacccccttcgtctccggcagcagccagaagacgaaggcggccatgataacgatccagatagcgaagaagaagaagatgaaggccttcatactgcacatcatggagaggaaggcctgcgcgatgaggaaggtgaagagcatgttggagctcacggcgaaggagaaccccgtcgtcctcgtcgccagggggaatgtctccgacgggattagccaccccaggggcccccacgaccacgcgaagctcgagacgtagacgcagatgagcaccacgatcgccaccgcccacttctcgcccggattgccgttcgccttcacgtgttcccacatgatcgcccccaccgctgtctgccatggatctttcatgttagtttgtagaactaaaggaacgcgaatgctaagaaatgacctaatatcagataattagaaggggtgaggcttcgaatacaggtcgtccccaccatcttgcggagctagccggaaaacctcttgccgttttttgggtttctcgaactgggagaggacttatgtaaaagtttatattaaaaattaatatatgtttcaaaatttaaatgtgtagtgtatttaaaaggaagttatagtaaaattatataataaaaagatatatttaagtgcatcatatatttaaaaagaaaaggtaacataaacatgtactccctccgtttttttaatagatgacgccgttgactttttctcacatgtttgaccattcgtcttatttaaaaaatttacgtaattataatttattttgttttgggttgttttatcactcacagtactttaagtgtgatttatattttatacatttgcataaaatttttgaataagacgaatggtcaaacatgtaagaaaaaattaatggcgtcatctattaaaaaacggaggtagtagaaaaaactatattttaaaagccaactgtgttatatatttagaaatagagatatatatacaaatatgtaatatgtttaaaggctaaattgcttcgtgtgtaatatatgtaatatattacctgtgcgatgagcatttggccgcaggcctggaggaggagcctgcggcggccgatcttgtcgacggcgacgatggagacgagcgtggagacgacgttgacgccgccggtgacgacggcggagagcagcgacccgttgctcttgaaccccatggtctggaatagcacgggcgcgtagaacatgatggcgttgatccccgtgaactgctggaacacctgcatcgccaccgcgatcaccagcggcggcctcgactcccgccgccgcagcctccggtacgccgactcctccgcgctcagcgccgccgccgcctcgcatgcgcgcgcgatctcgtccagctcgtcgccgacgtcgcgcgtgccgcggatcctctccagcgtggcgcgcccggcgtcgcgccgcccgcgctccacgaggctcgtcggcgtctcggtgatcaccagcgagcccaggaacagcaccgccgcgggcactccggcgccgccgagggagtacctccacccggtgctcgggtgggcgctcgaggtgaagtagttgacgacgttggcgatgaggatgccgatggtgacgtcgagctggaagaggatgttgagcgcgccgcggatgtgcgccggcgcgatctccgacaggaacagcggcgccgcctggttgccgaacccgacgccgacgccgaggcagatcctccccacgatcagcatcgccaggttcgccgcgccggcgcacagcgccgtcccgccgaggaagaacaccgacgcgagctgcatcgtgcgccgccgccccagccgcgtgcacagcctcgacgccgcgaagctggcggccagcgcggcgaggtacagcgacgaggtgaacagctgcagccgctggtcgtcgaacttgcagtagttgttctccctcgcgcggtgcttccgcgcgtacaccgacgggaagaacttgatcaggaagccgtccatggcggtcacgccgccggagatgccgacgtcgtagccgaacatgagcccgctcgtcgccgcgatgatgccgcacagccacacgtaccacgtgatcttccccttgaactcccgccgctcgccgccgccggcgaccttggcctcgacggcgaaaccacccgccattgatgacgtcaacgacgacgacgagatcaatcaaatggagatgatgaggaagaagatgaccaagaggtggtcgagtatatatagaggattttattaatggagataagatgtggataaattggagtgatctcatgcattcgcatgcagataaaataaattaaaattgaattgaatttgaattaaacttggtcaacgaacagattaactgaaggggtttaattaagcagatcggattagttactagctagaactaatcaggatagagttttccggggggtttttttgggggtttttttcacacggtgacggtgacatgcatgcagtttaggggagttggattagtccttttttaaggaatttatagttggattaatggttaggagtaattaggattaatcggatcagccgatctcaacagtgaccagttctcctgcgacaagcccgttcgttctcttgacacgtggcaccaattcattcgctctcaatctattaatggtaatttaatctccaacccaatccaaatgcaaaaattgaaagaaaaaaaaacgcgtttctcacaagatggactgttcctgtgatgactatttttgtctctacaggccgtcctaaactcgtaaatatattatctctaccgtgtattttattatttttttgaaaaaaaaaagtatgcacaaaaatggattttggccattaatttatctctattgatttttgaaaaaacctttacatgatttttatctgtcgctctgttctgcttatgccaaagatggacgttgtgcaaaattgaattgatcaagagcagcttgtgcacagtaattctctgttgtagtatgccttttgcctcgaaactgattaaaacagaacccaaaataaagagcatgagttaactaaagaaagttaacccgtaatcttgatgctatagcatgcttcaaaattataccctcgaatgctaaaaaaatagtactccctccgtttcataatgtaagtcattctagcatttcccatatttattttgataccaataaatctagacatatatatctatctagattcattagcataaatataaatgtgggaaatgctagaatgacttacattgtgaaactgagaaagtacaggtaataatcatcacttatatttgtcgaagaacaatatgaaaagaaagctatcaagcaggtgccttattgcaaagttacaatacacactggcgaatgaactgcaaacttaacttatgtgtcactaacaacttagaaacgagcaaacaaaaaccagtcagttcatcgtcttagactaaaacaggcaccctgcagacaagtgccttgatcaaacggtttttacacggcaaaccaacagacgaaaattcaccagttaaacacatttcagcatctcttcgtacgcataagaactcttcaagcttctgagcttcatcaggtgtttctttgaccgccataatgtttctttcaaactcctcgccttatctctgcgaattcacacataatatgagcttagggaaacattgcagaagatattggccatgttttaattggctggcgaaaatcgtatgctacctgaaatgtggttctgggagctcattctgagataggcttgcgaaccaaaaagaagtacatcggcgtgaagatttccttcctgtagttaatatatttgcattagaactttgcatgaagtattaaacaggagaggaaatggaaaaacagacagctgaactggaattccagaattcgtgacaattatgttgcttttctgattcctggtgctgaaatatgaatcagagacagacttacttgccaccttcgacgagaccttcagctgccttctctaaaaagttagataccctttcacttccttgtggggcaaggccgacgtattccaatgccttcacctaaaaaataacagaagaggatctcaattccatttccatgcgaatcaagagtgaatatataccatgattaaatcaggctgttatggccagttacagtggacaaagcagcctgatctttgaatattcagtgtaacaaagttttgatcgaatttaccatacaagcaatttagcacatctgctgagcagattatgtcaagtctacccgaaatttgatacttctagaaaaaaaatagtatagtacttttaaactttgctagctattagtataattgtttgttttatttattgtaaatgtccaaagaatgacttttctagctagccctggtagaacttctataggttttcatgttacataaactattacatgaaccattgttctcaaaaccacttttaaaggcagcagggaacctaaaacttcattaattattttccaccacaagattggtgtgcccccgaatgttcattggtattaggccacatgtcactgaaacaatggagtggcactaaaatgcaccctctttgggatgccaactcctcaattttaagcttttttctgttcagagggaggaatttgataagaaagaatgtctatagtacgctttactccaagggacaaatcaaacttgatttcactgtgcatcttgaacaatcaactcagaacataaggtgtagcaacaataaagaatgactacagatgtatctgttggccttaccattgtgcgagtaattgcacgccccacagtagtcagacggaagctactcaaggaaaaccggcttggatccaagggcaggtaccaaggaaccggggaatcttcagcaaggtctttatcccaaataaccttcacagaaaaaaaaattatgcccatgggaaaggaataacaaataacagaagtgttcatgaaactgtgctgctttgaaagaaaactgctgtaactggccagagtttctaaactaacaatagaggtgggctactcttccagccatgggttttcctcaggtaaacccaaacacacaatcaaacaaaagagaggtaaagcacagcgtctacattacctcaaacccagcatcttttgcagcttgaagacattgttgagtgcttcggatatctggcaggccattgccaagctcgatttcatccttgatcctcttgtgtgttgcattgttcggttcatagtgatcagtaatacaccactcatacacagcaaaacactggccaggcttcaatacacgatagatctccttatagcagccaacctttgacatgaaaaaaccaattgactttgtgtcgcaaggagggattaaagttgatgatgagttttaatatacaagcaataatttgcaatcataccggatcaggtgcgtggcatgttgcctcaatggcatagacagcatcaaaagtgttatcagaaaacggcatcttcatgaagtctgcctgtatagagaccaatatgtagaatgtaactgtttgtccttcagcttatatatattgtcaaataagtcttctctgtacagctaagcaagtgcagagagtctacgcaaggtaatttgcaatatgtgatggttgctggaaagggataaataacatttgcacagagatgcagctgcaaatagatgattgactactaaaagatgggggaaagaggcaaagagccaaaaagaatgtctattttagctaactataccttcacaaagtcgcaagttccactaactcctgctacccgattaagctcctggatattaaaacaaaaatcttatgtcaacacaggagtaatgtgatgaacagcaaacgctgaaaactgtttactaatctgaagttcttaaccatatgcagaagtagagtaaatcaaattaagtaagggaacatcaattaacctttcccctagttatctggtactcattgttgttcaatccagtgactgaagccaagctgcaggaaacagcagatcatggccacattagtcatctctagttcataatccatagtgaggggaaaaaaagagaagtttccacacttttgaggacagtattttagcagaaaatggatcatcaacactgatatttgggaaaaagaaatgccctaagtaaacaatgagctcaatgccatcttcacccaaaaaaataacatataatgaggaagtacagggttgatacttaacgacgttgtcctggcaccattatccaagatcaatttaccacacgtttaatttttaaatgtcaaatatttattatgcatattaaaatttctggcccaaacacattacaagcaagtggacagaaggcccatgaatcaaacctaaatttggcaatttctcttagtggtccgcctattccacaaccgacgtccaaaacctacagtagggaagtgaagttaacactttcattctaatgttgtagtgtagaaccagcaggaaatctttatgataggtttaaataggaaaattaaccttcattcctggtttcactccaagctgaagggcaagaaagtgctcatgtcgcttaatgctttcacgtagggattctccattccatctaaaacattcaggaacatgacaagtttctgtcactagatgtcaggtaatatgcaaaacttcaactacgttctcgtatttcattacaatgagcacagatgatctctctaaaaccctcacctgtgagcaaagtggaaggattcaccccaaccatactcatagaagctggtggcaagatcatagtatttattaacctgataaggcattaatgcattagttgctaatataaaaactgaaaaacccaaaattatctccaattagcatggggtaaatgggtgatgcagcaaacaaaaaattgtcacaaactctaaatttgaaggtttccttctttcaaacagaataaagaggggttcaattagaaatatgtgactaaaatacaattgacatatagcataaacagcagaacctagaatatgtgtactgtcttgcttcaacactcaacatgacaatttaaaaagcacaatatttgagttgtcttagatatctctttgaatcagtcgtgcttagttaaatttataatctagtcaagaagaactgaagattaacagctttttatcgtgcaaaagttgaagcaaattacagacaaacagttgaagcaaattatgcagatataatccttttaactgagcatctagaaaatgacttgagtaggaaagcaacaaatttacaaaataagatattcacaaaaatgtaataattctgtcttctgagagactaagatgatttaccatgtctgtgtagttggactttcttgcttcttcttttcctccatagtatccatggtatttctcataccttgcaaaaccaatttatttaaaataaataacagtaaaatacaggccaagttctgagcacaaaaatcctttttctgagtgtcaataaaattcttgctaagcagttgatatgttttttatacagggtaaatattgaatgtattgacaaattcttaatagaatgtgctaaaactggcatagatagagatagtttaaaagaggataagcttgttttaataattctgtaatggtgccacagtatgtactcctttccttgattaaccatagagcatagtttgaccttgcacgagaaatcaaggattaaagaggtgacaaaggtgatgaaacattagagaagatgacgtgggtgcactctcattattgattcagaaagatgagcgagcatactttgtggcagtaacaaataaaagcaaatgagaaggagtaaaagacatgggaatggtagaaaaagctcatatcttatatttattgctgggtctttggaatattaatgggaggggagtacaatacgtatggacaagttggcatggcttgaagtagcctatatagtgatggcctgatgggcgaccacaaagcatcacattcaatacacatgataaaaacctagtactattctaataagatgaaataggtgcaatgcatcaggagttttcagatgtccagaactgctaccaccaaaaaagaagaagaaaatttctgggtgcagaacgaaaagtcgagcaaacaacagtgagaaattacgaaatcagtgaatctgtgctttccttgtttaatctcagtcatacaaactgaattctgaaccctgaactctgaagagatgcattcaagtacagcacagcagacatgcaagtacagtacatcaccagaatcaaacctgcatatctaaatctaaatctaaatgccaacaaaaataaaagagagagagaaaataataatcaaccaacgcagagaaacaaagagcagaagatgctttactcatcgacagccgacttgacctcatccttggtgatcttccccccgagtccagatgcaagatccatggccccagacctcgacatcgcggcgtcgatcaccggagctccacctgcaaccaacagcagcaaagttcctcacggaaatcaggagcatccacctcctcactttcctcccaaatccgaacaaaccacacacatatatattccaaaaaaaattcaaacggtagtgcgaaagggatggatatgatttattttcttcacccttttttgcccgtccctttccccccaacctctcctcctcatcttttcacccccaaacaaagaacaaaaatactagccaatcacccaggccgcaaatgcggtgtaccaatcagccgccgatcaggccatggatggaggaggccgcacggcgagcagggccacgatcccgtgacggtagggcgctccccccccccccctcctctctctcccggggatgggtctggaactcgagatcgcgacagagccgagccgagacgatgcgtgcgataggagcaatgcatgtgcgccggcgagcggacgcgggaggaggaggacgaggaggggaggtgcttaccggacggtgagggcggcggcggcggcggtcgccggagacgagaactccggccggcgaggagggaggtggggaggatggggtggcttctctccctcgcgtgggttttatcgtggggttgcatctcggctcaatattgattatttttttctatttttattatataaaataatactccatctgtcccccatatatatatatatatatatatatatatatatatatatatatatgggggacagatggagtattattttatatatatatatatatatatataaataaataaaagaacctgatactggatgggataatccctagttaagttttttaagataatgataaaactttcagtatctaaactaactagacttgcacgctaaaatacctggatttgaacgaattattatggagtggctacttaagcccggtttcacgtattgataggagtatgaagtttgtgtgttaaattatatttgttctaaaattttggatttcatctaaataataggaaaataatgatttatttaaatgttattaatataatcgtgaatccagatctaacgatttatgaagttacgaatatcagtttcaaaaaattttggatctagagctacgtgcctatgtcgaagagggccctaatttatggtttctaattttattttcttctattatatgaaagatatatggcacatcctacttcaaatatgtcttttaacacatgttaaaaaagacaaaggctaataaaatgctctaacatcactgaaaacttttaaaagcgtgcttttatcgtagaggagatggtaataaataaagtttttgagaaaataagtccaagcatgcaaatttgtgcatcatcattcttcttcaactacgaaatacttcctctatctcataataagtttatttttagctcattttatttgttttaaaataaatttaattttagagtaaccattgcatcggagtttgtgaaagtagcgaacaattgtactccatttgaagtagataaaatcggaaatggttacattgagatttgataaattaagggtttgttaggcatagctctagctctatctctcctgaaattatagtccaatcaaacggtttcagtttcacccaaaatgcgagcggagttggttgaaatacttttacaaaatgaactagagatgtgaaactgggtttaggcagctccacctccacaactccatttcaaaccctaactcctaaagttaaatttaagatattgagccctatcaaatgagaagttaaatttataagttagaggcctaccaaatagaatgcgtgtttggtagggctccaactctcaaatttaactctatgagttggggtttagagtggagctgtctaaacctagctccacctttttagttcatttatagagcatttttgtcagcttcacttctttttgaataaagctaaaattatttggttggactctagcttcaggaaaaatggagctagagcaaaccaaatagttcatatatgttcttggcagctctttagcttacaagcttcagctatatttaaaatataaaggttggtttaaagttatttcaactttcttccgttgttttctatttttcagcatcatatcaactcaagtcgttaaaagtaaaagtataaaatcctagagccctatacaattattttcattgtttgggtcccgcatcatagcttatatagccacactaaaaatctcagcgaaggaaaaaaaaagaaagaaaagaaaaacatgcacatcgacgatgaactgtcaccgtagagcctagtagagcattatatagcttcatctaattctaataaggtgcaagatagtgtttgcgatagattaagatgaagataaagtagagctgaaaaaactagaaaattattagcgcataactaattaagtttaaatattataaatttaaaaaatagatttgttcgatatttcaaagcaacttacacatagacattatttagcaatttaaaaaacatgttaataaaaattaagttaaaatttatatgttaattcgaaaataatgtgcacggtcaagtacttagcttaaaaaaggtaaccagctagtactagcagggagaaacagtgtccagctgctgctgcggcaagagcctggaatgaggtggatcctgccaagccagcattttgaagacatcatagctaggctgtcgtgcgtccaaaaatatagcaatgttggcgaaataaaatagtcacaaaccaacaacatagcgccatagcgatatattaggcgttcaaaaatatagcttccctaccaactcattaatcccttggttctagatttaatacggatacttatatttataactaacttttttttatggtaggtaacgtacctgtcttctgaagatgattatagagatagagtgtgcttatgtacacattatgaacatctacatttatatatacttttaaaagcactttaatacactatataatagagttattttttaaccgtacgtgtagtcgaactggtgagccagcgatcgatcactattttatctagagatggtaacggggcaccaccctattcactactcgtgactcatgagcacgcatcaatcagatgaaatttttacttatcagaaattggtaaattgagttggaaaaattaatcaaacctataaataaaattcacaattaaactgcagtaaggcctgccacctttgaaacacgagaattgtttttatgcctaacggaatttaactaactaattcatctgaaaatatcgtaaaatttgcgtgaataattaaggagaccgtggcaacaaagatgtgcagctgcgtattcatttatcaaagaaggaaaaacgtaaatagctgaagttaatttggtgtaatataatataatatcaaaatataataattagtattggattgaacatataccaacactacaaatttatcataatattatagtttgaaatcgagggagtactttgttaacgacaaatggcgtataccatcagtacagtactagtactacttaattcgaccgtttgctgacaaggaattgaagcaaaaacgacatgaaatcggagagagctgactgcactaatcagattcacacatatttttcatttctatcgtatcaatccaacttgcattgattgcttttagttgaagcggtgaattcatgttttggtgtgtatgaaatcatcatgcaggtagttgggcgattttgtgaaaattacgaagatgatatacgtaccataacgcagtcggatggcagatagcgtagttcgtattcgtacagcagctctagtaaattatttgtccgattttaatagttaagggtatacaatgtctggctttcgagtttataagggtgtaattcgatcgaccgcaatagttccaagggtaaatcgtacattttcctaattataatgatggtggtatgtggtttgtccttcattagccttcatctttctctgatctcatcttcgtctctcacgtcaaattaggatcctctgattttgaagtcacaacttctttatttctgacatgtaaatccgagttttttttgccataaaaaaagtcacatgacatcaaccttagaggatcatgtgtctcttgcgccactaccgtcgtccctcttcttcctttacttaccttcacgccttctctaaaattataccgcccatcttctcattgctctttggccgaatgtgatactaacaatattctcccaataaacttggatcttcaagatcttcctagattattatagctgcatactcccttcgtataaaaaactaatctagtatatagtatcggatgtgacatatcataatactgtgaatttagatatacatatatctaaatttatagtactagtttggcttttttacgagacgaaagtagtatgtatataaagaagcagccgtatgttcctgttcaaaacgaggacaatagatatagcagaaacaatggtgacacgactacgagccacatgtgctatgagtgggtcatggatgttggcatcatggtatggtatatacttaccgcagctgtcaccagagatgataatttcctactacattcgttataatttaaaatatactaatataatattaaattagacatattataatattacgaatctaaagttcgggatagatatgatctatctaaatttataatattggaatgtgtctaatttaatattaaattactatattttaaaatggagagagtaagtagtactacggctgaggacaaatgtatcggcagatcagatcagatcgtgagtgcagagcaaagctagggtgcgacaaggaaaccaacaaaagattctgcatctgtatatctattttagaaatatataagaaaggttcgggtatttcggttagcaccataaggtatgtgtgctaacgagtctcgcttctcttttaataaatttggatatgagagatatttctctaatatccagcatatttcagaaatacatcacaaatacaatgcaatgctgtgctagctgctacagctatccagatacacaacgtacgtatgctgcatgtagcacaacctttgtcctcaggatggcaacagtaccatatgccagaaaatcagactgaattcttcggtgttgccgtcttagaacttctttgaaagctacctctgatgaacctttgtacaaataaaagttgtggcagatagggtttaaaaagcgctagtgtggtaccaaatccaatatataaggtgctaattaacatttactctctcttttcctggaactagttttttccaactactactctctcattttccacacaagtatatttccaaacggttaaacaacgatatgttcttttttaaaagaaatctataggaaagctcctttacaaaatcatattaatccattatctaagaattttataactaatttaattaattatatgttttttagataacttaaacaactttattaaccaagacagaaagcaggggatacaccccaatacatcgcagaaggatacaacttaaagcaaagcaagaagccatctctaacaaggtagaagctaaccaatctaaggaagctaacttccagatgagactaaacaacagtagagaatcagatcgacagagttctgcggcaaagccgcgacgactgaatccttgggtctccattgacatgctcaccgcttgacagactggaaggctcctacagctgtcaccacggaaacgacacaaatcggaggtttggtgctgagccgtagatcttggtgtagacgtcaccggactcagcgaattggttccacggagtctgccgttagatatgctaatggaccatttttttcgtgcgtgggaaaggagtgttcagacaagcaaacgatgctagctaatagcaatgttttctttccagaaggtagcatgggtgtccttatgggtcttattccagtatttactgttcgatggctaagtgtcctcagggatgggcagtgaaaatgcaattcctagcaaccaacaaaatatttaattagattttttttctttgtttcatgtcatttgctttttcattggaattattatttgcttgataacataccaaaaaagaaatctatctagctacccaaatgatcaaatatgcaactagcacagacatcagacctgttgatataattgtcttttagcttccctttttatatattttgttggagatctggctgcaactatcccattttctatgtccataatgttttggttctggcactgtgcgttacacgtggtatggcatatcagttcaattagaaaatgacaacagtacctctaccactgggaccgggatcctctctatcatcaaaggcagatagccaaagttttgatttgggttatttggatatattgcattataaatttgacggatttgaaatagtttgggtctatgctacagtgcttgatatcaacgggcaagtactggcaaattgtttgattacgctgccggaattggattgtttgagaggcaaccgtaacttcactaactcaaacacgtgacaactattaatttgctgatactcatagtagaaatgatttggaccttccacattttcttatctaacgaaacaaacctatttatgccatcaccataattaccattagaattcgtgggttaataatattgtttctactgacagaagagcatatgaatcaatggtttagataatctatgttgagtgttgacagtattgctggtagcagatttgcaccggtggatgatagtattgtcttgtcacaacaatttggttggcgtggtaaaaaagtttcagattcagaaataagttttgagagggtttatttttaaaactaaaaattaaatagttaaaaaggttttttaataaaaaatccaccggtagattggttgcaaaacttggctacaaaagcatagtctttgtcttgatgtggatacagtgtaaacaaacaaagggtctttcacagacagaaaaggtcaccccatgtgtgtgcttgcacgtgaatgttactctatacaccctccgtgaaaaaaaaaataacttctaacgatgaatctgaataaatgcttgtacagattcatctacagaggttagtttttcataggacgaagtgagtatactatacaagtgacccatttgggacagtcagaagggtgagagaaacaactcacatgcaagagtaggtgatgcctggctgtcacagtgtcactgggtgatccggtgaggtgtagtgcaggaaccacgtgcatggaccatcacactgatgttttttttttctctttcctgaaatacgagcagatgggggggaaaagcagactgtgtatattcaggtttttgttgtgcatgatcacaaacatttgcgtgatcgacacaacaatgggtacagaacaagataaggtccagtcagatgcacgtacctgtgcccatattgttctgcttcttccatttgaccagaaggacaggactattgcacaatcagaatgtgatgaatactcatgggtcgaaattattagtatggtgggtctaaacctccagctgcaaggaaaggttcatcaccccaacccttcttgccttctccatttgatactgacgtgcttagcacagcacacaataccaaaaaaaaaaaaaagtggcagctacaggacttccaaacttttattgagtgcagaaaaagaatatgtatacagactgttagacagactggaccagatgttgaaaccttaagcattttggagcaaacatccatggttgtcaaacttatattcaaattatgaatgtcttaaattactgagttcaaattttgcaaatcttaaattactgagttacaatcacaccatacatgtttaggtcaaatcgtacaccatgactggctgctatattggctatgttacatattcggtaaggtagtatttaccaatacagatatagcattttataaaatgctataaaaattctttagtggtggaataggttaaaacagagagtggtcaaattcgatgggatcgtataattattattcatgtctatagaataacatgctacaaactatttacatacacatactcaagcagtttcatagagcaggccgtgcaacttgataatagctgcaaaccataggtatgaattgcacgcccatcttacatcagaggcccaaatgcattgtcactggacaaaagatacaacagtataagacaatcctgatatgttactcataacctgcattaaaaactaatgcagtacaaactataagagagaagatcaaggcattacctcaatagcaatcctgacttatgattttctgagtatctgggctgacattcactgagcatgttatgagcccctggattagtaaaaatgttagcggtttaacacaaaatatatgcaaatgtataatgctacagttgtacaccaccactactaagaagttcatggtaaaacactctttgagaaaatgatgggatgacatatttttccattaagaaaagagctagctcagtcctgctgtagtgctgtagagtgtagaggattcagcatttaggttggtattctgacttatctaaccaattgagaattgaaatatgggcaatgctaagaggttattgcccattatttgacttgttatatctacactcttgcaaaacaaaaacaaaatcccgacccatccaaccatgaagattcaaaagcgaagacatctcagcacctactagtactgtatgatctatcatcaactgatacacgaaggaacaaattgtgaaggggtatgatgcactaattgtatatccaactgacagatcacagctccatctcccttcgtgtcgaacacaatactgttcaccaaacctaacaagcacaaattagatggcacacggcatcagccagaggatccggtcgctccttggccctttggcatcctagagccatccatcccatatgattcatgtttgcccacctcatctagtgcatgttggcatggtaggctagcatcagcctgccacagcactcactctcactgtgtggcactgccttagttaacaatttcagaaaaaataggaaaagctgttcatctacattagacaaagttcttaagtttaccttaattaacaaactagtgtattctttattcttgttttgagatcaacatctaatcctaattttgagtatagctgcttcaacaatacttttaagttagcagattaaccacttcatgtgatgttgaacatgaagggatacatatttgttcatgcaaaattagattccctaaacttatcaagacttgactatgcattgaaaattacacttacaataagaaagaactaaattgattggtttcttggaaaatggaggtattaatagtatggtttcttggaagatggaggtatcgatagtacctatgtgacaacaataaaacttggcccaaaaatctattttaggaattgaaaatgtgtacaagtgggtaattctcacattgtttaacaaaatatttaagtagatcaatcagaaaacaagataaataaagtatagtgaaagcattcttttatgaagcacatttttaaaacttaagttacttttgtttcagtgctaacattctgacaagttcttggccctttggtcgagttcagtctatgctgtctataccaaacattttatccacttaattcaaaatatgcagctctctgtcgtttattttctaaaaaaaataaaactaacatcatttctggcttaagtattcaaccaagggttagcgagatatttaactatttgccactcttacaagtggcgattaaggatttgccgctggaccaacatgtcataggacatgagggcccacatgtcataaactgtgagtggcaaatccttaattgccacatcttaaaagtggcaaaaagttaaatgccccgggttgaacaataaccgacaacttagtaaatgcttatgttctgcacctggaggggaaaaacctattgtgaaatgtggaactaatttgcagtattgcattttccaagcagattgaaactagggtcagtatctgcctatgctaagttatgcataaaatcctgagaagaaatttctaattatgttccttcaatgcttcaaacctgttccccttaagtatctcttcagcactgccctcatctattatgtcactcccactcctccattgcttattataccactcccactcttccattgtagggttagtctgataacaatttggtctcatgtgcttcagttaacctccactctgtatcgtccattctacaactcctcctgcccccttgctattacccctccaggggccactaactgaggctctgaaactataaaaaattctcactcaaccttgtggcaacaagtcatccagaaactcaaacatttggccattgtcctcacaattttgtcactctgtctaattcttctatagttagctttatgatattattatttcttacattttttttctcgaaaacgcaagagccatgcgtttcatttcattaagaataagaaagagtatgtacaatagggtgattcacaaggaacactctggagggaagagaaaaaaaaaggaagaaaaggtctcgccgaagcgatgtgcaacaactcccagaggagctaggttcctaagtgggaagtgaccgggtcatgagttcatggagagctcttgccccagcagtgcaccataacataatagcagtaatattttgcatgcttagtagttttttctgttcaatttatcttttgtgcttaagaaaatgtatccatgattgaaagaaaacgaaattcacttttttcctaaatgtcgttaatttgcaatttgggacaacatggttcaaggccagattcaagtagaaagccataattttctaggccttttcatctaaatctaaacttcttggttccaacaaatgctactcatataatgcagatgggcatgtcatcagcatatgcaacttatatatcattatcttagagacagcctatgaaatttgttagctcggttattgtaccactaatataagacagatattttacaatgcgctgtttgacaaatgaccacctcttatatatccttgtcttttctactaagatgctttgcattgccaccatgaaagaaaaggaggaaaaccatggccctttaacttcaccaacttcaaaatggaaatgttgacccaaaaaaaactcgaatgaaaacagagagcctcgtaacatagtagctgcaagcaaaatcctatcctatcactgatacaccaagcacaagaattctgtccatacaagtgctatagcatatcctaacaaataatggaactattccttaattaaccctaagaacatcgggagcatgtagattaaggagacaagttatcatattaatggtagcaaattttaataatttttataaactttctaaaccaatgtggaattacaggttcaagaagaatcagtttgacaaatgccctatagttacttaactatatcaactaccattcagcagccccagcccctcatatgaactgcaatttgtttaataagagaagaacagtttaactctgccgtgataaacctaataatacgatttagcctaacactctccctagctatattcaaaagccccaaacttctccaaacaatatccatcaccatgatatcaatcgatcgttggcaaatcaatgtaattcgtaaaatttatgacaagaaaatgaaaattaccttcacagggatgtcgaaacggaagaccctgacagcgccgaccacctcggtcacgatctccagcggcagggaccccgcggcgaggtccccgatgaggtcgatgacgtcatccacgaccctcccggcgtccacccacacctcggcgtcggcgtacgtcgtccctctggcaccgagctcgccggatccggggcgcgcggcggcggagccgaggaggtggccgcggtaggagacggcggcggacacggcgcggtatcggagcgggaggacgaggccggggttgcggacgcggaggcggagcgcgaggtggagatcgacggacgggagcgggggcgggttgacgcggaagcggtcgaggcggagcccctcgacgcgggcgacgggcgcggacgggtagaggaggaaggcgaggccggcgaggagcgcgaggaagaggaggagcgggagcgtgcgggcggagaacgcgcggaggcaggggacgcggcgcgggcggaggcggcggaggcggacgaggaccggggaggtgaccgggacgaacaccagcgtcggcggcggcggcggcggcggcggcggcggcggaggcgcgtatgccgccgcggggaaggcgtagtagggctgattgggcggcgggaggaggggctggccgagttgcgccgagggcttctccccgtcgccgtcgccgtacgccgccgatccgtacgacgccatcgccggagttgcggttgcgagacggtgacgagtcacaaagtggtgagatcaggaagagagagacgaggagggttgatgctcctgtcgtccaatgggagggcgccacgtgggtgacttagagtgggggagacgaagggaccaccggctacacatttgtcgacaaattttctcctaaaaatttgacaaatataattataatacaatcgttgtgtaattatactgtaacttgtatgtaattacactgtaatttgcatgtaactacagtgtaacttatatgtaagtttccgtaattttgaattgttagatctattacaagatttgttctggtgaagaagaaaaaaaatcatagcacacacatatgtaaaaggatttgttcccacgatctctattaattttaccgaaataacatgttacgaagagatttttaaaagttacatacaagttacattatagtcacagtgtaattacatgtaacttacaatgtaattacagtacgattctgttaaatttttggaggaaaatttgtcgacaaatatatagcaaaattgaagacgaaaccttagatgggccgggccgggcagacgttgacggcccatcaggcaaaaattctggctcgccgccggcgacatgcctcgtcgtcgttctgcgctccggcgatggatacggcgagagattaatgtactgttaattttttagaggaaatgtactgttaattataattatcctgctttagcaaggtatttaagctggtttgttggagcaagctactggctccaaagtggccttcagtacgtatctaacccatatatatctctcgagttaccgtgcactgctttctttttgttagtggtcagtaattttgagtggatgagtaattaattacagcaagttacttgctctaaagcagctttagccggtccaagtacacgtgtcctcagttcctcactgttgtcttctctgccatcctgtatatatacatggcagcatcagcatcactctaatcaaattatcgaactgcatttttcattataaactctaaaccttaaacctcaaaaataatggagctcatggctagagtgttcctgcttcttctcctgcctctctcctcctccgcggccaccgccgttgccgcccctccgcctcctcgatctcaagctcaaaccgccgatggtaatggtgtgttgtcgaatctctcttcttgcaataaataattaacagtctcaacttttcgcttatacttatacttacaagtgaaaatttaaatttttaatataaatttggaattgattttgatgtctttttatcatagtttatttttcagcctttgtttgtaaattgttaaatacatatatatatatatatatatatatatatatatatatatatatatatatatatatatatataaaagttttatttacaaattatttttcatttataaatatgccgaataagccaaacgatgcggctgtaaatctcatggctgtgatgtttgagaatgtaaggacaatggcattttcaggcgtgctggtgaacggcaacttcgcgatgagcccccggaagatgaacgccacggtgatcgtcgggagggactctctgccggggtgggcgctgcgcggccgcgtcgagtacgtctccggcgggccgcagcccggcgggatgtacttcgccgccgcgccgggcgcccacgcgctccgcctgggagcgcgcgcgtcggcggcgcaggcggtggcggtgcgccccggcgcggcgtacgcgctcacgttcgcggccacgcgcgcctgcgcgcgcgacggcgagcgcgaggaggcgctgcgcgtcgccgtgtcgccgtcgttctccgctcccggcgacgtccccgtgcgcacgctctacggcgccggcgccgccgacgcctgggcgtgggggttccgcgccgccgagaggaacgcccaggtcgagttcagtaaccccgccgccgccgacgaccacgacggcgacgacggcctcaactgcggcccgctcctcgccgccgtcgccttcaaggagctcccggcgccaatgccatccaaaggtaaactaacccaacgccatggcatccatggaaggtgaccttcctcttcttggatttgacgacgccattgctgactgcagacaacctgatccggaatgccgacttcgaggccgggccggcggcgatcccgaactccaccgccggcgtgctgctgccgccgaagcggaaggacgcgacgtcgccgctgccggggtggatcgtcgagtcgctccgccccgtccgcctcgtcgacgcgccgcacttcgcggtgccgcaggggcagcgcgccgtggagctcgtcgccgggcgggagggcgcggtcgcgcaggtgatccgcaccgcaccgggccgctcgtacaacctctccttcgccgtcggcgacgccagggacggctgcgagggcgccatgctggtgcacgccgtcgtcgtcgccggcggcggcggcaacgcgacggcgaaggcggcggcggcggccgtgccctacgcgtcgcgcggcggcggcggcgccaggcaggccagcctgaggttcgtggcgagcgggcggcgcgccagggtgacgttctacagctcctactaccacaccagcgccggcgacggcgtgtcgccgtgcgggccggtgctggaccaggtgaaggtgcagccattgatgacgaaagcttagcttaagctgtcgtcagctcagctcagctcgtcgtaatcttgcatgccttgtgttggctaatgttaatctgtggtttttttttgtttttattattttttaggtaaaatttgcggttttttattgatgttgtcatgaattaaaatgagtgcaaatgtgcaacgtagcaggatgtggctactggtacgtgattagcgatctcgcgtgacatttgaaagctgttttcacgtttcatgaaatttggaagctgttttcatatttcagtatgaaatagttctgtaattcgttcaaaaaatatatacgtttgctggtaaatctatttcacgtactccatagattatactgggctagttttgggccttttttttgttggggccacatggatctgaacttgtgaaggaaattaaagaaaaaaattggccatagtagaaggtttaacaaacaaacggttcatgagaaaaatccaatctttcagtaccatatgagtgccaactggcaactgccaactgcgaacggtttaaggaggcacaaaactataaattttatcaaatttatcaccatactatatatttatggagtatcttgaaactacaaatttagcaatgaagttataaaatatatagattttagagttgagtttccttagcattgttgtcccgctggagttataaatcttgtaatattatggtaaaactagcatcaaacatgtattttctaattcgataccttaaatatgtagctgcgataaacacaacaatgaatttgttgttggatgatataacgacttatacatagttttatcataatttgttcaaaatatatatagttctatgaaatttacttatcagttcagttcctgcaaagctcctctgttccaaaggagcacgaattttggaaggatttaagcaatcttgaatacaattatctgtgctatggtttatagtctgaatttgaagttattgactccagcttatatcttctttttttttatttggtgtgttctacttgttttgaactacactcttttctagagtgatactttgtaataattggttgtagctctttttaacaaataccgggatattatattccattatctaaaaaatctaaccgaagctatggaaaataattttataataagaccttttatgtttgtactcttaaggtcgaaaggtaatgatgaatgaaaagactaaagaccaacgaaaaatccctaattttaattctaaaagtttaaaaacgattgtggccaaatcatcatgctgcatgcctactagacattcatttccaaccaaatccagatgaaatccccacatttcaaatcgaggagacgccctcaatcatcgttgccgcggaaagtcgcaatcgcttttgtcgcacccaatgggagaaggattgatcaaagataggaacccagcacgaatcattgaccgacgcgattttgacacgcagaatctgtcgttgctttcatggcccctcatcgtacactaggcaatttaggaggagtagagtggagtaccaattaggcaattaggacttcacttggttaaaaataaaactagagtttattactagttgctagtaattgttagtactaatattacagttatcaatctatgcattaagaaacatatatctgtctagtatattattagatggctttaaaaaaagacaccatgttcattttgaggctaaaaattttcatattaattgaagaaaaaaagacagtaatataatttagaaacaactaaaattcggaatataaaataaagaatattgagaatagaatccatataaaacccaacacgagattaattgagattcaaattaaaaaaataaattctaaaattggatttcaatatgagtttcaaataaacttaaattatcattaaaattatctaaattatcatccattaaaaccataaaaggagtccaatgacatcttaaactataaagcagaacaccaataacgattatggctgatttttaaaattgtaatgactataaaaaggagagatggcgggcaagccgtaaaagggttgagcggtgtcggttgacaggactttaaaaacaaacaaaagaaacctaacgatgatcaggtttaaattttaaaatttcaatgacaataaaaaggaggggtagcaggcatgttgcaaaggagtagtgtgacggcgttttatagaacttctaaaaatataaaaacggaatcggtgagacaatgaactctaaaaactaataaataaggtttgatttttgaaaggtttgaacgatagccatgacatgccgataaatcaagtaaatggacggcaaaggaataagaggtggtgactggcgtcacttttactataaatttagaaattcgatgatgatatgtttgtttttcaaaaaacttaggacaatgagatgagtatttattttaaaagaaaaccatatataaaatagttttaaatgagtgctagccacgtagttacgcgggatcaacatactagttgacctaatttcgtggctcatcagcctcccggaccaactcctgagcgatagcgtccgatcattgcctttgtaagctatctcaccaagtcaccaactatcatgccagaatgtctgcgaaacatggctgaatctcacaagtgcattgtcgtcagattttctccaatcaggcagcaacttgtccgtcattgtttcgtccaaaaggttcaagcccaagctgccacgaaagggaccattggattcagaagccgtacatacaaacacatagagatgagaccagatcactcatcaacaggtccacagccaaatgggccagggatcccctcaggcattgatagtgaagaaaaaactttacagaagaggagaccactctacactatctgtggaatgatagagagaaaagagaataggtcataggtgcacaagcacaagcacaaccacctcaaccaaaagctcagcatgtaatgggagcaacaggatgcctgaatttttcaaggtttccgaccagatttgtaatgtaccaaacattctccactctgcatgttgctagcagtacagcagccactgtgctcaaatctatgatacatactgtttggctgggacttgggataccccccccccccccctaatgaaggttatgtacaccgaagaagacggcatcgttggatttatataccaggatcgatcggtcaaccgatcgccaaaaaattaccgcacggggttgttgtttacgcttctcgtttcatgagcaatcttcacagctagaggatatgctgtccctgccctgggtcctcagctgttcttggcctcttgcagcatttccaccaccttcttcatcttgggccgcttcgctggggcgcgctcggtgcacagcatcgcgaccttgagcacagcaagcatctgcttgcgccacgcgaacgacacggtgctcagcttcggatccatgatctgctccggtgtctcacccctcgcgggggcagagtgcacccacttgacaaggtccataccctccccgaactcctcatccactggcagctttgacgttaggatctccagcagcaccaccccgaagctgtacacgttgcccggcacagtcacttgcattgtgtaggcatactctgaaatggaggaattgcaacagcaacatattgttatgtttgtgaacaaaaaggaacttgtttagtggtcagttgtggagcaaaattcagatttcagacctggaggtatgtaaccgaacgaaccggcaactgcactgatgctagcagtgcccttcaaagggtccagaagcttggagatttccacttcaccaagaagcgcattgtagtgcgagtcaaggaagacgttccccgaagagatgtccaggtgaatggtggcgacatgatggaggaatgccaacccttcggcgacatcgatggcaatcgacaacagccttggccagtcaggcttctggttgtcaccgtcagggttgtcgacattgtgcagcagctgaagcaaggttccattcggcatgtgatggtgcagcagcaacgcgacgtcctcgtagatgacatacccaatgggacgaacaaggtttgggtggttgatgtgcgaaagacactcgagctcccatatcatctttgtctggtgatggataaccgcacgatcaactgacttcagcttcttgacacagactaccataccggatggcatgacggccttgtaggttatgctgaatgtcccattgctcacaacattggcatccttgaatgttgccttgacacaactctggaagtcgatagcctgctgcaagctgtcgatgaacatgtttgaggccatgacctgcggcgctgccactacaacctcccccgcctcagccatcttcgcttcagcctccttctcctgcctctcacgccacatgaacaacgccaccaccaacgacaccacagagaagatgagcacgcaggaccccacaactgccaatgccaccctgtaagatatcttcctgtggtccattccatagctggatccataaattggcccgcagtctacaaccagcgggttgccacacagcttggtgttgccggaaaagctggacgccgcgctcttctggaatggagcaaacacggggatggcgccacttagccggttgttcgacaaattgacctcaatcaagctcagcatccctctcatatcacctggtatctccccggatatctcattgctcgacaagtccagcgcgacgagcttatcaagccgcccaagctcacggggcagcggcccgacaaggtggttgaagctaagattcagggcaatctgcaagctcttgaccctgccaatttcagccggtatctcaccagtaagattgttgtttccaagttgcagctcaagaagccggccacagccgccgatgccgaccgggatgccaccggagaactcgttgtgatcgagcaaaaggaattgcaacctcgacccgttgcagacgctctccggcaagccgccgcggaacgcgttgtagctcaggtcgagcttgctgaggttccggcacctcaggatcgacctcgggaactccccggagaggccgttgctggagacgatgagctcctggaggctcctgagctcgccgagcacgtcggggacctcgccggcgaggcggttgtaggccaggttgagcagcgtgaggttggcgcatcgcgcgagctgcgcggggatcccgccggtgagctcgttgctgtcggcctcgaagtaggtgaggctggtggcgtcgccgatggacgccgggatggcgccggcgaggcggttgttgccgatgcgcacgttggagagggcggagcagcggccgatggtgtccgggatggtgccattgaggcggttcacggtgaggatgagcacctggaggttgccgaggtcgaagaggctgctcgggatggcgccctcgagggcattggagtggaggttgagcacctggagcttggaggagaggccgaggccggaggggatcgggccggagagggagttctcgtaggcggagaggatgcggagggcggggagcgcggcgagccagggcgggatggcgccggtgaggttgttgccggaaatctggagctccgtgagagccctgagcgacctgagctcgtcggggatgccgccggagagcgcgttgttggagaggttgaggaacctgagcccgacggcgccggcgagggagggcgggacgccgccggagaggtggttcatcgacaggtcgaggaactcgaggccggggagcccgcccagcgcctcgccggggacgccgccccggagcgcgttgaacgacaggtccagccgcgccagcgcccggagccccgccaccgccgagaagtcccccctcagcccgcgccgcggcaggtcgatcgccaccaccgcgccgccgccgccgcccgcgcacgtgacgccccgccacgcgcagtagtagcttcccttgccgtcctccccagccgcgccccagtccggcggcgccagcgcgcgccgcagctcccgcattgcgtccccgtccccatccgccgccacggcggcggccacggccacggaggcgccaagaacgcaggccaagaacaagaacgcggcaggcggcggcatcaccggtggtttcttggctttcttggcgctgcagccgccgtcgacgtgctcgctccggcgaccgaccaatccgccgccgccgccgccgagctcctcgcgtctccccttctctcgtgaggaggagacaggagctgtggctgcagcacagcagctgcctcctagctagctcacacacagcctcacactgtcactcactcaggtcacacacacacacacacacactctctgttcttctttcatgggagtttttagagaga

SEQ ID NO: 20155 - DNA, 3760 bp, Oryza sativa
cccgaggggcactgttttgtgggattgaggctatgtcaacacatgggattgtacactgaaactattgaagccccaacagtgtgttacgggtaggattgtgtctatatattggttcatggggcgtggtttgaggtcgggttttatggtttgttcatgcggacggtgacgataggttaacggtggtttagagctttttttatgtatattctgatttacgtactaggtataatacggctgagtgaatgcaaatggtgtaaaatggggtggttagtccgatcaatctattgagaagagactagtactttttaaaagagggtaattcatgatacggatatttcacgtttgtctcgtgaaagttatatgcttgttgtgaaatttggaatctaagtcgtggagggatttttattcaacttatctgttgtggaatgagattccctttacacatactaaagtgatagcgacaaacatgctaagctttgttggcttagtcgataaatcacatcaatgaccatcataacaaattgattcaagttaggaggctatcacttttcattccttatgtctccattgaaaaggggattctacatgaaatttaaaagaagtgactacattctaagaaaatcttgtataaaattctcgtgtcgaaatatccttaaataaatgcctccttgaaaggtcacatcaagtctcaatgttataataatattatttaagagagtatttttttgaaagaacaatttattaatttaccttatggtattaatattattcatggaaaagaaaaaaataacctcattttatcactatgaaacttgttagctacaatagtgcagctgcagtccgctgctattttcatgctttagaaactgttcttgctagctacagctgcaccacatttcaagtagcgaaaaaaacctatgagtttaaaatactactccgtaaaaaaaaaagaccaacctaatattagataatatataatctaatataataaatttagctgtaggctggctttttattgaggaaacacttaagcttgaatctttttttcaacaatcagtaggatagattatgctgagtctgaatggtcaaaaactcaaatatctgcggtagtccggtgcacatagcattttgtggacggacatagtgaatttctcggctgttgagccggtgaatctttgtgctctgttcctttccctaccttgatttgatccaaaacagtcacagccagacaattaattactccgattaaggcgtacggattgtcttaagtctactgacattaagggtgcctttgtcctcggcactgatgaaaggcttcccctggttagcatgatgctgatgtaatcatgctggttactctcttaattaaccaattctctttccattgctctctgtgattaagtgattggtagtaactacgtcctcataagccataatttgattcctctttttttttatcaacctttctggaccatttcatcagctttgcagatgaatcgattccctgggtgactaattatcccttgtgcttctaatgacagccactaaccatcatgattacaattattttttggcaagaccaattgagcaaactggttggctgaaaacatgatggcatcttttgcatgctagctctcaatacaaggagaagaaatcattctccctttctagaggttaggcctaacaataaaaaggttccttttgtgcatggaaattattagtgatgtcaatgcattttttttagataatagtgatgtcaatgcatatgaagactctagtactcaattcacaagtcattgatggtgtatgtgctctggcatgcatcatttggtcgtaatctgttcataatttgaggctacattttgaaaaaaaaaattctggaaggccaacttacaaaaatccctacatttttttaacattgattagggactaatttttttcacgtcgcctcttctttctttatttcttttagtatatatatgccttttcaacacaacccaaacgtattgtcttttgcatgtctctaactctttttcaagagaaattttaacaaatgtctctaactctttttaacacatgtttaagataatatacatggcatgagaaatatggaaaacctacttctttaattagctaatgactgattatctacatgccactgtagtcttgtagattgttccatgtagtgtgttaatgttgcacatactttgtactgtgtcccttctgttgcacaaccttagaggcagggaagcacttgaatactacttgatgctaggtttgttaaggtgcattgaatacagataggttattaattacatgccctgctccctttaattgcttttagtttgctcccattataattgtttttagttccatggagtggtagctagctggagctgcccaagtttgtcaccccttgaaacagggaatttttgtcctgtggagaccaagcaattctaaaagttaatacaaaatattatgagaagttaggccaaagaacaaaaggcttccttttgcattggattgtttttatggtattttgtcaaggtatatatacccttatgttgaccacttgtctatatcaaaacattgtctccacaagcttaaaagaattggagtgagtgttatgtaaactattgggttgacagctcgatagtccattcgtttaaaatatgaggtgttcatgcaacctatcaccttacatattacgtctcgtttggtacacttctatactatacagaaagcatttttttttacatatagctataatagatttttgcaggcggacaacgcaaccacttaccccgtatatgtacaaaataacattttgccatgcaagcaacacgaaaaatgattttcgcaagtggtgagttatgtcgtccgcctacaaaaaggatcgaaaaaaaaagaaaatctaaaagctgaaaccctagctcaaatccaccctagccacagtcgttgtcgagaccccaccgcacccaacgttactggcggcggacatgccactcccaagatcagggtctttggatccgccaccaggcagcttgccaccatcattttcatcgtcggattcatgagaagggggaggcctgcgacggtggatccgcgcctcccgctgccatcgctgctggatctgtgagggagggagagtctggcgacggcacaaccgcacctccccatgccgccgccgccgccggacccgtgagggagggggagtctagcgacggcagccacctgcccttgtagcccttgccagattcatgagggggaaagaattcggtgacggcggatccacgcctcctcgtacccccactgccagatgcatgagggaggggaaggtcggcgaccatcgatccgcccctccccctgccgccgtcgccggatccgtgagggaggggcaggccagcgacagtggatccgcgcctccccttgcagctattgccggatttgtgagggagggggaggccgacgatggtgggttcacgcccctccttgctgccttcgccatattagctcgaggccgatggccactgtcacaccctgcagttctcctctcaagcctaaaatttaatttataaatgaccctaagaaaatgccggtgcaaatcaagagaaaaccctaagaaagtaatacaaataataatcaaatctggcatgcggaatttttcttgagttctacatgtcgaaagtcactaacaggatttttagtggaattttcagagccctagaaataattttaaccaattaaaattgagcaagca

SEQ ID NO: 20156 - DNA, 1743 bp, Oryza sativa
tttcgagtgggccgccggcccattctccttcctcctctcctcccgctgggccggctgaaggccaaggcccagctaggccgcgcgggccggccgcccgcctcctctcacctgggtcgccgacaggtgggtcccacctgtcgggcccgtctcctacctcgcgcccgcgccgccgcgcccgcaacagtcaccgcgcgcacgcctccgcctcctccgggccacgtcggccacacccgcgcatgcgccgcacctcccgcgcccactcccctctctctcccgcccgcgcccgcgcccgagatggccgggattcgattttcgaatcccgcctctctctcctcccccactcccccacgttggccggcgattcccgcctccctcggccacgtccggccccctctctccctatttaagctgcgccgtcgtcccctctctctttttccccatttcgccgaactccctcgtgctccccatcgctcccgcgccgtgcacccacccgccgccacctttcccgccgctccggccaccgctagccgccgctaggctcgccgccgcaccgcgccgtcgccgccgtcgggttcgcaaggacgaactccaccccgtctgcccttcctccgccgggattcgtcgccggaattcgcatcccctcgcgctccggtgagttctacctctaccgccgcctttggccatggatgccggccgccgtggttcatctccctctctctaatctctctctcctccttccttagggcaccccgaagcccgtccgccggttgccgtcgtcctcccgtggcttgccgtcgccgttcgccgtcgtcttcctccgcgccggccaccctcggtgaggcttcctctcccctctattcccctccctctccttcctagccgccgcttagcgccgccgccttcgcgtcgcctttgcgccgtcgcctccgccgccggttgccgtcgccggcaacgcgttcgcgcgcgcgccgtcgccatcgccatggccggtcggccggccttgagccgagccgagccgggtcaccgccgcccgtccgatcaaccccgggggcgatctgggccgtcggtcccgtggaccggcggtggaccacccgcttggccccggtccacggtggactaccccccctttgagccgctgccaagtggggcccgcttgccggcgccccttttccctctctcccgagccgctgaccggtgggcccctcatgtcggcgccgcgccccctttggtgacgtcagccctgggaattattgcgcaataaatgatttaagtactttttgttatagtaataaacacagtgaatcttctaaaattcataactaatttatccgtgctccgtttaagcccattcaagtctcagtaaatcaagaaaaacgtgtaaaatccattaaaaatggttttgttctctgtttcagtagtcttatagcctgtttgcaatgtttgccttgtatgtcgctagattccggttcttccgacgctccggtgtacttcgaaatagtcgccgagtttcctccagcagcagagcaaggcaagtcatgcttgccacttgaacatgttgatcctatattgcaaatgctctattgtttttcttcaaatactgcatcgttttataatgttattatgggatgtttacctattgtcatagccatgctattgttgtaccatgtccctttgtcagcttggggttataacatgactagagattggactagggattgcttagccatgcttagttcaactagt

SEQ ID NO: 20157 - DNA, 29404 bp, Oryza sativa
  unsure (1)..(29404): unsure at all n locations
actagtgcacaatggggaaaatcctattaatgtttagactgttggttctaatggtattgttggattagtgccaccgcttgggtgttagttaattaaaataaatcacatggtgggctgtgggtgcatggttttgctagtcgcacccatggcagttaaggaccggttcgcgggatgccctggaagaacttatcgtacttaccacaagccagcgtgggcaacggctgggcttgtagtgtagctttcctctagctgacgcatccaggcaagggtgggcgtgatggagcggggcgggccctgcgacggcctctgtcgcttccggattcacctaggcacgagaggggactgcccgttgcccgctggggacgggggtgaaacctgaggtgtggtgtgcttggctagagggggttatgcgaagggtcctgtcacggtctctttccggtatgtcgtggtggcatgtcggcgcacggaaacatgtcgtggggctgtgtcttgtgggtacagttgtacacctctgatcagagtaaaactattcgaatagccaagcccgcggttatgggcggtcaaccagattcaccgtgattagtctcatcctagtgtaatcttttgaatttggatagtttaggtggatggttgggcctgttgcaacgtgggatagcgttggatagtggatagttaatattaattaattattacaactgtttaaatctttcaacttctgtttataaatgctcgctttatgcaaatgaaccactctagctctcctttgataattccctgcatcatacccctattccggtatgacttgctgagtacagtgggtagtactcagtcttgctctattttttttcccaaccccagagtacgagtatgtgtcagatggaggtttctccgaggagtaggcttcgtccgtaccgtcgaggatgcctgtggagtggtgttcccgctgcagttctagtcaaggcttagctcctgttgtctttcgcttttccgctgcatttatgtaagacttttatgatgtttgtaagacgtgggtctgaatgtcaacattgtcgtttgtgtaccccggtcggtcctggacggggattttaatgcacattctgcttggaattctattcgggaatttctgggcgtgacagccacccccgtcgtcgtccgcctaccacgcctctcctcatcattgtcgtcgtccgccggccaatcgtcgtcgttgctcactggatggcctctcccgttgggtgtgaaagtaagggggaggtgtgagagtgggaggaaaggtgaggagaataaactgagagaaaatgttaatatggagacagagagagaagggaaaattaagatgggtgaaaaaaattgcatacgggacctaggcccgtctgcgaaaattcattttcacacacggatatttattgaacaactctcaattccttttacatgcgggcttcttaggaattatttttagtctgcctgaacaaaggagatgtttttttagtggtataaaggaatatcacgagaattttgaggaaagttaactgaccaatgtgaaattctcatgtgttctaaaggatcccaccaacatatggtcaaagtgagacaatccttttgtatgaatacaacggactttggatgatacgttttgcctcttgggctcctttacagcaagggctaactataacaattaacacatcatgcacaaccacttttacagtttacccgtataataattaccaataaatatataaatatatatgtagaaccacttttacagatcccgtattatagttagcaataaatatatactaacactattagcatcttgttaaaacccatgttgtggcggattatatatatgtagcacacgcttctcttttaactctcatcttctgtttcctacaacttaacaccagtctattatggcaacgaataatatacttacattatcttattatatttcgtttgtatttaatgcatattcttttcttattcctatggagatgatttggttcctataaaataaaattcatgtgttcaaaaagcctttagaagagcggtgaaagataaccattagcttcattccatttgaagttcatcttgcatagggcttgtgatgtgggccccaatgcagccgagtagcatcattcccagttgcgctgcatggacaacttgcagaaggaaaaagtttacttgagatccctcatcttgtcctctagtttcaaattcgtccctgacccaaaatgcatagtcttgtaaaaccggatcacagtgggtcccaagacagtattaagaacagttttggctgatgtggcggctgagtcagcgtgagacccacgtaccagtggcccaatcttcttccacatctatctcccttctcttcccatctctctcctggcctccatgtggccggtgatgggcaatagtcgaacatgaaaggcgcaacgacaacttctcgcgcccgagtcctaagagcatgtcggtctggccgaatggtccggagttctggtcatcgcactcgaagatgaagccaggaacttgcttgatgccgatgtcattgtcggtgttaaacaccacagcgtattgcttcgttggtttctcgttcctgacggacaccttggaggcgcgagcgcccctccgctagggctgtcgacgagccgagctcgagcgagctcgtctgtctaggctcgagctcgatacaaactcgagctgagcctataaaatgttcgagctttctgacaggctcggctcgagctcgaccaagctcgagcttaactaccgagcttgatttttaagtaaaacaatatatatttcaaagataatctttaaaaaataattaatttctagttcatcatattagtagaagaggaaaaaaaaaataaatatataatgtcaatataaggcatacaaataacttattagatcttctaatttataaataacaacaaaaattatgtattactatgctcgttggaagctcgagctcggctcgacaaagctcgcgagcttagggaaaggatcaggctcggctcatctggagctcgagcctaggacgagccaagctcgagcagcttgcgagcctcgagcttttttgacagccctaccctccgccgactattaggcttcctccctgccaccgatgaacctaggcggcatcgaccactaggtgatgaccaacgtggaggggtcaaaggcagatgaagatggtgatgaggttggcgaggaaggccatgcagggtccttatgtagcattgttgccgatgtcaaggagccagaagctgatgaggtagacaatgatggcatcgaggcgggtagagcacagggtgatggagtcgccgaagattcgaacgaggtcagtggagaatctgacgatgagaacaatggcggcgataatgaaggggtgctgacgaccgaggctggcgaatgtgtacgggatgccaaggtcctagacatagggggtcggtagggagagttgcagcgccactcaaactgcacgccgcatgccaccgacaccgcacgtagaagcttccatatggagggcactagagatgggaagagaggagggggggaggtataataagaagattgggccactgacatgtaggtcccacgctgacttaaccgcacgttagccaaaactgttctcagtactaccttgggatctaatgtgactcggttttacaagattaggtatgcaagcattccggtccagggacggttttgaaactcgatgacaggatgagtgacctcaagtgaaccttttccacttgcagaacactagacatcacagcccaagtcttacccaccacaagcccaacacaccacactttaggctccttaggcccataaccatctacctatgagcccaaaaactacggcccaattaggcccacggcttggcccaacttctcagcgaaaaccctaaccccgtcgtctccacggccaccttatataaaaatccgccgccgccgccatcctccctcctcccctccgctctcccacccttcacgccgccgcatctccacgccccggcgatccgagcacaagcaagcatggccgagcgcggcggcggcggcgagaggggcggcgagcgcggcgggttcgggcgcgggttcggccgcggcgggcgcggcgaccgcggcaggggcgggcgcggcgggcggcgcggcccccgccaggaggaggagaagtgggtgcccgtgaccaagctggggcgcctcgtgaaggagaacaagatccacaagatcgaggagatctacctccactccctccccgtcaaggagcaccagatcgtggagcagctcgtgccgggcctcaaggacgaggtgatgaagatcacgccggtgcagaagcagacgcgcgccgggcagcgcacgcggttcaaggcgttcgtcgtcgtcggcgacggcgacggccacgtcgggctcggcgtcaagtgcgccaaggaggtcgcaacggcgatccgcggcgccatcatcctcgccaagctctccgtcgtgcccgtgaggagggggtactgggggaacaagatcgggaagccgcacaccgtgccgtgcaaggtcaccggcaagtgcggctccgtcaccgtgcgcatggtgccggcgcccagggggtccgggatcgtggcggcgcacgtgcccaagaaggtgctccagttcgccggcatcgaggacgtcttcacctcgtcgcgcggctccaccaagaccctcggcaacttcgtcaaggtatcttgaattcctccctagaaatgctcgcttatcttagaattctttctctgtaaatgaaaaatgtttgctgatagtgctagatttgaatgtaacagaaatggcttgactgattgtgatggaggacatctgtgtagaatgacttgactgattgtgattgaggacatgtgtagctagatagtctcatttccaccattttgttatgcctgtattatcgtagtagtattttgacatgtccgaccttatcacacaattcagttgtgcttagtattgttgtttgacatccgtgctgttgtgcttagtgttgctatgcatttcgattgtaataatattgactacattgtcctgtttaagtactagtatacatcctttgttaagttctgttgactaggattttaggaatctagggttttgtcatagcatcgcttccctttcggatgttctgtattgttctgtatcagtagagaaatatggtttatcattgcatagtgtgcaaacagtaaactgctttgtttactgaggatcatttggatgattgttagtagtcatgaattgttctgcggctttaaatgttgtcgctgtttctattcatgtgtacatgctgtagcttgctgaaaatagctatcatacttgcagcaatcaaacatgatatgtttccatttacatttcaagcatttcaattggtgaacccatgagactcttagatagcattctaatttcatgtacaccattacatttcaaatgtttcggtttacatgtcaagaatagtgcctcaattgatataacctgaactttttgttcttgacaggccaccttcgattgtctcatgaagacctatgggttcctgactcctgacttctggagagagaccaggtttatcaagacgccgttccaggagtacacggacctcttggctaggccaaaggggctcgtgatcgaggcacctgctgagaagatagaagcttagaaattttgcagcaaagagctgagaaagaattttgcattatggcagcaagaactgctgtcttatcctcaacctcaacttatgtcttaaaaaatccaaattttgaattagcgaaccttaatttatgtgctctggaatgtttaggtttctcttcaccgtgtttacaattctcatatccatatgaacgcgtacagcattggtgcattttgcgagttttactctctgttatgctgaattgtgttaccaatcctcattgaaggccgttagaacaaattattattctggttgtatatcattacaatctgaaaatgttgagcagcctatacgggaatatttataaagtattaatctgcatcgttgtaacttgtattataatatgtggtaaatgtgctgactaacaagaacacaatgttattttttgctttcccaaaacttggtgttggtttatatatcaaacagtatgacaataaggtccctcgctgcagtaagatgaaatttcgccccccccctcccgggcaaatgattatctcagccgttttttttggggttttctcaattttttatgattttgataaaaaaattaatcaaatttagttaattttttttaaaaatccaaaaatgtattgaaatggccgagatcgaaattgaaaacctgctggctactgccaatgggatgaacacatcatctttgctatacaattatctccctctttcagggaaccattaactttctctgccatggttttgttactgatactgcattaataatatagcacaatatcattccatcttttatattgtactaacacattgaaactgcacaggctatattcaccagggataacatgctgtatacgcttgctttcgctgctttgtgcgccatcttcagtatcctaaaggagattcttcagtatcctaaaggagattgttgagcaatggaatgctatggtattcattttcagcgttctttcaggagtttagctcatgggctcaggaattatggataacacatcaacaatcacaaggaacaacagtttctcctctgttcctgctaggttatctgcgaggatagggtacggtctctttgagatactctctccgttttatataatataagtcgtttgactttttttcctagccaaaccttattaagtttgactaagtttctagaaaaattagtaatatctataatattaaaaaaaagataatggaataacattttggcctttgctcaatgagctacagccaattattacaaagtccacacataaataaattcagcacacactaatatgatataaataaaacaaaaactaaagacaccaacacaagataaaagagccctgaattattgaattatattcgagaatctccatccaaagttggcaaaacggtgcataatcatccactcaagtttacggcatgcattatttagagagaaagggaagaggagatgggggaagaagaagtggctactgacgtgtggctctaatttttatttttagttttatttgctgactagacttccacatcattgacacgtagatgaaaaccagctgaaaaaccacttaagggtgtaaagtgaacggtattgaaagttggagggggtgaaatatctggttttagagttttgggtgtattttagacaagacaaagagttggagggtgtaaaatggacttatcccttatttattagcttgatatcatcatcaagcctttgtagttgagcccaaccccgaagcaaatattttaccctgaaaagtacttacaaataaaattttgattgtgttttatcaaaaaccatatcatttctactaagccaaagagcctaacataccgtggaagctcttccaagaataagtttcttaacttttttattaacatgcaccagccaattcccaaacatatgagaaacactatgtggtgggtatagtccaaatgagaattgaattgatctccaaagaaatctagaaaaaatgacaatccaggaaaagatggtaaattgtttcatttttcataaaaaacaacatctcaaactaccattgcaattcttcttagggcatctctagtcctaagttcggcgagaaccatccatgtaagcgaagtttattttggttcgggtgctacaacgcagcatcgatttaccaggtccccctagaatcagccataacctttcctccctcacacaaacaacctttcctccctcacacaaacaaatgaagaaatatttttctaaacggctaaatcgactgcttggctgaggttgatttcctctctgacaaataacagctgcatctcacagtgtgttaggttcgatgtttttccctcacgcgttgattcaacccaacgctacagatgctcttagccaaattatcttttgttagcacaattcctttaaagagataccacataaaaatattaacctaaggggcatcttaagcttccaaatgatcttattccactctctatatccattattaattaaggctaaatacattgatctaacagaaaaatgaccattttgatgaaacttccatctaaatatatcatcatcctctgttaaattaatatgcacaattgaagcacacaaattgtgacagttgaccaaattatgaccaactaaagctctctagaaggaaacattaagcggaacaaaacccataacacttgcaattgaagaacttttccttctaactatagaagacaacgacgactatttgtcatttaaagaaaaatttcctaaccacttatcctcttagaatctgatttgctcaccattattaattatccaagaacccatacttattaaggaactcttaaccttcatcaggccagacaataatgggaatccccttgtttttctttcgacctgggttattgatttactcctaagatatttccacttcaataagtcttaccacacacattgttcatttatttatttaaacaaccatttgctcaataaacaccggttttggatttctaaattatgaacaccaactccaccctaatattttggctgacatataatgtcctatcttgttagtctaaatttccttttgtgtttatcaccttgccaaaagaagcgggatctataaaatcatttttttgaagaacccctttaggaatctcaaaaaaagatatcataaacagaactaaacttgataacacataattaatcaaaaccaaactccctccaacagacatatgtttacctttccaactaatgagttttttttcttaattctttgctcaattgttaaccaatcattattactaagctttctataatacatagggataccaagatatctaacaggaaactattatattttagatcaaaaaatatttgaatattgctcataacattgttttgcttgaccaaagcaaaataattcactcttgtgaaaatttatctttaggccagataattttttcaaaagcagttaataacaacttcatatgcttcactttctctaaatcatggtcaagaaaaatagtagtatcatcagcatattgtaaaatagataaaccatcgtccaccaaatgtgggacaactcctgaaatctaaccatcagcttttgctctcttaattaatatagctagcatatcaacaactatattaaaaagaattggagataacaggtccccttgccttaaaaccttataagtttgaaaatttgcccccacttgaatgaaagaagcaatccaattacaccatttttgcaaaaaaaaaccctttattctcaaagttttttttaacaaaagaccacttcactttatcatagggttcctcaaaatcaatcttaaaaattacaccattcatttttattttcgatttaattcatgaattgtttcatggaggataacaaccccttccataatgtttctcccaggtataaatgttgtttgtgtaggactaataactttctgagctactccagaaattctatttgtagcaactttagtaaaaattttaaaactgaccttaagtaagcaaatatgcctatatttttgaatcttaatagcctccttgcacttaggcaataaaataatagtaccaaagttgagcgaataaagatttagacttctgctatgaaaatccttaaataaatctaccaaatcagatttgataacattccaaaacacttgataaaactcataagaaaatccatctagactcggagctttattatgttccatttgaaaaattgcatctttaatttcattttccataaattcatctactaaagcattattttctaattgagacacttgggggatatcacttatctggctttcatccaaagttaaagagaagcttctagagaaataaaaaggactttataataagtggtaatatgcacctttaaattcgcatcaccacttataacccggtcaccatcctgttattgaattttttttgttttcctatgcttcccatttgcaaccaaatgaaaatatttggtatttgagtcaccttccaaaatatctttagtcttagctcgctgataccatttaatttcctctcttctaagcaaacaagctaatctattctaaaaaaagtctagtatgaatctcatcctaactcaaccgagttaattcagctttttttttaaatctaacaaatctaatatttccggcaagaccttcttttcttttttgtaagtgccactattttgtttggccaatcctcttaataattgtcgtaatctacgaatttttgcctgctaacactctataggagtatttccatcaataatatttgaccagatttccttaaccatatctacaaaaccatctcttaatagccaacgcaactcaaatttaaagttttgatgactgttacaaacagaagatgattttgtatttaggagtaaaggagcatgatccgagatgtctctatgagatgtctctattaagagcaaatatcgaggacagtgaaaatttttgttcccactccgttgacattagcactctatctactttttcataagttaacactggtaaattatttgtccagatataattttgactaaaaccatcaataatagtattaaaaagaaaaggccatatattatcaaaattatcattatttttttccgtaggtctatgtaatagattaaagtcaccaccaataataattggtaaggtttcatgactagacatatgaactaattcgtttcattaaatctaacattttatattttgacaatatatttgttttgtgttaaaaatactaatatgttgtcaagtttaaagaagtttaacttggaaaaaagtcaaacgacttataatattaaatagatggagtatcatcaatctcctggtttgctggaaagtatggatatgtcacgggaataggggccgtggctgttctctgatctgtatgtggaacaggtggaatgtttctattttgcccatctgaagctgttacagtattacaaagtcaatatacaaatcagaacaaaaatgtatggagactaagaganagtgtatataattttatgtttacctcaaatacatattgtcatatgctactgtttatgtgagtatggagaacaagagaaagtgtatataattttttgcttacctcaaatacatgttgttctactatttctgtgacgctgtgaacatcttgttgctgaacgcttggtagagtgttttcatttttagtgctggatgtgtgtggattgtagttaagtgaatgcttgcttttaactaatctgaatgtcaactgagaaaattttgataattttttattatgatcttttttggcaagagatgactattggtttgctgtgttcgctgatggtattgtttttgtcagggttaaaagataatgcataccctctatcctatgagtcttgagatatatgaatacaatatgtcttatcttatgatatacggaaaggattcgtgtgagttaaggaaatcagtcaattcgtatgggaaatatccttcacaagtagggccatatcaatatcctactatcctactcagagggagagaagactataatgtatcgtgcggggtccgatgtctccgagttctacctggaaatcaaggtgatctaggtataaatacataccccctaaggggtatagggcattgaatcctgagcgcaagacacccgcaaccacataagtaatccggaggacttgaagtctattcgccaatagatcttgtcgagtccctctcgacaaggatctcgtcagtaatctcggagtttagttattctcttttgtactctgtggtttcctctataatcccatataaactggattagagctattaccttacgaggggcttgaactagttaatccttgtctttttgtgtgcttgatgtcgtatcgcgtagatcctcataccaacgtacccaaatatccttagaatatagtctacgggtctcccccgtcgacagttttcaggtaactccatgctcaatggtcactctatgctctggtacaaatataatattattgcctatatatacatattgataacatagtactcaccctattgaatgtgaactagcaaaaccaagcgttgactacgaccaagttgtatcttttgcgatactcttgattcgcatcatcaaatgcgctgtatgtcatcacaaaaataactagccattggataacccacaccactagaaagaacaatgtctggatcaaggagaggtcgtcgtggattaccaggcaaacataggtgatcaccatggcaacagtaaatatgctaaacaagacctgcaaaaaaaccaatcgtttagcatgagcatgtggtgttagttacccccttcgtcccaaaatataagaacctaggatcagataagagatttactagtactacgaatctggacaggctgtctgacgactcctagacaccaccttgagaaaagaggctagactaacaccgagccgactgttgctatgcgggatcgatcacattgattgtctttcttagacacggtaaaaggaaaaggagagtggaattagttcgtatgtactcacatcttttagggttctacaagggcgagtagtcgtgaagccttgatgatctgcatctaatttgctagtagtagggtcatccagatcatacggggtctcctcaaccgtcacggtcattccaagaggcatcggagcgtcggcggccattgcgatcagatcttgcatttcaagtattgtcagcacctatcaaagacaaattcttttaccacgagtttgacagcctagctctaatgcagacagtatcagctcataaaatctgattgcgagatacataagaggatcaattttggaattatcaagattagaaagaagataattttgaagcatgagttctcatagtccaaaattgggtggcatatgttagcgccaaaatttggtaagccccgaggtcatcatttgcttagaaaccatatcagcttcagagtcctggaattgaccgatgggaattgtcactcactagcagtcggattcttggttttggttaaggaaattaatcaattaaaggaagtttatttagaagagattgagtttaaggaggatacgacataacaatttatctattaattaagcagagttagttagttcccttttgtttttggaaagtgtgtttagtatccgatcaggacttgtgcttttccttttatctttagaaaagtttgagttgtgtccaataagggcttgtatttacccatgcgtataaatatatacacccggagtcattgtaatctatctctcgatcaatacaactttggcacatcgataccctttttattttcgtctttctcaacaagttcctgttttgagttaggctacatcggcttcgatctctgatgaggggtaaggcttattgtggctgtttgtatcggtgaggctagggcttcgacaccctaatcttgtcgatgtaaacatatatttatcatatatcttagttaatctaagtcgatgtctcaatttacctatatcggctagatcttttctagggttttttttatcagttaaattgtttcttagatctagattagctaaggtatccaccaccctgaaaatcagtaaaaggcttgattgtttagactttatgcttctttttcatactagcaaaatgcccatgcgttgcactgggtgaagacaaaaataaatagtaatgggtgtgtgggagcataatgccactaggttaattgagatccttatagttaaattgaatcttttcggtgcaagtaagacgctaacatgacataattatttgttgttctaaatccatttacatggattataagaaagctattaataccactttaaaatgaaattatgtattatacatactaaagtttgaaacccaaaaagtatttatttttttcatgtattattatgagtcggttgcaatgcatggttatatttttatacttgatattgataaaacacttttttttacatactgcaaagagtagcaatagtaaaagaaatgtttctcgctagctatcagatcaacctcactgcactctaattgcataattgctttcactcaaaaaatcaaaagaaatcgtgatgaatggaaagaaaaaaaaggtggtgtatcacataatagctctcactctaaaaaaacagaacaaaaacataccatgaatggaaaaaaaattgatgaggacgagggaaaaaatctggatgtaaatacgattcattttgttggtgactatatatttttttaaaaaagaaagacgcgtgattgttttctattttctaaaattaatttattttgtcggtaaataattcattttgttggtggttacattttttttaaaaaagaaagacatgtgattgtttttttacttttccaaaataatgaaattgttcccttttttatctaattcctggtagacatgggcccaaaatttatttagtgttaatagtcttaggcaagaatcctatttaggtggtattactcgtgctacagtgctcagttgctatagtatcacgcagaactgtgctgtgttgggctgctgcttctctgctacgtgggctgaactgtgctgtgctgggctgctgcttctctgctatgtgggctggttgctgggttgcgtttgctttttgttgggccagcctgctgccgtcttggctgggctgctcgctaggtttctcttttttttttcgtttctcttttatttgagaagcgtcagataggggtgggtggaaaaagaccgaacaacaaaactgagaccgagaaatttagtcatcaattcggtcctaggtagtgaaataccgaattttattcggtcaattcggttagtctcctcgggtaaccgaatagaccaaaaagatcgacttaccaaaaaatatctaaatgcaacctacaatccactatgtttaatagaattaaactctaattttcacatccctacttcttctaggcatgcaacctaataagagtctttacttataagtgcttacaaattttttttttgtgatttttatgttgaaaatttccattatttctttgcatatatgaaaatattgttgaatttcggtcaggaccgagaccgagaccaaaaagaccgagaccgaatttgtcagtcctgacatttttgcactgaaattcggtcttcacttttcaaagaccgaaaagaccgaaagaccgaagaccgagaccgaaattttcggttagaccgaatggccgcccctagcgtctgagatcgccgtaatgcatccagattcatggattagcggcgaaataatcacgtgggcccaccctttaatgatggacgaaaaaaatcaactggaagccttacttattttttaattaggtataggtatagatttagtgccgcatcaattggatttgattgccgataaaggtttcatcggggtttcagctgatgagttatctggacgttgcatcggctaacaaggattacatacaaattggttttagccgattgcattaaaggtttcactaattatctaatcttgtggatttaatgacatcggatcacaaaccgatgtatgcttaacctttggaacaagcaattattctatacgtattgatcaattggtttctacttaattatattattgttttattacattatcatcagccgattgttttatatcattatttactcaagtgtagaaatctacattgaacatatagccgattgctcaaaaccctattgacattggtcagtattggcatcggctagtataattatatcggtatgtcagttgcaggatcaaactgactgtcacacccgcatctcatcaatattttggacctgcactggagctaagcagatcttctatgccgttgtgttcatcgccttacataggtagtataatttgaacccgaagtaaagtaaggactcgatctaatcaatcctgaaggatgaatcataatattttttgaagctctatttctaatcataatgatatgaatcgaagaataaacaattcacaactattcgtaattacaactattttactcatgtgcacctctacatcacttttttttaagataataatagacctgtacataatgtggttctcctttcattctatacatacacctgtacataatctattcgagttcagatcatcctcctgttttattaactaggaaggtagcccgcgcattcgcgcgagcatgtaccgtatgtaggatgaatttgagaaacttatagggacagtataccagcgaaataatatctgcaatgtttcaaaattgtgattgtttttcatgagtctcttcattagcattacaaaatgaatttaattgttatttataaaattacctattgaagattggggttggtaacttatggtacctaagacatgactcttgaagtttcatatggaaagagaaaaaacttaggcctgtttggatcatttagtcctcagattaaaaagtttgtcccatactgtttggatcagggactaaaaaagactaaaggcatgtggactgagggagaaagaagaaagaggctgtcactttagcccctatataatccaatatgcacttttagtcaccttgtttggattcttaggaactaaaatggagggactaatgcattagccccattaaccaaatatggcctaagttataaaagacattacatatactaccatatataattaatggttctactgatttatatagaaaaaatatataataactttattatttgatggcagacatcgattggtcatagctatggataattcctcatagaaaattatgaatatgtgtacagtatagggatacaaattagaaaaaaaatagtagaagttatgagaaaaaaaacaaaatatatgactctcaatttttacttaattcggtagtccatcatttctaaccattggatatttagatgacctaacatattgtgtacagtccaactaactaaattattcgtcttacctcagttatggatgttggacatgatttacatatataaaattttaagtataataaaaaatacacactactctgccaatgtagcgaacgatgtgtgcgacaggttcgccacggctggcttcaacacgaacatgatcacgtacctgatgcagcagctgcacctgccgctggtgcacggtagattccttcgccggccgtctctggaccatcgccgccgctggcgttttttcccagctcggcatgctcggcctcgtcgggtccgcgctcgtccctgccctctgccccgcgccgtgctgcgctgccgccaccgcctcgtgacgacaatctatttagagtatgtatgtatacgtacgtacgcacgtatgagagggtgggcctatgggagaagaggtgggttgtgggatttttttctaaagataaatataatagttgaaaatagtaggtctagcgatttattattattatagaaatattgggtccaccggtttattagaacgccatgtggcggcttagaagcgtttgtaggagtctcacgtggcggcttgagagcgtttgtaggaagtttaatggacttttagtatataatagatagatagatagattactgaaagcacagggctatccctgatttcttccattttgcgtttccgcaagtgctcttggcatcactaccacctcccttgatagtgagcttgacgtccttcaaggttattccttgacaaggtacatttctgctacagtccagtttgatagcctccttggaagcacttgtgcccctgatgttcttgaagaccacattgctaacttgcaccgcagatgtctgatacaaaaccactaaattataagcatgcacattatttacacacatggataactgaataacagaaaagctatcactgagatttgtacctgttccttgcagggtgtagcagaatcacagtagttctggtcgataatgattgggttccaaacattttccatgatcatgttctggaacacgatgttcttcgcgtagccccaaccgccctgccatgtcttgatgcgagctccgttggttgtgccatatagcctgacggtgtcgacggtgacattgttgacatgagcttcagagttgtgatcgcctaagctcccgatgctgatgccgtgtcccggtccacacaccatgttcttgacatgtaagttctcagttccatcctcaatcgacatgcagtcatccccggtcttgattatgcagcctgtcacttgtacatttttacttcttgtgatatggatgccgtcggtgtttgggctagtgcctggtgctgtgattgtcaggctagagatcctaacatcagtgcaatcctcaactgacatgtggatttgttggctgtttagtagcttcaagttctccactttcagatttgaacaggagtagaatgtcaaggcctgtcagatgaaaaagaagtcagactttgtttgagcaaaatagccaaagttttatgaattgtgatgtgctagaagattaggatttgggaagaaaactcaccgttggagcttcagtgcatggctgaaaagaagagaagaataatatccacattagagatatttccaaaataaaaatgaaaaagagtgtaatgattcataactaaataacttcagagcacttacaagttttgcattcgttttgcaggaattttgccaccaaatcttgccgttttcatcgacagtcccaccaccagcgacagtaaggccactcacaccattgaacataatccagtgcctaatagtttccttgctccaatctgacctctttggaggagccaccaacgtaccctctatctgaaaatgttcaggaacttaacatttttgagtaattgaatttcatatgaaagtaaatgcaagtgcacgagtgcatatttcttaccatgaacgtgatgcttgatttgcatggaccagatagtgtaatgtgcttggtgaggtatctcttgccctttgggatgagaacaatggaaggttgcgaagaggagcaagctgcagcccatgcctttgccaatgcctgcaacaacggtattagttaagttttgctatttgtcagtcgcctgaaaataaaacaaagacattatacggtgtcacattttaccttcgtgtcatcatgttgtccatctccgtaagcgccatgtttgcgcacatcgaacaccaccttctttgactcaagagacctgcctctgagactatcatctccactagttaaatggaatgatgcattcatgttgaccttggcatgaacactacacaagaagaacgacatgacgacgacatatgcagagaaaatgagcacattgcaagccatctttccaactgttaacatatgtcaacacagtttcggacgatgaacagtgcagaaattctagtgttgttgtgagttctggactttgtagaatgtgttgatggatgtggcgattgatggagaccaaggattcgatcagggggtctatttattcgcgccgaaaccggttggaaatctttggatgttctcaactcaaggttgcttgttgttgatcagctagataggttgggttcagatatttggatcctagtatcacaagattctgtcggcatgggaactgagataaatgtgcctgagtccctgactctttgttgcttcactacctagtctacttgtatggctaaattacttccagagaaactaatcctgctattgaaagaagttcagcactaaaagaaaaatcaaggagacctggatcacagttgagtacagacaatcatctaaaatcctatgcatttcatcagtgctgcactcttgagacccactctgaattaactttgacagatttacgagccacaggtctccttgtgtcattaaagtgtatgtattattgtaagcttaatcaattctaatgacaactcatcagtcatcaacgagaaagaaggcatgtgtgtgtgaattccaatgtggtattctctacagatgcagcctatgatgcacggatacgcgatactggtacggcgatacagatacgttgatacggcgatacgggattttaaaaaaaaacatcaatacgtcgatacggcgagtatatataaaaatatttttaaaaataaaatataggaaactacaaaagggtaaagcaataagattatcttaaaaaatattttatgtattgttgcctgttacaaaaaatatagtaaatatagccttgtattacaaatagagcaagtatattaaagttataaatatatcagaagtatagcattgggtctttaatgggctattacactgctaggtatcggagaagtatctgataagtatcgtgtgagtatcggtatttattttttctttttttttcgttgtttaatgaccgatactcctctgatactgtatcgacatagtatcggacgtatcgccgtatcggatacgtatcagataccggtacggcaagaaagtgaagtatcggtgcaacattcgcagcattataatgtttcacataggtttctgaatcttgtgaagttaaaaattcaggtgtaaagctagctcttagctgagaaaggaaaagtacgggctccaaggaagcctatgaagaggaaaccaatgcagatttcaggtgatttctcatagatatctcaatgaaagtatggacaattcatggagtaagcagatgaacaacctctgctgtttgtggcttacaagcatggtgaagaggtgcagaaaattctagagagcagcctctgttgtgggcttgtggcttccaagcacatatttcagtgctttaaaaaattaacaggtgctacatgattttatcagtcaaaacatttgtggttttgaaagtatgcaatgttgcttagcccagtttgtactgtcaattaatacgcaaatttgcctgacaactctgaaaatatccaaaaaaaaaaggaagaatgagggatgattctgaaactgttttggtctcaaaattgtatgcttattatgccaaccaatttcagaaagtaaagtcttgaaccagctgtaagcaatttatttttttttgcgcaccaccttttttttttcttttggcactcaacagccgagacgagctaatgtcaaacattttctgtaagattcttcatctgtttttttttaattttctaaaatatcgttgagaaaaagagagcataaaaccgtggctgaacttgaagtatttgctaaactctgaaaatagagggttcctatttacctagcatggtgtttgtgcatatgggtatttcacgtaatcgcaaacaaaatttgcaactaacttggacaatatgatatatttttcagatattaataaatttaatgctaataaaaataatcaaagcttgaatttgaatatgaatagttcccgataaaattatttgaaaagttacctcgatcaactgagctacaattggtatacccatgccacacgaatgaagaaaaaacaatttataggaaatagttttatatatgcattattagctgttcaacagccaagactaaaaacaaattaaaataacaaatcataaaattaattaattgagttctgcattcatattttcggaagggacattcagatccccttggttgccctaataagcaaaagccaaaactaaaatttgaattttcaaactaaattttgaggttgattttaaaattttttcaacatgattctttttcagtattaacttttaaatcactaagacatatataaaattttacttataaactaatactcctatttattttctaatataccattttaacttattagtagagaatatggacaacccagagggcctcaaattttgactcgctggtaagacggcaaagcacagtagcacacaatgcgaagaccaacggaacgaatccaacctccaacgtccctgagcaccccagccgtcggatgcgtcagatccggccgtccatttggctcccctcgtaaaacgcgctcccacccggcaacccaacgacatccgggcccacccaccagtctcctctccgtttgggaacacgggattcccagtcccggccccaccccccctactcccattcccattcccgtcggatcccattcccacgggggagattactcctcgggcttgggattccgcctcctctctctctctctctctctctctcctcctcgcgacttgtcggcggcgacggcgacggcgacctcggcggcgcacggcctcgctccctccaccgccgcctccttccttcgccgccgcaccgcgcgtccccgctccatctccggtatgcggtgccctcccccctacctgcgctccttctcctgattcctcctaattcctcctctcccctccctcacactgctctctctcactcggctagggttttctcttctagatctccgcgggcggagctcccgggcgcggaggaggctgcgccgcgcgcgcggggaaggcgcacgaggtagggggtttctccttcctccatcttctcactgtggagtgtggattttctggcttgcttgcttgggcgcgcgtgcgtgcgtgcgtgccactggttgcttcgttgggggggggggggtttgcttgccgtgtcctcctggatgattgggcgcggtctttctgactgatttctccttcgcgtggatccgtgatttgttctgtgtcgcatggggggagtgaatcccaaagtcgagcgccactgcttgaagtttttgaaatgcaaacaggaagagcgaaggggtttttcgaaatcatgttcctggtaaaaaattgggggggtttttgaagtcatgttcccggtaaaaatttgggggttttggttctgtgggtaaatcgaaaaaaacaggataagagtgctagtactaaatctgaagtgtgcgtatgagctccatacacataactattgtgtccaaataagctccgtgccttcaccatatgatgcaacatattatgaagctttgttgcgttcatttaatctgtgtttttggggatctatttgaggtacattgatgtactaaactcttctgtaatttggtgatatcaaggttttgtcttcacatgactagatatggctcggcatctgattatgtgctttcttatgcaattgttgtcaactgttatcatctgaaatttgaaatttccaatgttagggcagtctagagttaagtttgaactgcattctttgcattccctgtgaacttattcctcacattcacttattttagctttgcagtgctattttcattctgaaggaaattgcacggttaatctgaatagattggtcagtggttgtctgcattctacatatgatccagatggtttggagatattcagtgtaatcaacaatgcagacacggaaaaagggtgctacgaaaaatgcacttggggatcctgccagtactaaaactagtaggcaacccagaagagcagctcaggcggcagcttctgaaaagaaagtgaatgatcttattacttcttctgccaagaagaagaagtctggtaaagttctatttttcaagtgtacatgatgtgtatgttaatgcaaaatcaatttcttctaaaccaaattattggtacaggcatgcttaatggttgtttgactttcatttattcaaataaactgacaaaacttactcatatgatgtataggataatttatagatgcttttctttaactactaagatgtattttcatggttcgaaacttgcaataacatattgtgaaatgatacatgcttctagaataaacaaatacattttgtccttgtttaagttgttgactattaatctattcctacacgtaaattgtttgtttaatttactatattggtgtagtgcccatgtgctggaacagttttgaaataaatttatgtcattttctaatcttgaaattccaaaacaaatatttaaatataaacgaaacaaaatctaccagccagctattgacatatatacatgtaaacatgatatatttttctgtaaaaaatatcctgcaaataatgcacacatgtctacatggatccatccacagaagataagcataaagcacaagatcactgtcaccaactctttcttttaaggagtagattttcaatttgagcttaattcttccacctcttatcgcgaaaagaaccaaacaacattctttatgtgcataaccgtttcttatttactatttaatgctgtatatctggtgaagttatgatactgattaggatgtagcaatggctgtatttggttctttgcattttaaaacatttgcttgccatgcagttggagccccttcaaagaaaaaccgagcttctaaaggtggaaggaagttgatatccgcatgtgatgcagctaattctgaaaatgaagtttctcaggtggtctctggtataccacacgatcagaaggtaaaatattttgactgaagtgaacttttttggctacttttctttttgaccactgtagagtaaatttcgtccaaaaagaatagagaaagggggaacagtacattaactacttaatgcctgttccggcacatgattattacacttttattattgagctaccaaattaacatctgaaaaatattgtactcttttggtttggttgttttagatcatctataatgtttagcctttttgtaacacctgataatcgtgcattggcatgtacggtgttgcttcactacaaagttttcacaacaaaatttggaacttatttttcctttattatttatattggtataattgctatgcgtacgtaactacttatgcatttatttttactacttgggcagcagtcagatgacaatgttgatgggaggccatgcaattccatattttcccctgcatatcaccttcagaaagaatgtggtgcgagtaacttcgccaaaggtatatataattgccatattttgaattcatcttttgatgccgtcattgttaagttttggactaggacgctttaaacatctgtgaaccataacatcgtataagtttcagggtataaagatttttctaactgctatcaacattcagcaatacatccttgcaaaaaaaaaaaacccaacaaaatgatcctgccctgatacatgctgcagtcaaattcttgaacgaaaaacttttactagttttgtgagtggaaaatatatcataacttttacactattgtgttgtcttgtttgcctgagaatgaaatggaatattcactcctgcattgtcttaggtgatgtccatgagaaattatgacttttaggggttattatataaatattatgagctccagcattagcactaggaattctgtactctgacagatttcaatgcaagttttgaatttaatttgctcacaggtggatatttcaatttaacgagatggtttatctgtcaacaaagggttcctttctgattatcaaaattagtttgttgtcatctattgttggaacctgtgccctagtaatagtacatgtctcatcgtgcatgctgtttctatgtgacttcattgtggctgtggtgctcattttgctctccataccatgttgctccagtagttgattcttgaagcgttaatcatgcaggcttagaacataaaggtgatacattgggttcggttagctcagtagaagaaaggacaacacatgctcaaggtagaaaagaagttaccaccagcagatctgaatccactagccatgcagttaagacttgtgttgggagcgatcaccatacactaaatgcacaatcagctttctgtaacacaccgcttgaagaggatgaattcagtgaactcggaaacctttcttcagaagtgtcagcaatatatcttgccatgcagcagtccaagttggagtgcattgatgaacatagtcaagattcaatctcaacagaaggttatgttgatcctgaggacactgaggaatatgatgattttgatccatatgcttttatcaaggatttgcctgatttatcactagtggtccccaagtttcgccctgtcctactccccaagcaaactcggagttgtcctacaactaccctggtacttgatctggatggtaatatatacttcctgtctgagcacttgtgttcactactacactaaggagccttctgttccatttctgtgattaactccaactactttcaagcaggagtctatttatgtaataatagttattagtgaatggatgaagttagctacatctgtttactgttattttaacttcatcattgtctcctgcatctatgaattggtgttaatggtacaaatttgaattcaaataactctagtactctacctaaaggctggaaactggtaaacaggagccactgatggactttcaaatgcatcatgattttattattaccaatttaccataccttcattggcatgaaatattaatagtcaacatacatttgatgttggtgtttgatttttgcctgctgcgtggcagtaatccttggacatagcagttggtaccgcccccacaaacaaaccttgatttagctttatcctagttttatcctattcttttttgttcatttttgtttgatctatgtgtgctcttttataaccagctagacatattttcgaaattgtcttttcctttctcctttgatgttcattttgtgtcactccaaacaatgcagaaacacttgtgcattcaactcttgaaccatgcgaggatgctgacttcgcatttccagtttattttaacttcagagaacacacaatatatgtccgatgccgtccctatctcaaagagttcttggagagggttgccaatttgtttgagacaatcattttcactgcaagtcaaagcatttatgcagaacagcttctcaatgttcttgatcctaaaagaaagttgttccgtcatcgtgtttaccgtgattcctgtgtttatgtggagggaaactacttaaaggatctaacagttcttggacgtgacttaactcgtataatgattgttgacaactctccacaggtatgcacttagctatctcaatttttgtgcgacaacatctgttcaatacttcaatctatgctaactttatcctggttttagtggtttgtattcacattgaaatgcctatttgtttcttggtggatataaattgtgttatagtggtggacgactacaaagataggtgtgcatcagttaccaggggttgtgaacttgtgattgaagctgtcaactttgctaggtgtctccagtaacttgctaattgttgtgacatatagtttccttactactttcagggtctcttaaagattatccgaaagttcactacctccagcaaaaaaaaaaatgttcttgtttacttttcaacctcaagagttaaccttggctacaatttaatatcatatattttgctcacggcattttcataatgaaactaacattttttagacaataaattggtcgaaattggtactatatttttgcaactagagttagttttgtagtaatataaattacaaagcaaaatcttgctattggctttcactggtagttcaaactctaattaagtaattatatttagcagtagcaggtaccttttagttctgaaattatgcattttattcagttccatatttgtagatccccatcaactattattgttatggttatggggacatgaataatgtactgatgtcctgcttacaggcttttggattccagttagacaatggcattcctattgaaagctggtttgatgatcccaatgatcaggagctgttgaaactgctcccattcttggaaagcctggttggcgttgaggatgttcgaccatatatagccaggaagttcaacctccgtgagaaggtagcaaccgcatcgtctctttcaatggacctgcaaatgtgatccacttttgctttggaatatgtctctgtgtaggtggtaatttcgataaatgcagaagggctggtatggtgattctgtagagtttaggctgtagtgtatcaggatcccccctgtactgcaaatcttgtatgtctttagaaccgccatgtacaatgttctccagatgtaagttcgtactggaagaatttggggatcccatgtatggctaatcaaggttactaggttcatggtggtgaactttccagcaatgcagataaaattgttcaaaaaatgtgttctattgtgattgtaaatgccgtggactgcatgctcctaacatctggacgattggtcaggtagctgaaatagtccgttttttactttgacctatccttagtttaatttatgatttcctgtcatggttgttttgccaacttatgtatcttctgccctaacaaaatggaaaaacgggtgcgaaatctgatactactttcatgcctgtctccagaaattattacctatccagttgtggtgacggtctcattagtcatttcccaacaagatgtgtttacttaacgcaatggtactgtggaggaatgctctggttgtaattgtataaatttcacgcaactctttgagttgccatcatgtgtgccctctgttattcagttgtgaagatgctgtgagcatctgagatgtcgtattgcttttgttgttctttcatatgatgggatgagacttactttgcatcgcttgtttgatttgatatccgaatgctgcacgagtcctttttgaagcagaccgattcgtgtggtttttcattttaacagatgtagtccaatttctcagtttggtgtcaatataagcattacagcaactctacaatgtttgatttaattacactagaggaaaagaggagaaaaatcttgcaaacagtaaattactgatgctcctcatctgatggtcaacattgatgattatattttgccatgatttagagtggtacgagttacaagaaataatctcaattgcaaattcctatacacttctgtacatgtcatgtattcctcctgtacatgttcttctgaatatatacacctgtctctctagctccacgatgtaaaatactcctacttctctacatcttccaaggtccaaggatgttcatgtttcagatcaattcctgaaaccacatggatgttcatgtttcatgtcagttcctgaaaccacatggctgtggactgacactcccggatttcttccattctgcgttctggcaggtgctcttggcattactgctacctcccttgacagtgagattgacattctccaaggttatgccatggcaaggtacactgctgctgcaatgcagcatgatggcctcctctgatgcacttgtgcccctgatgttcttgaacagcacattgctcacctccactgcagatttctgcaaccaaaattatatatatgaagttnnnnnnnnnnnnnnnnnnnnnnnnnnnnnnnnnnnnn

SEQ ID NO: 20158 - DNA, 365 bp, Oryza sativa
cgcctgcacggctgacttattatgccaccgttgttgggcgtctacgtcttcaccgactggcttgccttcgccgctgccgactggtgtttccgcctgcacggctggcctttatgccgccgttgttgggcgtctacgtcttcaccgaccggcttgccttcgtcgccgccgactggtgtttccgcctgcacggctggcctttatgccgtcgttgttgggcgtctacgtcttcaccgaccggcttgccttcgccgctgccgactggtgtttccgcctgcacggctggcttttatgcccccgttgttggggcgctacgtcttcaccgaccggcttgccttcgccgctaccgattggtgcttccgcctgca

SEQ ID NO: 20159 - DNA, 6002 bp, Oryza sativa
  unsure (1)..(6002): unsure at all n locations
nnnnnnnnnnnnnnnnnnnnnnnnnnnnnnnnnnnnnnnnnnnnnnnnnnncctttggtggatggggaggagcagtcgtcctatgaccccatgggggaaaagttgaagatgatgagcggcaagattatttcggaggagcagcgtctagtggagttggagttggagttggaagatgaagaggaggtggaagatgaggagttggccgagctgataacggcgcgagacttccgtgtcagctgggaacatcgctttacccctcgctattccttcaacgacaccagtaagtaataaatcctcctccgccccgccgttttattctgcttccgtttctttctttacttcaacgcaatcaagattatttctgcgaatctatctatcatgtttcgtatcaccattatatactggagtatataccactatctatttgtgctccaattctggttgttccaagtgtcttgttttattttgggttaagagattgccaggctaaatacctgtgtttgtgtgtcctcaactatatatgcaacacatttagcatgtgaaacaagtgctaggttttcctaattacactctataaaccatcacagtacaaatcctgttaatcacaacaggatactagaaagattaaatttgaaccagatccgatagattatctgacgtggtgccaactaattatgtttcatatatatattgggccgcaaaagcatgttaaataatctgagccaatttgtcttttttttccccttcatctagcacaatgaattctgacagaattaaagtggaatatcaattagttgctgattccctacttattggagcaataatccctaattttgtatgtttgtttatcttcttttttttttttcaaagtagcaggcaggagatctgctagctaaatacattagaagaagcaacaaatagagtctagtttagtacatactaaataggatatctacagcgccaagaatagcaacttgcatatcaaaatccgcattagagggtatcagcactaaacgctaagggtagctcgtttacgtcttgtatcaccaagaaaaccaccttgttcttgggttggtcctggaagaccctcatgtttctttcaagccggatattccaccacgtaacaagcaaagctcccaatactccctttctgttttcacatggtgtcattgcacttgacttgttccaccaatctgatagacaagtgtaggttgagttcattgctgtgatctgtagtttttagcgaatcatttcctacactttggtcgtgaaggaatattccttagcaagatgattggtgtcctcgaaaaagctttagtgcagagagtacaaatctcattacatggccaatgtcttttaagcaaatttttggttgctagtaccttgtggtgtaacaatagccaaccaaataattggtgctttggttcgttgtttgctttccagaggctggtaaaatttgagtatgacacacttccagtgaattgtgcaagatacgcgctttttgccatatatgatgtcattttttatccctggctgcagtttaaccccagctaatagatctgcaatccaaactagttcattgatttcttcaattgttgttaggggccttagcaggaaatctgttgtcagatatttcaactagaatagagttgtttgttctctttgctagtttgaacagacctggcaccagatccttttttctcccattctgaatccaagtaaatttcataaaactacaggtattttgcacaatttatcacaaaactacatatttaagagcttgtttcacaaaactacagatttaatgtctctgtttatcacaaaactacaggtactttgtataatctatcataaaactatatatttaagaacttgtttcacaaaactatagatttattgtattcgtttatcacagaactacacatttagtgtcttcatttatcataaaactacggatttagtgtctccattattacaaaactacatattttgacaatgctaatacctgtagttttgtgataatgaagacactaaacttgtagttttgtgataaatgaatatattaaatctgtagttttgtgaaataaattcttaaatatgtagttttgtgaaatattgtgcaaagtgcatgtagttttgtgataaatgaatatattgaatttgtagttttatgaaacaagctcttaaatagatcatgcaaagtatatgtggttttatgaaatttactcatccaattatcgttccagaaggtagctttactcccgtcacccaacgtgatggtagctgccgccgcaaaaggttctttgttgattgtatcacaaggaacctccatttggcgaagggccctggcgaactcctgcagctccaaaaatgggtccacccaaatttcttggtttggctggcatacagtcgcccaatttaccaaactgtgtccaggggtgatattttctgggtcttaccctttccacaaaaaggctctcctaattctgtcaattttcttgatcaaccatttttgtacgtagaactgtgagatggtatgttgggattgagctcagagcagtcttgatatgttgttcatcttactcctcattctcatcaaggttaatgtctagtactccatatatgtgcttatccacattgtcacatcaatcatttaactaaaacttggatttttgagtcaaaaatgggacacaacaatagcatccacaatgctattatttgataataaatattactgctacttgactgcagcaaccgtatgtcccatgcgctatacggagggacctatcccaagatatgcttgctgtggtgataccttgcagatcttctctctccaagtgaaagaagcaaaaggtggtcttgactggccgctgcatgtgtatggcttggttgccaccagggactctgtagatcaaaggcgcaaccttcttttcaggtgcacaagggataattgtcaaattctcactccacaggtatctatcttgtaatttccttatacctttattgttttctcatttttcttttgcagcttgaagtgctcaacctatcatactagtagattactactgttctgtacacttgtttgtataaatatgttgtctttttggagttattagtgcattcataggctggctgcacctaaactgtcaattgaaggcatgtttgcaattttttttccttaccactcttttttcacataattcattggtaaaaactaaaaactgaggatttgtttagttcccaaattttttttcccaaaaacgtcacatcgaatctttggatatatgcatggagcattaaatatagataaaaaaaactaattgcacggtttgcacggaaatcgcgagacgaatcttgtgagcctaattaatccatgattagccataagtgctacagtaacccacatgtgctaatgacggattaattaggcttaataaattcgtctcgcggtttctaggcgagttatgaaattagttttgtcattcatgtccgaaccccttccgacatccggtcaaacgtccaatgtgacacctaaaaattttcttttcgcgaactaaacacactgtgagttgatagaattggcaccactatgacctatacctatactccttttgaaataatccactcgtggtgttggcattgaatctgctgtgtcaactcttcctaccacagttttctataaatcaacctgtgatgatagttaatattatcaacagccaaacatagcagtattgccacatgtataaccaagatgagcactcactgttgcaaataaatgaatagcatattgcatgcaaaacataaattaggtttgtttattttaggcaatattatggcatactttcttttattggtagcaaagctattgcatttaccttgtctatggaaatagaagttttgtgatggaccgtctttaacatgggctcgtaggaaataactgcatggattggttgcatactggatccttattatacggagggaaccaagttttagtaataatcaattggttgtgatgcctgcaggattcacacctgctgttaacaggcccatctcgtgcagttgtggtaattgatccagtaacgtttgaagttgaactaaaggtaaaaggaaaaacagaggctgaggataaggtgttgagcctaagggtctttatgcaccacactgtgcatgctccgcagatgtttgtccagcaaacatggggagcttgagttgacatgtgctggacttgtagagcagttgaggccacaatggtgagtatccaagttagagaggggtcatggccagatcatatacgagggttggtcgtttgtcgtacgggcagcgtagagggaggggattttgtgctgcttgattctggagatggaagaatgcctattaacagctacgatggtggcattgagctttcaaggcgtcgtcgcacaacctcaatgtcgtcgttgcaagaggcagtgctgttttcaagcctcgccgtgccgggagtactagtcttgtatgggaccttgggttttgtaaggtggaagctactgtttgttggtcgctccacgcgaccttgaggcaaatgctctcgggcatgccttgatccatactaatcactttagcttgttttgatttttgagttaacgtacagctcggctgcatatgcttgcgtaattgtgtttttggcgtcatggtctgctcaaccccagccgtgttcaggactagtaccatgtaacatatatatgcttcaatgtcagaatccaacctttttaactttctgctgttttcttaatgaaggttagctgcctattcacttcactgaacgtacatgaagcgcagcagcagtttattaaccaaacacgtatagttagccagcagctacgttgaatcaaacaacagatcgaagaggaatcatccgttccgttccaccgccaaatccaatgtcatccaatcacttcaatttgcatctctcacatcaccatctcttacccttattcagaccgcaacacccttacatatatagcgtcaagtaatggaagcaaccacatacatacatcgttgcatacacatgcaggcctgcaggctgcagctaatccaatcccgaccaagaagcaaccggttcaattcattaacaccaattaacatatggatggatgcaatcagcaagatgcaaaatgaacaagatattttccccacaagcatctgggactggaagggacatgacatgcccacccttgttatcgtcaaatatcaatcttgacattatatcaagccttcatcttcaagttccactatttcgcaaaggaaaaaatatgaattacccccctaaactatcgtcgtcggccgaagttccctctgaaccaaaaaatcagacatcactcaccctaaacttttaataccggacgaattacccccctcgacccaatccggagcagttttgtcctacgtggcgcacacgtggcaacccagtcagcatttctttttttaaacacggtggggcctgcttgtcattctctcacctcgttttcctcttcccctcctacccctctccctctcgtgtcgttaggagagcggtgggcggtggctcgtcgtcaggagcggccgtgcggccggtcggcgcacacggcggcgggcgtgcgagggcgggcgaaagacgcgcgagactgggaggtgggcggccgcgcacggcggcgcgcgagcgcgggcggcgggcgcgcgccacgacgaacgagtgcggctggttggctccggtcgacaacgtgcgcggtggggcaagcggcggcgggcgcggttccggtcggggatgggtgcagcagggagggacaactggtcggcggcgagcgacgagcggtgacgggcgtggaggggtgcctccactcggctacgggcgcggctgggcgaacggcggcgggcgcgtctccgccgactgtgggcacaacactagttggcagcgagcggcaacgggcgcggctgggtggccctggtcggcggcgggtggcgctccaggcgacggcggggagggaccg

SEQ ID NO: 20160 - DNA, 32210 bp, Oryza sativa
ccgccctcgtgcacccgccgcccacacttgtccgccgccgtgtgcgccgaccggccgcgcggccgctcctgatgacgagccaccgcccaccgctcgcctgacgacacgagagagagacagagagaggggtaggaggggaagaggaaaaggaggtgagagacaatgacaagtaggcccaaccatgtttaaaaaaaaagaaatgctgactaggttgccacgtatacgccacgtaggacaaaactgctccggattgggtcggggggggggggtaattcgtccggtattaaaagtttagggtgagtgacgtctggtttttgggtttagagggaaaattcagccgacggcgatagttcaggggggtaattcgtactttttcctttcgcaaaatcaaatatcatcccctcatactgagataaaaacagtaagtatgaggggaacttttagaggttaattaaagcacatttatacaaacaagtgtacagagcagtgaattgcctactggaattgtgcacacattatcgtcccctcgtactgagataaaaacagtaagcatgaggggaatttttagaggttaattaaagcacatttatacaaacaagtgtacagagcagtgaattgcctactggaattgtgcacacattatcgtcccctcgtactgagataaaaacagtaagcatgaggggaatttttagaggttaattaaaatacaaaccacctcattccaaatatgtgaatgcaccatggcaggttgcccatttcatatttgaatgaaaccataaggattactagataaaaactctatccaaatatatgccttaagatagacaacaacatgtgaataactcaggtagcaattagatacgatgatgcttgtagatcaactattattctaaggtaaaaatatagtacagacgattattgcatcacagaatagctactaaatactaaagctcctacacaaagcattgtgaatgctcaaccaaaaaatacatggagcacaaatacttcagcaccatcctctaaatgattcattcatataagctattagccaggtttatggtcatgtgacaaggaaggaatacctggtcttctcggttttaacttgtagttagaccatatgcatgttgatatgatcagcatgcagttattagatgaaagaacagcagcctggctacaatttctaaatcattacaacaataggtgaaaagaagtaaactgcaagatagagtatataggttatacaatcgtagatagaggaagaactctagtacaagagcaaagcctgatgtacaattatgagataggggatttctctagaattattatgaagccaatcagaagatagggacacccaattactcaattaaatgatgcaacctaatagcatacagatgcagtaagtaataataaatgtaagatgagctagtaagatgcactcatcaatgaaagtagtggtagaattgagaagcatcctcaagaagaaaagtgtagtaacactagcaatcaatcccaaagagacaaattttgcgagcccaagtaattaattagcaacaaatgtttgaaagaaggtaagaagaaacagtaagggaaccataaacttgcactagggtatattgcttcacaaatcagttcaaatttgaatggaaccataaggattagtggaaaagaactctatccaaacatgcattaagatagataacacaacttgtgaattactacaaattagcattcagatgtactagcagcaatagatgaggttgcaagaggagtagtagtagaattgagaagcatcttcagtaacagtaactacactgtaacaatcaaaattcccaagaggcacattttgcaagcacaagtaggagtaattagccacaattgttcgtctgaaacaaggtaaacaagagtaaagttgaactagggtagggtacaattggttggcagatctagcaagaactcagcaagcagatccatatccctactactccactaagcttaggtttgtctttcttcatacacaaaaaaaaacatgtcatctgatccgatccgatccgatccgatctgatctgatgagagagaaagtaggggaacaagagaaagggggatggatcaggcggaggcggaggcggcggtgcgggagcggtagagcttgccgaagacgtggagggcagtgacgaagcctatgaagcagagcgacatgacgagcaccatggtgggcgagaggcggaggccgggcgcctcgtcggtgtagaatcgcagcatgttgctcccgccgccaccggagaagcccccggagccgccggcggtggaggcgcggcggcggcgcatgccggcggccgcagcggccgtgccgcgggggccaacggtggcagggcgggcggccccggcggcggcgccgacggaggactgggactgggaggaggagcgagccatggcgattcgggtggaagacagggagacgagacgacgaatagtctactctctgggcttgggtttggatctcacatgatatactagtactgtacatacacccgcccgcccatataggtgtccaaacgggcggcacggcccggcccggcacgggcacggttccggcacggcccgtttcggcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcccgccagcctgcagtgcacagtgtttttttttaaaaaaaaagcaaaggaaatgtataaggaaaaaaaattaaaaatggaaataaaatgtttaaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaatcatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaagatatgttatcttgtggtcattccaccacccgaggacgttgaaatcttgtgcttcatggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacgtctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattctttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagctttaaacctagggttatgagattgctgaatgtaatgttcaaaagcaggggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaactgcgagctcttcaaacctctgcgatcaaactgttgaactacgaaactaattttgatttttgacaaaatttgagcaaattttgtcaaaatcaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccggcccgctacagtagccgtgccgtgccgtgccggcccgcgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctacccgcccacatctctctctctgttttttttttcctcttcctgttggggcatgtaatgtaaccattcccacgaaacaagtagtaatccatcataactaagcagatgatgttgacgactactcttttccgggtaatacaaatccaccttagatttgcggtactaacagagtcatctaaaccaatgaatttagaaaaatatctatcttctaccctataattcatcaactacctcttacatccttcatacttcattcatcatcatcagatccaacggacgaaaatcatctctctcaaatccagtggctcccatttctcccaccttcttcccgggaatatcgcgcatcaataccatgccgccgccctctacaccgtgcgttcaacccgccacgaagaccgcccctccttcccagcgaatcttcatgttgcgtgttgccatgggtcgtccccgccacgaagaccgactcctcttcgtcggcatcgttggcgcgaaggtctccgcctcgggcaacccaccggcatcgtcgtccggccaacggtacctccgcggcaccaaagtccattcctcatggatacatcgaggacggacatgactgacgacacaacagtcgcaaccgttgctcaaggttgctactgttctcctcttgcacccatcttcattgttgactgaacctgaatggacggtaaccttcttctcgccctctgcattgcaggtctgattaagctctagtctccttcacttttaccttcccacttgtttctgccttccggtattctttgttttccactagcgtgtgatacatgagtgcaaggtgctcgatgaaaggtcggcaaggagtccactactaggagatcaatgcttgtggggggcaatgcagttggatctgctggcacaaagtggcacaggttagtgcctgctcccacatggcttgcaattggcattgatatctagatttttcagctctttagaaacaccatccaactcgctggagatgtgctgataggcgagctttctgggagaaacaatgtgtgcattatactgaactccattcaccagatcaacatatatataggctgcgttcttttctcagttcaacagtgattacggaaaacggagcgatccattagcacatgattaattaagtatctgctattcttttttaaaaaaatggactaatatgatttttttaagtaactttcgtatagaaactttttacagaaaaatgcaccgtttagtagtttgaaaagcgtgctaacggaaaacgaggactagaactgagaaaagaacgcagccttagtggtataaatttagtccttttttatgtgttaataccttggttcatcttcatgtctgtaagcaatgttggcaattcagcattttttgagagaaatgatatcatattgaaaggtccacgagttcagcattttctgtaagtgtctgtttaactcatatgcatgttgcaggggttccacgaggacgctaacgaccgtgtgatttattagtggaaaaaatgcttcagcccaaattggtctactgttttcagtcaatgtgaaaggaagcttaatgatatcaatgtatatatgggagtttagaggagttttgggtttgaggagcactctgtttcttcactttagtctctctcttccagcctatttatgattggagaactcttattgcaggaattgtcatttaaaaagagaagggtttgtcaaactaattcctttttgctacagctttcagtactgtccattaaatctgatgtgcttctaattaatcttatacacaatatgccaaaatttcagcattttaaacactgttgctttcatttgcagaacaataattggttaataaaactaacactatatttccattaccagctggtctgatgagtggtaattaattagttgggtgttgcaaatatacaggtagagagatagcagaaaggtatgccaatcagagatcttgtgggaattctcatctgtactatctctctacctgcatagattatattggagtattgcataatctcacaaaaatgatgggtcttcagaaggaattctagagatatttttgaaggaattctagagataagtctacgtgtgttgaaaattggggagtttggcacaaggatggaagaagatgggaacatctaaaattggggagtttggcacaaggatggaagaagatgggaacatctgtactatggtagtatggtctatgtgagattatgcaatacttcaatataagaatgggagaagatgtgaactctggttctctgaattatttaagtcaccagcaataacattacgacgaagtagtacagcaagattttaggcattggctaaccttttctgatccatgcaatggtgatggaaaaatcatagttgcaagccaagaattaactggacaatatgaagatacatatatgaaatttgtgatttttctttgtatagagagtctttttaatggataacctcgctctgcatcttactctgccactgaggccactacccatcttaagaggatatgattttaatctgcgttgtgcaggtatagatgcatgtacatttctcaaaaaaaacatattttagttaaaatacttggcatggatagcatatttacaatccgttagccatgtttttgttaaaactcttcatatatatttttaattcgtttttaattggttatctcctcttttcatcaaacgtgagcatttcaagagattattacgactattaagcaggaaaagtcctgattgaaaggaaacttgctgtcattatatctttttatatgcacatttaatactatttttatcatttatggatgtctaataaaatagcttcagatgttggcaaaccttccacgccaatttagtctaaaatttgattaccatgcacacacatatgttgtcgcacacatatatcgccattaataaatatcaccgtagcgttagcatggacacaatactagttaaaattggttagtggagccaatttaaaaatcaaaccaacctctaagctgatttaaatcgatctcaaggtaaacacccatcttatcgacgaattataaggtttataagacaaacctgtaaaaagcaccgcattctcgtagtgaaggcggataatttattatgcaaatcgataaagatggacagactaatgctacgtaaaagataaaatagaaacatggctgaaatgaaaaggtgaaagaacaattcgattgattgtgtaggggttgtggtggtggttgaggtgttagaatcaaatcagccttagctcttataaagggatcttatctccgcgtggcattctccacgtcctattaggtttagagatccaataggacttaataaaccttgaacccaaacgaggaaccctgagaaccaacaaatcaaactcggagtcgaactatatcggtttgaccagccctaggctgttgatctcctctcctttcttttcccttctttgtcttccccttggtctctctctctctctcttaagaaatggacggcacaagtagccgatcaaagcaggactagacagcggcgaccagatgccgatgaagaaatccaaaggaagaagcagctccccgaaggaatccttctaactaccacctatctacctcccgcttttgttcggacaaggcgaatttcctaagattcatccaccgcggatacactaagcgttcttcccattggtaaatctgattcttgcaaatcaacatcagacttagaagcttcatggggtctggtctcgccatttggcaatttaagccaaacaaaatacagggcctgtttggcacagctccagctccagctccaccctcctagagctggagctcagccaaacagtttcagctccactaaaactgggagtggagctgggtggagctctctcacaaaatgaactagagttgtggagctgggtttaggcagctccacaactccactccagacccaactcctgaagctaaatttaggagttggagctataccaaacaggcccacagtacagaggttataaccaatacaaaagcaagcgcgaactagtcagaaattagaatggagaagtagacacagaagaagaggttgttgggacagtatcgatagccgagcggcgagtatggggagtcctacgtatctcggggatgtagggggaagcgggtgctacatgtggttgggcagccatggcaaattaaaggcccgagatcgacgagctgccaatggcggccagttaggaagaagatgggttcaagcgatggcggttcacctaggtggaatcgatcaaatgactaaggatttggggactagggatggaggaggcgattgaggtgaaagggctcaccgggatttaggtgagcagttgtggagtcgagccatggcgcccaggaaggggaggccgccgcgagcaatgagaaaggtggcgccggtggtgcggactggagaaacctcaccgttgtgctgctccataaaaatggttgtgacattttggaacagaagtagcagatatttttgtatataactaataactctggtcataacaattttatgttcttgtccaggtgcatcatgcatggaagagggtcggcgcggctgacagggaaggaacaacggagaggagatcgaccagctggctccctactcggcgtggtggcctgctcccgcgtcatcgtcgccgctgccgccggaccttctcctctccctccttgcaccaccgaccttctcccgacccactggcctcctccccactcgccagccagcctgcgcagagaggtgagagagaggaggatgggagagaagaggggaaagaaagaaggtattggcgtggacaccctgacatgtggggcctgtgtgggtcccatgctgcctcagctgccatgtcggacaaaaccagggtaaaaaccacctaaggatctaaagggaacggttttgtaaattgaggggtgccatatatctggtttcatggttaggggacgattttgtaactcgatgacaaattgagggaccttcggtgtacttttttccgaaagaagaagggaacgactagctaatatgggcctggaaatgatggatcgaaagaggcccattaattaattagtacaacaccgaacgaaaagaagcgaacaaatgcatgcgaagttgcaacaaagaagagaagggaagtagccgttaaacggcagtagctagctagttgagaagaggtggttttgataatgaaatgtatatatagcgtagtagctgtagcttatatagggagttggcacgtacgcctaggtctagctagctagcgatcacaccaggatccaacacaaactgaacaagatccacgacacaaaagatcgatcgatcgatccatcgaaaatggcgaagcgcggaagcaaaaagaagaccaccgcttccacccgtgctctccctcttctccgacgatcggcaggcgagacggggacggccgagagcaaggaggagaccggcgcggcgtctccgatcaagaacgcgatcaagaacgcggcggctggcgagatggcggaggaggagaagttggccggcgcggcgtctcctctcctccgactccgatcagcccggggagaaacggggacggccatcaagaacgcggcggcggctggcgagatgggggaggaggaaacggcggcgatggggatcacaagaactcgcggggatcaagaaacaccaagaaagaaaaagggaagaagctggtaaaagaggcgatcaagaaacaccaagaagcgaggaaggcgaaggagatcggcggcgcgcgtggcaggaaggagagcaaggccatggatgacggcgcggcggcgctgcgaaggaaagcgcgagagatcaccaaggaagaggaggatgacgaacgtttgcgcggggagatggtgtcccgggttcgagcacggattcgtaagcagcaaccagacgaggtaactaataaaatcatccttttcgatttatttttaatttgatacgaattaattaatgacgatgaatcaatgatgcatatgcactgatccatcgatccatcgggagtattaactgtttgcttcttgtcaataatgagtagtatatatggatatgatatcatgcattagctaatttccacctattgaattagctacttaattagcttgcattatagatatgttaataatttctatctactactcattttaattaggttgcattttatatagatatgttcttaatttcgtttaatttctttccgctagctttctccgatcacgtacgtactactgctactgcatgcattaccattttaggagtactagctagctactagtagtattataatattggtgcgtcaatcaattactagctcgatctgcactagtaatacttaatcaattagtgtcgtctcctcgcctcgttcgctctattatacatggatgcatgcgtactatactcacaaacgtaggcatgaatattaaattaactcgctgcatgcagtagccagtagttgcatgtagcattttaaattccaactctcgatgaatgaatgaaattaagaaataatgaatgaatgcagagtaagttggatgcgttctccattggcgtcaacgctaatgtgcgatcgtaccacaagctaatgatgaagagatacaggcgcatgaaacgtatctgttgcatgacgctggccggggcgccggtgacacctccgaccacccggcggcgatcgccagacctcaagatgttaccacgttccacattgtgggcgtcgtcgacacagatggtgctcgtgttcgtctgctcttcagggacagcgacctatactttgttgctttcaaaactggttcttgctggttcagattcaacgatgaacacataccaacattcctcacgcccactgtacctatagcttacacctcgggctacatgaacatgtgagtagtacctctcactcgcctgcctctagctagtatatactactgctatccacattattcaatatatatatgatgacgcattgcatttgcatctctctctctctctctctctctctcttaatgcttgcattctggatacacacacacacactactgcatatgatgatcgacttcactcacagctgacagtttcttcatttttgcatggcacagtgcgcaagttcgggttggatatcactgtctttatgatatcttcaatgtaatctcaagatacacccctgagtcggcacaagagaagaccaatgagaggcaacggatacttcagtgtgcagctctcatgttgagtgagtcacaaaggtttggccacgtccagctactggtaaagagacagatccacaaaatgatgagtaaaaagattactgccaaacagaacaagaaaatacacagttggggttccatagcacgctactgcatatcccacgaatgcaaagaagacgtcctgcatcatttaagcacattgatcgttctgttcaaccccgatcaaaacaagtatgagaattacaaaatagttggcagaagaaaattgctatctcgagcagctgcagcagcagcagaagcagcagcaagagcagcagaagcagcagcacgaccatcgcaagcagcagcagcagaagcagaagaagaggaagaggatgatgatgatgatgaggatgaatacccatggcaatgccaaacaagagcaggacaggagctcctgattctcctctacgacaaaagattgcgtacccaaggccatcaggagcggaggacatagggtccgactgcctccaccgcttcaagctgaagacgagaccaacaagcagaagatgatgattaagaaaaagaatacccaccaccctgcagttccatcatcgtctgataatgtggaagatctccctactgtttcagcgccaccagttactccaatggtggtaacacagcagaagaaccacaagaaaactcaggctgaggaggttgatgaaaagaaaaaccaagagaatccaaacacagatgccactattggcgctccatctggaggtgaaaaccatcagaatcgttcattgatcagctgtgacgggattaacctgtatgaatctgatttggacagtctacgcggcccacattgggtgacagatgcaatcctgggctatgccttggccaaattttcaagagcttactcagatgatggcctactcctggtgcaaccaacgaacgcagcattgctgaacaataaacactatgttgctgccgaggccgaccacttgctacttgctagtcgtcgcctggtcctcataccagtaaatgataatctggatttcaaccaagctggtgatgggaaacactggagcctcttagtcatccacaagaccagtaacgatggtgttatccagttcatccaccatgacagtgtgcgttcaggggataactcatacaatctgcatgctgctcaaaagcttgcaaatgttctgcggggagtgctgcccactgctggagatgttattaacgctgaaacgccccagcagactaatggaaatgattgcgccatacatgttctggctgctgtacaggtcatatgcagatggtggagagccaatgccaacaagagtggcccagctgattggatcaggaaattggacaaaagaatcagtgaaggcaacattacacagatgagggcctccctcctgcaggacattgaaagagactgtcaaaagaagaaatcgaaagatcaatgagctacaatgaaatcctttaacgtgaatctttgcaaacatgcatgaatcgtgtcaatttgtttggtaatatcactacatactgcagagtgcacaattaaaatgtgtgtactacgacagtgagcttatgttaccttcaagttgatttgatatcacatctgcatattcatctctcctggtcttctgatccatgactaagaaaactgttcattagttgcagttgcatttggaattaatttcactagtaagctcatactttgtattttgccaacatggactgcataggaagtttgaatggtttcagaccttgcatgacctttgcctacctgaatgtgattatcgtttggaatggcttacctggagattgaccgagtagttagttactggctgcacactcaaacaataaataaatcaattgcaggaatgcaaaaataccatgggcagccacaagcacaacttatttgtatgctacaagaacaaacagcatgcagaaggaggattagagaggagagaaggtatgtggcgtttggaaagaggcgaatttccgaagtggaaaaagcaatcagctgcgctaatcccacagaaacataatcctaaacctaacattgtctagtgtgaaatttgagacaagagcaacccaccaaatctatgtccatccgtatcgacacataactcgttgggccaggtatgatcatggtgtggtcggtgagggagagggcggagatcgaggaggctgagcgcgccttggtcgcggccatcggtgatctgccttgccgctccagcgccaccatccccatccccctgcccagctcagctcaatgcggctcctcctcccctgctttatgtgggttgggatgggctgttttatgtggcctcttgttattaactagcaagagacacgcgctacgctgcgtgtggacatggatagaatccaaatgagctcatgacatacaacacatacaaattctgttcaagatattagtagttttaatgtacagtatacacgctgtaaaaaattgttacaatccaaaataagcatgacaggcaattgtagatataaacgggcgcccaaacgtctgtttgtttcttccctgatatattgacaattttgaaagagaataataagatattgatggggcacacaacccaaatttttgtcaaatgcagaaacagggcctagctaaagggataataaacctatgtgctttcagataaacttcatatatactgggtggagtgcaacaaaaattctaagaaagtaatgtagcttggatggcaaaggaactaaatcaaaatagaattgtttcaacgatttacgattccactgaactaacacaacatacatctttacatgccttacctgcaaacacaaaatatcagtcattccatagcattttttccgtactattcttaaaagttaatattttattaactctatcacacacacatatataacattaggacaaaatgaactaaaaaacatggcagtataactgcttcagatgttaggacatggttacccatggaagatctggtggtaggcctttaaaaataaaaatatttcatgagataaactgcactaaaatgggagtctctaaggacatggtagtaattagttgtatggtgagtacattgctatgagagaaatcatatacacaattcatacatgactactaaaatgtgagaaccaaaaaataatgtttgctgaggcaatgacaggctctagtacatccttgtgcactataccttgctaaataaaggatttcctgcaagaggaatccttaagttgcaactttgagattctgtttgagaaaaccaggagggcagatgcactgaaggaatgagcatagtagcccaaatacaggcttgaatagatttatccttcaccctactgcattccctaaaagaaaaagaagtatgacattagtgttttctcaaaagtaaagtgacagatgtacatgaatagggattgttttttttttaaaaaagcatccatatatatatgcattggccatgtttttaaaatgtgatacaatagaagcaggccaaacataacatgtaagaaaatcaaccatggaatcatcgtagcatgtggataagtaccacaggcaggaatcatcttcccgtaaatcgaaagaagcgaactttaatcaacaatgtagcccgtaatagggtgtgctatcaatcctatgtgtaagccttcgtgcatgcttagtgcacagtccagtcaagaaagagtgaactaatctattgcggaactgcggactgtagaagcacaatcaagttgtatgaacttgaggacagtaagcttccttgctaaaatgcataatggacgatttgtttctgtgctgtatcaaggcgattaggagaaagcattaaaattaaatggcagtcattgaattatagttcatctcatccttggtaacaaatttattagcaagcagactactaatgcgtgtctctgggtcgtccccccggtcgacgccgtctcgttccgttcgcaagccgtcccctcgctggaccgcgcgtcccccgctccttttcgcccgggcgccggtggaagaaacccgttgtgtgggtatgggtgcttgaggcgacgacccccagagtgaagatttcctcttccacccctctcagtctcgacccccagagtgatgagattccggcggcggcggcggcgaggagagggagaggcgagaggtggcggcgagagggagagggaggtgcggcgggagagtcggagagagaggcggggtcgacggcgcctgcataccagatctgggacggctggaaggtcggcgacggcggcggggcggacaggtcggcgatggcggcacggcggggaggtcggagtcggcggcggggcagagcaccagatctggcgacgaccccgccgacgaccggcgacggagatgactcggcgacgaccccgcgacagcaacgggcggagggagcgccgggccgttctccccgcctcctccgccgccgccgcgcccgccaccgccagcgccgccaccgagtctcacgggagagagagggtgagaggcgtcgagccggcggaggtgtcgaggcggcgctggcggtctcctccacgcgggagtaattgagagagggggaaaagagagggggagggagtatagtaaaatatctatgtgggttttttggtttctactaggggcgcgtctgatgcgcgagtgttcgcgtagcgcgaacgagaaacaacaatcaaaagcggtcgcttgacttcgccatacgccactattccgctggttccacgcatcacgtgtccccgcgggactcatctattgcaagcctcgatactactctccataatcgtaattaagcaccatccttaactaacgttttaattagggaaattaatgatttactattaagatttctttaaagaagaaacataactttatattttttaccataaattattccaattaatatctatccaaacactatttcttttaattttctttgcatggactaaatgcctacagaaattcttaaaaactttctaccagtaaactttacacgagaattaaaactctttactctcaaactttatactcgaaaactttatggacataaacttgatactcggaaactttatacacataaactttatactcagaaactttatactcaatttttttatattggaataaatatatttattttgtaaatcatgacttctaaaggacacaactcgtagtatactccctccgtcccataaaaaaccaacctattactggatgtgacacatcctagtaccatgaatctaaatattcctatgtccggaattcgttgtactgtaatatgtcacatccaatcctagattccttttttttatggagggagtatctagtattgaagcaaaaaattaaagcaataaaaataagtcagcaagcagaaactatatcgcacatatatagtgtaaatgcaagaagactaaatgagtttatcacataaaaacatcccgtgtggatcccactctagtaccaagaggcggcaaatatagtggttatagtgacctgagtagtaccctaaggtcctgagtttaaatctgccgtttcgctactaggggtatcctccattgttaagggggtttcctagatagtaccctcagttagtgagggtactctaagagtatccctgattggtgatgccctaagcccatcaccaatgcagctctccaacccgtgtccctagctaatgccgtcccattttgacgccgcggcgtgccccagcagaatagcgtcccccagcagagggacgcgtctctaccagcgcctggactgggggatcgatccgggagacgcgctgggtcgggagtagcccaaggacactgctccatcccctggtttttccccttccaccctcgtccccttccaccagcgacggcatggctccgcggcggcggcgaccctcctcgtcgctcttgcggccgccggcgacgggagagagagtgacgagtggtaggagagaggtgaccgtcggcggcgagggagagagggagacgagcagcggagaggatgccgacgacgacctagagacctccgccggtgccgcgccgccgcggcctcctcctcgatgcggcgcagccggggctgctccatcgggacgacctagagaccttcgccggcgccgatctagccgcgagggggccaaatccgggcacgacggcgccggatctgccgcctccagctgccgccggtgccgaaacccacgcgcggctctctgacggcggggcgaggccggcgcgaggcggggaggactgcgacgtccaccgcaacccacgcacggctctccatccgccacctcgacccgcacgacgctctccgtcagcggcgacaaagggcggtggcaaggagagatggcgggagagagaggatgagggagagagcggcgacgggtgagagagggagagagaggggagcagctgccgccaccgccgccgccggcctgcatccaccgtcggagtccggcgacggcgacggcacgagaagcggaggggaggagaagagacgggcggagacgagcctaccgatggagtaaaggggaatttaactatttgctactattgcatttggcacttatccaaatgcccctcttatatttgctcctttttttgctcttcttaggtgatggcttcttaacaatttaccacttttgcctacgtggcgtaccaccatggcttgcaaacccaaaaaagtagtgtgggacccacaagtcagcctctcttcccttcacttcatcttcctcctcgctcatcctccagctcgccgacggggaggagccccctcctagtccgagcccggtgccggcaagctcccacgcgcatgcctccctccgcgagctccctccctacgtccctccaagcccagcgccggcaagttccctccgtgctcggcgtcctgtgaccctctcctcggcagcggggaccatgaggcgtagctccggtgggcgaggaccattaagatgtacgcggccttctcctggcacaccggcttgtcggaccaattgagcacatcggcggccctcggggtaaagtgcggcgagcgcgcggtccgctgccgtggcccgcgggcgtgtcgcccacggtggcgacgagcgatggtgtcagcaccgcagacaacagctgcgacgcgttcgccggcacgatggagaggttcaggagtgcgcgcaggccattgttcgttagctccatcggcgaggagagggacgtcgggcatggtgggaacttgccggcgccgcgcctggagggaggtagggagggagcttgcggagggaggcgtgcgcatgggagctcatcggcgtcgggcttggagggaggcggggagggatgctggactgggagggggctcctccccgtcggtgaactggaggaggaagatgaagtgaagggaagagaggctgacttgtgggtctcacactgcttttttggggttacaagccacgtggcacgccacgtaggcaaaagtggcaaattgttaagaagccatcacccaagaagggcaaaaaaaaaaagagcaaatataagaggggcatttggataagtgccaaatgcaatagtggcaaatagttaaattccccatggagtaaatgagggagagaaagagagggggagggagaagagaggggtaatattgtaaaatacctacgtgggctttttgggctagggacactcgttgggctactatcgttgggctactagtggtatccttgattgcgaggggagtttcccaaagggtgctctcagttagtgaggacacccatagagtgtccctgattgtagatgctctaagttaagcttgcattagcttatagtgaggacaaaactccacgcctgggtcagcctgacaacatatgcgctagaatgtgtaaagataatggcaaggttgaaaggcaatatattcaggatatgacaagaaagctgaatattctttgagtgatggcagtggaactgaaaattataggaacatgagagaaccattaggaataagaaaggggacccggcggcggagatgccactggtgatctggaatgcttgttgctcctcgtcgtcgaaccatctccaccgacgcaaccggcctagagcacgtcaccgccgcctcctccgcctctagatccactcggtcgtcggcaccacctcgccactcgtcgaccactgactccaccgcccggccacccgccggcccgttgccctacgccgaccccgtccacgctggtgcacggggtactcgtcccgccggtctcgccgccccctctgcctggagcacgccttcacgccgtcggccggcccgtcgccctacgcctctccaccaccgtctccgcgttgcttccgcccgacctctgctccaaaccaacgctgggtccccttccgatctggaggccgtcctcgacccttcgcctcggcgcgccgccggcctggacgatggggccccgcctcctgccgtccgtcgggatgccgcgtggacgcctatctctctcagctcactcatatactcccttcgtactcgtggttagctcttcattgtaaatatatggtccacctgtcagtctcagagattttcttggttcctgtgcctaagctggttgtaagtgctcatctctctcctctcctctctcatctaaatatatggtccacatgtctgtctcacaaattttcttggttcatgtgcctaagctggttgtaagtgctcatctctctcctctcatctctcatccacctcagcatttagccttcttatagtcctctattatacttgctctaatagctattaatcagacgctaatcgcaatgttaatctaacttgtaatttacgtagttagattagatgatccaacaattagaaaacttctgtgtacacttttctatgtagatgtaagaaagaaacaactggtgctttttatattagtatagagatagatatagattatattataggaacaattgcttatttcacctcgttttgaactctaactaccaatttcatactacttttttgttgtttatttatttgaccctccttttcaaaaaggcacactttactacaggacactatgatttcgtggttttacccgtaggacactgtccaaactcacttttatgggaaaacactcccataaacgtggtaatttgccaatggacaccgctccgattaaaataatgatttccggttgaggaggagagagaaatcacataaaatgtcaaaaatgcccttgggcccacatgacagctctccatctctctttctccctcctttcactcttctccctgtcacggcttgctcaacggtggcggcaacgtccggagcacgcgcgacctactcggcgatggtggaggaggcagcgtggcttgctcgggtgcaaccaccgtgacgaagccgctggagtggctagctcgggcgacgccggcggtgaacgagccaccgagcaaggccatggatgccgccaagcaaggccatccggcggccaggggcagcacgtgtgtcaccttgtcatccctatcaacctcatcggacaccgcagacgtgacgtcgaccccctcgggggactccatctgcgccaccgcgctgtcgtggacctgcattgacgggactccatctgcgccatcgcgccgtcgtggacatgcattgatgacatcctagacgccgcacgttcgagcacttttgcgtgcataccggcggccgcgccgtgctggaggaggtgcagcgaagcctcagcctcggcgacgtccgaagcacgcgcagcctactcggcgacggtggaggaggcaacgtggcttgctcgggcgctactgccgtgacgaagccgctgaagtggcttgctcgggcgacgccggcggcgaacgagccaccgagcaaggccatggacgccgccgagcaaggccattcggtagctaggggcagcacgtgcatcaccttgtcatccctatccacctcattggacaccgcagacgtgacgtcgaccccctcgggagactccatctacgccgtcgtggacctgcattgacgggactccatctacgccgtcgtgccgtcgcggacatgcattgacaacatcccggacgccgcacgttcgagcacttttgtgtgcatgccggcggccgtgccgtgctggaggaggtgcagcgaagcctcagcctcggcgacaacgacatggagccgagcaagtgcacgcttgtcagggttatggataccacatacccaatagtaattgactaagctcagcggggcccaccacataccaagtcttatacggaaacaaacctcatatatagaaggagttccggataaggaaggataaatagagttctatatggaaatgacaaggactactcggattgtatccatatttatctccctagtcttacttggacaagggggcatctatgggtataaatacaagcccccctaggaggagaggggatacgccactgttgacgaccaaatttggtaatctaaggatcagagatgaagaagaaatcgagaagaaattgagatggagatcgtcccagaaatagagtgaggatcggctgaagtccgaatcggctacggctaagatcggcagagttcgagtcggacggggttagccgattgagccgaatgtgacaatatgacgcagcatatgttgtcggtttaggttgatgtgcttcatgatgatgtccgcgcatggatagagtcctgagaaggcaattttatctattaattaggatattttatgtaaattccttagagatatgtttgggcaaaagtctgctgcaaagacttatggtatcttagagtttgttagagataagagtcgtgtccgatatggacatatcttgtaattctcgggtataaatagatccaaaccccatgtaatcgatagaacacacgtttaatacaatctcggcgcatcgccaccctttttactttcgttttgtttcgatgagttcttgctttcgggttgagctgcatcggtttcgatcttcaacaagaggtaaaactcgttatggcggcttgcgttctcgggattagtgcttacatctttatgacactctactcttgtttatgtaattcgtcaagttatcatatatcttacataatcttcgataacatcgttatctaacctacaatcggctaacatcgttatcttggactctatttttgacagacatagatttgaacagcttggttgacatgttttcaactcaggaaatagatagtctcatctccattattccagctgacaaagcaccagggccggatggtttcaatggattcttcatgaaaaagtgttggcatatcatagctcaggactattatagactggcagctcatttccatgttggaaatgttgatttggaaatccttaatagctctttcataaccctggttccaaagactgttaatgatttcagacccatttcccttatgggtatctaaaaatcttaattaaattgctagccgacagacttcaagggataattcttaaactgttgagtgataaccaatatggtttcatcaaaggaaaaaccatacaagattgacttgcctggtcttttgaagttagactttgaaaaagcctttgataccattgagcattctgcaattatttcagttatgtagcatatgggttttcctccaaaatggattgagtgggtacagatggttttctctactgcttcttctgctgtgttattgaatggggtgccagggaattctttcaaatgcagaagaggagtcagacaaggggatcctctctcacctctgctttttgtgttggggggagagctgttgcaaagagtaatcaacaaagcttttcatcaaggccttctgtcaaaaccaattaatgaaagcagtggggatggtttcccaatcattcagtatgctgatgataccttgatcttgttaaaagcatctcagaaagaagtcttctgtttcaaggctattttgaatatgtttgctcaatccacaggcctcaaggttaactataataaatcaagtctgtacccacttaatatgcctcaggacaaagctgtcttactatctggcattttgggatgtaagatcggttctcttccattcacttatttggggctacctttgggaaccaccaggcctagagtggtagactttgctccgttggtagacagggttgaaaggaggctgacagcaagctccatttttttacctcaaggaggaagattaactttgatcaactcagtcctgtcttctatcccaacctactacatgtcctcattgcagctaccagttactgtcatcaaggccattgacacagctcgtaagaattgtctgtggagagggaataacccttcttctacaaggaaatctctagcttcctgggatagggtgtgcatgcctaaggagaaaggaggcttaggagtgatcaatctgagagttcaaaacacagcccttcttctaaagcatatggtcaagttctataatggtgctgatttaccatgggtgaaattaatctcacaatcatattatgagtataaagttccacacttgatgatgaataagggttctttttggtggagggacatcacatctcttgcagacatattcagggggatagcaaaatgcgaaatcaggacaggaagaactgcccttttctagaatgatttatggaatgatgattttaagtgcaccagctaccccaatctctttgctgtgactatgtatatgtctgattcagtcaaggccatgtgttcaagacccttagaagactcttttgcactacccctctcagatgaggcttattcggaattcttgcagcttcagggggttctggacagtttgactttacaatcagggatgggggatgcttggaattttatctgggactcagataagtacacagctaagaaattctataagctaaattattctgcattgcaactccccaggcccatgatttggctatggaaaacaaaatgtgtcatgaagatcaaagtctttgcctggctaatgttctgtgataggctcaatacaagagatatgctggatagaagatattgtgccaaagaagatgatgatctcacgtgtgttttgtgcaatgcgaattgtagagagacaaggctacacctcttcttcttatgtcctttcagcatcaggtgttggcaatacctgggaattgagtggaataataatttggagtttttcccaatgatatccctagcaagaatcaaatttgctcagaagggtttcctggaaattttctttttggcagcttggcacatttggaagcaaaggaatggcttcatatttcagaacattcagccctccttccagacatggagatctctttttgtcaaagaagttcttctgcatatgtgcagaatgaatgatcctttaaagcaaactgtttttaattgggtacaaaccttatagtctttctgtgtgacccgcatgtaatctctgtaaccttgtaaatattttctttatttataaaattacactgttgggcaaagccctagcagttttcctggtaaaaaaaaacatatgctaatagagggcagccgaataggctaaataacgacatttgcttagattatataggatatctaccactctaggaatcgtccagtgacttgattgtctagatattgttcttcttttcatacttaatactgcatcagttgagtttgatctattaagtcgtgcttagaatttcaatctctagcctgccttctggttgccgattagggtagcatcggggtttcagccgatcttacctgatttaactacatctattttatacacctgattgacatgttaaatctgcgctttatagtaagatcttgtcgcatttaagtatattagtcttttgtttagtatattttacttgctttaatatcttaatatagagtagtatcggagtattagccgatacatgctagatctatataatcggctatgctataaacgtatatagtcttgttattaatatatattttgattggagtgatttatactgtctcggcatgacgaccgatctatcccaatcacttgatttaattatatatcgacataaggactatatgtcgttaatatctacatccgatcaagtagatttagttctttcttacttattaatgattgccgatcgatgcatatatgacatcggctcaaagataaatgatatgtcgtcggcacctagctgatcggctatcgtttatggatttaaccacggtttctttgtccttgtttcttgttgattgcaggatcaaatcaactggcacgctagcatacccgaaggcgagttttggacctgcattggagttaagtagatctctcaggcctcgtgtttttacatcaacaatcaacggcggcgacggcccgatgctgggcaaatctaagccgtctgatctaatggatggctccaatcgtccctgcgccggatgatgcgccgaccgagagagaggggcaaaaccttagctcccaaatcgttctctcccgatcccattgccgattagggtagtatcggggtttcagacgatcttacctgatttaactacatttatcttatatgccttattgacatgttgaatccgccctttatactaagatcttgacgcatttaagtatattaggctttcgtttggtattttttacttgctgtgatatcttaatatagagtggtatcggagtattagccgatacacgctagatctatctgatcggctatgctataaacacatatagtctcattattaatatatatttcgatctaagtgatttatactgtctcggcatggcgaccgatctatcccaatcacttgatttaagtatatatcgacataaggactatatgtcgttaatatctacagccgatcgagtagatttagttctttcttacttattaatgattgccgatcgatgcatatatgacatcggctcaaagataaataatatgtcatcggcacctagccaatcggctatcgtttatggatttaaccacagtttctttgtcctcgtttcttgttgattgcaggatcaaatcaactggcacgatagcatacccgaaggcgagttttggacctgcactggagttaagcagatctcccaggcctcgtgtttttacgtcaacacgcttttggcacgcccggtgggacagatcagaagtcagaatcacaacagcaattttcctcatggccgagaaaccgccagcatcgccgtcttcggctggtaaagatggttctgctaagtcgaagttcccgaggcttggtctatctgagattaatgatgacaacatcgtacccgtcactccggataagttgacacctgagcagcagatggatcttgaggcaatgatggagcaagcacggaaccaattcttgaactcattcatggagacccgaaagggaacgcttgttcagaaatataaagtaaaggtaattgctgatgttcctaggacaggttcttccaaagatggagaagtaaagcaagcttcagatgatgcagctcaaacaagtgataaaggtgctgcagatgactctcagggggttcaaggtgatggctctcaaggggttcaaggtgttggctcttagggggttcaaggtgatggttctcagggatttcaaggtgggaatcttaatcaggatggcaatacggcacaaggatttttcaataacttctaagatcatgtcgactatgctatgcaacacgctttgatcaaccaatctggagtgctagtcaatactttgtcaaatatggtgaagtcgattgttgatggcacaatagctgaataccaggctacaggaccggtttatttgccaggaggtgttttcccgaattatcggcccttaatcaccgataatcagccagctgttaagtcagttcctctcaatgcaccatcggctcagccgacggcaccagtatcagctcctgcacctgctgtaccatcatcggcaccaggtcaattagttaatcctcagttgttggtgagagaacagccacaacatagtggacagaatgtgaatcggctaactcaagaccaagttgcagttatgttcttaccacctcagcctactgctgacccaatacaacaacagccgattcaacagacaccaccaagccagcaggctttgcagtcaacgcaacagacgccaccaaggcagctggttgtgcaaccgatccagcaaacgccattaaggcagcaggttgttcaactgattcagcagcaaggtgtgataaatgcatcggctgggtttgcaacatcggacaatcagataaggcagcatactgcgaatcaagttgtcccagagcatttggttcatcatgtacggccagaccaaacggtgatgcctcaagttgttcctaagcatttggtgcgcaatattcagccaaactttcaaaattaccagggggcaatttgaattatcagtatcagtctccttcaccgcaagttcaatatcaacagggaggaccggctcaatcccagtttgtttctcaatacaatcaattcgagcccatgccacaacaagctcaaggagtgcctcagcaacgaccatgggctgatatgattgcagatgtaatgagagacagtttggactcaagccgaaggatgctgggaatatgtatcggcacccataccctgaatggtttgaaagggtacaattgcctaaccgatacaaaattccggatttttcaaaattctcggggtaggacagtgtttcgacttatgaacatgtcagccgattcttagctcaatgtggcgaggcatcggctactgacgccctgagggttcggttgtttcctttgtctttgtctggatcggcttttacttggttttcttctttgccatatggatcaattaacagttgggccgatttggagaagcaattccacagttatttttatagtggggttcaggagatgaaattgtccgatttgacggcaatcaagcaaaggcatgatgagcccgtgaaacattatattcagaggttcagggagatgaggaataagtgctacagcttgagcttgactgatgcccagttagccgatttggcttttcagggtatgatagctccgatcagagagaagttctcatctcaagactttgatagtttgtcacatcttgcacagaaggtaaccttgcatgaacagagatttgcagaagccaggaagaactttaaaaaggttaatcatgtttgtcattacatatatggatcggacgatgatgatgaggatgacaccaaaatagcggtagccgaatgggttagaagcaagaaagttataccatgccaatgggtgaagagttctggaaaagaagaaaggtatgactttgatattaccaagactgataagatttttgatttgctacttcgagagaaacagattcaacttcctgctggtcatacaattccatcggctgaagaattgggcaagaggaggtattgcaagtggcataattctgggtctcattctaccaatgattgcaaagttttcagacagcagatccagtcagctattgagggaggcaaaattaaatttgatgattccaagaggccgatgaaggttgatggcaatcattttcctgtcaatatggtgcacacatctggccgaacaaccgatggaggaagagctagaggctttcaggtgaattcggctaagattatcaataagtaccagaagaactacttcaagcaacatgagaggcgttataaggaagataatggtggttttgatcctcattgggaaaaaaagttctttagattttgctggaatgagggtatgaggctgccatctattgaagactgtcctgggtgtggtgatattgcggaaagttcaagacgatcgtataatagaagcaatcggctaaggcagactagggttcctgttcatcagaggttgggcccagtaaaccaggatcatgacaaaggagatgatgaggataggaagactcagtggtgttcttttggtatttttacaaagaatcaaaagagaagggttcagaagttgaggaatagagaacgctttcaggagttgagcaagagatcaaccatcggttgaagaagacgaagccaaaataggagtggcatgttaagagtcaagttcctgtagccgatgaagcaaagagactagctaaaggaaaaagtgttgtgactgtatcggttaacatggttttcacgttgtctgttgaatttggggtcaagcaagctgatgtcgatgaaattgaagaagaatcggctaagttacttttatcactagaacaagcagtcttcgagaagccggaaggaacagagaatcggcatcttaatccattgtatataaatggatatgtcaatgggaagccgatgtccaagatgatggtcgatggtggggctacagtaaatttgatgccttatgctatatttagaaaattgggcagaaacgttgaagatctcattaagacaaacatggtgctcaaagattttggtggcaatccatcggaaaccaaaggagttttaaatgtggagctgacagtcggcagcaaaactatccctacaacgttctttgtcatcgatgggaagggttcctacggattgttgcttggaaaggattggattcatgccaattgttgtattccttcaaccatgcatcaatgcttgatttagtggcaaggcgacaagattgaaatcgtgccagccgacaggtcagtcaacgttgccagtgccgatttagcgctttgggagatggatggtctcgattgcttatctggaaaagtttgggatggagattttctaaaagtgtccgattctgatatacagccgattgaagatggagaacccaagctattattttgagggcgtcgtggagggttcaaacgtctacaccaaggacacaatggatgatctcgatgacaaacagggacagggtttcatgtcggctgatgatttggaagaaattgatataggtccaggtgat

SEQ ID NO: 20161 - DNA, 10841 bp, Oryza sativa
atttgaataaagctaccccaaaagacgagtatccaatgccagtagccgatcagttagttgatgctgcttcagggcacaagatattgagttttatggatggaaatgcaggatataatcaattttttatggctgaggaagatattcataagacagcttttagatgtcttggtgcaatcgtcttatttgagtgggttgtaatgacttttggcttgaaaagtgctggagccacgtttcaaagagccatgaattatatatatcatgatctgatcggctggttgatcgaagtttatattgatgatgtggttgttaaatctgaagagatagaggaccacatagccgatttgatgaaggtttttgaaagaaccaggaaatatggcttgaagatgaatccaacaaagtgtgctttcggtgtatcggctggccagcttttggggtttcttagtcatgagaggggaattgagataactcaaaggagtgttaatgccatcaagaaaattcagcctacacagaataaaacagaattgcaagagatgatcggcaagataaattttgttagaaggtttatttctaatttgtctggaaggttagagccttttacactattgttaagattgaaagccaatcagaagtttacttggggggcagagcaacagaaagctttggataatattaaggaatatcttagctctcctccagttttgattcctccgcggaaaggggtaccttttaggttatatctatcggccggtgagaagtcaatcggctcggttctgattcaggagttggaagggaaggaaatggttgtattttacttaagtcatcggctcttggacgcggaaacgagatattctcctgtagagaaattgtgcttgtgcttatatttttcctgtacaagattaaggcattatctattgtccaacgaatgcactgtcatatgcaaaaccgatgttgttaaatacatgttatcggctccaattttgaaaggaagggttggaaagtggatattctctttaacagagtttaatcttcggtatgagtcaccgaaggcagtcaaggggcaagcaatagccaattttatcgttgatcatcgtgatgatttgatcggctcggttgaaattgtgccatggactttattctttgacggatcagtatgtactcgtggttgcggtatcggcttagtgataatttcccctaggggggcatgctttgagtttgcttatactattaaatcctatgcaaccaacaatcaagctgagtatgaggcagttctcaaagggttgcagttactcaaggaagttgaagccaacgctattgaaattatgggagattctttgctagttatcagtcagttgggaggagagtatgaatgcaaaaatggcacgttaatggtttataatgagaagtgcctagaactgatgaaggaatttcggctagtaactttgaagcatgtatcacgagagcaaaatactgaagctaatagtttggcccaaggggcatcgggatataagccgatgatcaaggatgttaaagttgaggttgctgcattaatagccaatgattggaggtatgatgtgcatcagtatttacagaatccgtctcaatcggcttctcagaaattgagatataaagcgttgaagtatactttattagatgatgagctttattatcggatgattgatggggtgttgctttaagtgtttaagtgccgatcaggctaaggttgtaatcggcgaagttcatgaagggatttgtggcactcatcaatcggctcataagatgaagtggttgctttgacgtgcagggtatttctggccgacaatgctggaggattgtttcagatattacaagggatgtcaagattgtcaaaaatttggagcaattcattgggcaccggcatcggctatgaatcctatcattaaacattggccatttagaggttggggaattgatatgatcggcatgattaatccaccatcgagtaaggggcataagttcatattggtagcaaccgattattttaccaagtgggtagaggcgattcctttgaagaaggttgattctagggacgctattcaatttgttcaagagcatatagtctatcgatttggtattcctcaaaccatcacaaccgatcaaggttcaatctttgtgtctgatgagtttgttcagtttgccgatagcatgggtattaaattgttgaattcttcaccatattatgcacaagctaatgggcaggccgaggcatctaactagagtttgatcaaattgattaagagaaagatttccgattatcctcggcaattgcatactcgtttagccgaagcgttgtggtcttatcggatggcttgtcatggatcgattcaagtccctccttataagcttgtttatggacatgatgctgttttaccatgggaagttagaatcggctcgagaaggacggagttgcaagatgatttgacagccgatgagtattataaccttatggccgatgaaagggaggacttggttcaatcaagattgcgagcccttgcaaaggttactaaggataaggaacgagttgctcggcattacaacaagaaagtggtacctaaaactttttcggagggtgagcttgtatggaagttgattttgccaattggaacttgggataacaaattcggcaagtggtcgccgaattgggaaggaccgttccgaatctataaggttgtgtctaagggagcatacatgttgcaacgactcgatggagaagtctatggacgagcgctaaatggaaaatatttgaagaaatattacccaagtgtttgggttaatgcatgctcggctagtgttgccgatgtatgatagccgatgtattcacatcgccttgagatggccgatattgttatatcgccctttgttgtttttcatattgtaatcggttgtggtttgccgatgtgcaatggccgatattgttatatcgcctttggttgaagttataattttatcaatgcttgacattgtaaaattaggggggcacatatatgaaaaattgcagatttttgagcaaaatatggagttcttttgaatcggcataaaagttattgagatgagttagatacagagccaaagtttcttagccgattacaaaaattcctagagtctattacacaagatatcactgagacagatagcgttgaatagccgacacggcccgttgcctaatttgttcaacttctttgatggcttgggcgtcttgagcatcggttccagggatgactcttagagacttggtcaggtcagcgacattcttgatagccgattttagccgtgacttatgttcttcaatagccttcgggagatcggcggtttcttgtgctccagatccagctcggcattacatttttgaagttgtgccaggagtttaatcttatgagcttcgagccgatcaatattggacttgattggaccctcagatagctaatcaagcttggacttttcttcatgtacaagctgccgattaatctgaattgtggcttcaatatctttacgttcccgacgttcggctagtcttagcttggctttctctagcttaaattggtgctgttcaagatagacggctggagtaagggcatcggctagctcatctgggattagagcttgaacttcatgtagccgagtcctgatcgacccacagtcaaccaccaagctgtctaatgacgacgcctctagccaatgcgagatatcttcaagtgttttctttacgtcatcagataagggagctaaagccttgctgctagtatcttcttctgtttcatcaagataatccttgatgtcaaaagaaaataaatcggctaggacctgcaaggtggaaaaatgacgatagctaaatatcaggacagactatacaaccgatttgatatttttgaaggtaaaacttactgggatggtaggagcagctggttgttcttcttcatcaacattgtgactacctgcagccgatggagaatgatcacttgattcggtctgcacaggaggaggaggtggctgcaaaagaataaagtgttatgaaagattggctataacaaaaaggatttatgtgataatcttactggtggggctggtttaagggttgctgcagccgatttcttcctcacagcagtcttctttttctgcaaatacaagattaatgatcgatcggcaatgaattaacatgactgcaaaaagggattaatgtaagtgatttacccttgagaaatgagctggggcagaaggagtgggaggagttcgtttgggagaagccgatggtgttctttctgtatcgctcacttcggctgcagcttgatcaacatcctcttcgatctcttcttcatccaaagcttgctcaatggatgaatctagggctggcaggtcatcggttggcttagttttctgtgacttggttttcttctttggagcctgagccgatgggtctactgccaatgacctggttttcctcttttttccggcatcggctgattctcttatgagcccttgaagaagagttgaagtcttgggggcattatagccgatgacaggaggagatggtccacctccattaggaatgagacccggagcatattcaatgtctctgccactattacttttgcgagtgggagaggattctgttgtctacaagatgagaagaagattaatcatgtttcaaatcggctaataattgttcaaacttgacaagggtaaagatttacctgaggaataacatcggggaacagatctgtcatatacatagaagctggttgatggaagatatgttttttccattcaccccaccatctgtcaaagttcttgctcctgaaccttgccagttctatgttctcgatgttgcccaagggaggtcctgggatgttgagtaactgatccatcatcagagttgatgaaatttctcctcgacattggattttatcagcaaagaacaggccaattggtagctgtcccattccaaactgtctggcagagctcatcggatggtagaattcataagaaacttgtatatttcttccttgatgaataccaacatgaaggatgtatgggttgattgaagttgagaaaacttctccagatttctgctatctctcatgattgatgtcttcaaatctgaagtccgatgggagatccaagtcggcagaattctcatagaagaaccagacacgggcgtctttttgaaagttttcataaaagctgcagaaccagtccttgagcagctcagccgataactttgctcctgaatcggctggtgtggatgcatattccccataggacatacacctgcggtgggtgcgttcttctccatcatcatcagcaatcggctctagtcttggaaattcggcttctgtcatagatggccgattaatggctttcataactaccagatttagccaagattgcaataaccaccatggtcctcctgctccaaccactgagccgacagaaattttagacgatgcattgttcagtgtttgatataggtagccgagaaggattttgcctagaggaaattgcctttttgattctagggcttcggctaaaaattgctagttggttgtagggccgcaacttgatccacagaaaaggaatttctcaagccacatcaggaggaaggccacatgttctcgaggagtgacagacccttggcccatatatgctgccacataaccagaccaaccacctatgcttttggttctgaaatcgaattggttcttagtgttcaaactcatagggttagccgatgaagtcacatctaatccagtgatcatggtgatgtcgatcagagttggggtcatcggcccttggttgaacaaaaaggcattaatggcattggaccaaaaataggtggcggcagccattaggggctcatccttagctgaattggctatagtgagggcgagtgcctggccgattccaatatcatcccaatgaacctgcttgctagccgatacgcgcttataccatgtagtccagcttttctcaggggaggttttctcgagggatggccaagatttgaaggtgttcttccaatggctcagattagggtttgctaatctaaaggggattctattggtttctgcaatgatgaattcagtagggtcggaatcaccaattggaccaaggaaatagtggttctcatgcgacagacttggaattgcacagattggacagatgctatggatgcaaacaagaatagagaagaagaaaacaatatgaggcaggagaaaaccaatatgttgcaaaagaaagagatctagccaatggatacttacctctgcatactcagccgatggcgcgacagatggactggcggaggtcgacatcgccacgagcggaaacttggccggggaggagatcgccttgaaatcactatatagtctttcttgttccacttgcaaggcaaggaaaaaaatgtcagtttcgttattacaaccttatttttttatgtcaaagacaaaaagctacgtgcaaattcttattggatctcggttgttcttaacagcgatggctattattttttatgttcatttaagtcttcaggtagcaccaccagatcttcaacaaggtggaaattctcatatttcgtatgtacggtctaaattattttccttagatacaattactacaatagtttactattataacaataagtaaaaataatatgtaagatggcttaaacaacataagcttacataaacattaggtgatgtgatttgaatttaaaatagtatgtagataatgattcaaatttaaaaataagatgatgtggctctatgagagaacaaaatatggaaaataatttagaccgtacatctaagggctaaaaaaattgagatgatatggcttaatgagataataaaagaggagtgtgacaccctgaaaattcgaacaacgaaaaatcaaaactccaaaaatatgggccttcaaaaaactttttcaataaattgcatcatgccgattctcttcgcctatttcattggaatttggtttcgaagtttatcagtcgtgaataggggataaataattaggaataaaacctaaaattaggttggcaaaagaaataatcaagatataatttaaaataaagattaggtgaggatagaaataaataaaatattatcgcgaccatatttgtatcaattaaatttaaatgcgatggaataagaattaactctaattaaattcaagtaaattatgtaaaaataaaaataacacatattgagtaaacttcatttatgcaagatttagaatttatagaatcaaatttatatgggaaataaactaacatcgggataaataggaaaatacactgttcattgcaccctagccctaacccctcctctgccgcgcgctctggccgccctgagccccgcgcgccgtcaccattgctgccgccgcgcgccgtcgccatcgccgccgccgcgccgcgccgtcgtcgtgtcgcctcgtgcctcgcgcccgcgcgccgctcgcttgtcccgtcgctgcgtcgcgagcctgccgcctcgcgccccgcgccactgccgcgcgccgtcgcgtcccgtcgtcgctccgagccgcgcgccgcccatgctgcgcaggcgccgtcgccatcccactgccgcgccgcgcgtgccgccgtcacctcgagccccgcccctccgtcatgtcgcccgtcccgtggccgcgcgccagtctcctcgcagcctagcgcccagcgcagccgcgccgccgtcgcttcaccccccctccttctctcccttttccccctctctcccctataaaaaccccaccttccccattctccccactccattccctcctcctcccctctaccctcaccaccgcgccatcgttctcgtactgccgcgccgccgccttcgtgccgctgcgccgctgcctttgtgccgccgtcctcagtgccgccgcaccacaccgtgtgccgcgccggggcttgcgccgccgtcgccgtcgtcgccgccgaccgccgctgtcggtaagccgccgccttcccccccccccttgcgtccaccgccgtcgccgccgggtgggccaaaagccgagagagagaggaagggagaaagaagccgggagggagagagagaaaagaagagaggaagggagaaaggagccgggagagagaaaagagagaagagagaaaaaaggaaaaagaaaagaaaacgaaaggaaggaaaaagaaaaagaaagggagaaaaagaaaagggaaataaataggaaattaggaggagatttaggatatttaaaatattaggaattaactataggattaactaaagtgtagtatttgcaaaataatactataatcatagattattataaattattcttgataatttctataagaaatcaattcgcggtagtaatttagatgtaatttcttatagattattatagattatttttggtaatctctataagtaatcaatttgcggtaggaatttagatttatttaagaactaaaataaaggtgttgaatttttaggaaaatttcttaggagacacaaaatgtcttaggttgaggaatagttctatttcgcgaataatatagtggatataacaatcgcctctcgtgctcgcttttcgatttggtctttattagattttatttgaattctagtggaattcaaatcaattctttgcacgtacttgtagagcctgagggagttgcggatccgagtgaaggccaagacccgctagactttgagcaaggcaagtcatcactattctttgaacatgttgatcccaattgcgaaattgttttgtttacaaataaaattacatgcaatgatgaacatcctacttgtgattatgccatgccttgattgttgtctacccttaaaatctttgtaaccatgattacgtatgagtccctagtcaattatgacgattgcttagaaatgctattctagaatcttgcatactcatatttgtcaaatgctatatgcttgggcaattacctttgggaaggtaattgagatgcagcatgtggagacatgagcgtcacattgccatgatgttgatgacatgatttgtgaaaggagaaataaaattaaacaactattttcgactagggcggacggaggatttgggtggtgtccggaaaaggctagtgccgtccctggtcaattaaggaccgagccatgaagttaagcatgaaacgacccccgtacaaccgcacttctcgtatgggtatagacctagtggaatagatagctgagcagaggcagtatccatgcatagtggtttcttgatatgtgaggcaggggctctacggtggggcagccattggtaggacagcgaagcgggtgtctacaatggtatcgccatcggtaggactgccatgtgagaatctaaacataattataacctaatgcatgtgtgagtcttcctttcccgggtgcgccagaactcctctcactgctagaaaccgtgtacgcctagagtgcatgaggatgtaaagttcatggagcgggtactgccaatgcgaggttatcgaaaagctttgccgtgacgcgtctcatgtgttgggacgaggctcatgtgttgggcagtcgcggagtgtgggtaacgtgtacatccactgaagtgtgagtaaaccgaatctattcaaatagccatgctcacggttattgagcaccgggacatgtattacacttggctagactctaaattcttaacttgtatgggatgggatattgcatgatgatttttatgctgttggagccacttcctgagagacaggaaggtggacgtcctcagaaaaccatgacgactcaatggcgggaagctatccttgggatcacaatggatggtggacagaaccgtcattgtttaatatgaacactggtactaaaatttggtcagtctatgctaggtcttaggcttgtgaaaagaattacaaaacttgctttgcgcaaaagaaccatagccattccttgaaatactcctatcatgtgcattgttgctgtggtggcttgttgagtacggttggtactcacccttgcaatatatacacttaatcagaggccggagatgaagtttcggaggatccctatgcctattaccaggagggtgatgaagacgatggcgctcagtaggtcttagttacggttgttgcctgtggcaatggtgtgccgctggcttaactccgctgccttatctacttctgcttttggaatgtattccggaccgctcggttcgataatctaagactatgccggcgggcttatgatgtaataattcgcactagactcttgtgtgtgtgcatttggtatttcagctatgaactcgtgtgtaccagactacttgatctagggaaatggtactgtttacacgattgattcctgttataaaaacgggggtccacaaggagagataattggaaccatagattaatcatctaaggactaaaaacaattgatgatatatgacttaatgagagaagagaaaaataatgatgaactatataggtatataggatatttaaaaaatgatggagagatatattgaaatattatgtgaattatgtgggataatttaacatgcttatattttaaatctctaaaatttaataaattattaaattataaataatgtactccctccatctatttttgatagacatatttccaaatctgaaaattttatttttcataggcatatttcaatccaacaacatatcctcttaatgactttctcaaatttaatgcttcactctccattttttcacacaagattggctacatgggtatcgagaagtgtaaatgttaatggatcgcttgtttacgaggaataactagtagcatgtttaaatggatgat

SEQ ID NO: 20162 - DNA, 32429 bp, Oryza sativa
atgcccatgtagccaatcttgtgtggaaaaatgaagagtcacgcattaaatccgagaaagtcattaagatgataggttattggattgaaatatactatcaaaaataaaattttcagatttagaaattgttgatgtgaaaacacgaggcctgggagatcttcttaactccagtgcaggtccaaaattcgccttcgggtatgctagcgtgccagttgatttgatcctgcaatcaacaagaaacgaggacaaagaaaccgtggttaaatccataaccgatagctgatcggctaggtgccgatgacatatcatttatctttgagccgatgtcatatatgcatcgatcggcaatcattaataagtaagaaagaactaaatctactcgatcggctgtagatattaacgacatatagtccttatgtcgatatatacttaaatcaagtgattgggatagatcggtcgccatgccgagacagtataaatcacttagatcgaaatatatattaataatgagactatatgtgtttatagcatagccgatcagatagatctagcgtgtatcggctaatactccgataccactctatattaagatatcacagcaagtaaaatataccaaacgaaagcctaatatacttaaatgcgtcaagatcttagtacaaagggcggattcaacatgtcaataaggcatataagataaatgtagttaaatcaggtaagatcggctgaaaccccgatactaccctaatcgacaaccaaagccaggctagagattgagattctaatcacgactcataagatcaaactcaactaatgcagctataagtatgaaaagaaggacaatatctagacaatcaagccgttggatgtatcatagagtggtggatatcttatataatctaagccaacatcgatatttaacctaatcggctacattctactgacagatgttagccgattgtaggttagatagcgatattgccaaagattatgtgagatatatgataactttgacgaattacataaacaagcttagagtgtcataaagatggaagcactaatcccgagaacgcaagccgccataacaagttttacctcttgttgatgatcgaaaccgatgcagctcaacccgaaagcaagaactcatcgaaacaaaacgaaagtaaagagggtggcgatgcgccgagattgtattgaacgtgtgttagtttgattacatggggctcggggtctatttatacccgagaattacaaaatatgtccatgtcggacacgactcatatctctaacaaactctaagataccataagtcttcgcgtcagacttttgccaaacatatctctaaagaaattacataaaatatcctaattaacagatacaattgcctcctcaggactctatccatgtgtggcaatcatcatgaagcacatcaacctaaaccgacaacatatgctgtgtcatatcgtcggactcggctcaatcggctaacctcgtccgactcgaactctgccgatcttagtcgtagccgattcggacttcagccgaccctcactctgtttacgggacgatttacatctcgagttccatctcggtttcttctttatctctgatccttggattaccaaatttggtcgttaacacaaatatgcctatcaaaagtagatggagggagtaattgttagtggatgatgacatgacatatttgcatgctaagttttaaaaattagtgggctataaagtatagtaagagaggatatcattaagaggctacattgattgtatatttttttcttaaaaaaagtagtcatatttgaaagagcatctatgcctctagttggttttggtttattgatgacaaacgattatgggactaatgcacttattgagtgtataagcaagtgattagtccgatgaagaagctaggaaatggacttatcgatggatgagaattaaagagaagatattgaagatgcgggtatgacgtgactatctatggcaagacggtgaagcgcaagcgacgctcagctgcgatggaccatgcggtggtgaagggcaagcaaggggcttggtgctgacgaatctaaaccggtggtgaagggcgagtgaagaatgtgtcgtgatgaaccgtgtgtcgatgtaaaaacacgaggcctgggagatctgcttaactccagtgcaggtccaaaactcgcctttgggtgtatgagcgtgccagttgatttgattctgcaatgaacaagaacaaagacaaagaaaccgtggttaaatccataaacgatagccgatcggctaagtgccgatgacatatcatttatctttgagccgatgtcatatttgaatcgatcggcaatcatgaataaataagaacgaactaaatctactcgatcggctgtagatattaacagtatataatccttatgtcgatatataattaaatcaagtgattgggatagatcggtcgccatgctgagacagtataaatcacttagattgaaatatatattaacaacaagattatatacgttcgtaacataaccgatcaaatagatctagcatgtatcggctaatactccgataccactctatattaagatattaaagcaagtaaaatatgtcaaacataagcctaacatatctaattacgacaagatcttaatgtaaagggcagatttaacatgccaatcaagcatataatatataaagtagttaaatcaggtaagatcggctgaaaccccgatgctaccctaatcgacaaccagaaaacaggctagagattgagattctaagcacgacatagtagatcaaacttaactgatgtagcattaagtatgaaaagaagaacaatatctagacaatcaagccgctagatgtttcatagagtggtggatatcctatataatctaagccaacgtcgctatttaacctaatcggctgctttctactgatagatgttagccgattgtaggttagataacgatattgccggagattttgtaagatatatgataactcaacgaattacataaacaagattagagtatcatgaagatggaagcactaatcctgagaacgcaagccgccataacaagttttacctcttgttgaagatcagaactgatacagctcaacccgaaagcaagaactcgttgaaataaaatgaaagtaaaaagggtggcgatgcgccgagattgtattgaacgtgtgttaatttgattacatggggctcgggtttatttatacccgagaattacaaaatatgtccatatcggacatgactcttatctctaacaaactctaagatatcataagtctttgcggcagacttttgctcaaacatatctctaaggaaattacgtaaaatatcctaattaatagatacaattgccttctcaggactctatccatgcgtggcaatcatcatgaagcacgtcaacctaacccgacaacatatgccgtgccatattgtcagattcgactcaatcggctaatcccgtccgactcgaattctgctgacattagtcgtaaccgattcggacttcagccaatcctcactctgtttccaggactatttccacctcgaattccatctcgatttcttctttatctccgatccttggattatcaaatttggtcattaacaccgtgtgaggccattcgaagccacggattatccgcattagtcatttgagaaatggaagatgaaatgtcaaagatcaagaagatgagatcttcccgatgatcaaatgaccttgacgttggtaaccctccaagtgaagaaacaatatggtgtgaaggtactcctattggtataactttgctttttaaatttgagtttaggatgccgtactattaagagggataccacatgcatataattggttgaatactagtgctcaaaatgcttcatctttgtgtgagttgaaaaacctaagccaaaatttcaatccccagttgtttcttttgtcacaacacttacaccgggtttctttgcaagtttttcgacatctcttgatggttttggaccatgttttatgttaggtttgatagcccatgaaactagctttccatatagtccaagatcttcgaaatcggagttcggagtaaaaaagttattgcatttttacttgagcaacatcagactatcagatttgaaatcagactatccgatgtatcggactatccgatttttcacagaacttcactctctgtcttgatttgaaaaaatcctatcaagtgagtttttctaagtatcgaagtatccgatgtcggatcagaaagtccgatgatacaaagactccgaaatttcatggaacttgagtctctgtttaaggacaaagtttttgcttctaaaatatcggatactttgatttaacatcaaatagtccgatgtctcggaaagaccgaaattttatggaactttgttctctgtttctcattgccttggaggtttaaaatatcggactatctgatcttgtatcgtactatccgacgtgggctgaaagattcccctctaacggtcacattttggggggatctatataaaccccccaccaacccttttctagggttgcccaaactgatttcatcccaatcttgctttgtgttgagctttgtgctaagtgctttggatttttgaactctctccctctctatctcaaatcccccttgttctttgtgacttggatctttgtgtgtggatttggagtttgagagtctagtgtgtgtttctctttatcttgagcactaggatttgtccaagagttgtgtggtgtttattactcttggaggttgagaactcctagatggctaggtgtcgttcttgggccgccgatctacgtgtggttggccaagagaagtttatgaaggccagatctcgcctccgcaaggaaagagatacccttattggaaggaggagtgcatttgtgcaacctcacgaggatagggttgaaaaagacccggctctttgcgagcccctcaatggagactagaatcccctcaaggatttgaactccgggaaatacatcatcacataaacctcggtgatatgctcactctctttgccttcttgttatattgctttgtgccatgctaatcttattgtgggttgtgctcacctctttgcttgtggattggatctagagcttttaagttgttgcatgtttggttgttgttgtgcaggttagatagtctgatctcagttcagataatctgatcacataggactatccaacttgatatcagacaatccaaccctgttttgttttagcttccgcatttatttctaaaacgcctattcacacccccccctctaggcgacatcaaggtcctttcaatatgcattggttgtgaagtagtcataaggcgagccaattttggacataaactgtggttgcgaagtacttcctccatttcatattataagactttctagcattgcccacattcatatacattaatgaatctagacatatatgtgtgcctagattcattaacatctatatgaatatgggcaatgctagaaagtcttataacatgaaacggaggtagtagtagggaagtagtagtaataatatagtagtaagatggaaaaaagtctacccttaactaaagcccaagagcaagtttaatagtatagtcaattattagctccaaaccttatatagccaatataatagaccattcatacaatagttacccgtaaatttgtactatatcattaatacatggcctcatctctcttacacacacaacgtttagaagtttgtgctaccgttggctacaaatctgtagcccgcttttcttctctctactctcttatttcctccacatgtgcttatagcttatttgtagccatacttgctctaaaggggcgagttgcattcactagataaattttaaataaatttaatgaaaaaaaatattataaagcatgacccacaaaagtaactatttctccacctctctcgttcacaccacctagtccgccgccgccgccctcccaagtcatggtcacggcattgtgattatggaatgtgggcacgactgtggttagggaggaaggcgtcgccgccaatagaggagaagaagaaccggagctcatgaaggtgggggaggtagtcccagccatagtcgacgaagaagtggttggccgcattggctcaggcgaatacaagggtgggggcaccttgggcttgagcggcttagcctcataattccactgaaatctcaccagaaaaaatagtgaaaattcatgtgtctaactttgaacacattacttagccctagacttagccaatctctgactccgcccctacgccagtagaggcaaaacatggcaacaatgtccccgtcgcatggtggctactgggtgctcgccacatggtggggggagccgctgctgtggctatggcagccctttcgggcaggaggtggagcaggccccctaggtcacctccttgagatcagtggtggtctgggacggatacgtggatgggcggctatggaggagagaggagatgaggtgacgttgcatgagctcggtgagggcgaagccgctgcctacgttgctcgggggagaggatagagaggagactaggcagccgctcgagcttagtgttggcatcgccgctgctcggaaggtgacgacttgtcgatgcctcgattcatctttaatttcgatagtcaccgccctgtaaactattgggcgcctcgcatcaaactattgttgctattgacagttgcaatacgggggagccgtgacagcggagagacgggcgcaaggcggtagggccgacgtccgccttcccacggacacctgacggtgagctcatgctaggacaaatcaacgttaggtgaaggtgggagtgccaccatcctctccttccttcaccatcaacgcggcgccgccatcctttgtctcttgccgactcgtctattaaggaagggcggttgacgagcttggaacgggaggctggaggaggagagataaagaagtgagcgattaaatgtcactgatatgtggggggccactattacttttttttagaaaaaacattttacttattattagaatgtcccacgtagatgccacatgggttgaagatgaagtcaaccctcagtactgtcccttagggctatatttactttggttttggaagacgtgggattttgctgtcgagggacgtgcaattagatagggatgtaaagtggacttgtcctaattaagatcgaagccgaaagttccttggcccagtagatgtgcttaggacacgtccctttctaattacggcccgttccgtggtgaccgactccgatccgaggcgagacgcgacgcgagagagatccgatccgagtagaagaagacagaagagggagatggaagggggaaaaacacaggaaaccctagcttagcagtaccacgcacccacgcgggctccgtcaaatttcatccaaaaaaaaaagtgtttccgcccgcgcggcggcttccctgagagagatcgatcgatcggatatccttgtggattactattaattgttgcatggcaacgaggagaggggatcgaagaaagaagaagagtagtactagtactagtgacggcggggagaggatgatgagggatttattgatgatgcagcgattggaggtggaagaagaagaagaagaagaatcccaagcggaggattatgagattgtgatgttccgccgcgtctggacaagatggcacggtcgtaactttggctccttcgacgataccagtcagtatctacatcttcttctcctctcttccaactccaaaacacaagattaattaatttctattctagcgattaataatccttattagttaacaataatcgatcctatgtgcagcttatccggccatgcgttacacgtttggacgcatcccgaaatcaagttttgctggctgcgacaacggattgcagatcttctcaatcaaactcctcctccgcaacagaccatcagctccagtggccacttcatgtctatggcctcgtcgctaccagggactctcttgatcctaggcgcaaccttctctttaatcgcactagagacaactgccaaatccttactcaacaggtatatattattaacctcttcttcttaattcgagtccattaagaggttgattgactagctcatatatatgctcttaattgcaggatccctttctagtgctaacaggaccgtctcgcgcaattgtcttaattgatcctgttcaatttgaggttcagctcaaagcaaagtccaataacaacaccctgcatgatcatcctgaccaagatcaaattgttaactttggagtggtggattctggctatcttccaggcccaacgaggcattgcatcggcaagcggagtgaggtcgagttcacaatctcagtgcttgatcgatcaattgaggccactatcatcagcgtccagcttgttggtggctcgtcatggccggatcatctccaaggaaagcttgtttcccgtacggccagtgcaattcatcaagaaatcgtgctacttgattctcaaaaacaacaagatggaaaaatgcctatcgatgatggcggcttcattcagctttcaaggcgtgttgtttcggtagaactggctggccaactcatagttcaagtgctggctttcaattcccagcagcaagtagttgacaatgacaacgacaacaagaaggatgagattgttgcaaaacacgagattgtttttgatcctaaggaagcttcattgagtgtggagacgtgtgagctacaactaggaggaggaggaggaggcccatgtaagcttcaaatctctgttgcttggtctctggtcgataggcttccccctgttggctatttctaacttacccatttcgatcgctgccattccaaattactatcatgctagctagtatctctattcagacaatcatatatatatttgagacatatatagttccaattaatcttataaaaaaactggctaatatggctattcgggtatcgcccctgtttgatttggctcatgatggtttgcgtattttgggggtggaatttcacgaatctgattcccgatgttgggtttgttttgagtttttgcgtctgagctccgcgttcatggggcgattaagggcaaatgctgcgtacctgtctctctggttcgttaacaaattttctctttcctacaaaggccaggtacaagtaattattcaaagaaaaaatgaaggaaataacatgtataattagctgttgatgggtaattgggtagagatctgtttgaaccagaataaagatgatgatcaccaaagtaaaggttggtgacatggcatgtatgtaatatatgagtatatattgtgagatgcaaagaagatctgggaatcgcattttgtgtacaataagttgttcaagtgagtccaatctttgagtgatgttctgtgttacatcactcttggagtgttatgtaattgttcttcacatcaaggcacaagtagtctctgacatgaggttcctttttccgtaaatttgatttgctcactgctacttagctatacagggtgaagaaagaagtgcgaaatttccgaataaaaacaatttgtgcttgattgcatagtgtggatatggcccaagctctttggactgttggtctggaaaatgaataagtcccaatagttcaggtgttggactgacgggattgggttaaattaatgcctccttacatacataaaggaacctaatggttactgtttgtgactttttaagttccacataattatttagatgttctatagttcaggtgttagagcagtgtgatgataatgtagggtgagtcatattattttttcctctactgaagtgcaatttctaagatagtttcacgctgcatcctttctttttaattttcatgcaacccagtttaagaaccaattttaagaaagtcataaagttgttttggtttcaaaatggtctgtagttctgtagaaagctttttttttggtgatgctacagcagtaacagtaactagtcttcctcacaagcaaaagctatattagactttgaggcacaatttgtacccgtgggcttaatttttaaatgctgcactccttttcggacaaatggagttgcataaacactgatcgaggcatggaatgtcatagtttacatatttgagatttggcacaagcgttcagtgtgaacgttgcagccaggattcgattcctgaactcctcacttttcgcctggattaaatgaagggatgaaaatatgtggctcttcttatcttaattccattggatggctagctcctagccatcgcaacaatacttgtgtagctgaatcagtaatgcaccataacgatggtgaatgcaagattttaaattggaaaaactcatcctctcacaacctacaacatctaattagctttgtttccctgtacgtggtttctttagataatttagctctgttctcggctattcagttatgatattctatgggtctccccatagtcgagtcctctcgtaggttggcctttttgctttcttagttggtcggtgtcttggtcatggaggctaggcatgcaggcggtgaatttagtggcggtggttgtcagaggtggtcgggagccagtgccctgaatcgacggtcttggagacagcggtcaggagctggcaccccgaatcgacggtctcggcagtgacaacagcgggagccaacgcccctcctatttgacggtctccttgacggcaacagtcaggtggtggcgccactagtaaaaaacaatttttctagatgggcgacagagtcagacggggggcgacgaaggctttcgtggctgctcggcgcttgcagtcacgagccagatgttggaagccccagcagcggcggcaacgcaccgggagacggcacgatcgaggcaacctggtgcaaggtggagagacagttgaaacaccggtcgagaaggtccggtgggatgccgtgagctcctagctgcgccggcggcaaggaaggacgtggctggcagcggcggccgcccggatgccacccctccagagctgggggcacagctcccaagagcccctcgaagatttcagccggaaggggtggttgtcaagccggcgaggtggacgactggtgcagaggcggcggccgacaagccgacagagacggactgcgtcacgactcggcgccggaggagcacgttgcggtggggcgaccggggacagggagggcggccgtgcctacggcgaccatcgtgccacctctaggtaggagggagagggcgagggagaaggggagagggatgacgagagctcgacccgggccgcgctatctggccgctctgccacctcgtcgctggtggcgccgcccgccagggcgggaacgacgacgacagagcggagagccatggggcgaccgacgcgggtggcaaccggggccggagcggcgtccggcacgggctcagggccgctaccgcctggtcggctacatctcggcggtggtggcggcgatgagccgccttaatcgagcaagttaatttacaccgggggttaacatgtgtatgtttagtggaaatatcaatcctatgtgtaccgggcaattccaattctcttttaatgtggttaatctttaatatattttttaagtctaaaacaaagtccatgcgcgcggacacatgtatgtatgtatcttggttcgcactcatgcatgcacgttaatcaccagagttctactatattattatatgtgacctttttcttccctagtttttagcagtcactattgattaagttttcttctcttgactgggccttaattaccattttcatctattttcgcaaccacatagtaatatagctatgtcatgcggtttggcagctttgcatacatcacaaatcaatggaaagtggagggaaaagaaagaaaaactaatataattaacctgaagatcgatcgagtatggattcgaatgataatggcaacgaaggaaacagcaggtgccttttgaatggcaggcaggcagcaaaagtctcaaaagtgatggacgatgaatggatcctgcaactacaagtgactttaccatgacatgacactaatgctaatgcccaatgcaccgcaactttgcactaaaaggttaaattaaagctagctaggagaagaaacaatacagtatatattagtgcccccatatgtacgtggggccggctacctgcaatcttattggtgcatgatacatgggaggatctctctatttatataccaatcaagggcaaattgatccaagtcactggattcatcgtcatcaaccatgattccatatgtgtgtagtttgtacgtacatacacaggtggtcttccatcttaagtcttcttcagacttccctggtcttttaatcgatcttcaatatatgcatcaagcgaccatgcacaaatgtattcctatatatcgtgcacggggagttaacatatattcagattgtcatctataaatatcagtaagatgtacatgtggctgtaccccaaccacatgtgaaaacaagatttttgcacgtggtcacctaagccgactgcatgcgaaaataatttcggcaaaaaaaaatataaaaatctcctgccattgaagcctaaccaaatgtttcaactccaccaaaaaaaaaagcggagcgggctagaatatatgctctcacaaaatgaattagagatgtggagcagagggttcggtctgctccacaacttcaccacagaccttagctgttggagttaaatttaatagttggagcccaccaaaccttaaaattatacactttcctatctctatatataagtatatacttgtattgattgcatttgatacggtatacatgcaagaagcatatatatgctttgtcagctgccaccagtaatacatgcaagagaagaagttgaaaacatttggtcaagggtggtggtgatgaacaaacgcatataccagttacattattattggtagggaccgtatatatgcttatgctggctggtgtcatcgtctcaatgggtacacatcgatgtgtaaaaagttaggcctaagcttctactttagtatcaaatcataacaacataagatcgcatattaaacataccatatactatgtcttaaaatataagaattttttactctgacatagcatccgagatgttactttaacttaaaaaaatctataaaaataagatgttttaaataaaatagttacatattatgatatttgtttattgataaatttagtaacatcaatttttcataatttattttttattttttattaatagttaaagtcaaaaatatttcatttgttggagtattgtaaatctagataaaggttgctatactttgaaaaaaaaagtatataggccgatgtatatatacccgctataataattaatcgataggaagagcatccatcatatatggaggctgtgagtctgtgagcagctgtatgaatgtcgttgccaaagggacatcatttatacatgcatatctctctttattatcagctttatcgtttggcttataaaccaaacaacatatttgcaaacgaaaaataatttataaataaaacttttatataagtatttttggtgatctaaaagcaaagactaaaaaataaactatgataaaaaaaaccccctaaaatcaacttcaaatttaagattgaaaatttaaattttgggtgacaaacataagcgaaaaggcgaggctttatgtatattgatctaagtaattcttttcctatcattcgattcattgttaaatatacttttatgtatacatacaattttacatattttacaaaagtttttacatattttacaaaagtttttgaataagacgaacggtcaaatatgttaaaaaaagtcaacgacatcaaatattcagggacgaagggagtataatatatggatacccgcagaggcctctcaattaatgaggtcagaaaaggcattttaattcccttgcaacaaaacctgactaataggttcgttcgagtctttcttttcaccggcctgacgaaagcgggacaaaactttattaagataaaagaataacaaattagcaaggggcaaagttgtcgtggaaaacataaaagcacaaccaacacccttcctgacataacgagaaaggaatagtaagagagtttaataatatagtcaactgctatctttaaatttaactatagttaatttaatagtcatttcatacaaactagtaatatttggtctcatctgtcatgcacacatgcagctgactataaatctgtaacccattgctattctttcttttcatttatctttttgatatatgtttatagctgacttatagtctgctattatacatgctctaaaaataaaaatatttagacatccatcttgatcaactcagcttcgcaccgattccacggctgaatattacattgttccttaggatcaaatatatctacgtaaatacaaatgtgtatttagtggtctaacgcatgcctgcctgaaacagtactgtgtgagcgtgtgcattttgatctatgttaattgttgcaaaataacaagtattcctatttatatttcaaatagatgcatggctagctagctaattttgcttaattaaaatttgcctccttattcaccaagacgttaattaactttactttaggtttccagtagtactagttaattaagttaagtagcaaattaacgacacgtagatgagatctcagagagaaataaaccgccgcatgaacagtgcggaggtcttcctagctagtgtgtactatattatatagctagctccatgtgtggtcaattgtgctgaaagcaaacccacttacatactttcggtcactttcataataactgcaaattagttgaacatatatatatataaagtgaggaaaggaaatggtaacactgcaaattaagttcatgagagaattgtgatcaccttagcagatcgcaatagcaaggtgctaattgatcaccttagctcaactggttaatgagctttcttgtgatgaaacatgcgtacgcgcgcgggcttaacatagataccctcttttacactaattattttttagcggtaaacatcgcgataacaaggcacgtttgtgtgacttcactaatataaatatatgccggctcggtatatcaagattttgatcattaatttcttaaaattttatatagttcagcaccacaatatgttttaaaatccagcatgataataatttataattcacatgtgaatctatatagaaaattgatagtaaaaattaagtatatttaacatatatagaacaaaaagctaaaacaagctaagtaattttggaatatgcatgcaatgcaacgatataatccaacagctaagccccctctcatgcatatattgcgtgcgttatgcatatcctccgtccttctcgagttgacaaagtatagttgattaaatttaattgcttcgacatgtacagggacgtccactgtactcatgtcacaatcagagaaacttaagtacgtaggagtagtatgtatttacatgggcagcaaattatacgatccgtagatttaattaattaattagtaggtagctactccctccgtcccataatataaaaatttaggaccggatgggtcatttcatactacaacgaatctggacggaatattgtccagatttgttgtactataaaatgtctcattcggttctaggttgctatattatgggatggagggagtagcttaaagttagggcatgtttagcacagctccatctctcctggagttaaagcccaagtaaacagtttcagctccacctaaaatggaagtggagttaggtgaagctctcaaacaaaataaactagagaagtggagctaaattttggcagctccacaattccacttcagactcaactcctgaagttaaatttaggagttagagctctaccaaatggacccttagtatcaataactgtccataagaccgactgaaactagaagatacgtatgtacgttaaattaaccagtgtgcatgcctgtgtacgatctgtatgttcgaccaacggcgaccggccgcggccggccgatgcacgaagctgccctgcaggtagcaacaataacacgctacgtacgtactgtaatatactccctccgtactcgtaaaggaaattgtttagaataatgtttaagtcaaaccttagaaatataaatcatgaataactcttaagttgttatatttgaaaatataaaaattatatgaatagatttgtcttgaaaaatactttcataaaagtatacatatatcacttttcaataaatatttttatagaaacagaaagttaaagttgtattttggagaccgtgtcgctgtcctaaatgactttctttactaagtgtagagggagtacacatatatgtacgttgaattatattgattggagacattattatgtactccatctgtttccaaatgtttaacgctggttgattctattttgatctagtcaactagtactacataaaaaaggaaattggagggagtagtgtgtctgcatgtgtgatcactagcgagctgtatatataagtcaccttcataaaaaagtgcatgtctatttcgtgaaaacatttttacgcaattgaggtcctctgctgatagatgggtccgagaggctgtagaacccgcgtgtcagtgagcagtactacatatctgcatctatttttatgctcttccttttttctaatcaaaataattaatacaacagtttatacggtagaacatattttgatagacaaagtagcatctaaacttttaccgacagataattgtcctctttttagtgttgtggtatagcgctagttaaccacctctatcatactagtacattttatatacaccttgatcacacactttcatagttttatcaagctaaacctctcccaaaatacctcctaattaagcaccatagaaaaacccaaaatcttatcttaaaaataatttctgaaacaaaacacctgccatgcatgttgaccatgtaaaatgcgccgcggcggagtgggtgaagattctaacctgacggtgccgtgtgcctctatcaaaccacgagaagccaaccagtaaggagtactccaacaccacaattatttttagttttgatatttgctttatgccaaggacccagtgtccttgctaaaatcgtttgtatcgtagtgtttttttctatgaaagattgttactttttttttcacccctgtaaatacacacgcatatcctattgatacgagagtgttcgaaagataaggctgacatactttgagattaaaggagttatcacggtgactcattgttgatgaatacgttgcctaccactgaatgaaaaataatagtaagtttagaactagaatcaagtgagtaggtttaatcataaaaaaatctaaccagttgagctaattttatctcgtggaaagttgttattttctatagccaaatacgatatattttattgtctcggtcatatatatgcaagcagtaccaatttttttcctaaaaagatgttagcatatattttttcaacttcttatatatggatttttggtaattaagataaatgaaattgataataattataaccttggtaaattactagtaattacttcctccgtttcacaatgtaagtcattcttacatttcccacgttcatattgatttaatgaatctagatagatatatatgtctagattcatcaacatcaatatgaatgtgggaaatgctaaaatgacttacattgtgaaacggagggaatagttaattgatcgtcatttattttggtattaaaaagaggttgtccatgttatgcgaagacgatgataggtagctagggccaaatgcatgtcaacatcgatggcttttggactataaagatgtgaatgcgacgcttgtggtgagcggtcaattggtgggagtgggatggcttcttttgcccaatcattcacattcatcttggtgttccattgtatgtgtatgtatgtcctaacctgacaaaatatatcacattaataatttgaatataacaaaaatatgacgtatactatagactcggaaagatttacgatattttgtgttgtgatgtgaaagtgagtgtttgaaaaggtaagagaatatatacagatagatcgaatcccatcggtagcctagcttttttaccacaaaagttatattagtgtgggatcgaataataacttaagtatacctccttttctatatagtttgttatatcaaaaggataggcaggtaacaatactaagaattatgtaagagaataaattagattagaataaaaagaagagattatgtgatgggtgtcattttcgtgatgaaaggatatgtaagtggaggatgtgcgcggaagaaaaatatatggaggatgcaattggttgatagtatggattgccaggtggatacgcaagaagatggatgtaggcaacaaagaggatgcgccaccggctaattccattccaaggatgaatgatggaccctggataagtggtctggtcaatcatgattcactaatactactagtaccacttaacaaaccaaagaaaatacaaatttttaaattttaaatttaattttaaagttgatttgaagatattttcaatatagtttcttttaagtattggcttttaaatcgctaaaaatacatatataaaagttttacatgtaaattagtttttattctttaataagcggttttggtttattagaaaatatgggcaatcaataaggaccttaaattttaagctactcttttcatcctaaaataaatagacaaaatgcgagatattttttttagatttatagcatttgaatgtgtcgcattgttttattttagaatgggtggatgatgtatttagatataagctacaccgataacaaactgctagtttgagaagacgaaactatttaaagatgccatccattgtgcagttgcagcgatggttgccggttaatagcgagatatttaaccatttgccacatttagatgtgttaattaactttttttcactggacccacacgtcatagacatatgtggacccacgtgtcattgaaataggggtggcaaatagttatttgccaaatctaaaagtggcaaatagttaaaatccccgttaatagctactccaagttgatagtactatatctttctgctacactaaacttgatcatggtggggcccagaaagatttagtgttaagctactactgatcgagcaagcaggaattttttgattattcggtttggactttggactaacaagaaagaaaaagacaaaagatgcttatccgtgaaaaggcccctttgacaggtgactcaaaagcaaacctttccctctcctttctactggccttttatttctccttttttgttaatttccttccgacagaaactaatttctcctcttttaaattaaatttggttggggtcacctagcctccaatcgactcgtgtcgaccagccactcataaacaataactagctaatacgttctctggatcttctctctcaaaggttatgttgccgctatatatttacaggttggattattacttttatatgcttctatacctagatcaatgccaataaaaagcactcaaggtgagcatacctggttttgtcgtattctgtcctacccattcttatcttgtatatatagatgcttatctcaactttttggtgggtttttttggcatgtgataattattaacaaggcaatggttttgatatatcttaaaatgttacaaaggttttatcctccttttgtagaattttggatcgcagcaaatggtttatttctattttagctgtcaacataatgttagtctagtttcactagccccgtccaaaatatagcttgagttctcaacaaacttattaatagcctacgataaaaaagtgtcactcttctagttaagggcctatagtaaggacctagtgagttccaaattccctaactttaatctaggtacgacaacatacggttgaaaagtcataactggacaattaacaaaagagaaaacgtgttgtagatcagactattgggaacaatttaatctgctttcaagccattgttatggttacgacttataaaccaaagtcaacacttctacttttaacaaaccaaaaaggctaggttaaaaaatagaaagcgacaaaaaaaacccttaaatcaattttgaaattcaaaactggttgagttttcttttgttaaaactcagaaaatatattaattactcctaaatttcattattttttcttacaagggtaaggttgatgttaaaagtggtttgccaaatgttaggaaacatttatcaaccgtgctaagaaaataagaaaatgagagagcattctatacttataactggtgatgtactcatgtccacatcgtgaattaattttatacatagtgtgtgtttagttcctgaaaaaagttggaagtttgaagaaagttgagagtttagaaaaaaaaagttgaaagtttatgtgtgtagaaaagtttttgatgtgatatgatgtgatggaaagttgggaatagagggaaactaaacacggccatagagagcaacgtggttcattgcacgcacaaaggatccaacttctcattttgtcttgagagtgtcacttgttggttgggccacagcccacatgatgcatagtgctgccaagtggacgtactcactctccatctctcatcgccggatccatcgatctaaccctctctctgccaaaccttgagtattgctctacgcactcgtgtagcacatggaaaaactatattggctctgttataaaatatgaagatttctgaattttacaccgtgattaagaatatttgtgagtatttgtgattgattcacataagaaaataggtggagaaattaaataagtgtattattatgattgattgagaagagaaaatatgtgtacaatggacacattttgaccgccaaaagttataatacaaagggagcaatagatgtgctggtttatagttggatcagaaattgggtcaaatgatatacattaattcatatagcactatcacataggcactacaatgagaacaaggactatttgtagtatgcagtagtggtttaaatggtttaaatggcgtgatggtggtctaaaagtatatgggcattgggcaagactgttgtcaccatcatttccaaagttttgaaaaaaaaagataaacttttgcttagatagatttcaaaatagaaaaaaaaaacagaacatgatgtgcagctgtcgaataaaagaaaaaaggtacacggaatatagctttagcgaaaatagcagctccattgtttggtcttcagtcatagccaaaatttgagtcttaaaacttagttttaaagttacttttggtgtttttttattgtagtctatttttcagtattagtttataagccgctaaaaacacaagtataaaaagttttatttataattattaatattatttgttaataagcgttatgatttataattagatgtctatcccatgacaaagttaaaatctcgctgaccttttttttactgaggatctttcatgagaaaagaacaatgatgcatgcattcatccaggggaaaggaagaacacaagcagcatagcaacagtagattgactatagttgagcacaacagtaagctgttgataaccaagagaagaatctacactgcactccacttgtcttgtgctatgttgccaatgtgtgcactgtgaagaagaagcactcaccaaacttgtccactcctccactcccagcaatagtatttatggtggcccctcaccagcacaggggcgcggatcaggaaagattaacaggagggtctgaataaaatatataaaattatagccacctcttctaatagatgtatgacagaaaattttagtgaggtcttcgtgaggtcttccatgattacaacataggtagtggggtcgtagtgaggtctcgagaccctagagatcccacggtggatccgccactgccagcacatcacctgatttgcactgcactgctcttgctttccccctcctgttgaagttgcagagtacagcagcagcagcagcatatctatctacctattccttcttactcctcactttatactccacttatttgtcaaatctttatttttctactatactatttctcttttcaagggaaaagaaaagaaagaagaatatatgttgagcagtgagagagatttggaggtataaagagacagacaccaacctcctccatcttcaatcccttccttccttccattttattttcttttattttcccaacaaagagaaaagagggtgaggagcctccatccgcgaaaagcaactccacccgacaacctgccccatgcactttccgttattctcatttcacccctcgcaattttacactccgccccccatgccctctcaaaactaattacaatccagtccttcaccggtcagcgatgcccactccggtggccgccgcgaggcagtgcctctcgccggccgccgtccccgccctcgacgccgccgtcgcctccgctcgccgccgcgcccacgcccagactacctccctccacctcatctcctccctcctcgccccgcccgcacctcccctcctccgcgacgccctcgcccgcgcccgcagcgccgcctactccccacgcgtccagctcaaggccctcgacctctgcttcgccgtctccctcgacaggctcccctccgtctccgcctcctcctcctctggcgccgccgacgagccccccgtctccaactccctcatggccgccatcaagcgctcccaggccaaccagcgccgcaacccggacaccttccacttctaccaccaggccgccaccgcccagacccccgccgccgtcaaggtcgagctctcccacctcgtcctcgccatcctcgatgaccccgtcgtcagccgcgtcttcgccgaggccggattccgcagcggggacatcaagctcgccatcctccgcccggctccgcccatgccgctcctcggccgcctacccacgcgcacccgcccgcctcctctcttcctctgcagcttcgccgccgcggacgacgccgacgtcccttcgcctgcggggaacctcgcgggcgcgggggaggagaactgccgccgcatcgccgagatcctctcccgcggccgcaaccccatgctcgtcggcgtcggggccgcctccgccgcggacgacttcgcggccgcctccccgtatcgtatcatccatgtcgaccccaacaccatcgaccgctcagacctcggcgtggcggcggcaatggccagcgccacctccggcctcatcataagcatcggagacctcaagcagctggtccccgatgaggacgcggaggcgcaggagaatgggcggcgggtggtggcggaggtgacgcgagtgctggaggcgcacagcaaggtcggccgcgtctgggtgatggggtggtcggcaacgtacgagacctacctcgccttcctctccaaattccccttggtcgacaaggattgggacctccagctgctgccaatcaccgcggtgcatgctgcccctgccgccgccggccctgctgctgctggtggactcatgcctccggcaaccactgttgctgccttctccaagccagctgcaaggtcaagcctcttctcttctcttctcttcacttttgtatccacgaattctttatgcataagatttttattaccatccatttgctgactgccgtgagttaaatgtcccccctttctttattgtcagaatgtttcttggatagtagtgtatctgattaggtgtgctagtacgatttgcttatgttctttactaatttcattttcttaagtgttgatttgtgtgctttgcccattgtagtatggatatttttttcaacttgtgcaattgatttagtgtactactgtaattagaagcagcataggtagctaaaaatacataaatctagaaaggtttgttttcttccactgcattttttaaaaaatgtttttacacggtcaatgatgtacaaccgtttttgtttaatgcgatggtttagttactatgttctaagttccatgttactcctgttatgttctatgttcagtcctgttaggtgcgacaagagttgctggatattttctcttctcggaagtgggttccaatttgttgtcatcagaaccttccagaccaacttccttttagatgctctgctgttagtcactacctgtgttatttactgatttctcagctcttttttattttttgcctttaggatatttaatgggattttcttcttataagccttttctctgtagtcctattcttgtaatattttggattttattactacatatgtgtggccatgaaggagaggttctatagccagtgcagaatccatataatgcacatttcaaactgcttgataaagagagactaaagtgtaaaagtaaaataatatggcttgtgtactaagagatgcaatttcatggtaaaagagtggtgcttctgctgcagcacatctgttctttactgttgtaatgctcaaattgctgatagtttgggtcatatatgtgggcagagattatttgtcattaatatgtagtatcacctataatgaattaccttgatgcatagggctatgtgtggcctatataccaatgaactccactgcttccatgctttgttctaccttgtagcctgatctccttggtagggtctttctgtatatcaaaatcgcagcaatatcctgaaattattgaatcaaggattgtttgatttgaactgctttcagttatgtttacaaatatgtcccaccagaattttgcaacactcttctgatttctgtcacagcatagtattgtatggcattttattcagctgtagaaatgttagtgcttaagcattgcaggtattaatgacaaagtgacatatgcataactccaatataaagcaaagatatgcttgtgccttgacctcatagtttcaaacttgttattgcagcttgatggactcctttgttccttttggaggctttctctgtgataactacgaagagaacagcctgacagcaaattcatgcccacaggccctgcggtgccagcagtgcaatgataaatatgagcaagaagttgcaactatcattagcgcaagtggcattacagctgaagaccatcaccagggaggtcttccttcactgctgcagaatggcagcatgatgggtcctaacaatggatttgatccagtcaaggtgtgaagctacctatgtcttttggaacatttatgttaagtactgaacgcagcaagcactgcttgttgatagatgaataatttttggtcgttggtataaaagatgcacagttttttttcagtgcaggttagagatgatcggatggtattgaattcaaaaatattgaatctacagaagaagtggaacgagtactgcctgcggctccaccaagactgccagaggatcaacagagatccttacaaaccatttccacgctatattggtgttcccgctgacaaagaaagatcagcaaatccaagcaaaggttctgagtcaattggggttcaaaaggatgttattaaaccttgtgcagtgtctgctgtacattccagctcaactgcaaggcctatttcatctccatctgtcaccaacaaaagaaatgaagatcttgtattgaaccttcaagccaggcattccaagagtgatgaaaaccttcaagaaaggggcatgcaatcccaacatggcaccctgtcgaatgctgacaatccggatgatcatgcctcaccatcatctgctgcacctgtggagactgacttggttttgtgcacccctcgagattgtagttcgaaaggttcaagttccacctgcagtaaacgtgtagaggattcagagaggtctgtccatctggtacccaagaaggtggatgatttaaatctgaagcatccacaactctctgttcaacctaactcttgctcctggagttccataaatgttgggaaaacatcacacagtacactacactcagtagcttcaggaggcttctctgcctttggccaatggcagaaacggtcaccccttgctgcacaaaattctgatctgagcaattacaagctacttgtcgaacgcctgttcaaggtagttggaaggcaggaggaagccgtgagtgctatttgtgaatccattgtgcggtgccggtcaacagagtcgcgccgtggtcctagcaggaatgacatctggttgtgttttcatggttctgacagcatggccaagaagagaatcgccgtggcacttgcagagctcatgcacggcagcaaagagaacttgatttatctggacctaaaccttcaggattgggatgactccagtttcagagggaagactggcatagactgcattgtggagcagttgagcaagaaacggcgatctgttctcttccttgacaacattgatagagctgactgccttgttcaggatagtctgtctgatgctattaagtctggcaggttccaggacatgcgaggcaaggtggttgacattaatgactcgattgtggttttgtcaagaagcatgatacatggcagcaaaaatgggttggaagagggcctttcattttctgaagaaaagattctggcaactcgcggacatcgactgaagatcctggttgaaccgggtagggcaatcaccagtggatgccctagtggtaaggtggtagtttccccaaggcattttctcaccaaaattcaagcatctttgtgctctggttcaatcagcaagagaaagctcagcatgtctgatgaccaggaaaagctacaagagtcgccaagcagtttgaagcgactgcatagaacatcgagtataccgttcgacctgaacctccctgttgatgaggatgaaccctttgatgctgatgacgacagtagtagccatgaaaactcatatggcaacacagaaaaatccattgatgcccttttgcattcagttgatggatcaatcaattttaagccgtttgactttgataaacttgcggatgacatgctgcaggagttcagcaacatactcaggaaaaatctgggtgctgagtgcatgttggagattgatgttggtgcaatggagcaaatacttgccgcagcatggaaatcagaggacaagggccctgtgcagacctggctggagcaggtttttgccaggagccttgacgagctgaagctcaaatataagcatgtgagtagctctacccttagactagtgccctgtgaggacacattaccaacagtgaaaggagatggtttaggagttttgctcccaccaagaataattctagattgttgatgatattatctgtatagggatcgctgtaattatctgtagtccacaatagtatagcattatttgttggctaaataagctctagtctagctgatgcattgccttgggttctctaattagctactgccagtactgtcatatcattttctacctcagggccttttccagatatatgggcatccgaatgtatattggttgtaactactatggattgtcaatatttgattgttctatatatacatggacacatggtgctcggtcagtgtacttgtgtggttcatgctgaaatccacaactgcaaggttgcttacatattttgttggccaacttgtatatgtgctctcatctcgtcttgatttgtggcaggagttgattgctactccaataactacgtttttattattcctgaatgatgctatcatgtacggtagggtgccgatgatattatagagaccttatagttagttgttcaatggtccatagaaagttgcatggcagcatagtacttgatgcgcctacttgcattagaagcgaactcgaattggatgctagtagtagcagatttgtgatttgctagactccaatgcagaagattccaaacaatctgatggatgcatccgtagtcactcacactaatcagtatcaacaaaagatgaactaggctgtgaaatcccaatagtagttcagttttgatcatcatgattatgcaaataaactccattgtgagtgattcagtatggaaaaattaaggtgcagagcttaattcggatcataattgtctgctcaatggcacatacaaactccagacattgaattgcctggcaaactccaaagggttacacggtataacttggacactttcagaactaatcaaaactgaacgacccgctagctacaacaacaattggacaatgcttgtttagtgatctgaatatggtgatccaacagatcaatgaatccctgtgttctgcagggccgcatgcttttgagcaggtaagtagcccttgctgcttattatttctctttctttcagcagttcatgctatgatggatatgctatctatcaggaaaacaatccattcttcacttactaagctactagtacacggtgactccaataattttcaagttaatttttcacttgtgcttagcatcttcggcccagtcagtgccgttcaagctgtgatctgtttggtagtaaacaacatccccgacgtcgctgacaaagtgatcaactctcaagctcctcagcagaacgccaaacaggtgaagtggcagcggacctgacttctctggctccctgtagtatctgcccagcactggccttgctgcctttgtctgtttttttgttcccatcaaaacaaggcaattgtttcagtactcagtgaacttggtaacagtgcaccgtacatacatactatctagcagaggtgaataatgctggcagtgtacttactgcttctacgaggtgataatgaggaatttgggggaaaaggtggtggatgacatgggtgccaatgtcatggtggatgttgttgatccacccgtagtcccgatccaccgttgtcaggccaccgcggaggtagctccattcctgcaaatagtggtcattgccagatgttcagccctattttcagtgtttgtaagcagaacttaatgaagtatagagtgagaggaagtatagagtgctcataggctgcacccaactcaataacctacagcaacttttcatgctttattctggaaaaactatgatccaatcaatacagaaaaaagatatacctctccacgataccagggaaggtcattgtgaccgtggtggtgcagataagtcaccaaatcaagccacatcacgaatacctgttttgaatgcagacaacgcatatcagatatctagcttttgggtacagtttcagttagatatcccataaatatgatggagtttcttagaagcaaaagcagaggattaatagtgaatagtgtatcttacaagatatgggacaccgtatagcatgagcaccggaacagacccaaacacgcacgccaaggcgacgagcaacgaaatcatgatgcaccagcaggtggtggagacaatcacgtcactcttctccttggggctgaacagatcgctgctcggcagaaagtgagatccggtcttgcccggacttctgtaccactgcagcacattcaagcatccgtatagaagattcagttgtctttctttcttttggggatacagattcagttcggtttcagttgagtcattcattcagcacaattgcgtggagttgccgggtgaggaggacattcagagacttacgaggtagacagggaaggcaagcaatggaaatggtaatgtaaagcgcagtttcttggtgcgcgtctccagcttccggtacaatttctcggtgatctgctcaaacaaattgcaaaagcatatataaaaatttaagcagattatagagtacgtatctatatgttgagagccagcttatatacaggtgacaagcaaaaaactcattcagcctctcgttattttcttattcagtcaataaagctgagcagatgcttatgctaccctggcggccttattcaaatgaacctacaacttaattagcatatatatatatatatatatatgttatgaatcaaatcacgtgatgtgtaatatgatattcgatctgacgctgagctacggatcaaaaagtgatccgattcgcatctgggatccctggtgaataatttagcagcaaaggcacgtgagccagatctactgtctcaatcttgttggtattactattcacggaccacaaaggaaggctgatattttgcaacaagcagggtggatcgttgtggtctgctgcagtggtcatgtgcccttctctccatctgcattattattaatgcaattgcaggtgagcatgtcgcataatacttactgttcgtttggctgtcctgtcctttcccgtcctgccaaacgccccagttggacacgctagcgaagaatacggagtatatttgcgaaagtcatatatacagttttggtactatatatgatagtagtagtaccgcgaattaagcaaatgtaattggtgtatctttttcaaaagggttgtaattgttgtacgggcgatggattgagacaagcataattaaggatagtactaggagtggaatgaagttgagaagtgcaagcaattgtaggatgggcgagagatgagaagaaattagtaagagaggaggtgatctgaaggagtgacaaaccgggtgccaggactcgtccttctcgatatgaccgtggttctgatggtgtgttctgtggctgattctcctgcatatgacattaataatatcagtcagatgctcagatcggatgggtcaacgagatgaattaccatagcagtgatggtccaagatgctatggtaaaccaagactagcattgcctaattgcacatacagtatcatgtgaagagattctggatttgacaggacaggctagttccacgtatataggatggagacccgaatatgtgctgttttttcaacttgctttgcctgcatctatgcttttgccgtgtgccgcgcgtgtggtaaagcaaaaactttttagtttctaactaattaactggtttcagagcattaatttggtaggtgtgcaatagaagtaggtaggtgaaatatatatatatatatatatatatatatatatatatatattctgtttgtgcatgcaactcgtgtgattttgaaaattgatatacatgcatgtatgctatagagagagagagagagagagagagagtataggaggagttggtaccatccatggtaggggacgaggatgaaggagtgcaggaggtggccgacgacgttgttgagcatggcgctgtcggagaagctcccgtgcccactgtgtttgcatgcattttcaatttgtttttcatggagatctcgatggattgatgcatatatgcatatatgagaaaagaaatggaagcgatgaatgaatgaatagaaattaccagtcgtggccgaggacgaagagcgcccagaacatggtgccctgcgccgcccagtagagcggccaggccgcccaggcgacggagacgtcaatccgagtggcggctgcggcgaagagggcggcgacgatgaggaggtcgcgggcgacgtaggagagggagcggaggggggtcttgcgccagcagtgggcggggatggcggcgcggacgtcgccgatgcggaagggcgggggcttggcggcgtcgaagaagagacgggcgtcctcggaagccttgcagtccgcctcctgggtcgccgacgccgccattgccgccgccgtgtcgtggtggatctgattccgatttgtgatttgtgaagcgcaggcagcgaggcgaggcgaggcggaaagggagaagagacaagaaagagaaatttgaggggaggtgtttggtttgtgcctgcgaacgcgaatgcgatggatgggccgcaacgcaaccaaacccaacccaacccagaaaccaagctcctcctcctcctgtgttgccttctgccccctttgcgttgctttgctatctatttataggcctcctttgctctgctcctttcttcccatttcatcaccacaccacacgcttagcctatgtatgcatgctgccttaccttttaggattctcttgcatcctcaattaggccttgtttcgttccttttttttttcctcaaaaatatcacatcgaatctttgaatatatacatggagcattaaatatagataaaataaaaaactaattgcacagcttacatggaaatcgcgatacggatcttttgagactaattaatccatgattagtcatatgtgctacagtacccaacatgtgctaatggcggattaattaggcttaataaattcgtctcgcggtttccaggcgagttatgaaattagtttttttcattcgtgtccaaaaaccccttccgatatctggtcaaacgttcaatgtgacacctaaaaatttgctttttgcaaactaaacaagaaat

SEQ ID NO: 20163 - DNA, 12244 bp, Oryza sativa
cattagcacatgtgggggtactgtagcacgtatggctaatcacggactaattaggctcaaaagatttgtctcgcgatttccatgcaaagtatgcaattagtttttttaatttatattttaatgctccatgcatgtgtccaaagatttgatatgatgtttttggacaaaaattttgagaactaaacaaggcctaaacatggccaaaatccatactactatttcttgctaatcaatacccatttacctataaaactaataacatatatttgtacattacagctaaccaaacccatacgtagggctaactaggatgtaatgtaaaaaaaaggagcagactgaaatggacatggggaggaccgaaccgtttggttgctcggtttctctagcgttgtgcatgtacggtgggaggaggggatcgctgtaaggtgactccccttttacattagtaaataagtatattttctcccttttcaccacagctttaaaaatgatcactccatttgcatcgttgttctatggccctcacatgtcaactgatggtgacatgtggaaaaaaaactaattttggacaaatagtaacattacactagtcacctgatttttttttccttccaagttaagttgagtttaagatttagtggtaatgtagttcatgctaatacctacctcttatagttttcttttataaatttagaaaacttttaggtccagtttttaacggttttcacttattcaattattttcactggatattcacccatgttaaaattgcatatttgaacccttaatactgtggaatattggatgaaggagacggttttagagggatacctttatgggcaagtggaagccagggaatgggtggttgtgcgatagggtggcgaggtggcgatgatgctgctagtggtggatgcatgatttattggttatgtattcactcaacaattgtaggtgtcatgtgactagggtttggtgggcttgggttaggagaactaaggttacgagccgagagtgtaggaggagtggatttgttcaaaaaatgaaagataaaaaatagagtaaatttcacaaaactatatatacattgaccaaattattacaaaactaaatttaaaatgatgtgtcataaaactacagatttaacatcaaatttatcacaaaactatagatttatgattaaatatcgcaaaactatagatttattaatagagttatcacaaaattacaagtttagatccaaaataatctcaaaccttaggcgtttaaaactcaaatataacaatagtgctaaggatttaaatcccaaaatctgtagttttgtgataactatgctactaactctatagttttgcaatacttagtcataaatttgtagttttgtgataaatttgatgttaaatctgtagttttgtgataatttgttcaaagtatttgtagtattgtgaaatttactctaaaaaatatagtattaaacctcgtcaagtatatacatatgtaataatacagggaatgcccattgcttcatccctaacgttgtggagcaagggggtggttggccgatgttggaggcagagttgatcactagttggagtagttaggaggcaagagtggtggttacggatctgtcaacatgcatgagcctccagagatgagaaggagagacagagtaggggaactcaccagagttaacgaagtgggtagtggtgaccgtggtggaagaggagagagggaggcgatatgatgaagaggaaacagttgggtgtgcattggccgatgccaacgtgccaatgccgataagacaaagggcagtggtgcgtagataacaggttgagacgcattgggacatggggaggcggggaggaatggatcacaagagcatgagagaacaaaggtgggtaatgtttataggtgttaacaaatttgaatcaatctcgacatttaaaaacgacacaggcaaatagataaccccttgaagtgctataacgacaaatgtttaagcttaaatttgaaaaataaatcccaaaatcaactccaaattttagattgaaagtttaaattttagatgataaatataagcacaagcaaaaagataaggctgacagtatttctcgaccggacggtggtcataataaattaacttaaaaatatcggcaatgtattgataaatagaactcatgtgaaaacgtgttagatgaatggccacgtacacaatcgattgatcgatcgacagctagctagctacaagtatatatgtgaatgtcgtacgtacgtgttaatcggtgccacacatagctaggcttttatataattgagttaattggtccttcatgtatctatcaatcgtccaaaaaacgtacgatcgacgactttgcactgcatggacacgcacgtacgtgcatatatatatatacgcacgatcgatttgcactagtgcagtacgatcatctcataaattattaaacaattaaaattaaattgtttggcccacgtttggacaatcaaacgtgtatatatatgtctaatttggagttccaatgggtacggtacgaaccagtacacttgactttattgtctttgtatttaattattatgatgattacattgacgatgtctttttctcctcggtctaataagctaggtaggtacgttaatcatcatgtgtgtatagcctaacaattaattaatgtcataaacaacaaaaacaagttatacaatgctactgctttctagaattaggccggcctacaattctgggcaatgtacatatatatacaccatccgtttaaaaaaaataaactttagccatgaacctgtgtgtccagatttattcttagggttggattcttttgacggagtagtacatgtgtactgtgtacacctaataagtcaacttgatgcatatatacataactaaccgagaatcacacttgagcctgcctacgtgatggctaaaacttcacatatataccttttgcgtgtgagcgacgagaagagaggaaaatcactggatgcaacatatagcacgtgttgattttatggtgtccactaacttaactgtgtatttaagtctaattttttttcatgaagaagaagcatcacccagactagctattttgtctttggatgattgatcggcataaattgtctctgtcttttttttttgtcatgaagccacattagtccaactattttatgttttagattattgatcaaaggtgcaaagtttacatatacagcatgtagagtcaaaccatctaatttcaaagaaagagcacattgcgcctcatatttagcaaatttgtcagacaacttttaccacataactgccgctagagtattcacaaccaattttgccaatggaaaactttgctcctggaagaattagtggaacctgtatactctaaaacttgtctgaatgattgagccaagaagaagaggaagaatttttgtcatttttaaatttttattttttaatatttacagcaatattataccatccaaaatatttacagaagtagcccctgccgcccaactggagagcggcaaggtgtgcgcattttgtactgaggtcccttgccgccctctgcaagggctgcaagggggcaaatgcaattttcgccctgctaaaaatgtatttttctagttttttttcatcctgttcgtccctcatgtcaccctgccaccctggtctacttctgtaaatattttcactggtataacatttctgtaaatattaaaaattaaaaatgaaaaaaatccgaagaagaattagtggaagggccatgacgtgtagaaatatgtgggaaacataaggcccattagatccaacagtgaatacaagtgtcaaggaataatagcccacacacacaaagagctaagaattttcagcctgtacacatggatatggacctcaatgtaggcccaagttgatgaggccttctcaattctcaacgagaaaggccccagggatatatatggctcctcaaggaaaaggttcactttgctcctttaagtatagttgtggatttgatacgtcatatttctcaaccacaatacctgccatcacgatttctccaactattaaaaccgtttaaatggttgtattaacggtggtttttactgacgtgatgttcatgtgacagcctaatcatcaaagatattaaaaaaaaacttgggaccacatataagtggcaagggagaaaaatggaagaaaaaaaagtggccttcgtgttcttggcagcagcagtagacgccgccgccaccggcgatgtaggaggaagccagaggaggggtttgacaggcggtcaacctagcagcgcagaacgagagtgtgcgcacacagcgatgacgagttgagttgcagaccaagctacactgccatgatagggccaactgtgagctatccagtcgccgagcttatgctcatgttgctgcttcgtcgtcgcctcctctcccttctcttgtccatctactgattggtaccttctctgcttttcttttcgttcttcgcttagctgattcattcgttcgtctctactacatggcgcccttccctaaaccctgattgattccatttttgcagcttcagaactagttgggtttgctccatctctgtcctctttgggatccaaccggtacaatacatgattgattaataattgataatgtattcactttgcgttgattcagaatggctgcccagtttgatcaaccgatccctggatgcaattatgctctcaagttttaatctttttggagaatttttaaaaggagaaaaggccccaaccaatacgtagactagaacatgaaggatattttctaattacatatagttttgaaccaaccaaagcgacggcgatcttgctcttgagccgtcatgctccaagattcacgtgcctagattaggaaatggatttaatttcatccctcgagggaacatcacctcattttttccatgccacttaataaaagattgaaaaactttaacaatatagattaatatgaaatatatcacttcacaaacagacaatgccaaatttgacttctacaagatgcaaaaaaaaaacaaagtaaactgaaaattcgcagttatatttgttatttgtagaagttgaatttgaatttgcatgtttacatcgatatgttgcatattaatctatcctatcaatttctttcattttgtatgactgtttagataacatgcgggaaacgagtggtatcctttcgagggatgaaaatactttcccatattacaaaacctcccataatgtgccgcctcctgcctctgccgcttgcccttttgtgccgccgacgaagtggagtaccatcattgccactgcgatggcaatggcagattctagagcatggacaacatcttcatgtgacacaaggtaagagacctgctcatcgtgatcgcctacttctctatcccactgacccactcgatgggagctcgattggggagagagaggggagaaagagggagaagtggccactaatctctggtcttatttttattttgtttttattatcattgtaatgccatgtatacgtcacaagaccaggtcatacaacacgtaggtgacatgtaagtgtgaaaaacattgtctatattgtcgagggagtcgtttagagcggttttggtaattggaggaatcgttatacccaatattatggttgaagaatacaaattaaatctaacctatataattaaattggtttttttcccgctcctgaatgcataatggtcagcatatgtctccatccaaaactatttctctcattctctccgacttgaatatctatctatctattgtttgtctgttttgttttggcttatcagatttaaggaatgatttgcatctttaccttgttgaaaaattattggctaatcaatcatatgcactcactactaaaaaaacattttttagcgacatttgccttttatttttctaggcaggtataaccctcgaagccaaatgtccgcctacaaaaatgtaaaccggggtaaatttttttcatccgcctgcaaaaatcaattttttcagacgaaccacttaagaggtccgcctgtgaaaatacctttatttttgcaagtggacctcttaagtagaccgtctgaaaaaattgattttcgcaggtgaaaccttatgtggtccgcttgcaaaaatcatgcctccaccaaaaaaaatatctaagtcaccgagtcgtccttatcttcaactcaaagtcaaccttatcttcgactcaacctctccccaccactcatttcccctctccacacacacactctctatctctcacgtgcgcgcagggcaacgacggtgttgggagtgactccgacgagtggcagtgttggtggcggctccgaggaggaatggtgtgggcggcggctccaccggctcgcctcctcgccgcttcccctcctcgccccctccgtcgccgggcatgacgagcgacgacaaacagctcgccggctaccctcctcgtcacctcctccaccggccacaacacgcgactacgacggctcgcctcctcgccaccttcgccgccggcttccctcctcgctgcctctgccaccggccgcaacgcgcgatgccgccggctcgccttctcgccgcccctgccaccggacacgacgcacgacgacgacggctcgcatcctcaccccttccgccgccggctcccctcctcgccgacgtgacgacaacgacgaacgcgccgacgcaacaacaaccgagtcgaggcgacgacgacggcgccgagtctacgactgccgcgacaacgatgacgacgacgtctgtggaggctgcgaatggaggaggagaggcggcggcttggctcctccctctcctatgtggggtggcggacagaggagagccgtcagccggagggggaggccggcggcggcgcccgtgggtaggggtggtggatttttttcatttgctgagatgattttcgcaggcgagcgatagtataccggcagtccttcccccgcctgcaaaaattgttttgggccatctggaaaaacgatttttctagtagtgacaatgaataatccaatcaattgcctaaaaaatccaatcatcaagtaattaagcttgcaagtaaaaagtacatgaatcggggttgcatcctgaaagaaaaaggaatcgatgatttagttgtccgctccagccggtaggagtagtgtagtacgaagaaaagatgaaataataaagcagaagctgcattctgcgagaaaacgggacagcgagatgtcatccacaaaaaagctttgctaactgccatcttctcttaattagcagagtggaataatgttgattagtttaagcttgagcctcagatggacatcgacatctcatattctcatgctttaatatgtggtaatggcattggtggtagtcatgaagctagaacactcttgcattgtgtggttttttttatgaatatataataaaatacgtacattgaaaactatgtcaaagtcttagaccacgagtaaaaaagaatccagggagcaggaggttcagatggtttgatttgctaaatatatgtagtagtacttcgttgacaataatactcgatcgtataaagggttaaaaggctattttggagaactgagacttactatatactccatccgtttcacaatataagtcattctagtatttcctatattcatattgatactaatgaatctagatatatatatctatttagaatgacttacattatgaaacggaggaagtatatacagctagcactgcatcatgggctcatggcaataaaagagctcgatcacatcgaccaagatacaaaatacacgaaaatctcatacactggaatggttatctggataacaaacttgcatgagttcgatcgatctggccagggtccaatgatcccatcgcattcgctagctagctagctaagcccatgtttatatgaaatccattttaagaagaaggcagcaactaccagctgaaacggtagttaatcaccaaacatgcgtatctacatcatgcatgatgctactatgttagcgaagaatttaatattattattattggtaggaagtagtacgaaggaagaaatggaagctagggagggctccacagagacacaggtggtggatgtggttgcaaacagaaacagaaagtgtcgcgcactgccatggttgatggaactcttgataacttcattctttaaccatatagtataagctactccccctccaaaatataagcatttttagctatgaatctagataactgtgtgttcagattcacagctaaaacttgttatattttgaaacggaggtagtaatatatcttcttttcaatttacactggaatgttatataaatggtcccttcataacttcacataaaaactatcgtgggctcgtcgactctatgtatctgttatggagacccacatcgtttagagctttttatttgaaaaatgcagaattttgttttttaccgaattcagttcgattacttaaagaatgctttaaaaatcctattttacaaaggctctatgagtttctaaaatctatttatttgtacgtgactctaccatacctactatactgagatagtccacaaaactagtaatccaacggttctcgaggaagacaatagcggggaactagttttcaatcggtgccaacggtggctgcggcgttacctctccacataatcccactcctgacggggcaagaaacgatcgggttggcacaacaaggctggagagcgacgacgagtaggcgaggcgagaggatgaggaaggcatcagcggactgacaacatctcctccctttggatctgaatctggattggtggcatctcctctctttggatctagatcggcggctgttgatgaaaaaaatcgaacacaccggcctaggagatctgcttagctcctgtgcaggtccaaaagttgttgagatgagggcgtgccagtcagtttgatcctgcaactgacaagatatgcaaatagtagatcaaacagccgatcggctaacaaaccgatggagtagttccagccgatagtgataatagccgatgccgataccagccgatagcgatagcgtttaagcaatcggctatatgtccaatgtagataataatataaaggcaatcggctgatgatgatgtaataaaataacaatataatccagtataaaccaatcggcaaataatgatatgataaataagtatcgatccgaaagttaaagcacacatcggctggaggtccgatgtcatgaaatgcacaagattagattaaacagtgaaacctttgttgtcatcggctaaattcaacttatatgtatatgcaatccttatgagccgatgcaacgtccagataatttactggctgaaaccccgatgaacccttattggcagtcaaaaagcaggctagagattatggttctaagcacgacttagtagatcaaacttaactgatgcagcactaagtatgaaaagaaacacaatatctagacaatcaagccgatgactgattttcagggtggtagatgcctaagctaatctaatctaacaacgcgatttagccgataccggtagaaaccctaaagcgagaagcaaccgatagagctaaattgatatgctaagactagattaacagagacatatgataaataggtaggcaaatatatcatccaaaccagagcaatccaagaggtcgaatgtactgatgcagccttgaacgacgccgacgtagacgatacaattgcctgggccgacggaacattggacttaccccttcgccagagatcgaacatcgatgcagccccgcgtcaggtagggatgaaaacggagcggatacggacggataatgctcataccatattcgttttcatattttttgccggatacggaaacaaatacggatagctcgaatacggaaacaaatacggactatctcgaatacgaataagaatcgaatatgatcggacacgaatacggaaacaaatttttcttggaacacgaaaaccaattcaacttctaatagaaacaaatatcaacatatataattagctcattttatataaaatgtagtataatttataaatatttttaaaattttaaataatattaataatgtggactagtgttaagagatgaactactattaaaatctaaaaaggtatattgaaggtcatagagttataaagaaatggggtatgtcttgtggcttctgcggatatccgaattattattcgtatccgacggaaaccctgataccatattcgtattcgtatcgagagaaaataccgtattcgtatccgtatccgaactatccgatccgaaaggtatccgtattcgtttttatccggagcggacggaaactatccgctccgttttcatccctagcgtcaggtgccaagtcccgccggacgataaaataaagtagaaaagataaaaggtggcgatgcgccgaattgtattaatcgtgaagatagattacatagaccccgggtgtacatatttgtacccatgggttgatacaagttcttgtccgacaagaaataaactttcctaaagataaaaggcaagataaagtctttataggacactaaacacactttcctaaagataaaaggaaactaacgaactattcctaattaatagataacttgccatgccgcattctctttgaactcggtctcttctggataagctttctttagtatatcaatttccttaactgaatatagcaagaatccgacaactgacgacttgacaattctcatcggctaatctcaggacttcaaagccaatgctgactctaagccaataactattccgggcttaccaaatttcactgttaacagcggcatgcacgatttagatctggagcagtggcgaggtggctcgagcaccgacatagtgacacatgtgagagtcacacatcttcttggaggtgatgttctgacaccctctcggcctcttcctcattagtgcttggtagtgaactcttcggatgaaattctttgttctggatgccaggaattgcaccaatggcattctagatgttgcaaccttctcaaggatattgcattggaagtatcctattggtgtcgcgtctcgtgccagcatccccgtaggttgggtttggtggctatggcgatggcatgatctatatgaatgactgacttatagcttagttgctcttagtattttccgtgttggttcaacgttagttatcgactgtgatgatagcgaaatatgactgacaaggaaacaaatacagaacaaatgagtgtggcggttgccattttctgttgaactctataagagagtcagggagaccttttggaaaactacagaatgaacaaccacattatctctataattgtcatcttgtggtccaatcaatccatgtattttcttcaatattttacaatcttcagtgtttgcacttgaattcatcccatagttatatttttttccttatacattccctttttaatcattgtttcaaatagttgttctttaccacctcttcctaactttcacttgcttgtttttcatgtccacacttcccaactcattaaatagtttgttttttgaaagaaaatgcatatgaaagtttttttaataaatatattgatttatttttaagtttattttaactaataattaattaattatacagtaatccctccatcccattttgatcactctctaaaattgctgaggtattcccaaattgattgtcatctaactggtgtctatccatttacatgtgtaagagtaaatgtgttgcgtttctatccgtttatgtgtgtaggagtaaatgctatagttacatatccgtttgtttatttgtgcatgagtaaattgtattattgcatcctcacgtgcatgtctaacataatattttgatcgataaggtttaatttaagaaagaatgatgttttttttcttgatcacgataacacttatgaatatgatgatgaagaggtgtgtaaaacatagttgaagatgtggaaatgggtggttgtctctccctctcctcctttcttctccaagtcaacagttcctacgctaccaaacccgatcggacgcggacactgacagagccgacgccgacggacaccaaacttcccttcaaatcaagggttataggagcacaccacgcgggtgagcctcaagaaaggaagggggcgagtccggccgccgtcgccatgtccaagccacagcagcagtcgg

SEQ ID NO: 20164 - DNA, 9539 bp, Oryza sativa
  unsure (1)..(9539): unsure at all n locations
gcccttccccctctcctcctccccccgcccacctgcgacttctcccgcggccgatgggtattcgacaacacctccctcccggcctacagggagaaggaatgcaccttcctcaccaagcaggtctcctgcctcgccaatggccgccccgacgacctatggcagtactggcgctggcaacccaacaactgctcgctccccacgtacttcccattccttctagttctagatctgccatttcatttcttccagatggatcgatttgagttgattcgattgcaggttcgacgcgcggcggttcatggagaagatgcgggggaagaggatgatgttcgtgggggactcgctgaatcggaaccagtgggagtcgctggtgtgcctggtgcagcccatcctatccaagggcaggaagaagatcgtcaagcgcggttccttcaacatcttctacgccaaggagtatcgcgccaccctcgagttctactgggctccattcctcgtcgagtccaactccgacaaccccaatttccaccacatcgaccagcgcatcatcagccctgagcggatcgagagccatgccaacaactggaaggacgttgattacctcatcttcaacacctacatctggtggatgaacaacgaagacatcaaagtcaggtctgtacccaccaactttgatgttactacttcatttaaccaatttttagtttagctgggatttctagtgtgtttaaaatttctttcattttttttttatttttgcaggaggccaaattcaacttcttggtcagatcacgacgaggtgccaaggatcgagacctatggccgtgtgttcaagacttggtcgacctggctggaacagaatgttgatcctgccaggacttcggtgttcttcatgacaatttctcctcttcacaacaggtgatcataaaacttgcatttctgatttctctatctcttacctcctctctacttcctctctagttcaagcaatggcggttcgttacgaacatcaattagttcctccagggcagggcctaggaaaacttaatttggtaaccttgaaatctttaatgttgtggaccactgtcggtttgcaataggacaccctacctatccctgataaagtggtttgttactcctaattacgttctgtacaagcaagcttcctcttgttccagtctgcagagcacagccactatgtcattgtccaccagaaaatgaggtcagttggacccgtttgttaggtttgcacgtgataaactaggaacaaatttgcctgactttctggggttttagagtctttcaaattccatagttcactagttggtcttggaataattccacactagttcactagtaggtcttggaataatcactcctgtatccgtatatgcatcagaatgacagaaagtatggtgctatgcacaaactagttacttcggaacataccaatgtctgaaatcagaaggcgtggtgctatgaacttactggattaacgcacctcattcctcaccttttatatatattatttccaaatatttaagaacaagtgaaccaattttaagtactttagtttggaaccactagtattatttcttgttttgtgtgattctcaaaggctctttgttcttttctggtttgttgcttgtgaagcacaaggtgccacaccattccatcacactatgcacgcacccatgtgaaaacaaccctccttttgttgttgtaccagatggtccaccaagaaatttgttgggttcttatattgtatatagacacacatatatatagactgggagtgcacccttggtgattcttttagtgagttttcatggtttcttcaaacaaaaatgcttctgtgcttgtgggtgtgggcaagcaatttaaatttcaaatggaacatttgggataggcacagtatagcctacaagattttgcatgctttagtgattctggcccattttgacaagacaattttcagcaaacataaaacgacgtaatgttcgaaatgttgtacctcaaggaaactgttcaccaatctcagagaaactgcaatgatgtggataactaccatacccacatacacaaatctcactattaaaaaatattgatattggctttgcctgaaagaagagtttctactgttaagaataatgatctgcaaaactaaatgcagtgtaaaaataggcttaatatgcttcttaaataagtctttgtttgatactccctctgtttcatattataagttgctttgacttcttttctagtcaaacttttttaagtttaatcaagtttatagaaaaatgtagcaacatctttaatacaaaataaacatattatcaaaatatatttaatgtttcatttaataaaactaatttggtgttgtaaattttgctaaatttttctacaatttggtcaaacttaaagaagtttgactaagaaaaaatcaaaatgacctataatatgaaacggatggagtacatgtattgggtagccatttttggaaagttgaatttgcaatcttttgagttaggttggtagttggtagatggcaaaaaatttgggggagtgttacttccaacaaaactctgatgcttttgctaggagaatttacatagaaagattagtctatgtcgatgtcacctagaccagccagaaaaaagaagctgtggtagtagattctatataaacagtaacatgaaactctcatgtatgctctttgatgtcaaaatctgatgtttgcagtagtaagatcggtataggtggccgttggttcaacactgatgctgtcatcaccttttgccaatttaatatagacgagccctgcagtgagcttcatagtcgcactctgttcagatccattgctaagacattttaaaaccaccttactgttgaagttagtgctactggaagtctggaactgtggaatatactaaaatataggcatcgtgtgaggtggttgtgagccttgtgcgtcatgacctgtgcaaagcaaagtactatgtgtactactagtatactttgtgaagttagtgtcggtgtcaaataatagtaatatttcatcttcatctgacatcttgaccccaatcctttcaaccatgagacaaagcatacatcatttggtgctttaggctttgattttattccacatcatttgtacagatattgatttgcaaatgatttgagcacagttgcttataaatcaagtcgctttcttgacatgttgggacatttacattctgatgcactcatgtaccggttgaaattaaggatagaatttaaatcaatcgtgtgtttgtgtcagcaaaagacctgctactgtttgttgttgtattgaactaatgatatctgctcttgaattaacattatggtacatgcatttctaatttatttacatcgctgaagcattttttcccctcttgtgatgctatcttaaaaacagcccagcacaatgggggaacccgaacgggatcaaatgcgtaaaggagacacttccagtcctcaactacaccaagccactggatctcaaccatgacatgcggatgtacgacctggtagcaaaagttgctaaaaacatgaagaatgttccagtgtcgttgatcgacatcacaaggatgtcagattacaggaaggatgcccacacatcattgtattccatccgtcagggtaaactgttgacaccggagcagaaggctgacccacagaagtacgctgactgcatccattggtgccttcctggggtaccagacgtctggaaccagatactctacaccaggatcctctccaaatcctcccctccatccacacatccctctctccctccacaatgacaagcagggagcatgatttttttttgccccatcgtatactatataggaaatgtatcattactattcaatttttttggtagtttggtgaagaaaatcaagctagagagagaaaggatggagtgggctgtttactggtggcatgtaaaatcgttcaattgaattgtaaattagttttgagctaaccaattgagcaaacagcactgttgtagacactcggtactctggactgtgaaatcagctggcaatacatatatacaggggggcacagtgattaatctgagatcaatttgttagtattatgtgttgatggcgtgatgcttttgtctgagaagagcagtcggtgtgagattggcccagatggccttccttttgtgtttgggccgtatgtgtgcatacgccaccttaacttccatttattcactcatcgaaataattaatttcacgtcgatcctactcctgagaaaaatatagctccttgagaaatcttttatgtattctgaagttcatgataaatcttgtctcagaaattacccatttcagttaaccgaagaaatcacctacaacgagacgataaatctttgtcttggaatcagctaactcctaacttatcagttgccattagcgaccttagcaaggtaatgtatttttaacccggagagtttaactaactcacaagaaaaaaaaaacagtcaacctcaaaacaagtctctgtataatccaaactatttctcctaatgcattttcgttgctctataagcaacaactcgcagcagcctgcctgcatctctttccagatcatacctacgttcacatgggcttaacagctcagcttcaccttatgcggctgagatttgctctaataagtgttatcagatctaagtgaagtagcagtagtagtgctaaaccaagaagatgaggccaactcccatgttgtacgaatacttaccgctagcatgtatctttgcagtggagcacccttaaatgttggtatttgcaaattgccctctaatggtagttggctagttgaagagcatagcagcgtcgtgctctttttttaaggcatataatcacttacaagccgaaaagtctaagcctaaatacataagcgtttttttcgtttggctttttaaaaactataagtcactttacactaacactattaagtcaaaagctatgtccggaaagttttttttggcttatatgagatagagatataactctaccactaaactaaggatttcaaatctatttgcttataaattatataaactaaaaaaactgacttaaaagtctaaacctaaacaatgagacccttatacatatgcttataagccaaaatttagtttattttacatcatttgcttttaatcgttaaatttatgcatataaaagttttactctcttattttttgcttgctaataagccatacggataagaaagcattggtgaaactatgagccgctaggtgttattaggcacaaatcattttgaaacaaccttttttctatgttcttttattcttaacggatttatagataaatatgcatgattttcgaacccttagacaatgtgactttgaaaaaaactttctatatatgaattttttagaaaaccatttaaacactatttttaactttataatatttaatttgtttgtttgtaaaatttataattaccacaaatcatccatccaatcagccatttagcacaaaagaaatctagcttggacaatatttagttggctacatcaatagtgacggggcaactctaaatattattgatggtagtatatcaccccttaaataaattaaacaatctagcttggacaacatttagttaactatatcaagaggcaccagaacttttgaccctttgaccatgagtttcatattataataactttagatgagaaagttaaggacctgtttagttcccaaacaaaatttctcacgttgtcacttcaaatgtttggacacatgtatggagtattaaatgtagagaaaaaccaattacacagttcaccaggaatttgcgagacaaatctttaaagcctaattgcgccatgattgacaatacggtgctacagtaaacatttgctaatgatggattaattaggtttaattaattcgtctcatagattcctgtgagtctgaaatttgttttgttattagattacgtttaatatttcaaatgtgtgtccgtatatccgatataacatgcatgggtaaattttttttgccaactaaacaaggcctaaaatgtacaaatccctttgagatgcttttaggaaactaataacttgggtgtgaagtagttaagggtgatttatgtcatcaagtaaacctgtgttagtaataaaattgatgggagtagtgggtgagagagtgaatacagggatgatggggggttattaaggaaaaagaggccatatgtttgttgcaaagcaatagagaagccaagcaggcagccactaaattgggttggggtgcctcctcctccctttctttctttcatctgcttcgtcctcagatccgatctctcttctcttgttctggggttggggtctcacgacccgccgccttcttcgtccccgtcgctctagaggggatctcaccgccagccgtctctcgccatggcggcggccaacgcccccatcgccatgcgcgaggcgctcacggtatcctcttctcctcttactcctccccgcgagatctcactcgtaaccaaggcggagctaatggcgcctgactcgtatctcttctcctcgctcgatgcagctcaccagcctggggatcgcgccccagttcgtcaccttcacccacgtcaccatggagtcggagaaatacatctgcgtccgcgagacctccccgcagaacagcgtcgtcatcgtcgacatggccatgcccgcgcagcccctccgcaggcccatcaccgccgactccgccctcatgaaccccaacacccgcatcctcgccctcaaaggttccttcctacctagatctacctgctatctactctttcggatcttcacttatttcctagcgatctactctcctactccctaatctttctactatttgcttaattcaaggagccatagactacctagcacattcattttgccatcctaccatagctggaaaccatactgttattcttaccatttgcttcatcttgttcaattcatcagaaatgtgtatgctaattgtggtttacctctataatttcgcgcacatgtataatttccagtaacaatatgttaaggactgacaaattatttagcttcgtgatctactatcaaaaaattcacgatgaatctcgatcaactgtgcattttacaacttcaagagtacttactccatagtaaaccaacagttttcatattctcatgctgctcattcctagtcacagtttccatgcccttgctagttgctactgactaggagtcgactatcatttcggttttcgcttatatttgtagccatggccacaacatcaacttattctcccataactccataagttaagcttaattttaacctcggattgggcttacatggatatttccacgctgttcttcctaattgaatacatgacgtacagatcatctggtcttgcacttgatgtttataatatatcctctccaggcaattgttcacttgttatactgtttcataccattgtcacgatttgttcatgcttcatgcttttgtatgtctatttttaggttgcttcagattggattcatactggcaataaatttttctaatgtttaccatcaccagtgtttgtctgacattcaacattcaatttaaaatgcctagtttatacattgacatcatggtgtctggctagcttactaattgcttacgtagaagcagaatgatatgtctttacttttgcaactttccagctgtttaacttttttttgttgctggaatttgcagctcaaatacctgggacaacacaggatcacctgcaaatcttcaacattgaggctaaaacaaaaattaagtcccaccagatgcctgagcaggtacaaaatttgaagttttgccaaagtatgcgtaaccactttgtttaaattgtatcctataatcttaatgtattctttgcatattttattttcttttcacaatcacaggttgtgttttggaaatggatcaccccaaagttgttgggtttggtaacacaaacatcagtttatcactggtcaattgagggtattgaactattgatctgaacttttgtccaattattattcgctgctttgcattatttggatcatatccatacaaaccaatgattttttttgcatgtatttgttgtaatacaggagattctgaaccggccaagatgttcgataggacggctaatttggccaacaatcaaattatcaactatcgatgtgatccatctgagaagtggcttgtgcttattggaattgcacctggtgctccagaggtatgtttgttaataagtgccgatataacaggctgcaatggtgtaaagatcaaaatccttttgggcatagtgtaaaagactacatatattttcgaaagttgtaggaaatatgctacacctatgctggagcagttcttaaaagtttattacgtaatgctttgttctatatcatcctaacattgatgtgctctctttttcacccatcagaggccacaactggtgaagggaaatatgcaacttttttctgtggatcagcaacgtagtcaggcacttgaagcccatgcagcatcctttgcatcatttaaggtaatgtccggtactccagttatatttgtgctggttacatattctttgttctactatttgccaaattttccttttatttttcctccacaggtcgtgggcaacgagaacccttcaactctcatctgctttgcctcaaagacaactaatgctgggcagatcacttctaagttgcatgttattgaattgggtgcccagccaggtttgtctctggaaattttcaagatttgttttgtttctattttcaagtttgtagcagagtaagaaataagtagaatgccttttatcaaacacacatttgtcatttagtgtagtcagtgctattctgcaaatggttctatattccaccccattcttctccttgtaggccattaacagtgaataaatgttcatggataaatcattcctctgttcactcgttcttcctatcatttatttcagggaaaccagggttttccaagaagcaagctgatctcttcttccccccagattttcaggatgattttcctgtggccatgcaggtgaatatcttgcactctaaaggaagtataccctgttagataccgcatagatctaatttttttaaattttctgtcaattacagatctctcagaagtatggccttatctatgtaattacgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20165 - DNA, 4491 bp, Oryza sativa
  unsure (1)..(4491): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncgataacctcgcattggcagtatccgctctatgaacttaaatcctcatgcactctaggcgtccatgtttctagcagtgtgaggagttctggcggtcccgggaaagagaagtctcacacatattaaattatggttcaagttaagttctctctctcacacactcatggcagttctaccaacggcgacaccgatgtagggcacgcctctcggctctacctcaacggttgtcccatcgtagcgcacctgcctcactcaggggtgaaccatctatgcagggatactgcctccgctcggctatctaatccgctaggtctatacccattcgagaagtacggttgtacgggggtcgtttcatgcttaactttatggctcggtccttaattgaccggggacggtactagcctttcccagataccacccaaatcatccgtccgccccagttgaaaacagttgttttcgctttattttcctttcacaaatcatgttatcaatttcatggcaatgtggtgctcatgtctccacatgccgcatctcaattaccttcccaaaggtaattgcccaagcatttagcatttgataaatatgagtatgcatgatcctagaatagcatttctaagcaattgtcataattgactagggactcatacgtaaacatggataaacaataatcaaggcatggcataatcacaagtaggatgtgcatcattgcatgcaattttatttataaacaaaataatttcgcaattaggatcaacatgttcaaggaatagtgatgacttgccttgctcaaggtcttgggggtcttggccttcacttggatccgcaactccctcgggctctatagttacctgcgaaaattgatttggattcgattagaattcaaataaaaatccaaataaatccaaatggaagtcgaacgcgaaagtcgattcttttatattaactttactattcgcgtactagggcaaacccaatttctttttgtatatcctaactattttgtgggtataaatattttgttatcataagtttttaatttaatctacccgagcgttatatccatataataggttggaaatttctatcgcaagctaaatatcgaacggaatccaaaaattatcttataatattatacgatttaattttagtctaggactaaacgactaaatataataaacgtctaaaattcctagtgattaagtccgaatttctaccgtgaatcaattacttatagagattacccaaaataatctataatagtctataagaattcatctaatcgtttagttcttaattacatttaaactactaccgcgaattgatttcttgtagaaattaccaagaataatccataatttatattaaatttcgcaattctacgactataactaatctataactaaattctaattattttaaattttcaaaacttccctaatctccctctaatttcctatttatttcccttttctttttcttcccttctttttctttttccttcctttctttttcttttctttttttttctttctctctctcctttcttttctttttccttctctctctcccttttcttttctttttccttctctctctccctcccggtttctctcctccttccttcttctttctctccctcggcttctcccttcctccctctccctcggctctctctctacccggcggcacggcgacaaacagggggggaaggcagcggctcaccgacggcggcagcggcaacgacggcggtggtaacgacggcgcacggcgcggcacagcgcggcggctcgaaggcggcggcgcggcggcacgatgacagcgacgcgtggagaagttgagggaaaagggagaggaggaggggatggagtggggagaggggagattggtgggcttttataggggaaagagaggataagggggagagggaaagaagggaagggcggtggaggggggtgaggcgacggcggcgatgtgacggcgcgcggcgcgcgggcggagatgacgacggcgcggcgcggctcagggcgcaaggcggcgcggcacgtggcagcggcgctgggcgcgaggcagcggatgcgcggcgcgaggcgacgggacggcgcacggcgcggcagcggcacggctcgaggcggcgatggaacgcgcacgcggcgacgggatggcgacggcgacggcgcggcagtggtggcgcgcggcgcgaggcggcgatggtacgcacgcgcggcgcgaggcgggacgcgacggcgacggcgcggcaacggcaatgagatggcgacggcgacaggcggcgatggcgacggtggcgcggcggcaggcgacgatggcgacggcgcgcggtggctctgggcgcgaggcggtgatgggacgcacgcgcggcgcgaggcgggacgcgacggcgacggcgcggcagcggcgatgggatggcgacggcgacaggcggcgatggcgacggcggcgcggcggcaggcgacgatggcgacggcccgcggtggctcggggcgcgaggcggcggcgcgtggtgaaggtggcggcagagagagggggaaagaggaggagctgggttaggggaccacgtcgaacacctggcggccgatgaatagtgactttttctatttatcccgattttagtgtattttccatataaatttgattccacaattcctaattttgcatatgtgcattttactcaatatttgtgttatcttaactaatgaattcaccctagattaatattactcatattttatttttatataatttatttgagttttaattagggttaattcttattccattgtatttaaatttaattgatccaaatatggtcgcgataatattttatttatttctgtccacacctaatctttattttaatttgtatttattttaccaatttgtttgtaaggtttattcctaattaactattctttactcacgattaataatcttcgagatcaaatccagataaaatagacgaataagatcggcatgatgcaattaatttaaaaagtttttgaaaatccgtatttttagagttttgattttgtcggtcgaattttcagggtgttacattatcacttctaccatctgtacacatagagtgtaatatggctataagcaaaacttgtgagactaaggaaatcaaagttctttgtgttgaatcatttcatgaaggcacatgatacagtgacaaccaaattaaggatagattatatgttggattttttttctacgtagaagttcaactagttcaattttttacacagttttgaagaactttaaaggtatgttagaacacataacacccacacaattgcttggctggtaatgcaaaatattagcaattgtttcaagctaattactttgttttttcatgcttgattgttttctttgaaacaacatttgtttgaaataagatcaatagtgtataaatttgattagtgtgtgtagtgtacttataaattttgaagtgttctacagtaaagtttgcttttgtcatgtagtccaattatatcaaagaatatagttttatcatgtaaattataatcaataagttcaatataatttatatcatcataattaatgaaacttatttaaaaaatatgactacttaaaaaactatggttcgcttttttttttctccttatttactggtgcctttgtctactcggaatcaaagaaaaaagtaacacgtcatgccatagttgatatatggctatatgctatttatcagtactctatgtccactcattgctcagtagtgtcttccactcaccaatcatcttgtgataatcatatagacaatatttgtctatttgtttagtttacctaaagggcaacaccacattgctcctttctcatgcatggtcgtagactctaaaatgatttgcccaaagcatgttcttcattaacacatgtaactagaacattaattacataatattatacaagtgtggcacacttggtaattttcgttctagtttcacccctgttctggaaaaagtgctttaggaaacaatatatacataattctttttctgaaacacatcatttaggaacttgggaaatgtgcaaatgaaaatccaaaatccattaggtaatcaacccttcattttagcttacactgagttgcattttgcaaaaacttgacccactggacttg

SEQ ID NO: 20166 - DNA, 1582 bp, Oryza sativa
aaatataatggtataaacttcagacaatgtattatttggaaataattagtccaccagtttaagtaaaatattatcttatattattaatttaatgggttaaaaatataactttataactttatttttaaacattgtagagctaatgttcagttatatttatttgtaaagtgttactttatgattatatatatagtatatgtttgtaatactatattttttaaatttattatgactaatataattattttctcacatatacatgaaaaaaggtggaaagaagagggaagctggtgtatttttttaattgatgtatataatttgtgtttttagtttttttggctttaacgttcattttttggctttaattgatgttcatttttgtcttctcacataatgttttacgatatgtatgtactttgtattttgggtttttttacgagcaatacttatgtgaacaggagattagaagaagggagttttttaaaaaatatatctaatctaacgggtccatcaatttatgtgaaaattgaaactagatgttttgcttttttttcttagaatttcaagcaatttctttaatttattagagtgccacgtgacggcttaagagcatttgtagaaagtttaatgaacttttactatataatagatagataatttaaatatagaatgctgaagcagtgttgattggatattttatatgcaagatctagtttaactgcatatatttatagagtaatatacattatttctaaatagtagaaaatactatttcaaagctcatcgattttttttcaatgacactaagtgttttttttctttactttatcgcttaggttaatcgtttttcttttagatgtatgttcgtaatacttctttttctttttccggcctataagaggaaagtattatcttttaaaataatacatctaatctaatggtgtaaaatatcgggtccatcaatttaaataaaaatcgatgatgagattaaacaatgccatgtgacgatctaggagtgcttgtatgagcgctacatgatggttttagagcgtttgtagattggttttagagcatttgtagttagtttaatgtattttgaagtatataatagatacgtgtcagggctgtgcaaccgtcggttttaattactgtagctttctgtgaacaatagcagttcatattggtacataagagtcctgttataatcttagaaacacggttgagacaagcatggtggcccaaataccaccataatttattctatttgtccttctcccattatcaaattttttgtcacataaagtagctggccggctgtgacgtttgggccaacttattgaaatagataggtggcttgcttgtcatatacatcctccgtttttggaaagaaaaacaatttttaagaatgaatctgggcaaatgttcttttttatttacaggtagtaccttaggatgaaatacggttcaatgatagggaataagatatggcattgttatcctactaggggtttcccggattatctatatattaatcattgtttttgagggtggaaaactatatatgttaattaataaatcgatc

SEQ ID NO: 20167 - DNA, 41033 bp, Oryza sativa
  unsure (1)..(41033): unsure at all n locations
atggacagctgaaggaatttctggatgtgttacataaacacacaaacattaacctcaattgaaagaaattgtattttttatatatatttcagcatgacatttcaaaaaggaattagtgaaaaatccttttgaatgaagctattcagggaaaaaaacatcaaatttgcaggtccactcttactaacatttcgactttaaaatcttttaataggaaaaactagtggtcattggtgaaagtaatgtggatgacagaacaacatgttggatggaaactactaacccaactaacaacgaatgtgtgcatctagcaaaaatctcttgatgataagtaatactttgattcactgtgttgagctacagacacatttttaccttcttaagatatacccagtattgtaaactactgtttcatcaaatttatgtgcagtggtgaccacgatgctgttgtgccattcctcgggacacaagcctgggtgagatcactcaactacccaattgtggatgactggagagcctggcatatcgatggccagtctgctgggtaagattaatgttgcctaattcgttttcttgtttagttatgtataacactactacggggtgattaataagattttcataagtttaaaatacactgtgtttttcagttcataataaactcagtcgaagagtacattacctgaaatacgatttatttatttgcagattcaccatagcatatggaaacaatttgacattcgctacagtaaaggtgacaatatatctgtctacaaatgcatgattcttgtttttcaaaaagcaaatgaaacttttcttttttacattcattatttttactatggttattttgaatgaagttaattaactcctacagtttcaaacagtttgggagtatctaggttctaatgatttgttaaataccagatgcaaatgtttggttgcagtatgggttgaaagttgaaactgcaaaacgaaaattttgaattaagggtacaagttgtacactccacattttcatgaatgaaaacttcatgcatagtgatgagtaaaaataaatccaaccattaatgtaataaagctatgtttgttattaaagataagtgaattgttcatgcttgttcaccagcataacttttgaatgaattggcttggctggtgcacagaactaaatttacgtactattagagctagagatcttgagtatgaatcactagtgcaatccatttattatatactaaaagtccattaaacatcatataaatgctcctaatacgcaagtagcactcttacaaacaatactaagatgccatgtgtactccaataaatcaaagaaattcctaaaaaaaaaaatccaaccattgcatttcatttaattgtgtggacccattattttcatgcatttgatttattttagattagaaaaaaaacacttcccaacccaacgtcccttccatggccagcacgtatgtcgatggaaatgcgtacgtactaactactaacgtacacaactcccctcgttatcttactcctgtttactcttctatttacgtgcaatattagttaggaagcataatttctaaaaaaaaaagtttaaacagctataacatctaagttatatagctaataagctaattatatgttcctaggttatttatgactaaatttacatttaaagacacatatttacttatatttcaagtttcaaaaaaaatatgtcacttctgtcttattttttttattttcgtgtgcaattaaaaaatattaaaaaaggaagatatagattttacctttgtacgtaacttcacaatgtctttaaaactagaaaaactctaagaaattgtgaggaaataaacatccaactatcgatttttcactaaaatcgatggacacattgttttcaaccattaggtatatttttagagaaatcgcgatcatgtgtcatgtcttacgaattagaaaaaaatatttgaaattatcaagaagaagcatcaggttttcacttaaatcgtttagaaaaattagaaatacgaactactttctactttatcctactcctaaaatgcacataaaacttgccccgccccctctcctcatgactcagtctctccgatctccacctctacctttctccttgtttctatcaaactaaaagagaaacgatctataacattaacatgaccataatatttaagccatagatctgatttctaatctaactattgccatattcataactaaaataacagttaaatgtacacaatgcctatatttctaacttaaaataagaaccatgtaaaataaaaaaacagaaaatagcaaatgtcaatacagactaagttgagccatttggagaaaatctaataaattcgtaaaataatttggtttttaatttttcacttaaattgaaacaaccatagctttttccattgccataacaattttaagtgcatggtcaacatatatattaatggcctcccatctatcctatagcgtgacataagttgacaaagtgtaattataaatttctccacatattatttcattatgtggctgggacaaaagtgattttttaatctaggagacatttttatcatttaaatatattaaagtttacggtctatttcacgtcatagaaatgataagaggtgacttcttttagcgacttcttttagcattgctttcataaaacaataactaatatgcccacgcattggccggcttccatcatagttaaataaaaaaacacagcccacttctatgagttgcttgtacgtatagcattggggagtgttgaagtataaaagtattattctctcttcctcattcagcttatgtttttcaatgaccaaaggcagttgatgcaactcaacacaaatatacagcaaaattacagcctaagaggcacgctttgaccgttttcgtataatggaaacaaatccaataacatatgctttgagctgaacctaggacatataattaatttattttatttctagcattcaaataatcaaacaacattgatgatgtaaactattcctttagtggcctctacagcaaggaacttctatatctaacccgtagtcattattaacagttcgatgaaagaaaccagttatatttcatccttagtcattatcaacgacaagatagaagaagaaaaaaaaattcaagaacttgacaaaagaccaactaattattgtttgtgattttacttgttttgaatatgcattgtaatactgttttactctctccaaatgtagggtgctggacacactgcaccagagtttgagccggagaggtgctttgcaatgtttaagcgttggatttccagcataccactatgatgatggatgtgcatatcgtgtaacttgcacaaatggaggattgtagtatgaatgtcatgggtgaataaaatcaattcttttttgggaaggctcaaaacaagactattttttgtaaatttgattctttttgacgagaccccactaggttccaggcggaccagaagtcctctcacctacaaaaatcgctccttggggatggttaaggggccgcatgcaaaaatttatttcacaatcgctccctaagaggtccacctatgataataggtggggttgcccgcgaaagtatattttcgcaagcagacaacatggagagaatgtgtgccccatgcgtcccgcactgacacgcactaccttttctttcttgatcttcaccttttttacacctcctctccactcacacacacctttcttctcttctcctcccctttgctctggtggctaaggcttcacattccctctccactccctcttcctctcctcatctcttccccattcctctcccccttctcttctccggtggttgagacggaggcagctaggagcgacgctgacggcggcgacggtgactactgtgagggcggagcagaaggaaggtcgatccggtggcgccgcccttgggagcgtcatatcaaccgttagcatcacgaggtcgataagcccctcaactgccacttagtcgtcacattccaccgctagaacgcacctccctctagccagcaatgcgtgcctccccaggtcaagccggtccctgtccgccacctcctccgtctttcctgtcaccggttcgccactatcgacaccgacccggagccgtcgccatcttcctcgcgtcgccatcgtcctctcatcattgcccgctgtcgtgagccctcggtgagccgcccctcctcttcctccccttctgccgccgctccgcgcaccctccgtcgcgccagatggtcgccgtctggcaccatcgggctgtgcatgtcgcaccctcacggtggggaaggccgaccgcaggaagccgcttcccagccgtctgatatgccccacgacagatctaggccgtccaccttgccgcccgtgtggctgctgcgtcggcacaacatgtgcaccacatggtgcacctgtccccagcctagtggacttagtccactgtgcgccgccctccttatgtcaacaacgtgtgcggcccgcttgtcggtgctggcctccattcacttacgtcagtgctcgagctttcatgcgcaataattcataaagttttttttctattagtatattcatccgagctccatttatgtcctttcaaatcgcactgaattcatcaaaatgcctagaattcatttaaaatgtttttattttccatttcaaaagacttatagcatgtttgctttgtgtgcattgtttgtctcttagattccatcagttgtgaacccccgttttacttcaaagtggttgcagaggtttcagcagcactagagcaaggcatgtcatgcatcctcattaaacatattgtacccatctaacaaatgtctcgctttgtattaaatactgtattattttacaatgtcatgtggggtagtttcctacatacttagccacagtttaatcatcttgtaccattgataagttgggaattaatatgactagatgttggtttaggaaatgcctagccatgcttagatcaactacctcactatgggaatctcacatataccttatttcttggattaatgatgatgacattggacatggatcaacatggtattaattcaacgacaatatgcgtaatggtgggctatgggcatatggttttgatagaagcgcccaggcagctaaggactagttcgtgggaaacaactgggtctgtagtatagctcttccctctataacgtatccaggcaagggttggcgtgatggagttgggttggccctggtttaagcgttgatcagttgcgagattcatcgcggtgcacatggggttgcccacccctatttaaaggtggcggttgttggtatttcttacgttcacagataaatctgcaagcgcacggatattgttgtagcattttacccatgagtattcccaagggtatcgtatttatattctgcaggcacggcggcggcgtaaagatataaattatacatcattcatctatctacaattaatccaccatagtctaaaaaggagttaaagataatatgattaaggtagtggacacacagtatgttcacctctatattaatgcttagtagaacagagtattagagaactatgatacaactgtacttctatactaatcatgtctaatacacacttaacatatacatgcttacaacataggacttagttccaggcacctaggtactaccgagagaccactccctgctagtctgcaagcgtagttattgcatttacgcaatacgtcacacccgaacgtggaggaatacaaatgatggacatggatatcaccacctaccatctacctcacttttcgtggggcacacccacatccaatggcatttatataacctaagcactgtgcttgtgctagtaaataatgtcacttactcccctaggactcccaccctacgggtagacaagttagcgctagagctacctataaaggtcattagaccgttactgtagcatggatcaactagcctagctagaatgaagcagttatacaaagtatatactaatatactgcctggtgggcccttccatccgcgtgctcgcacatgattcgtcggaggtgtgtttctttgcatgccggcttcatttttccttcactttgatgtatattctctacatccatgttaattctctaggtccagtacatttaatttatttattatctattatatactaaaagtccattaaacttcctacaaacgctcctaagccgccacgtggcgctctacaaacgctcctaaaccgccacatggcactttaatatagtagagaaaatcttaaaaattctgataaaaacaaaatacatctaaccattgattttcctttaaataggtggacccatcaattttaaccattagttctctattaaaaaatccggtacaacaccccgcaccgtatttgcgcacgtacgtaatccgtactccctccaccctccgtatctcttctcctctcctattttctaacttacctttcatatttttctagctaacagttaatatataattgtaattagatagatcataactctcaaaagttatcataaaagaaaaaagaaaaagatccgtccgtcgatttcaactaaagctgatggatccactatgcatgtcaaacagttagattatatttgtaaaggggcaattgcttatttgaccccgttttgaaccctaactaccaatttgaccctactttgttgagtttgcttatttgaccctcctttttgaaaatgaagatacggtataaccctattctgttaaaggcacctaatggtgttaactgaagcacaaaatgtctcttatgcctttaatgatttgaccctattacatgtgcgacccacccgtagttctctcttctcatctcctcctctcctctcttctctcttcacctctgcttctttcctccccgccaccccctcctccctaggcgcgccggccccgtcaccactgatctcttcgcgtgtcggcgccgctgccgccgcctctctccagcgcaacgccacccctcctcccaccaccgcgccggctgccacgacctaccttctcacgccggccccgccggtggtcctctctccgcgtgccggcgcccccggcgccgactcctcctgctggctccgcgcatccggcgtcgggccgccgactgcttcatcttcgcagtgccgcctcccccacctccttccccatgccaccgacgccgcggagatgtcaacgagagagggttgggccctcctccccgcgccgccgcctcctcctgctcgctcccctcatcggtgtcggccgcgccacgcctcctccttccccatgcgtcatcccactgcggggcgcaggagctagggatccgctgccgcaccagctggggatctgccgtgatgaccgggcgccggcgcggatcctcctgtctcgccgccgccgcgcacgcagagcgccgccgccgccctcctctacctccacgccggcgcgaggttccgattcacgcagccaccactgccccctcggagcgccaccgccgccccctcagtgctgtcgccgcaattggcgcaggaacgagagagagaaattctgggtattatgaatactggttacatttctttttttattttaaataaaaacttaacggattagtggaagcagggttggactggagcttcgttttgaaaaaggagggtcaaataagcaaactcaaaaaaaaatagggtcaaattggcagttagggttcaaaatggggtaaaataagcaattgtcccatttgtaaaataacaggcctatgttcggccttggagctattcaaaaataacgaacctttttctctctctctaagtgtacctacatatgttaggatatgtttagatcccactttaaattttttcactctatcacatcgaacgtttgaacacctacatgaagtattaaatatagactttaaaaaaaactaatggtacagattgggactaattttcgtgatgaatattttaaacttaattgctctatgttttgataatatggtgctattgtaaacatttgctaatgacggaataattaggcttaataaatttgtctcgtggtttactaacggattctgtaattagtttttttattagtgcccaaacaccccataatcgtatataatacctgatgtgacacaccaaaactttacacccatggatttccatacccccttagtcaaaaaataaagtgtacgtatatagtgcaagagtataccgtggttaaatacttaaaaatagtattcaaataaatataacttcttaactgtgcatgcaatttccaactggtttgtatttttatattatttttgattaaattaataatttaagacccatgttaactatattttgattatagttatgatattctatgcatcacagttatgaaatattttctaaataaatacgatatcaaatgtgctattatatattaatctagaaacgtatatgtagttaaatttgatccatgataacaatgatgacgatgctctacgtatttccatggtgtatataattttttaagtagtgtcaaataaccaactacactcatcaaatttaaaagatgataaatgtttatatactactaaaatttgatagtataatttaagtgtaccaattacttaataaaaatgtgtctccactaaataaaaaatagactcaaaacacgtaatgattccctcacggatacaatattcttttgttgatcttccctatcttcaatttgtctccgtgaatcttctcattgtcctcccttatagtccccaccaattcatcccataataaactatcataatatatatgcaattaaaaaacaccttactttttacttctgttgacatgttttccaaagaaaataagtctaccttcttttcatatgaagaagaagattataaataattgcttacagacattacttaaatatgatataatataaagctaataggttagaaaattataaaaacatttaatgtcgatgaaaaaactttatggagaaattgtggcagatgttctccggttaatatttcgcttttataagtgtctcaaacttagcatacgatatatgcccgtgtaaatgtgtgggctacctttctagttgttataagtgtaagaaatattagttatccttttatttattatgatagttgacagtcgaaattggtacttatcgaccgtcaacaggggtgaaacctcaacgtggtaagcttgattaaagggagttgtgtgaagggtcctgtcccttttttgatatgttgttgtggcatgtcgacgcatagaaacgtgttgtttggctatgtttcatgggtacagtctgcactctgtttgcagatattgaagatggggtcagatcgacgcttaatctgaagttagttcacatgtccatatttttctttttttctatagatacattcaggtgttttacacgcgatgatttaattaaataataaataagtggtgttagagataactagattgctataggttgtcgatcaaacataaagaagaacaggtatccttacccatatcaagatatagtttactatgggctcgtggccattaattaatttgcaatttgggagatggtcagggctatctgataggtaatccgccgcttactggcgaaggcattgtctacgcatcaaaagtgccgtactgccatggagtcggaatcaattcagatcagctatatgaggtaagcacttaaacacgctgctcgcaaaattttaattatgtcgaatgattcctgctcgggcttgattaactctgcttggaaatgcatatgtatgtgatttgtctgaaaatgacaatggagactgcgaattgaagttgatttgcaaacaagctttggccaagcttgacagtgtaaggagacaagtacacttccgttttttcgcgattgtatgagttgaattatgatgacaattgctagcaggaaaaaaaagaaatttccctgataattctgtcacaattaactcattaattgcttaagcctaaataacatgtcatttttttaagtttcttcaaacaaatacatacacaagtgtccaacctggatagctgaaacaggacaaacactttttccccttggagcaaatatatgcaccggtggttataaataaactaattaacattagacagaaaattaggggattgtgatcccatggatgaatttttttttcttccaagatttggaccctagttttcggtcaaattctatataggtagacccaagtaaatatcattcatgtttagttctcaaattagtgaattttaagatttaagtactggtgtgtcaggactatgtaaccgtttgttttgattaacgtagctttctgttaactatagtagttgattggtatagatgcgtcatcctgtgatatataatcctacaaaacactcatgttcagacaaaaatgggtggcccacgtatatacctccatttatcatgttttcgccgataaagttgctgcagctggttgtgacgtttgggccaatttattgaattaagtagacatttttgggttttgcttgttatatctatgccacctcttatccacgggtaattatcaaaatctaaacacttcatcttctcccccgtatcattttcataacattttaacattcattatttgtacaatattttacatatatccatcctatagcctaatgattacaagagcctcagtagcacctgaggtcctgggttcgactccccatgggagtgaattttccagtatttaacggcgttgtgctttcagtggtaggcgatgtacccgttgacaacgaggcgcctgtggggacttcgtcaatctctccaggatttgctggcccaatcttcgaagatgctcataagggtgagtgtgcgtgcgttgtgagtgtctgcattgtactgtgtaattctaaaaaaaaatttacatatatgcatctattaataccacaacaaaacacgaggtatcatccaataggaacgatgaaatgaaccaggttcagtgattggaaaaaaagtacttaaaaacctatgtattaatcattgttttgaagtgtagaaactgcataaatcaactactcctttcatgactctgtccctccgtcccaaaagttgttatattttagaatggagagagtaataaactgatcatagctaaacattagattggttagtcatatcaaactggctatggaagacattgtgggcaactttttgtgacaagtcgacaagcacgattgcagcacctaaacaccttgcggtgatatggagtcaccaacctcctcgatctagccaaatggccaaatcaagatgggttatgtagaaaaacaactaaaccggctaacggagccgatttagagatcaaaatcagcctctaagccggtttagatcgatatgaggataattacatgtttcgtgggcaaaacgaaaggttttcaggacaaacctacaaagatgtgtcacactctcgcagcggcggcggacaatttacggcacaaatcgacaaagatggactaaaactagggtaaaatagaaaacatagctaaaaagtaaagataaaagaaaaagcgattcaagtatattgtgtgtatgggagattacaattgaaccggccttgtcccttaaataggggttggtcttgccctctacaggctctcctccatgtccaacttggtatagaaaccaaaggaaatccaaaatatgccttcccaagcaagaaaacccgagacccgacgaaaacatactcagactcggaatctgacggtctgaccggacccatacctgcggtcagactggagttcaagccacggtcagaccgcccacatacctacggtctgaccggccccgtgaaggaaacccgacactttccaaactttggcaattttcccctatttcgtgcataggtgccaaatttcggtgtaaacagacatattgttgttcaactgtagctactactacaccacggttcgaaggcccaaatacgtccccccctaccaaaccataagacaaccggtagaaagaccatggaaggactagcatgttgcactgaggcaaaatatgttacaggatatccagaaaatttgtaattggctagagaacaccgcaaaaacgtgtatcaactatagagcaccgcaaataactggtaattagctgcttgttggcgctgttaatgacaaattttatgccaccaatacctgcataaatcaaagaaatagaacatccaatatagtgatagcgttaaattctaacatattccacaaagtgttagtgtatatttatatgcaggtaataaaccgccaaagatggatgaaatatagacttaagtgaaggagaattcccatccatatcaagagtgggccagaaactatcagaaaacatattcaattgggccttccactcgtagatatggatagtggaggaggaggagagacaacatgccaaaacttgggcctgttggacctggcctgggttcggccgaaccactcccacggcagttcgatcaaggttttggcatgaacggtcatgggttctgccgaaccactccaacggccgttcgatctaggttttggcatggacaatctggatgaactcctgatagcggttgaagggcaaaaaggacattttgtgttttctaaccgtcatacctacccttatataaggacttcacctcttcacttcactcacacactgcaagcttgtcacgcccagaagtttccccctttttccttgctttaaatatttgttaaataaatcgtccgaagaaattatcttaattaacctagagctaattccataattaataaatgcaattaataatcggaaatagcgtggtggaatttttcttgagttccccatgctccaatgcattaacaagatttttagtggaattttcagagccttggaaataattttaaccaattaaaaatcaccaaagtgcaatatctaatcccaggaaaatccttctcctctttttcttttcttttccttcctttttctctagatgggccatcggcccatctctctccccgcgctcggcacccctttcctgggccggcccgctcctcctttcccctccccgaagtcctccctccctccctttctctttcgggtgccgacaggtggggcccacctgtcggtcgtcccttacctctggtcgttggagccggagctccaaccgcccgcgccgccgccttctccgctgcacgtcgcgcctccactccgcgcccgcacctcgcgcccacgtcgccgccctctcccccgcatctcccccgcgcgcgcgcacccgcaagtggtgggggatttgaaatcccccaacaccctctttctctcctccacctctccacgtcgccggccaaataggggccatccccggccgtttccgcccctccctcgccataaaaaccctcactcgagctctctctctcatttcccccattcaccgtcctctcccacgccctctaccgccgtcgcgccgcgctcgccgagctccgccgctgccgcccatctccggccgcgtgccgtcgccactagggccgccgccgcgccaagccgccgccgcggctagctccgccgccgtgtgggccatcttggccaccgcctcgcgtcgccggaaccccaccggaaccgcatctccctcgcgagccggtgagctatccattcccctccgtctccggccagccactttggtcgtcgcggtcgccttctccatccctaactcctctcctcccctcctctaggtgtcgccgccgctcgtccgcccctcctctcgtcgggtcgtcgtcgccgccttcgtcttccgctccggccgccgtgtcgccggtgagtcctccctccccctcctttcctcaccttcccgcgagcgccggccacgccgctgctccggccatgcgccgctgcctttcggccgtcgccgccgcttcccgcaccgccggtcaccgccgtcggtggccgtgcctcgccgccgcctcgccttggtcggccggtcggcccttaggcagagccgagcccggccggcgcctccctcgcctcccctttgagccaccgcctggtggggcccacctgccaggcgccacctccctccctttggagccgctgacccgtggggcccacgtgccggcgccccccctttcactgacgtcagccctgggctttattgcgcaataaaatgattaaggctttttctttattagtaaaaacacagtttatcttctaaaattcttaagtaattcatccgagctccgtttaagtccattcaagtctcagtaaatcaagaaaaatgcaaagaatccattaaaaatggttttgtttcctgtttctgtagtcttatagcatgttttgcttgtgtgctttgtttgtcgcataggttttggccgtttcgtcgatccgcggtttctcgaagacgttgctgaggtctcatcagttcgagagcaaggcaagtcatgcaatacgtttgatcatattgtacccaatttacaaatatcccgcatttctattaaatgttgcattcttttacaatgtaatgtgggatgggtcctattcctcagccacatattggttacctgatgccattgataacttgggtatcaaaatgactagatgttggcttaggaaatgcttagccatgcttagttcaactagtacacaaatggggatcacattattacatagactttgtctattggcatagctttagattggtgccaccgcaagggtgtcagttaattaaaatattctgaatggcgggctgtgagtgcatggttttgctagtcgcacccatggcagttaaggaccggttcacgggaaaccctgggagacttaccgtgcttaccacaagcgggagtgggtaactgcttgatctgaagtatagctcgaccctttcctaggcaccggtggcgagggtgggcgtgatggagttgggtcggccgaggtgttcggttgtccagctgccggattcaccgcggcgcaagaggggaccgcccactgccttttgaggggtaggggtgaaaccttagcgtggtgtggatggttaggggagggttatgtggagggtcttgtcacgatttccccctttgcagtatcatggtgatacttcggggcatggcgacatgtgtggaatcgtgtcttgtgggtacagttgtacacctctggccagagtaaaactattcgaatagccgtgcccgcggttatgggcgatcaaccagattcaccgtgattagtctcacccctagtttagcttaatgaactggtgtagtttaggtggttggttgggcctgttgcaacgtggtgtagcgttggacagtgattggttaatattgattaattactacagctgttttactgctttcaactactgctttgaaatgcctgctttatgcaaaagaacccctagcttcctttggttatatcctgcatcatacctcctcttccggtatgacttgctgagtacagtgggtagtactcagtcttgctctcttttcccccacaccagagttgaagttcttctcagttggagccgtctcagagaggttggtttcgttgctgccgtcaaggtttgcctgtggagtggagtcgcccgctgctgaagtcaagcttcccggtttagctcgctttaatctttcccgctgcatttgtaatcttttatatttttgtaagacgtgggtctgtatgtcaacaattgtcgtttgtgtaccctggctggtcctggacagggatttaatgcacattcagcttagaaattctggttcaagaatttctgggtgtgacaaagcttgagctgaattataagaggctctattgtactatgttgtatactagaataggaagagagtagagtagaagaagtcggaggaattgcggagttatcgtaatccgctccctgtttctttctgctctgttaattactttgattataatagaattatcttttgagtaatttagtttttctcggttagaattatctcttggttagttcctattcagagtacgggatcatcatacactataatcaactaaaatacagtgatttactttagtgtgtagctagcattaaagtaagtaatttccgttgttttcatacgactattttgtgatacagatcaacaatactcttagtatcagtttttactcttatactatatattgaacacatcagtaaacatattactacatggtggctatgagatcatggctatatcgagaggaaggtggtaattgttttacttgcaaaccacgaaatctcagtttttactcttatactgtgtaatgagcacatcagtaaacatattactacacagtgactatgagatcatgggctatatcgagaggaaggtagtaattgctttactcacagaccacgaaatctaaacattatttataatattggtaaaagaataactagcgttgtaagttgtagtaattcttttaagaccatctaggtatggcgtcatacgatgtggaggcattggcgtcatatgatgtggaggcattcatgcaagtcaatttgttacttttgattgagcagatgtgggaggctgggactaaatgaaaaacttcacggagtaaattcgttacttttgaaacgtgcagagacactagaaaaacgaaaactcagaaagaaaaactagacggtaaatagtttactaaaacacgaaaatagaaaaactacatagagggaacaaaaaaacaaaaaaatctggatggttaatatttaactgggcccatgatgaagcacggatgagatggaaaagtgaaaaaaagaaacacggaaggtagagtggtaaaaaagaataaaacaaaccgagaaaaggtgggatgcggaggaaaggtggggtggtaaaaaaaagggaaaaccggaaggagagggcgtcgtgcggcgctcgaactaatattccacgctgtagagcgcagaatagcgctacctgtaacttttaatatttatttaataatcaagttaaaagtaaaattgtattaattattaacaacaaataaaattggtttgtcaaactatgttcaaagagaaataaataatgtgaacgatatatatgtgttaaaaatattgtgaagaataatgtgaaggaagatgattggatgttgatttgcataattcaattataaatgatgttgcatgcttgcataagttttgcatataatcattgctagtggatgatgaggtggcatgtttacatgttgagcttaggattagtgggttattactttatagtaagataggataacactagggctgtttccgcttcacgctccagctcccttatcttgtgagctcgccagatttgactattagacatgagaggcgtgtagaagtggagccagggaggttcgagcggaacagagagacgagagggaggaggtatgctgccgcaacccataaggagagaggtaaaggggagaggcagatggcggctagggtttgggggacggaaccaggacatggggattaggtaatatgtgtaaatttttccataaaacacccttaacttctgtttttcatagggcagtcccattttccgttctatttcgcttcgttacgtagaatattacggtttatagagagcatctagataataatgcagaaagtagaaactaagtaccagagatctaaaaaaattaacaaagaaatcaaggtttttgtttttgcaaaacatcaaatgtcgacgcggacgcacaagagctagtgaaaaccactaggcttccagcatcttgttgttgcaattaatagatgggccttagccctctcgaagattaattctttggaaaatcacaaaagcccacctcatgggatggtatgcatgggagtttagtaccacctttcttattctaggagagggggacctccttaaaagggtggatgccctactagcaacttgaagcatgtgaggtggagagaagagggggaacacgcgcgcgtgctcgctcgctcggcatggcatggcagcgcgtctgcacgacgtacgcatcgaatggtccgccaaagttggttcctcacccttgcgtagatgcagcttccttctgcagttttgttttgctgcgggaaatctggatttgtttgttttggaaacattccgaaaaatctagtgcgagaaaacggcgtggagtccggataggttacgcgcgacttatccagttcggttacgtggagtggacatcgtacgagcgccctgatcaagcgacctttctctatataaaccgagccgccacctccacgcaacgatacgaaatcaatctagggtttgcctcctccactatactgcgccgtcgctcgtagtctactccatcccactcgtcagcgtgcactggtgatcgggagagtaggtctccagaacctgtgccttcagcgtcctacaccgggggaaggcggcaataaggtttttgggaagtgctccgtgcgactgctccttgttcgaccacgacggctcgtcttcctgttcgctcgcgtgctgtgcgtcgttgtcaacgcctgcaactgctgagcaaccggtcttccactaccctcggtacgtgctcaacatactgtgcatatttgatttgttcatgttatcctgcttagtttacatgtgtagatctaatgatacgttcatgctagtttacatcttcaatgtcatgatttatttatggaataaattaaatcattatgtgcttataaattcaacaatccaaaaaccttattataggcactgtggttttactatgattggttttgccgatgcactgaagccggataaattcaccggtgtgcactttaagagatggcagatcagggtcactctgtggctgatagctatgaaatgcttctggctgagtactggcaaaactatgggagttcttactgctgaccagcagaaagaattcgatgaggccactactctctttgtgggatgcattcttaacgttcttggcgatcgtctagtcgacgtgtatatgcatatgaccgacgctaaggagttatgggatgcactgaataccaaattcggtgctactgatgttagcaatgatctgtacgtcatggagcagtttaatgactacaggatggctcatgaaatacagaccatggctaaggaactcgaactccttacatgtgtcttacccgataattttgtggccggatgcattattgcgaaactacctccatcttagagaggttttggtactgcactcaaacacacgagataggaatacgccatttagtggttgatagcgtctcttgatgttgaggagaaagctcgagaaaaagataccgcgtctaagggcgatggtggacagtctagtgccaatattatgcacaaggcccagaacaagaataaggggaaatataaagctcaacagaccaccaacttcaagaagcagaagaagaacaacagcaatccgaaccacgatgagtgaacttgctttgtgtgtggtttgactagtcatctggccaagaagtgtccacaacgcaaggggatgaaggcacctgtagggcagacttccaagtttgctaatgtaaccattggtaacactggaaaaggaagcgggtatggtaatttacctactattttttcagctaatcagtctactaattggtgggttgatacatgggccaatgtatatatttgtgctgatgtttcgttgttttcttcttatcaggtagcacgggattccaccgtcctaatggggaatgggtagatatgaagttttgttgttcatggtgtttgcacggtagatctgaagtttacttggggaaatatcgtgcagttgaagaacgtgcagcatgtccctacaatcgatagtaatcttgttagtggctcccgtctaactagagacggatttaagttagtttttgagtgtaataaagtagttgtgtctaaacatggatattttattggtaaaggttatgagtgtggaggcctgttccgcttttccctttctgatttctgcaataagtcggcagtgtggatgatgaggctaatgtttggcactcacgtttatgtcatattaattttcgcttgatgtctcgcctttccaacatgtgtttaatttctaagttttccattgtcaaaggttctaagtgccatagttgtgtgcaatgaaagcaacctcgcaagcgtcacaaggctgccgaggagagaaacttggcacctctaaaactcctacattcagatcgctatgaaatgaatggggtgttgacgaagggtggaaaatgatatttcatgacgttgattgatgatgctactagattttgctatgtgtatatgttgaaaatgaaagacgagggtctagactattttaaaatttataaggcagaagttgaaaatcaacttgacagagagataaaaagatttaggtctgatcgtggtggagagttgttcttaaacgagtttgacttattctatgaggaacatggcatcatacataagaggacgcatccctattttcccgagtctaatgggattgccgaaaggaagaaccgcacactgattgacttggtgaatgccatgttgcataccgcggaactacttaaggcatggtggagggaggcattgttgacgtcgaatcatgtgttaaacagagttcctaacagaaacaagaacaaaacaccagacgagatatggattgggagaaaaccatcactttcttacttgtgcacacgggggtgcttggcgaaagtcaatgtaccaataacgaagaagcgcaaacttagacctaagactgtggacagtgtcttcctgggatatgctcatcacagtactgcctatagatttttaatagttaaatctgaggtacattttatgcatgttggtacagttatggtgtctcgtgacgctaccttctttgagagcttttttttccaatgaaggatacacatagtacttctagccaaccctctgaaataattcccagttcaatcacaccaccagaacaaaatgaacatacacatgaacatgtcattaaggaggatggcagtgaagctcgtccgaggagtgagagataaaggatggctaagtcttttggtgatgatttcactgtgtacctcgtgaatgacactccgcagtcaatttcagaagcatatgcatctcctgatgcagactactggaaggaggttgtccgtagtgaaatggattccattatcgctaacgggacttgggaggtaacagagcgaccctatgggtgtagacctatggggtgcaattgggtgttcaagaagaagtttacgcctgacggtactattgaaaagtacaaggctcagcttgttgaaaagggctatactcagaaagaaggcgaagatttctttgacacttactcacttattgctagattgaccacaattcgcgtactactttccctaagcctcacatggtcttgtcgtttatcaaatggacgttaagacaactttcctcaatggagagctggagggagatctatatggatcaacctgatgggtttgcaattgaaggtcaagaaggcaaggtgtgcaaattgatgagatctttgtatggtctgaaacaaactactaagcaatagcatgagaaatttgatagaacatttacatttgcaagcctccaagtcaatgaggcaaataaatgtgtatactatcgctatggtaggggtgagggagttattctgtgcttgtatgttgatgacatactaatatttgagacaaatactgaggtgataaatgaggttaaatcattctgtctcaaagtttcgatatgaagaagttgggagtagctgatgtttcctaacctttagaaaagttggggggaaaatgggattaccctcttgcagtcccattatgtggagaagatcttgaatcgctttggctacattgacagcaagccttctccaacactttatgatcctagcttgctgcttcgcaagaacaagagaattgctaggaatcaattggaatattcccaaatcattgaacataaggttggtgctgtttcgtggaggtcttcacactgggtggtggtgttgtttcgtacccatgtgagttatactattgtggtaacccagtctatgtgatcggagatcccgtgaattggatcctgggaagaacaagccataagttaactgaaggagagtaccaatataaaccctctctaagtgaagatgcatgtactctcgtgagctgcaaggcaggttggctatgccttaatgagttttgttggctttaatttgcgaagatgctgtcctgcagagcattcttgaaagaactcacctttgtgagcttgactgttggtcgcagtctacggagattttggatgaatcttctaggaagcttactaaaagaccaaggagtatgacttatacgctccaaatgaggggtagtttacagacggtctagtatcagataagactctgagtaaaatttgcttgcacaagacttgcaatgcaaggcatagtccattgttcaagttgtgagtaagtgtagcttggagttctagatggatgttcaaccttaatcggtctccatcgaaccgttggtctataaaaagtacattggaaaaggaaaatctcagtgagattttaagatttggtgggggattgttggaattaacagatgggtcttagtccacttgaagattaattctttggaaaatcacaaaagcccacctcatgtgatggtatgcatggggagtttagtaccaccttgcttattctaggagagggggacctccttaaaagggaggatgccttcctagccacttgaagcatgtgaggtggagagaagaggcgaacacacccgcgcgctcactcgcctcgcctggtccaccaaaattggttcctcacccttgcgcagatgcaacctccttttgtagttttgttttgttgtaggaaattcggatttgtttgttttggaaacatttcgaaaaatccggtgcgtgaaaatggcgtggagtccggataggttacgcgcgatttatccggttcggttacacggagtggacatcgtgtggacgccctgatcaagcgacctttctctatataaactgagccgccacctccatgcaacgacacaaaatcaatctagggtttgcctccacgcaacaacatcgtgcgggcaccctgatcaagcgccgtcgctcgtagtctactccatcccgctcgtaggcgtgcaccggcgatcgggagagcaagtctccggaacctctaccttcgatgtcctgcatcgggagaaggcggcaataatgtttttgggaagcgcttcacgtgactgttccctgttcgaccacgacggctcatcttcctgttcgttcgcgtgctccatgctgtcgtcaacgcacacagtaccctcggtacgtgttcaacgtgttacacatatttgatctgttcatgttttactgcttagtttacatgtgtagatctaatgatgcgttcatgctagtttacatctgcaatgtcataatttatttatggaataaattaaaccattatgtacttataaatttaaaaatcgctgacgtatatcagcacctacagggggccacgctagtcaaaaattgctggggaggggtgaattcccagctacctttaatactttcggttgcaacgtaagacttttaacttatgtggcgaacttatgtggcgctgtattaaatgagagagatgaaaaaaaaacttggtcttatacaacacatatctcaaagggaaaaccaatacactattgctgcccccagttttggaaacaaaaaatatattttgtttccctataccaacccctagaataacagttggtacatacaaaaggctccaaaatgtaacgtacccaaactctagacctttaaaatttcttgtcaagatagttgaaagattacttttatatttttgtgagacaaaaattttcattttaaacataggtgaagataaaaccaacctttatatgtaggaaaatgagagcaaaattaaaacctttttcatttctaacctgagattaaaaaaaagtgcaaccatatgtgtaattatgcatacttgcataggacatagtttaacttgagtcttttttcttgtgcatttgtatttttggttggcatggcataataggtctgatgaacatgattaaaagctaacttcactaagcaaacctaaagtcattcttgaggtataactttaaagacatgaaaatggagttaagtaataacatgtcaggtcaagagaaatccaaatataattcttataaaatttagatgcatttatgcattggaaacacacatataaagaaaggtcttgctaattatcaagaacaatccatgcaagacaaaatcatgagaaaattcatgaaagcacaaatcaatataatcagctcactataatttttactcaaattaatatttaaatttcttagctcaaataattcagtcaaagcagtcaactataggatgtaaaatttaactttaatctgctaaaaacataactcacaaaaatgtgcattaaactgcatagaagtgtatgagtgaaataatttattcacatactaggttaattatcaagagcaaatataatttttctagagtttatttcttctatttagacctcctaaaattcaaacaaagttctggtgagcccatattctctatttgtctgacagcaaactacacataattagtacaaccaaagaaaatagaatctagataatttcatctacctccggaaaaatccactataaattattctgcacagaaattaaataattgaattactaaagtgagggagagaaataattcaggaaaatcgttggaaaacatcttccactcatgttcctacccttacctctcttacccacatagctaccatcgacctgggcccatctagcagctccttggccacgcgtcgaccggtgcctagccgtgtccgagacataggagtttcgagaaatgccatcatagaaacgattttgtaactcaacagcacggaatagacggaaccctaacagagatggtatttttagaataaaattgttagtacgatgatatttcttggaacttacacttgtccatggtgtttctgggacttagacgcttgtcaatggtatttcatagattatctcttattatatatgtaagtctaccgtctattccatctagatatttctttagaaatcgctcatggtggtgctgtgctgtcctgtccttgaatccgacgatgtccctcctcctcctcctcctcctcctcctcctccttagcttattctctggtgtgtccgccgaagtgccattgacgcggacgcatgtcaccagcctaccaggcttcaacggcgcgctcccttcccgcctcgagacggggttcgtacgccaaaagttcttcgccatcatgttctacttgaccatgaccaggtacgtgctgctgctgatgtgagtcttgtcgtcgatcgatcagatatgtgaccgtcgacgaggagaacggggcagagctgttctactacttcttcgagtctgagggcgaccccggcagcgaccccgtcctcctctggctcaccggcggcgaccgctgctccgtgctcagcgccctcttcttcgagatcggtcagcaacccaacagcaaacaagccccgttgtcacccaagagtgtcagatcatgtggtaaattcatcgcgtaagttgcgattaccccgcaggcccattgaagctggtcatcgagccctacaacggcagccttccgcggctgcactaccacccttactcgtggacaaaggtcgccagcatcctcttcgtcgactcgccggtcggcgcaggcttctccttctccagggatcccaaggggtacgacgtcggcgacgtctccgcgtcactgcagctcgtgaaattcctctccaacgtaagcccatgttctagttctacgcaattaattggctgtatttttcgaccatttttgttccaagaaacgcctctgatcgcctgtttcagtggttcggtggccatcctgagtacctcacgaatccgttctacgtcgggcgagactcttatgccggaaagatcgtcccatttatcgcgcagaagatctcagaaggttttgcatgtttcgcagcaattacgactacttcacaatttaacgattccctgtttttcagatattgaagcgggggtaagaccgactcttaatctcaaggttagccatctgtctgccattgattaatcgcagaagaatcattaccatggttaatacgcagtggctaattaacaagtaaaattgcagtctctcgtccttatcgaaatacgtcctcgtgtacaacttgcatctaactgtagttcatgtacggtcgatcttataatacgggcagtagtccaaaacgttaccatcgttcttgattaataatgtttgttcatcatataatagtacaaataagttcacctaaaagctttgacaagtttaattaggactgaccattcgtctatatggctagctatatccatttataattgtaggaactgttgttagagatagcaactgaactaaatactgggccaattttattcagtaactagtcgaatccaataccaatatccggtctctatatccatgcatgacagattatgtactcgtactaattactttgcattttgagtgttattcagggctatgtagtagacaatccaactacaggcgaaaggatcgactacgaatcaaaggtgccatatctccatggtgtcggaatcatttcagatcaattgtacgaggtaattttaattaactaaacacgcttcccatttattatgtcatcagtccaatttcattcagactgactttttacatttcttaattacaccggccttaagacaataatggaacgctgcaaaggggaggaccacaacaaccccaagaacgtgatttgcaaacaagctttgactaggtttaacgatgtaaggtgacaagtacaacttcattttttatcatccttttgacttctttttcccggttcaaattacgtgcatgggaatttctgttcgaatcaagggaaacgtctagaattcgtccttttggtttaaggtccctaggctttcaccaaagaacagttttgctataaatctatcgtcaaattttttccttaaaatttgacgttttttcaactgtccgattagcacctgattagggcaaggcacatcccacggttcgtgcggaagagacagcagggcgcactgatgaccaagtgaagtactgtatgtatgcatctttttctagctttgccactgtatagaacgaaagcgattgaacgataaaacgtccttaatacgggtcagagatctcccgtgatgtctatttcgtatgagcagcagtgttttaaaagttacatgcaagttacactagaattaatgtaagttacaatgtaaactataattgtactatgtttctttaaaatataaaactacagtcctatataactaaaattacatttgtaaatttatttgacatgacatgcaagtatattgtaattttggtaaaaatattatgtaagtaaatatgtattcgttattttctttaaaatataaaattacagtcctatatataactaaaattacatttgttaattcagttgatatgacatgtaagtgcactgtaattttgataaaaataatgtgtaagtaaatatgtatttgttatttttttttgtagtccgttggatgtaaatctagagatatgaaaaatctgggagatttttttttgttagaaatcacccgacaaatggataggcagaagtctaaactttcgatttatccgtccttagacttctgggctgtgttcgttgatttgggttgggaatccaactcctacacacggaaaacggagcgattcattagcacgtgattaattaagcattagcttatttttctcaaaaatggatcaatatgattttttaagcaattttcttataaaaactttttgcaaaaaacacaacgtttagcaatttgaaaagcgtgcacgtgaaaaacgagggaggtgagttgggaaactggggaaaaaacttagccatgtatcagtgaacttcagaaccgaacaatattcatccctcaaattttcaaaccatatactctagacccctaatcctgaaccacggtggtttcagtttagatggcgcttatatagtactttctttgtcccaaaatataaaaacctataactggataggacgtttcctagtataacgtatcttctactagtaaatgtctcatctagttctaggttattatattttagaatggaggtagtatctcgttagcgaaaatcattcaaacgtctgtctctggtttctcttcacctttcacctttccaccttttttatccttgtgttcaacaccaccatgccctctttgtacccggatgcctgcaacctactggccatggatagaaatagatcgagtaggaagtagtaagtgaccagatatgcctcctcgtttctctgattgatgccttttgtgctccattttgtaattgatctgatctgttctgttatgaagtactagtataagtagtaagtattattttgttgtccgtggagttgagtagattactacatgtgcttctattgtgagctccggctaggtggtcgatgagctcgagctggtgcagtagagtgagaaagagcaacggaggaaaaagcagagtgaatgacattttttttttttgggaagagtgaatgacatgttgaccagctgtgtgcaatttttttatttttcgaactaaccacataacacgtaagtgccacatcaactaaaaccacaataggttaaggacaacctgtataaaattaattgtttaaaaggttgagcgatgaatagtatctggttttaactttggatgtttaggggcctaaaatcaacttattgctatttaaaacttcaaaaagtagctagtatccttttataggtcaagtatgtgttgaggcgtaacatcctgttatagcatcttattacgattaaatgaatactacatataacatccataggaaataagcaacaaatatgggatgattcccgaaaaaaaattcctatattatcttctgagcacacacaatgattcttctgtgctaccttgaaattcacgggaatatgggctactgttccattggaatttggtggaaagctagctaacacgagtattgcattgctattcctaatgtttcactgcagctactaaatgaagtttcaaagccccacattttgtacaagaagtgcatttatatgtctctcatcccaaaatttgagagcatggacagaaagatcctgaaagaggagcttggaatactaaagcatcgacctccgcgcccttcaatacaatgtgttgtaagtagaacttacctcaactatatggtaatggctagttataatctatgtaaagtgagtatagaaataatatagtcgaggaagtacattactttctgaaaatatataaaataatatatatggcatcctttatatcctaaaggatacaggaacagacgcttgtttaattttatgtttctatcttataccaatttagacctgaattaaaatgaactttcctattgcagagctattccaactatttgtcatatttttgggccaacgataacgtcacacgagagtatctcggaatcaagaaggtaaatttgtggttccttcatttttctagagatgaatacacgcttgtttgcagtttacatacaaaatgtatgaagttgtcttcgaattctatacatgctaatatttcagggaagcgtggatgaatggattagatgccacgataacgatctaccgtacaccaaagatatcaagagcagcatacagtaccatcacaatgttacattaaatggttatcgtgctttagtatacaggtaaagaaaaattatcaccaagttacttgctgaagcttacattagttgattttcagaagaaaaaaaaatctgtcatagataaaagtaaatgatgtgggatatgacatagaagaggtgttttctatttgtttcactagtggattactagtaatcatgcatttgcaaggcacgttttggttatatatattgcctataatcaaacatactattttcttatattgcaaatctgacatcaatttgcggaagcaattctacttccaagaggtaaataagtaaggtggcatagttacttcacatatattacaaactttacctcatgaatcaaacttatatggtttagcaatatgaaatgttagaaatagattctgtctaaagaataacaatcattatgcttcgaaatccacatgacaatctgcaaccaccagacatttggtgttatctcaaaagataaacaaatggcagcacaatcttgaataatcggtaagatgaaaaaaagaagagaacttctaaagtcaatcttgaatggcagcacaatccattcgcctcacttgcaccaccattcccctctaactctcctctaccctgcagcgggccgccattccccttcaactcccctctatctgcagcggacacaaacgggcaaccataaaaaaaccaagtactcaaaacaaaccaatccgagacgaaacctagtgtttgcataaatgaagaccatactaatggtaccttggtacctgcgacctaattttccggactacagaaaaggatagttagtaagaacaaatgataaaaaaacatatagaaatttcgttttctacccatagtaagatagtgaataattgaaaaacaatccaattgctcaatccgtgatttaaaaaaaagaagaaaggaaaaagtggcacagtacattatcactgaataatccactcaaaaaaatgaactcaagtaatacactgatttgaaacacatatatatatatatgagccaatgtaccctgacggagatatgggcccgggggtatgtgaagaagaggggaattactttcccttcagccacatgactctgcaagttggccccactcacacgtcacgcgagtcgtggaagcggggggggggggggggggaaggggggcggggggcctcggagcatggcgtcaccctctcgggctctcccgtagcttcgccccgaggccctcacccggctgccatgtggcggagggagagagcgagagggaagcacaggctgaatagccataaatgtgcgacgccccaactgtccctcaccgcatttaatgtggtcagggcagacgtgcggcgcgcctagctgacccctgtccatcggatgtgaccggtctgtgaccggcctgtcaccgtcatgtccgatggatagggcaatcgtgtcctcacgtcgctcctgtacccggcggagtgggggtgggtatgacccgtcacatccgagcgtcactcgaggaagggttgtcgcaagtcatcgttcatttatgagagaatgacagggctgtcccccgtgtcaggcggggggcggcgccggtttccactcgagaaccgtttgttgcttagcttccgggagaaggcacggtttgaagcccaaaaaaagtggagtgggatccccctcctatggagggtaggtagaggcggcgcatgtggtatccccttgagctataaaaggaggaccctgcccactgagattgggggacgactcccagaaaacctgagcttcagaagaaagaaagcgagtgtgctctctggagtgaagaaacctctgtaaaactctaccataatcctaaacacaggagtagggtattacgcttcatagcggcccgaacctgtataatccgacggcgtgcaagcttgccagtaatcttagggacgagcgagtggttttcaagaagcaagcctctgtcttctgaactcacaagaggggggtctcacgattccccgctttcgaggatcttccctcgacaagactacctcctttagatgtgatggggcatatctcttgtgcccagtttctcggaaaataatatatagatttcagatgactggaatcatgtacgtcacaaatatgaaactttgatcagaaaaaagtggaaattcttatgattatgtcattcagagttatcagagcatagtaaaatcctctaacaacaacatgcttaccaatgacagcaaattaggtatgtgtctatgtgaagctctagttttctaaaaaacatgaatatgtacttacctcatgatttcattaaacgcggccactacaaatctttatagtagatgagatcttatacttaatgactgtaacatcaaaatttcagttcaagatattcagtgccataataaggggtgagatttggggtacctgtaacacatttttagcagaagtttttagcagtacctgaacaatctaaaagaacatatacatagatctaaaatatacacaaacctggaatataattttagtgaaggaactgatatgcttaaaatcctggagtacatagccggagaagccacactatatttttagtgaagctacaaataaacaacaccaacacaatagagatgaaaatgattaaaaacatatatcagtaaccccagaacttatatatcgttttggtcttctcttccaaaagttgattattctccaaaaggtcatcgaaaaaattcaagaataccttataaatttgacggaagagaaagggcctgactctaaaaccaaaaaaaactcaattattttagtccattgctatgagcacatgattcaaccgaaaatgataaaaagtcgaattgttaagcattttatcaagtaacccaaaagcatgagagagccatgtgcatgtacctgattaggacacatcagaatatcagaaattcttgactttttggatatcttctcaccttgttcttgttcttgatgacagtggccatcaatctaattacatgttcttgatgtgaaatcaccttagggtaaggattcttcttccctgctataaaaagagaggaaacaattaccaaaggtaaccacctaaatagattgtccagcgaactattaaatacatgcgattgtagaaaaaggaacacatcaacaatattacaggcttttcaaatgtgcacatcttcagttttccttaaaagaagaaagtctgacacattcttgaaatcagaagcatcatgtatttacatctaaagaaaagaagaacaatctgataaatctgcactatgtatatatatcatagaatggaaacataagattgtagtgcgccatgtaaattactgattgacaaagaagcaaancncccntngnnccanancccaagangaacaatatgcagattttgtcatttagatagtgaagtaactatctcatgatgtgtccagattcatcgtctgactccatcaaggattcaaagcaaaatagcacgcatgtaaaagaactcatttcatggttcatgtctagctattcagttcttctgagtgacatcactcgtatgattttgctcgaaaacaaacatgctttctaatttgaacacaccgagatgttacatccaatttctgaactttttgagagtaaggaattagaaggttccacataattagctcttatataaacgtgatctcacagcatgctgcatctagaatctgttaaaactgagtcacttgtagttgttcaccttctccaaaaaatatcatgattgagacgttatgtatttatctattgaacaatatatcagcaattcagaaaccggcctgcgtatgcaggttgaacaatgtgattgtgaaactgtaagatccaaattagttggctgcactgcaactaatcgtgagaatggttccaaaattttatatttccatctatatatacacgcgatcattttataaaaaaggttccaataataccacactatgttggaataaatgggctaggcccaatttaattcaattaaaatctcaagagcccacaagtaatgttagagagaataatactgcgaagagtatggaattattcatgagatgacgcctccctattcaccccagtcaaacggggtagccgaaagaaagaaccgcattctaactgagatggtgaatgccatgttagacactgcaggactttccaaggaatggtggggtgaggcaatattgactgcgtgtcatgtcctgaatagaattcctactaagcataaggaagtaacaccattcgaggaatgggaaaggaagaaattaaatctctctcacctgcgcacatggggctgtttgaccaaggtaaatgtacctatagccaaaaagcgtaaacttggaccaaagaccgtagattgtgtgttccttggttatgctatccacagtgtgggatataggttcttaatagtaaattctggagtacccgacatgtgtgttggtacaattactgagtccagagatgccacattttttgagaatgaatttcctatgaaaaatgcacctagcacttctagtcaagaacctattttatcccctgagcactttgtgccgatagaacatattgatcaaacgcttgaggaaaatcctgaggaggataactacattgtaagagacaaaggactgcaaagtcttttggagatgactacattgtatatcttgtggatgatactccaagaaccattaaagaggcatattcatcttctgatgctgactattggaaggaagcggtactcagtggatggactcaattatgtctaatggtacttgggaagtcgtcgagcatccatatgggtgcaagcctgtaggatgcaaatgggttttcaagaaaaagcttaggcctgatggtacaattgaaaagtacaaggcaagacttgtggccaagggttatacccaaaaagaaggcgaggactttttcgacacttattcaccggttgctcgcttgaccacgattcgagtactactcgctctggcagcctctcatggtctactcgtccatcagatggatgttaagacagctttcctcaatggagagttggaggaggagatctatatggatcaaccagatgggtatgtactagaaggtcagaagggaatggtgtgcaagctattgaagtccttgtatggtctcaaacaagcgcctaagcaatggcatgagaaatttgacaatacacttagatctgctggctttgttgtgaacgaagctgacgaatgtgtgtactatcgctatggtgagggagagggagtgatcttgtgtttatatgtcgatgacatattgatctttgggaccagcctcaatgtgattgaggaggtcaaggactttctgtccaaatgctttgaaatgaaggatttgggagtggctgatgttattcttaacattaatctactgagaggagatgagggtgggattacacttgtgcaatctcactatgtggacaaggtcttgagtcgctttggttatagtgactgcaaggcagctcctactccttatgatcccagtgtgctattaaggaaaaactaaagaatagcaagggatcaattgagatactcttagatcgttggttcattgatgtacttagctagtgcaacgaggcctgacatcttatttgctgtgagcaagttgagccagtttgtttcaaatccgggagatgatcattggcatgctcttgaaagagtaatgcgctatctaaaagggacaatgagctatggaattcactacgctaggtacccaaaagtgctggagggctatagtgattcaaattggatatctgatgctgatgagataaaggccacaagtgggtatgtgttcacacttggagggggcgctgtttcctggaagtcttgcaagcagaccatcttaacaaggtcaacaatggaagcagaattcacagctttagatattgccacagttgaggccgaatggcttcgtgagctcctgatggacttgtcggtggttgaaaaaccagtaccagcaatcctgatgaactgtgataatcaaacaatgattattaaagtgaacagttcaaaggacaacatgaagtcatccaggcatgttaaaagaagactgaagtctgtcagaaagcagaaaaactccggagtgatagcattggactatgtccagacggctaaaaatctggcagatcagtttaccaaggggctaggacgtaatgtgatagacagtgcatcgagggagatgggcttgagacccacttacagttgcacaatagtgtaaacctgtccattgtgatcggagatcccgtgaatttggatggcgaaacaaactattgtgtagctgagagaagagaccctaaaatgagcctatcttcatgatgcacttctcttctaatctgtatggtaggatggtatacaccttaatgtgatccgagtggcttttcataaagcagagatgttggcctatagaacaccttagaaggaacacacctatatgagtctgactgctagtcacagtctatgagatctgggtgatctctagatactcatgaaaaggccaggagtatgacttatacgctcaaaacagaggggatgcaaacgacagcctagtaccagttaagggtttgagtgaaacctgaatcgcacaagactgacaattcaaggcatagtccattgttcagttgtgatctggtgtagctcttttcctaggtagaagttcaacttaacagtctccatcgaaacactggtatatctaacaggttcaattttgagaacatttcttgtgagccatgaaatttggttgggattgttagaataaatgggctaggcccaatttaattcaattaaaatctcaagagcgcacaagtaatgttagagagaataatactgccttgaaaatttaggtggaagaacctcaacttaaatagggtgatattagagattccctgttgaccggttaaggtgatggttggactgccacacgcatgcgcgcatgctgagtcggcctcggccgtgggccgtgggcgtagcgaggcgaggtggccgaccgagctgagcctgcctgctgctcttccgttttgtaacagacgagaataaagtcaccattaacaaatgaaattcattgtgttgtaacctccacaacaaatgagacattcattgtgttgtaacctccacaacaaatgagagattcattgtgttgtaacatccacaacaaatgagagatttatttgttgtaatcttcacaacaaatgaaagattcattatgtggtaaccttcacaacaaatgagattcattatgtggtaaccttcacaacaaatgagatttattttgtggtaaccttcacaacaaatgagatttatttgtgtggtaatggagatctctctctctacatataacgcaaggcagaggctctcaaagtgtgtgtcttcctcctactattgttccttggcgatactctccttctgttcctgcgctgtctctctgtttccccggttctgttcatcccgcgcgcagaggtgatcggaacgagcaggtgcctccgaaattccgtccgcttgagaacctgcacgggaaggcgggcgatcaagtttttgggtaccgcttcaagcgcgactgctctacatcatcttcaccaacattattgcgttctcttatctatgttgatgcttattctatattaagcatgctcatattgtacacatctagcactgtcactagatctactcaaattacaaatgtcatgtttattgtctaaatattttggattaaaatatggcgaattatgaccaaattttccaacacactacaactaaaagaatgtgactccatgagtaaatcacccaaaacggaagttggagggacgacttgggtttagcggcattcaatcaaacagctctggacaaaacaagagaatctgcaatcaggtaagaacttgctgctaatcattcaagttaaaatcaaatagtaaaatggaaggtagaagtgatcataccaatacaaagaaaatctagacagtggaagaaaaggagagtggaatttgttggtggagaatgccagcaggaggtagcaccgtagcagtagtggaccaccccatccgtgccgagcgagtccaatggcctctaacctcaaccgacctgatttgacatcttggacctggcgttcgatggatgaggtgacaccgggttcgatggggaaggaggagacgctggccccgggagggagctcgggggaggacgccgctgcatcctctattcctctgtgagagctcgagctcgggaggtgaagccggggaggaagtggggtcgcaaggatggaagcgggatcaaggggtcatcattaggagggcggaggcggagggggtggcgtggtttctgccgctgttttgatgctgcgggagtcggtatgtgcggatgcggatggatagtagagaattaatctgtgatttggcctgtaggattgctacagatgaactcctcctttttatattagtataggaatataactagagatgattcggcgattatgctttgaatcatgattttttttatagatattacgggatctattcagaacactcttttgtgagaagttcgaaccatccacttaggaattatactacaatacaaacacactgtggtttgaatttttttcaaaactgcagattagtagtgaactcatcattgtcttcaaataaccaagcttgtgtccattgaattagcataatttgcctctcttaataaaacagtagggatcaataaaataaagcagtggtcaaagttgcattttggtactgttaatgtcaaaatcgatatgttcactagaccagagtagtataaattctgccattatgtctttacgtggaacactttgagatctgtatgcttagtgtattaatgattttgcacatatctatctaataaattatctgcatgaccattgcagctagctagccagctatgcatgtcctctaccatgactagagagaccggttggcaaaagggcataatgcactccagtgttctaaactgtttctttatcatatttctgcattaataaaaaaataacatttcggtgcgcagcggtgaccatgataccgttttgccatttcttggtacacaaacctgggtgaggtcactcaactatcccattgtagatgactggagagcttggcatgtggatggccagtccgcagggtgagttttaattatgtttgattagttctgttgtttggcttacataatcaaaatggttgtctaataagttttcagtatacaaactgctttcaggaataacttttctaaaacttcaattaatttgcagattcaccgtagcatatggaaacaacctgacatttgctactgttaaggtaacaacccatcaatgcacatccaattttatgaataatttatatatagatatttccaaaggttgttgtgaatggagttacgttctgattcacgattacatatcgttgatacaaattcaacccgcgtcatgatgaggatttttaatctgtattactgctaatgatatttactttagttcaaagattattctattttatcaaaaatttcttatattatttaaaaatgcaatcattggtatgcgaagaaatcctcacaacatgggaaagaccttgccacaccagtgttagcaacatttgtggccccaaggttcattttttaaatataagttcattgaaggttcattttttaatttatattagaaaggttaaaagataataaaatttcaaaaactctttagaaggaccttgatatcaccaaggggtcaaattggcgttcctaaacattcgatttgaatccggaacatttggtctaagattaagagttgtgatcttatagcaaaacgtccaatggcaaggtggtaaatcaagaactaaccacttgcagatcaaacaaacaacaaatatagctaccaaaatgtgtgaaacaagatacaaagaaaataacaatatcatcaactagattaaactaagcacataggtagatgaggcaaatgaagaataataatggaaaaacacacgagagacaaaatcaaatattctgttctgtgatgtttagatccactgattccatttcaaaggccatgtctctttccactcttatactcactaaggcaacaccaaagtgcttctgatgtttagtctttatttcttctattatggaggcaaaatcgaaatcttgacaaacatccatgccacactacataagcttgggtactcaccagcaacacccagccatctaaaagaccttaatgtccaatatagtaatacacacattacaaaatttcctataaactcaagtgctcagacgatgaagtaaactcactagcttacaacatttcaatctgtcactaatttgataaaaaaaagaggggaggggggggatatgtaagaactatatggtcatggatatgcataactctttgtacaaactcaacaactcctaaaggagggggatgagagctttaaatagcatcgttatatttctacccgttaaggtaaaaacaataggtggctgaattaaaataaccataacatctcgctctcaagtctgttttcgaaatcttgaactctatgtaaagcttaattcgacatctaggtaacacaactaaaaccacacaaagtagatgttaaaactgttgattctcttaagatagcacttggatatgtcactttgagcaccgtcaataatcaaggtacaattctgcattcctcttgacaggacataattcctaaactcaaatgcaattagaaaaataactataccaatgagaacacatgtactgtcatggttatggataccaaatacctaatagtagttgattaggcacggctggacccaccacatatcaagtcttatacggaattaggcctcacttacggaaggtattccggataaggaaggacaagtaaagttctatatggaaactataaggactacttggattgtatccatattggtctccctagttctagttggataaggggacacctataggcataaatagaccccctaggaggagagggagataagccacaagacatacaaatcgacacacaagccaggacaaaccaatacgccaccagatatcgacatcagagataagcctagacagaccccatttggtgcctgtagaggccaactaaagggatctaatgccatctttgatctcgatgagttcatattcgaggaggaagactaccctatcgtcgactacgtgttagtgatccatgccgccaagtcgatgacagctagataggttttcccaaatattgtacttgtgtgattcag

SEQ ID NO: 20168 - DNA, 18956 bp, Oryza sativa
  unsure (1)..(18956): unsure at all n locations
ttcatcaatatatgaagtttgaccacttctatatcttcatgccacttgatgtcattcaacaagtaaagtccaatctttacccattttgcagtcaaactcgatgtgggtccacctatgaattacatcttattgatcttcaccatttcatcttgcattcttttaatggtggatgtgggttactcatagattcaactgacctcgggtggaccatcacggcaaagccttcaatcatccttatgaatgaaatggtcacggaaattacctactgacctcgtttctgaccattaccgtttctagacatatataaaatttaacttatttaacttatctaatttatttcaacatctgattgatgttgacactgaatagttcaattgataaatatcatcaattcccaattgatcgagcaacatttctgaagagatctgccccatttcatccctactcgtacgcaccaccaaatttggtcaattggtggcaatcacttgcttgcccttcaccatcgcatggctcatcatggcggacatggcttacccatcgccattttgttgtagataaataaaaagctatgtaatagctaaccatgtgcacgtcgtgtctccatgctagcacttgtagtagtcattatcaattgtggccaagagatggtaactaatcatgaaaagaacattctccaatgtagtcgtataacaagtgtcaatgttttatatcggtataataaaaggggtagcacacgggacctaaaaatagatggaagtggaagataagggtttgtagaagttcaggcctgcccaatgcaaggtattaccatattcctattttagtggattgtatctattgggtgtattgatcttgatgttgatctcatgatttgattgtgggttgtgtatctcatttctggttgccctcgatggggctccctgccaaccttatataggttggaggtgcagggttacaagtaggaaaccgaattagatattcctttggttaccttacctatacatggtattatttggttggggctatataaccttgcttggaatacaagaggtaacatggcaactgtattctactctattttatattacattgtagtcggatacctaactattgttatttgttatgatcacaaataattccacaagcgcacagatatcaatgtacaacttcaccatagattatttcaagggtatcgaatcataaggaacatgtgtgtaatatctaaaaaacatgtttgtccaaggacaataactaaatcataggcggaggatagagaagtttccgaagggtcaaaattcttgaattaagttttggtaaaagtctatcacttgctttgggtaccggctctcccctggcacaccaagcaaatctggccaatagctctgtgatgtacccgaatgtgaaggatcataatggacgaacaaggctgttatcacatgccgcctacctatacaatccgtggagcacacaacaaaccaaggtaacctctaacctagacactacgtctacgttatcaattactacactagcctcggtcaagaacttttttttcatccagagtcttaatactatagcacttaatacaaatactaagtgacgaacccacagtgatgagaatatgtaatgatctaaatcaccctaatctttaaatcgtgcttttatgcattttctagaaattgtaaaaaccaaaacgagcctcaaacaattaaaaatatcaagatagaactcaaattggcttgtgggaattgttattgaatttctcatgcctccaaatatttaaacaaattttactcgaaatttcagctcgctctaacaaattttactgccacaaacacttttattagagttttataacaagaaaaataaaagaaaatcctctcttcctcttgcgccgaatctggcccaaggtgtccttttccaccctcttcacccctcctggtctaggccagccacctctttcccctccctccttccgggcctcccccttcttggcccattctttccctccttccctccacttggcctgctcccgcacgtgccccatctcctcttcccgcgcccagccgagcccgagcactgtgtgcggcacacgcgagcgctcaccctcacgcgttggtaggtggggcccatggatcagctcatcccctacctccagccaccgccgcatcctctcactcctccaaaaactctagctgtttctccccaaatcctcagcaatcaatccatccgtggttttcaaactaaagtggtggagttaatacccattaaatcctcttcaatttccccaattgcccccttgattatagctcccaatctccacgaattggccgctcctcccttaggtcttgttcgtttaatccccaagagaggtggaacggaggggattaaggaggaataattccacgccacaataggtgtggaataaatcacctctaaatccccctcaaacctttttttatgtaacccccctcaatcctattgtgggggagattaaatgaacaaggccttaccggtttccatggctactggcgggatttacggcgccattccgccactccccttggaccgttctctccatcggcctataatacagagttctctccctcctatctttccttttccccctcccgagctttgttgccgtttccccactctgctcctctctctcctccgaactaggtgttgtccagcagcctatttctcctcgtcgacgctccacctttacctcaccgccaccttcctccactctgtgaggacgagctcgaactcggccaccgtttggctttgcccagaggccacctcaccgcgtcaccggcctctccttcctccttgttgaagaaccatattatgaacttatgaactgtttaaacttagcctttatgcaaatgaaccatattatgccattcctttgttacccctatgcattattgtgcatctccgatatggcttgctaagtaccgtgagttgtacttatcatttcttacatctaattcaaaagatggatattctggagaagaaggcttggatggctagctcgtatcaccgtcaagtatatctagttgttgtttccataagcttccgctatcattttgtttatcttagagtgtaagggcctatgctcactctttaataaagtattatatttacgcttccgcaagtgtagcttgtaatacaacaactttgtacgttgagattgtggttattgtactccgccttgctgggacagggattaatacaattagtttttgggaatatggttgtatttctccgggcatgatgaaatttatcctacataaataagaaaacaaaatacccgaaagaaatcacgtatacttatataaaaaaagcatttgtcaaggtaaaactgtggaaagagtaccaacaactccggcactcctccagagctttcngtcacgctcttgccatattctaactctattagaaggttgcctaaatatgtgttgtgttgtgttgagtgtaaagtgagaagctcctttaatagggtccaatgacggctgtggttaatcggtctcacacataaccaacattggggaccaatgggggagtgccacgtagaagaatgcgattaggggtgccattagtggttcggtcgaaccacctccaccgcccctagccacagaccttctctgtgaggattgcaagtgggcccctatgatgatgatgcacgatggataggcttgaaatatcactacaccatgacacaaaatccccaacggaaaatcggttgggaaagaccacattcaaagacaaactgtcggtcggcaaaagttttcctaaccaacttcaacagtcataagatgtctagtcggcaatgaccgatatatttttaccgaccgaccattagatcccgatgacagatttgccgacaaacattattttttccgaccaacatatttttcccaaccaaccacaattcccaaccgatgactggccaaagatattacaattgccgacccacattcagtccaagaactcagtttcttctttttttcacatatacaattcaataatatacggtgaattgtatttcaaaacttcttgaacacatggagcatagggaaaaactaatagtcacaccaaataatgaaagtctcactttattcattcaacgaactgtattacatagttcttcaaaagctacacataaatcccaatattctctaagtacaaagaagttcctagtagcaactttccatctaacaagttctatccattgtacaatgtcttcatcatcaagtgaatttgagcaacaggatcagtggttcctctaggacctcctcctgcaaaaaggaactagtttagtcaagtagctgaacttttaactaaatgttgctaacaaaaaaaatattctaaaacactatgtcaagtactctagttgcttccaatcatttggggctctaaattctccacacgcatgatatgcttcaacaagcatataggagcttcttcccattatttcagtaccatatatatatttttcaagactaagggcctgtttagatccatttggaatggcaaatggcaaatggcaaaagttttggtagcaaaagttttggcattgcaaaagtactagttggtgtttagatgcatgttaaagttttgccattctagcactaaagtgagagagagaaagagagagggagtggtcccaaagcattttttggcacaatttgctactatggactagcaaatgccaaatgccaaattgccaacttttgctactagtgtttagatccaaaatggcaaaaagtgctacaaaatggtaaaacttttaccattttagaggatctaaacagggcctaatagaagtaaaaccaagtttgtaaaatactacaataaataagtagtagatagcaagcagtaaacatcgatcggatctaaagtacaatgtccatatattatattctttccaacttgtgaatgtaaatccacggtaccaagataacaaaattggagttctcttcaaataagatacaaatttgtaaaagaaaccgcatataagtggttttggtcaccgccttaccggccggcatcggtgtcctaagattacagaagcatacaaactcaactgtggttgaaagcttgaagccactgccatgctggagcagccgatgccagtcatggaacagcaaaacaaagtcctcatcatggaacctgcaagaaacaaaaacaacagcctgagataatcctatgttcatatattttaaaatttaaattttcattaaatacattgcacatacatgattgcaaaaatatagtatctgggaacaaatctattaagacaggcattgctacgattacatgaaagagcttaaagaccacgtgtttcttaggcaagggtgatgtatatgactagtgaatctatgcttatgtggaacctatgtccaacatcagtagtcaatcttgaacagaaaaataaaactaataaatcataaagtacaatctgcacacataatgtcgaagtatcaaatatcatattttataagaaaattcaggtattataataacagataaactagaagtttaaagctccttagtccttaccttcaatagatcaaacatataatatcaaacaagttatccatcaagcatgtcattttgaggtgcacacagaactatactctattttcccacattatcaaccttcacacgaacaattaaaactgaacataacagtgatacttgccgttattctcttcatttcgaatctcaggtctcaaatcgtgtatctttgttcactccgcctctggattcctctgcaattttgcatataagagaagcgagagcatcacatcaaacatcttgacaaatctgccgcatgcaagtgggttagtcaccggaagtagtgttgcttgtgagattacagatacgtaccaactcgtggttagtaataattcctaccattaggtttggtgtttcattttattttcttttatgaatgatttgatggtcagatttggtatttaaggatcgtcaaataaccattttgtccgcaacaagataaagaaaaatagtagtttcaaattgcttgatatattttgtttacgcttttactttttttatgaaatgtttaggcttttactttttttatgaaatgtttacgctttttcctcaatctatcagggtggtggacatactgcaccagagtaccagccggggagatgctcagccatgtttaggcgctggatttcaaacatgccactgtgataaattaatgattatgctagccggctagctgtacagtgtacacaatatgatggatatgtattttctcgatttctggttaattaattaccttgcaccatgctgtaccagattctgaaatatcgtacgcggtcgaggcagataaagtttttcatggaacaagtcatgctggtgccatgtgccaatcctgagctagtgcttgaaaacaaaagcttgatctgtccaatcatttgaagaattttacttcctctttatcttcaggtgctagttttcgatgaggtattttaatattttgtgattattttattggctgctcaaagtttggcagatatattctaataaaatagatacctacgtactttggcactctcaggaaattgagacaataatctagggattttgaataaaccaagcgtctaaactatgtttataatttagtccgtttaacaggagagaatttttatgcatattgaaaaaaaaaagaaagagcactaccaatacatctgggaaaccgatcagacataaggcgtctatcaaaccggtcacaaatttcggtggtatatattctaaaacactattgttttaaacttttaaagcaatataaattatttgtctataattatatactaaaagttcatactataaacgctcctaagcatatgatgctcctgcaaatgcttcaaagagtgtcacgtggttctttaaaaaaaactactcgatttcccttaaaccataatacccattattctttaactattagatttatgtttagagatatagataactcaaatggatcggcagacccattacagggcatttagttgggggaactattaagagtgaatgggagtttgagggatgtgggtggttatggctgttgtttgtttagttgatattagtgagcgtgcacgtgtaagacatgttgccatatattgaatgaagtaaattgaaaaaaacaaatacatccatcgcttaaatcaatcttaaccctacaggtaaacagttcatactttcagagacaactcggtgtggttagtgcatcagatgcaaattatgtgcagaagaagtgttttctggcaggtcatattgagcacaaacatcttgcaaaaagcacataacattatattctaattcacatttattttttcttcaaataagaatcttaagggtaaataaaactcatagaagaataatcttagtgtgtttccttaaatttattgaacccataggtaaaataaataaaatcattgtccccactacataagattttttgaattggcaaggatctcagatcaatcttgctcccataagtatcaggcaaaatttgctacagcacacttaaagattatggtctttgctgtgagacacccgaagatcgtgtatttgcccttggacaccgaaaaatgtggtaatttgctggcggacactcctcccattattttattatttccggctgaaacggtgagagaaactttcctaaaagacattttgcccatgggccatttgtataagccgaccaggtccggctgcaaccagatatgagagaaggaggaggaggcagagcagccatggctccctggccgtgctctgccatggcggcggcgcagcggcgttcgttggtgacggcgcatggctgccgcgacgagcgtcggcatctgcaagaggagatggaggcgaacccggtggcgtggcacggggctctgggatggcgtggaggtggcgctgcggcaacggacagcgttggccggaattggggaagagagagaggcaatggcgcgaggggaagaaggcttcggccttggagctcaccggcgacggcagcgcagcaaggaaacggcgatgcccacggtgcagcaaccggccgtgatggcctccacgacgcggcggctcgccgcggccgcgccctcgtcatcgccggtcaggcacaggcagaaccgcgctctgcccatgagcttgccgtggtccacccctgccgggaggagaccgtacagcagctcctggtcatcccgcccctcccaccgcgtgagcagcacctcccgcacggcgccgctacctgtagcgaagaacacgacctgtgtcaggggcaggaaagagagaagaaagaagaacagtgtcaggggcattttggtactttcaacactctttctctctgttttcaccgaaaataataaaataatgcctcgagtgtctagcagctaattaccatatttttacagtgtccataagcaaatacacgatttttgggtgtctcacagcaaatgccacaatctttgagtgtcctgtagcaaattttgctactgtatcagctcatagccccatagacaacatggcagtcagtcaagtagacatgaagggaagatagtcttcaggcaggtcattatggaaaaacatcttctagaaagacaaagtctatggtcatcatccataaacatttccccaaaaaaagtagcctatggccatcatgcataaacaccttcctaaaaactcttatcttctagactgaatcaacaaaggcacacaacttcttctatctacccatgattttttatggtactacctagtctcgtgtccaagtttgtcataatatgcccacgcacagtgtcatatgtatagattattacgtttaggtgaaggagtgaattaggtgttttctaactactcaagtttaaggaaagttcatccctcttcctttgatcacattgaaacccatgatttgggagatcaaaagtgttgtttgcaaaattgcatgcttatttataactatcggtaacagggcaaatggtaattatgcctgttgactgctgttaaataccaaattcacgccgtcaatacctgcataaatatgagagtataaaatatccaacatagtggtagggtttatttctaacaaagtccactagcgttggtgtatatttggatgcaggtgacaaatcatcaaagttgagacaaaagatacataaagaaggaggtaaattaaacttccatatttaagcctatggagtttttgtgtcacaaacctaatcaaacacaagcaaatgggcccattcaccatatatatatgcaccgaggagtccttcaccagagcccaggagaaaattcggggcaaaatgggccagcaagggtttggccgaacacaaaaggatcccaatcggctccatttttcacgggcagatacttaccgatattctaagacccttgagaccgtttctcaagaggacacatggcaagaggagagtgaagatgccatttagatgcttagcatctccacattttcccaaagcatctccctacctataaatacctctctcttcctcacttctaaacacgctcaagcatgagctgaattataagaggctctattgtatcttttatatacattagaataggcagacagtaaggaagaaagagtcggaggaattccgaagttgtcagtattttcctctttaccttttgtaccttgtcaattactttgctttaattgataatatctttatcgagtaagtgagttttactttgtgaggattatctcttagttagttcctattagcatattggattattgttcactattgttcaataatagatagtgattactttagtgtttaactaacgctacaatagtaattaattgcatagacgcaatgtctaggtatttaattaccagtgattgctgcgtatctaacatttcgttagaggttggtgtagaggtggtgatagccctcgagatcaccggtcctccctgtccgggtatggagtaaagcgagatctggtagcagcgagcaagccaatgcctgaagtattgcgataggattaaatttaagttttctgtacacactgttcctcactaggaaatcatcttctaggttttgcccattntgctttggtgtccttggttgaactttaagaggagttgaacacacacgttccccgtgtctttggttgaactttaagagggagttgaccacacatatatatatagaaaaaatgcccgtgcgttgcaacaggtaaaaacatttttttatactatacaatatactcccttgttttgtttttggaccgaacgttcattctttccttccttttcagctcagtcccagtgcagtccgctgtctctatttgctcggcctatctctctctggctcagcccacaagtggagctgtaggcccagctcgaacagtcctttgcctggcctatctctctttggctcagcccataagtggagctgtaggcccagctcgaatagtcttgtgcctggcctagtggcctacctctcttcggctcagcccgcaagtggagctgtagtcccatctcgaacagtctcatgccccgtaccatgacggagccgatcttcccaccaaatccggtaatctagtcgagctcgcataataccgtgcacgtacaatgatggagtcgatcctctccgtcaaatgcggccgaatctttctcgacctccaaaattattgacatattttaatccacttgatctcctttttctatttttttcataaaaatcgaagcaatccgcaaaatttgggataaaaaatgacgaactaaagggaatttaaggggaaaatgatgagagagtagtggggaatccgtttttcaatcaattggatgaggaaacacatggagaggcaaatcgatacggcggctagggttcggccccacaaaaaaaaaccgccaaaaaaatagcgtgttggatttcgttgaaactggaaaaatggtgaaaaaaatggcgaaaagaaaatgaaaaggaaaaaggaaaaaaagaaagggacgaaaattttgtttttttggctcttttatatgttttttctgccgtgccgggttttttttacaatcgttttttttgcggcactttttttgtccgcttttttatacggacaggaatcggtcaggtttttttttcccgcgccgttttttttcgcgccggactttttaattacaatcgaacttttttttatcgctttttttaattaacggacgaaggaaacatcttatactttttaagtagtagtagaagtagaagtgtgtgtctatatatatatatacatatatatatatatatatacatatatatatagctaaaataagtctattttacatccctactctttgagccgtgcaatataataaggctacttttcctccctattctttgtgacgtgctttacatatggttgagaataaatctgtttcgcatccctaaacttcgggccaggccgtgccggcccagcgtgctaaggtagcagcctagacacgacacggctgttgggccgggccagcacaaccacgaccggagcagctcaggcacggcacgactgttgggcttggctggcacgggaacgaccgtcgggccaaaattaccgggcctgggtacatatagctgtaccataattactgattggtcgatctagagaatccgacatcgaggtccccctttttacaaattgcgcatgttttgtaactatcgtctccccaatatgcaataaaccgcaagtaggggtgccgagctgtttgacggtgtcgtccttcaatgcgacgatggccttgctcctcccgctcatcgtaatctgcatcgtctccggcgtcaccgccgacgccaacgccgacgcgccaatgacgcggacgcatgtcgccagcctaccgggtttcgacggcgccctcccttcccgcctcgagaccgggtgcgtccatctcgtacgcccaaagttttctggtctctgctctgcatcagtcggtgagaggggtcgtgctgacgctacgtgctacaacttgccagctacgtgaccgtcgacgaggtgaacggcggcgaactgttctactacttaatcgagtcggagggcgacctcgggagcgaccccgtcctcctctggctcaccggcggcgaccgctgctccgtcctcagcgccctcttcttcgagatcggtcagcaaccatcttccaccccgagcagtgccactgacacaccgtcctccaatttatcaatctgctagtagctgctttcttgcctgcaggcccaatgaagctggtcatcgagccgtacaacggcggcctgccgcggctgcgttaccacccctactcgtggacaaaggtggcgaacatcctgttcgtcgactcgccgatgggcgccggcttctccttctcccgggaccccaacggctacgacgtcagcgaagtatcctcgtcgctgcagatcgtgaaatttctctaccgagtatcgatccacgcatgcatgcactgtctatcctatgctaattgttcgtggttgtctcgtgatcgttgtaacctgttgctcgtcttgttcagtggttcgatggccatcctgaatatctcgcgaatccgttctacgtcgggggggactccatggccgggaggttcgtcccgttcatcacggagaagatctccgaaggtgttgcaatgttacgttacatttattacccgagatccctacttgttcacaagaattactactactgctacaagcttaattaaaccagttcatgcttgatcgctcctctgtttttcagacattgaagcggcggttagaccaactcttaatctgaaggttagccaagtcttttccattaattgatttaattcctcgcaaaaaaagtcattggaattaattagttggtgcaacttaagaaataaaactgtggtctcccatatgtatcaaaatactagccaccctgtcgcgcttcgcgcgactctgagttctaatataacctgtcaatattagtaggccatctatattggggtgtcgcaaggctgatgcgagagcgagacgacggagactgcgcccaagatttggggatttggatcgtctctcttgtgtgtattgtgtcttctccggagaataggagagattatcgctggttttttttatcctctcctttcattgttgtgcaaccttcccgatacttcctttttatttatttattgtttctttgactagatttgctctaactaccataaactatctgcatatgtgcaccgatgcgtgggaactggaactctcctgattctgtgattggtttacatgatccaacggtcctgatttattcatactctcatcctaaggctattattagttcaactgacgtggctcattagtttttgagaaagcttgttgctttcacatatgtagatgtcctctgtacaatttgctcttcgaggaactgtagttgatgtatagtcagtactagtacgaatatggggttccccgatcaaaaaattgaaaatatgagcagtagttgaaacattacttccttcatgatttatgtttgttcacagctcaaatcagtttcacctaatagcttgacaagtttgtgatcagacattcctctgttttaaggaattccagagggttaggagttagaaccgcacttactcagaaggtagcagtatttatgccttttgtacggtgcaaatttcattgtaggaactgttgttaaatagcaacgttttttttttcgcgggcagagacagcgaatacagtacctagaaacccgagaaaataaaactctatatgtcgattctagaaatcggcaatgagaaaagaaagtagcacacgggatttaaaatagatgagtaaacgaacaaaggttagactggttaatacactattcctgtttcggaaattgtatctgtcgggtgtattattgatctcacaatcttagtgtggttatgtccttggaggggctccctgccctccttatgtatataggttcgggggtaagattacaaagaggaaaactcagtcgaacatgacatggatttcattatacagttatacagtcatataagactaagatttcatactgtaccttagaatataaggtaatacagtattcaaagcttaatctctttacataatatacggacttggtccccacctcctatctctagtctacgagtaaccaatctctacatgtaaactaccatggttaggactaaaaaaatagggagaatagctcctgtagtccctaaagtttttatgtaggatcagtttagtccataaccttttaaatagttcaaagaaatccttaaactttatcataaggcctagaataatccttgagtccaccaaaatcgtcatatagatatgacatgtcatcattcatggaaaatctatgataaattgttcagtttacccttacgtatatcatagaaaaataaatgtaaaggtgaattagacataaccataggaaaaaaaatacttttccttttttcacccttttgacgtatatttttgctcttacatataccatattttttaactttttccttttgttttttattttactatgatatatgtaagggtaaattgaagaaatcatatagattttgcatagaagggtgacatggcatgtttatgtggcgattttggtgggaccaaggactatatcagcccatgtgacaaatttaaaggacttgtttggataatatgaaagattaagtactaaaatgactcatgagcgaaactttagggagcatcttggctattctcccaaaaaaaatactcatggtgatatggtgataagaataaatctcagacatttatttttatcctacaataatttttaagtttgtactgtatatttttctcgttatctctgtataattgattatgcactcgtgctgaatattttgcgttttgggagattctcagggctatctagtaggtaatccagttacaggcgaaagtattgacaacaaatcaaaggtgccatattttcatggagtcggaataatttcagatcaattatacaaaataaggagacaagtgcaacttgatttcatggagtcggaatagtaaagagtgacttgtacatttcttaatattattaactgtgacacacctggtcttcagatgatattggagcactgcaaaggggaggactacgacaagcccaagaatctgatttgcagacaagctatggctaggttcaacgaggtacaacttggttttttgtttattctcgtgcttttggaaaagttttatccttgatatcctttccagtggaaaataattatatgggaatttctgttaaaatcaacttaacaaaaattgtatgttcaaaactatatttatagtacttacatgaactagcgggaagcccgcacatatacacacttgcgcaggcaactcatttattctttactaaaaaaagcaactcatttattctttattaaaaactgttaaaagatgttatgttaccgtattttatttaacgacggtagattatcttatgactaagaaaacccgctctgagcaggagatattgtgtcctgactctcttcatcaccccgacagcaaacccatatctatcgtatttttgtttgtgacctttcttgtgcctacctgcacaaccgtacgtggtgaaaatttcaggcaagctaaatagaaaaaacttgagttccaaaaggatctcttgatatcagttccatttcccatctcaatgtacatcgatgccctcaccctttctgactgacgtaagctttttttaataaaaaacttttaaattaactatactttaactatatatttacagaacgcagagttttaaaaaaagagtgatttgtgctagaatcaagattattttttttaataattgaaatgggttaccggtctatgcccatgggcacatagccaacaagtttcagataaatatagacgtgatgggaaaaaccccacaactcctgccaataaaagagtccactgaaataatgttttcataatcacatagtttctagcatgaaatttcgtacgtactatgccatccaacctagaataaaatctccgtgtaggatcgaaacacaataattaagccaaccagagggggtgaatggtcggtatacccaaaaatcaaaaacttttagcggaaataaaagttaccctcgaattcgatggagatcggtctgtccggaataaattagccggtttgattgaagcgtagccgccggtctgaccggtattgatcttacggcctaaccgccgaaacttgtcgccgcctcctgttaccgacgccggtctgaccgccatgtgcccgccagtctgaccgccgcgatgccgccggtctgaccgccggtgcgccgccggttagaccaccgaaacccggtgaaacacaaatcgaagaactcttaaagtggatgacgactttattaattctctctgtgtttacaaagtgcaccaacaacactcgttacaaaaatttcgactaaactcgaaaccctaactcaactctcaactcaattgctctcaaaagcgatacagggaagcctcacgctccccttctatttatactcaaggtaagcagcctaaagccacgaatcaaatacatactagaagtcctaaacaccttaggaaaccctctggtacaagaaacaaactttacataaccaatcataccaaatttggacaacttacaaagtcgactctacatcccatacgcacacaatacctccattgtatgccatatggaatcttcaccaaccacgtgtattgaattctagccatagtatctcgcatgatctctgaccaccacagacgtcgtcttatccctaagccgactcccggtccatcaccgcaaatactctcctggcatccgagtcacctacatatagaacaaacaaagaaaccatattccaagaccaagcattctccaacttgactcaaacaacagtattacatacgtatagtatccatctagaggccagaatcatgaaacaatcacggatatccaaacaaacaacccaaaaccaaaactgacacagagtcggctggtcaaaccgcgagctgcgccggtctgactgcgcgatacacgccggtctgaccggcaaccactacccggtctgaccggacccattccagtagtacctgtagattcacctgtgaaatccaatcatctccaaaactacttcgtgaatgaattccaaatatcaaaaccaataatctccaatgccaattgttcatcacagaataataatcaaaaacacctttgattttacaattaaccccttgatgaacacattggcaaacccatcaaaaatgtttggtgtttggaaaaataaaaacaaaactggtaaaaagcacacttcgtacaaacgtacacatcgtgctcgaaaatccaaaagaaaacttctcttacttttgaaaagaaagaaatttgcttttccaaaaattttcacttggcttctcccccttttgacaatgatttcatcaagcataggaattatgttcattaatggataagagcttagcatacatatagcatatcatgtcatttgttgcaataaaaagaagatgaacccatctataatatagcaagcatgcattaaaatataaccatgaaccaaagagtttacaattaagcttgaatcaacaatcaaaattcatgatttcatacgaattataatgcaacatcttaacaagcacataggttgaaaaataaacactaaacatatagacctattgcatttatcactctttctcaaataacctttagcagaaaataaccaagagaatttttaactttttcttttcttgagcctttttgcttatatttttctcttttattctgggtacgtccctatcgtcaagactgtttccagggattcggcacccattattttgctcacattgaatacttccttgtcatcaagactatttccaaggattcggtattcattttttccatatttttattctcttttcacaataagaaattaaagctattcgaggaataacaattcaataaagcatatatatagagcatttagaaatcaaaccacatgctagcgtcaacattgcatatttacttaattcaaatatagaatttaagtgtcatgcatcatctcccttaaaaagcaaaatctaaatctcatgcaaagactagaatacaaacaagctatgttagagacaaataaaccttcaaagtattgctagcatgtacaagaaaataccacatgtataaacaaagctctcttttctcaatttttctcattgtcatattttttgcttgataaaaccatgaggtacaaactccccctcaaatcatgccaaaaggatgaattatccccaattcaccacgaagaaaagcaaaacgattagaatccaaaggtttagtgaaaatatcagtaagttgcaagtttgtgtccaaaaactgcaattcaacatctcccttctcaacatgatccctcaaaaaatgaaagcgaatatcaatgtgctttgtgcgtgagtgttgaacatgattcttagcaatgttaatagcactagtattatcacaaaagagaggtactttctcaaaagtaagtccataatatttcaaagtagataaaagtcaaagaatctatgaacaacaactagcagcagcaacatattcagattcagcagttgattgagaaatactagattgtttcctagaagaccatggaatcaatgatgtatcaagaaaatgacatgttccacccgtacttttcctatcaattctacaaccaccaaaatcagcatcggaatatccacttaagcatatagaagatgaagtagaataccaaattccaaactcaagtgtatgatttaaatacctcattatttacttgacaacttaacgatatgaagcacgaggagaagcttgaaagcgtgcacacaaacacacagcaaattgtatgtctggcctagaagcagttagatacaacaaagatccaatcatacttctatactcctttt

SEQ ID NO: 20169 - DNA, 1191 bp, Oryza sativa
tgaacgaacagttgattatcaccatgcttaagaacaaaaagcgttttgtcaacctttcccattgtaaaacctttcgcaagcaaaaagttcttaagcctatcataccactctaggtgcttgtttcaagccatacaaagctttagacaatttaaaaacatggttgggaaaatcaggattttcaaaacctggtggttttttgacataaacttcttcctgtataaaacgatttagaaaagcactttttacatctatttgatataatttaaaaccttttgaagcagcaaaagccaacaaaagtctaattgcctcaattctagcaacaggagcaaaagtttcattaaaatccaaaccctccacctgggtaaaactttgagcaacaagtctagctttatttctcacaatcaaaccatcctcattttgtttatttttgaaaacccacttggttccaataatattatgtccagaaggtggttcaactaaagtccaaactatgtttctcttgaaattttcaagttcttcatgcatggcgttaatctgcgattcattagttaatgcgtgtgacacatctttgggttcaaaagaagcaacaaatgcagaatttacataaacatcatgagtcgttaccttagaccttgtagtccgctcacctatattactaatgatttgttctggcggatattgtcgttgaatgtgcaatggagcagcgacttccgaacttgattcacgccctgtatcaatactgatcaaagttgtagtctccggaggaccatctcgatcagcatcaacagtacccgaacccgatgagcctggccggtctgactgcacctcctgtgtcagtctgatcggcggcgtgccggcagtctgaccggcctagcgcctggtctgactggccgagccgaccttatcgttgtcgtcattgctctcgtcttcaaaaatacgaccatcctccccctgaacctgtgacaatgtacctgcaatatcgggtctagtacctggactagcctcatcaaaagaaacttcgcaagtctcaacgattttgttagtctccaaaataagtacacgatagccacgagtatgttcggggtaaccaagaaacaatccatcagtaaaacgtgactcaaacttattcaaatgtccagatttcaagacaaagcacttgcaacaaaaaatacgcaaatgtgaaactttggg

SEQ ID NO: 20170 - DNA, 1291 bp, Oryza sativa
gtgcttggataaagtgtttagtgtgttccttttgttagggacatattaaacatgagtatgagttaaagatatttgagatgttgtggatctttagccatttttgtcaagtctcctgattgtgtaacacatctggtcgccaccttcgagtggtttgacgggcacatctcaggctgaagttgactggcaggctaaaggcccggcaatgtctcacatatttttctctcggagcgtcgaatgtcttaatatgtttgatggaagaattgtgattagctattcatccttcaaatatactaaggggttcggagtgcttccgacaaaaatatacttgttctttttgtggcaaagatggatatattgttggtttttgtttcagattagctcataaacagaaaaaggagagagaggttgcttttgcaaaatcaaagtggcaaaaatctggttttccctcgaggaaaccggtcagaccgtagtgggtcccgtggtcagactggcaaccggtcaaaccggctgcagagtctcgatcagactggacaccggtcagaccaacggtgaagcggcggtcagaccggcccccggtcagaccggctggacacccacggtcagactggcctcggagagatttttcgaaaaattattaaactgtttttgcacgtggatatatgcctattggatcttctggtcgtgtgtctcagtactggattcctaaatttttattatcatctaaccccagtactgaggcttcgacatatgcttgtgtgtaggctttggtggcaaggaaggagaacgtgtggatcgtggattccggttcttcgcgacacatgaccggtgataaaaattggttctcctctctcagaaaggcatccaagactgaatcaattatctttggtgatgtttctacaagtgccgttctcgctacaggtttggttaaggtaaatgagaaatttgaattgaagaatgtagctttggttgaggacttaaagtacaatttgctttcggtttcacaaattgttgatgaagattttgaggttcactttaagaaaactggaagtaaagtttttgattcttgtggtgattctgtgttgagtatttctcgctatggaagagtgtttaaagctgattttgaaaatcctgtttcacctgtgataacatgtttggttgctaagtttgataaagatgtgatgttttggcatcatagacttggacatgttggttttgatcatctcactaggttaagtggtttggatcttgttcatgggttgcctaaacttaagaaagatcttgatttggtttg

SEQ ID NO: 20171 - DNA, 16823 bp, Oryza sativa
  unsure (1)..(16823): unsure at all n locations
aactacagtttggatcgagttttacagcctaggagttcaagatccaattttggcagtgtgtcaaagagtgctccagagaatctgtcaaaatcctgtgcttaagtgtttagagagttgtttggttgatctaatgagttgataagctaaattaaatccacatttagtttctaaggtcagcaagaagttaccacaaattcttcccagatttttgagttgttccaagaatttttctttgatccattggttttagttaaatatgaacatgatcctataaaccatatgcatacaccacaaaatgcacaaacaagcaagcatataagttttaaacaaaagttttatttattttacttcttccaccatttccatgttttccaaacacccaaagtcatggtatgtgacagcctacccccttacaaaagaatctcgaccccgagattcgtcattctagaagaaactagggaattcggccttaagtcggtcctctcgttcccatgtggcttcatccacagtatgattgctccattgtactcgaagcatcttgatggagcttttgcgggtacgccgttcactttcttcgagaatacgaattgggtattcttgataggagagatttggctttagattaatgtcttcaagtgaggtgtgctcaatcggagttcgaagacatttcttaagttgagaaacatggaatacatcatgtatattagacaactgaaatggcaattccaattgataggctacttgtccacgcttagatattatttggtatggcccaatatatcgtggagcaagcttgccatgaatttggaatcgttgagtgcctctcatgggtgatactttaagatagacatggtcaccaacatcaaaacttagctctcgtcgacgacgatcagagtagctcttttgacgagtttgagcttcttttaatcggtcccgaataagagtgacattcttttcagcttcattaatgatagcaggtccaaagaattgtctttctcctacttcggaccaataaagaggagtcctacaatttctcccataaagagcttcaaatggtgacatttggatacttgattgaaagctattgttgtaggagaattcagcaaaagatagacatttctcccagttagtgttatgttcaagcacacaagctcggagcatgtcttcaagtatttggtttgttctttccacttgacctcctgtttgtggatgaaaggcggtgctgaggaacaatttggttccgagaagttcatgtaaatttttccaaaatctggatgtaaattgtgttcctcgatcggatactatgacttttggtacgccatgaagccttacaatatgagtcaaatataactctgctagcttggctccaccataagtcacatgcaccggaatgaagtgagccactttagtcagtcgatccataataacccatatagaatcatgtccattgggtgttttaggaagaccggtaataaaatccattccaacttcatcaaatttccattcaggtacttgcaaaggttggagtagcccagcgggtcgttgatgttcagctttgacacgttggcacacatcgcaaattgcaacatatgctgctatgtcacgcctcaggctaggccaccaatattgagtgcgaatatcctggtacatcttagtgcaacccggatggatagacaaaggtgtttgatgtgcttcatcaagaatggtttctcgaaggtgttgattattgggaacaaagattcgtttgccaagcataaccataccatcagaattaagagtgtatatagattgtggctttgaattgatttctttcataatttcagctacttcctcatcaatggactgagcagctttaatttgagaatagagagtaggttgtaatgctagtgcagcaacataaccatcctctaccaatcccaaattcaatttctgaaattcagaggacaacgatggctgatttattgtctcaataacggcaaggtgatgtagcttccggcttaaagcatcagctactacatttgctttaccgggatgataatgaataccgagatcataatctttaatgagttctaaccatcttctttgccttaggttcagatctggttgggtaaagaaatatttcaaactcttatgatcggtaaagatttcgcaccgattactgaccaaataatggcgccaaatctttagagcatgcaccacagctgctagctctaagtcatgagttggataattgatctcgtgtggtcgtaactgacgagaagcataagccactacttttccttcttgcatcagtacacaaccgagaccatgatgtgaggcatcgcagtaaacattaaaaggtttaagaacatcaggcatcactagcactggggctgttgtgagccttcttttaagttcatgaaaacttgtttcacatgcctcagaccatatgaatttattttcttttttaagaagttgagtcaagggcctagcaattttggagaaattttcaatgaaacgacggtagtaaccagctagtccaagaaaacttctaatttcaggaacattttgtggttgcttccaattaagtacgttctgtacatttcttggattcacagcaataccaccttcagaaagtacatgaccaagaaattcaacttcttttaaccaaaattcacattttgagaatttggcataaagttgatgctcacggagtttatcgagtaccatacgtaaatgttgcgcatgttcctcttcactcttggagtagatgagtatatcatcaatgaataccaccacaaatttatcaagatattccatgaagattttattcatcatattcatgaaagaagcaggagcaatggttaatccaaaagagactacggtgtattcaaataaaccgtagcgagttgtgaatgcggttttaggaatgtcctccggtctgattttaagctgaaaatatcccaatctaagatcaatttttgagaagacacgagttccggttaactgatcaaataaatcatcgatcctaggaagaggatatttatttttgatggtgacttcattcagaggtcgataatccacgcacattcgcatggttccatctttctttggtacaaacaacactggacagccccagggagatgaactaggacgaatgaaacctttagccaattgctcattgagttgcttctttaattccatcaaattttcagaagtcattcgatatggccttttggctataggtgctgtcccagggattaaatctatcacaaattcaatgtcacgatctggaggcatccctggtaattcgtcaggaaacacatcggaatattcattcacgatgggtactgattttaactccggtatagagagagattgtatagagggttgatttgaagtggaggtttgttcaaaggtaaacctaacaaattgaccatcggtgctacgaagagttacagttctatgagcacaatcaatggttccctcatgtttagttaaccaatccatcccaagaatgacatttaggcccaaggtgtctaataatatgaggttagctttaaactttaccccgtctattataagttctacacctttgcatagaagtttggtgaccatggtggatccaggagattggatgcgcatagcatcgctaagaaattctgttttcaagtcaagttgttttgctttcaaggttgacatgaatgaatgagttgcaccggaatcaaaaagaactgttaagggaatggagtgcacaagaaatgtaccaagtacgacaccaggtgcgtcggttgcttcttctgcagtgacatggttgagccggccccttccaaaagttggagctggcttgggaacagcaggagctccacgctgtccaggctgaacttgaggaggaccacgaggctgctgcggtgctccctgtgagtacggtccggattttccagtcttcggataaggacagctaggagaataatgcccctcttgccgcaattgtagcaggtgacattggcattacgagatgcatctcccgcagcttgaactgcgcgaggaacttgacgaactaactgagtttgcggacgtggaggcacatacatctgccgaggtggctgaggtgccataggacgaaccgcaggagatggagcaagacgaggccgagtggaactgctgctgccagcaaatttctttgcagcccacttacgcttacggtcttcaaccacttccttttcacttgattcaacacgaagggctttatcaaccagtgtcttcatgctggtgatttcatgagcagcaagagcatgcttgagttcaggtgcaagacgatctctgcatagctcaaccttctttgtttcagtgttcaagtcagaagcggcatatctacccagataattgaagcgttccatgaactccatgaagggcatgtttccttgcttcaagttaagaaattctttctttttgatttccatgagaccagcagggatgtgagcagacctgaatccctcacggaaaacagtccaagtgattggctcgtcaggaggaatgagagtcttgtatgtctcccaccaagcagctgctgcaccttgcaggtagtaagcagcaaaggtagccttctctacaggatcacaccggcaaaggttcagcttgatttcaatatcacgaagccaatcatctgctgcgagtggatcagccgcagaggagaaatgaggtggatgtgttcgttgaacatctgctagcttggagggtgcttgattggcctgctgtgccatggcagcccccatgttttcagagttcgctaccatcctttcaaaaagtcggttctgattagccaggagttgagcaagagatggttcatcatcatgctgttctgcagtggcagcacggcgactacccccggcacgtccagaagaatatgggccagtgcgaggctgactcgctccctcaccattggcatcatcagtaagagcagccatagagtgagtatgtgtcatcctgcactcaaagtacaaaagtacatgagctgcttgagcatagaattggcatatacattaccctaaataggtagcatacaggaatgatttcttatagccgaatttacaagtcatccatcatatatttgcatgaaacaaatttctggacagcaagcaatccattccaaaaggagcataagttcattccagtacattagttttaaaggatctaagtgatcacagatacataggagtggataatggtcataagaaaccaagttcatgccttggtgttacaaaattttgaccgttaaaaagattacatattagggtgtcatctcatacatcttaaagaaaagaaatgaaagttacaccccatacatattctttttttccagtacaccattttatggaacttcggagaatccgatgggaggttgaggcactgtggttgacggagtggccatagtcaaacggtattgtctcccattccgctcgaactcatagaatggccccagcagcaccggatctccagcaagtgcacttcttggcatggttngacgatttcgatgaaaaccaactctcatgcgggctctagtgtttatattatgataaatacccatgggaggaggcaaagtctctgtaagaggctgaaangggtnttcatngattcccataaatgatggcattatcaaaatgtccttgatgcccgagtggttctattcgtctatcaagcatgaccaccctagcttgcaatctacgcaactcagttatagtttttgcgagatatctatccatagcacgaaccaggccagctaagaatagtcctggagtgtcaatctctctcatgtttccctcaagacctggatagtaattagcggaggattggtttgcgcgagctggaaagaaatgaaagaacccgtccaaccctggcctataatgtcggtaatacacaattgcttgtaatgcagcttcctgcattgctgagggtgcatcccaaccacaagcttgaaagtaaaggggtggttcatgggtccaaagtccctgtatacacagctcagccatatatgctcgagagatgaactccgctcatgagaaaagaaatgatactccggtggatgatcataacctagatgttgcagcataagccacaggatgtgaggcagtgcttcttcctcaaaacctccagaatagcccaatggttgccacatagaagacatctacaagatattggaagtatagaccaattagaatttcaattgaaactctttaggaacttggaaatggtgttttggttattatgtcaggttctgtccagcatactgctctgagtaaaaaaggagaaggacgactgctaccagttctagaatctgcgcagtttaaaaaaaaattatatatattttttttaaaaaaaatgcgagcatgtaaaattcgtaccaattttgggacatgctaagaacttaatgtagaggctttacaaacatctggtggcctttatatgacaagcaaactatggttaaaacaaatcaattccatcctaccccgtactaccactttctaggccatcgataaaattttaaaattttaaattcaaatttagaagggaaaaatttagtcatctatttactgagaagttttcaaatcattcaagtactgacttgaatcgaatttgtttcattcattccttattcttctctatgagttactacttctctatttatgcatcttccggtcctatagagtaagatggggttttaaaatcaaaacaagattcataggaaaggaatttatccaaacagggctaagaagtaagaatagattagattttgcaaatatattttagtgaggacattaccctcaaaatattttcttttgaagccttactaccgctcagtcttaaaagggttcctacagtcggtcttggctctgataccaaagctgtcggaagcactccgaaccccttagtatatttgaaggatgaatagctaatcacaattcttccatcaaacatattaagacattcgacgctccgagagaaaaatatgtgagacattgccgggcctttagcctgccagtcaacttcagcctgagatgtgcccgtcaaaccactcgaaggtggcgaccagatgtgttacacaatcaggagacttgacaaaaatggctaaagatccacaacatctcaaatatctttaactcatactcatgtttaatatgtccctaacaaaaggaacacactaaacactttcatccaagcacatgatatctcaacatagggagttctaagttctaagttttagttaggatcatacaacttataacttagatacacatggccgattggctgaatagataggttcgcggaagcatcttctacccaaaagatctttcatgcaaccgactaggatagaccctagtaagaaccatcctggaagaaagaaacttccccaacgaaatcatcctccacaggagtgatctcacctgcaaccaattctaaacatgcaacaatataacaatacaagcaagagtcagtacaataaattgtactggcaagcaccaagcaagcctagtactctacatgcatggcaaattcaaagtaaagctaacatgggataattttagcataaagcaaatttagtttgcaaagagcatttcaaatttcagatttattttcaaataaatttcagcaagaatacacttagcaattgggcaccaaattagatgataaacacatataacatagctccttattgccttccatggcagcaaggatataaaccacaaattacatcacattttgaagttcaaattcagctttagaagaataaaacacatgtctaaactcatgacatattcacacgccgctcttgaccgtgagcacggctaatcgattagttttaactctgcagagtatgtacactttacccacatgatgcgaaataataatcatgcaaaagcatggcacgcgatacataagtacccgatttattactcacaacaaagcccttccaagattcatgatttagccttacaccagcacgatacgtgttactccatcctaagccatactcgatatatgacctagaaccgttaagtggcgggcccacgccttaaacttaacgccgtggtggcggacgcaacgggaacccacccacgtggcacaataccgttgtattggacagacttagtcacctaaactaccacgtcggggtaaatagaaagttcctctgaatcaacgactaattcctcagaattatcgactaactcatacacaccggcctaccagaatgtaaggctaaatcataaataatttactaagcttgggctatcccatactagcacatgtggttgtactgtatacgaaatgaattgacgctgagtgaagtccttaggtcggtttgggcacactgtccccctatcagtacacaactaaacacaatatgtgtaccacatgcggcccaaacctaaaatccacattttccaacattttatttaacaaatatcacattttatcattttaatccagatcataaaataaatcatttaatatatgtaattgagcccaaatggtaagtaaactcatcactaagcatggctgagcatttttatagacttgctatctcaaacatcattcttaatgtgacacaatggattgttcctaaggttttggaataatggttaaggtcttttgtggagttcaggtgataatgcaagttaaggagttgatctaacaaattttacaagattttaatggattagtgtacaatagacatgcatattttgcaaacttttcaaaaacatccaaatcataggttcaatgtgatcaaagaagggaggtggcttgccttgctcttccactccttgctcagctacaaagtaggcctcctcgagactcggctgcgaatcgtctaaacatacatatgcaaaaatttaaaatttaaacatacataaaaatccaacatgctctaaaatgaatgcttttttttatggagttggtgtgctccgtgttagtttgattttcagtgaaagaaacttcaatctaacagtttacattcaaagttacagattttttttaaagtgtttacatgttaattatggtcctaaatgcatttcgaattattgagacataaatctttatgattctgttaagtcaaacatttttatgacgcaaagcatgaaaatatgattctaacataatttagtttgcaatttttagagtcaggatgaattttctaccactttctaaagttctgacatttttcagttgataggaaattagtttttgtattttctcaaattttcatacatcattttcctttctcaggtccaccagacagagactaacattttgcgcaaaagcccctgggttctcaggaaatagatcccgcagcccctagcacgtgttccaggattttattcaaaatgggacttgagttctatgttatttacagattagtgcacgaccccatatgtaagtgattgctcgggctgctaatgcatccctgggagtctttaaatttcaaaagccatgcccttgctctggacagaacagagcagcagcacagccacgaacttcacagtatcaccagcggcgaacagcggcgattcagctcaagctcccaaaacaaaaagtgtagagaacaaccgtacgaacctattggtgtttttcttgcaagccttggtgctctatagcggctgtcagggtgttagaagcggcggctaagctcggcttgcacatgcatgtgagttttgaggctcgatctaatcgtgcatgcgtatggtaaggactctagggactactaggaggctcaccaagaagcaaacgcagctcagcgaagtcttggcgacggtgtactggttcggcgacggcgcggctgctacggtcgtcgtcgacggcgtatccccaggcttctactgcaaagagaggaagcatgactctgtttagatcagcacaaggtagctctaggcggaaaatattgcgccgaagctcaccagagaaggagaaagaaaggaatggcgtcggtggctgggattggagaagaagaagaggatctcccactgtggtccacctcgcgtcgattccttcgggattcttgatctacaggtgttgatgaagctcgtgacgaagtggctcagcctgtaacgaactatggaagcagggcgacgagcaaaggcgaagcagcggcgtccagagcgcgacggtgttccgatttgacgcggtcacgttcccggagattggctgcaccaaatgaggtgttcttggtggtgttagagacggcattgagaggggattacagaacgcatattgaacggaaatgggctcaccggattgtgacggagtcgaggacttatctcgccggcgccggagatggcgcctccgttcccggcgaatccgaggcggggtacctcggttcttctgcgaaacgagacaagggcgagagggagagaaagttggtcggccggtcgggttaagtatggtcgccggcggagatggacaagaggagctcgccttctcccgtgctcgacgcgtgctcacacgcgtggcatgcgagttcaggcagtgggcccgtgtggagaggaatgtgaggctgacaatggggtcccgccatgcagccctggcccacatggcagcgactagtgagagagaaggagaggagatctaggttttggccaagtctggaacagaggtggaattccatctttgggttcagtttaaaattagttctaggcagagttagagctagtgaccaaaggcaaagttgtaaagcaatgattgaactacagtttggatcgagttttacagcctaggagttcaagatccaattttggcagtgtgtcaaagagtgctccagagaatctgtcaaaatcctgtgcttaagtgtttagagagttgtttggttgatctaatgagttgataagctaaattaaaatccacatttagtttctaaggtcagcaagaagttaccacaaattcttcccagatttttgagttgttccaagaatttttctttgatccattggttttagttaaatatgaacatgatcctataaaccatatgcatacaccacaaaatgcacaaacaagcaagcatataagttttaaacaaaagttttatttattttacttcttccaccatttccatgttttccaaacacccaaagtcatggtatgtgacaatttttcacgatgattcgacatattggtagaatcagaaaacttagtgataataatccggcctaggtggggtcggctgaggcccaataacttaaggtttcccggaccccaacagttcttaggcacacccactcggagaaaggcccaatctccctaaaagactagtccaataggggaagggtggctctcccttttaaggtggcttcctcctcccaagctaagcaaggtgggattattcaaaggctcacacggtcgttgcccgactttggcgtctttgccagcgggtaatagtggaggatgtcctcatcacttagcaacacaagcaacaacaggaggttttgcatgcacaacattggactttgaagaagatgtactcaaggtagacatgataccatcatatttaaacatagttttattagtatcaggtttaactaaaatctcaccacctctagcaccagcacctaacacaacaggaggatgactagtatgatgagcataagaattaaaacctaaaccacggttatgtgtgctaaccttagattgatctaaaatcatgttgagcttctttttaccatcagaaaatcttagcaaagaatttttcaaataagaaacctctttttctaaattagcacaattttcacaatctaccatgacaactttgcttttacgacatttggggcaagaaagcacttcattggttttcacaacatcttccatgtacttaacacgatctaaagcatcttttagtttcattttatttaaattagatgttgagcaatccaaaacatcatgagattgttttaactttttagcacaaatcatgttaaacatcaaactagcatgaaaagcaatttgatatttttgcaacaactttttagtcaaaaacaactcatccaaagtgcgtgtgtgcaaagcaaaactaagagcaagagaagatttatttttcaaatcatgggcagcattgacatctctaatttttgaaatcacattcattaaaacctcacaacttttgcaaccatcatcattaggaataagatattttaatctagcaatttcagaattaagagattcaatgataaactcctgttttctatacattttctcacacttcttattttttgcactcaaaatattaatagcttcctcaaaagcacttacctcattgtcttcacactctgaatccgattcaccacgcgccatgaagcgaacaccgaagatgttctttcccttatcgtcatctccactatccccatctacatcgcttagtggttcaaacgcggcgtacacttgatcaaaagccttcttgagattctccttgatcttcctccctttgaatgtacccttcggcttgttgtcattggtcttctcaccatctttgtcttctcttttgcctctcccaagcttaggacaatgcgaacgaagatgatcaatcgaaccacattcaaagcaacgatttggaccacctcttttcctgaagctggcattgttcatagctcgagcaattctgttagcaaccaaagccaaatcctccttctcgaactgttcgagttggtcatcggatgtggcattaaataaagtaagaatagaagactttgatgaagaagtatcaacatccaaagaagaagaggaagaaaccaaagcactcgacttagaatcaactttacgagaaagaacgttcatctcatgtgttttcagttttgtgtaaagcgaatccaaagtcaaagtagacatattaacagactcctgaattgatgtaactttcatctcccaaatagacatgtcaagaccattcaaaaagtgacgagaaatctcagattgtggataattagcatcataagaagaatcaacagatctaagatcactcaaaattttgttaaacctagaaagatagtcatccaaagcttctccaggtttcatctcaaatttaatgtactcctttttgaaaagacctcgacgaagttctttaatgttatatgttccttgatgaaaattactcaaagcaatccaaatctcatgggcagcttgaagatgagcaacacgatcataatccgaacgagaaattccactcaaaagaatattgcgagctttgcaattttgttcaaactcaagttttaaagcggtagtattaatttcttcgggaatcacataaggatgagaaacttttctccaaatatcataatctttagccataatgtatgattgcatcctactacaccaatgagaaaaatccgttccatcaaaaacatgaggcttagttgaaaatctatcagccatggcaaaaactctagatcggttaaaatccaaagaagaaaacaaggctctgataccacttgtaggatcgaaacacaatacctaagccaaccagaggagggtgaatggttggtatacccaaaaaccaaaaacttttagtggaaataaaagttaccctcgaattcgatggagatcggtctgaccggagtagattagccggtctgatcgaagcgtagccgccggtctgaccggtgttgatcttccggtctaaccgccgaaacttgtcgccgacgccggtctgaccgccgtgtgcccgccagtctgaccactgcgatgccgccggtctgaccgccggtgcgccgtaggttagaccgccgaaacccggtgaaaccaatgccgccggtctaaccgccggtgcgtcgccggttagaccgccgaaacccggtgaaacacaaatcgaagaactcttaaagtggatgacgactttattgattctctctgtgtttacaaagtggaccaacagcactccttacaaaaatttcgactaaactcgaaaccctaactcaactctcaactcatttgctctcaaaagtgataccggaaagcctcacgctccccctctatttatactagaggtaggcagcctaaagccacgaatcaaacacatactagaagtcctaaacaccttaggaaaccctttagtgcaagaaacaaactttacataaccaatcataccaaatttggactccttaaaaattcgactccatatcccatacgcacacaatacctccattgtatgccatatagaatcttcaccaaccacgtgtattgaactctagccatagtatcccgcatgatctctgaccaccacggatgtcgtcttatccccaagccgactcccggtccatcaccgcaaatactctcccggcatccgagtcacctacacaaagaacaaacaaagaaaccatattcctccgagaccaagctatctccaacttgactcatttgtagcaaacaacagtattacatacgtatagtatccatctagaagctataatcatgaaacaatcatggatatccaaacaaacaatccgaaaccgaaaccgacacagagtcggccggtcagaccgcgagttgcgccggtctgaccggcaaccactgcccggactgaccggacccaatccagtagtacctgtagattcacctgtgaaatccaatcatctccaaaaccacttcgtgaatgaattttaaatatcaaaaccaataatctccaatgccaattgttcatcacagaataataatcaaaaacacctttgattttacactccatagctaccaattccatgcgtgtagcaccaatttgcatagtatcatgtttctgtgatagcatcatacaccaagagtggagtcaattggaacacaagaagatgaccggcttaatgttagacaatttcttatgctaagtatgtgattgcttaaagaacatgaactggcagagtctgcacaatctacttttttgtcacgaaaacagacaaaatggcaactacgacagccagaggaaaaaaaaagggttaataaaaaaggtaaaatgagcaatttataacaagagaggttatttaaacctttttgatagtttggaggtgtaataggacttatgcatatataacagaaataagtccatgaaacaggcagttgattgggatatttctccgaacgtaatttacagtcttcctccaatcttcagttacttcaaaattcaacgggaataggctattattccataggggtttggaggaaaaaactagctaattgcatggtcttgctgttactgatgtttcactgcagctactagatgaagtttccaagccccacattttgtacaggaaatgcatttatttgtctccgaggccaaaccttgagtccattcacagaaagatcttgaaagaggagtttagagtactaaagcatccaccaccacgcccttcaatacaatgcattgtaagtatatctgacctttgttgtaagctataaatattgttatgtagttggaattgttccttatggaataactaaaattaaaatgcatcaatgttccttaaaaatatcgtgtgttgtcatctatgtcccttaaccttgataatgttgatctgagtctagggaatagttaaagcatgccatgtggtccaaaattcccacatacctttgggtgcctacatagccaatactacactctgtcagagccgtgacattaacaggggtatgtatgtggcaattctacttcggtgccatatgggcagttgaagggtacatggtagttatggacctatattgaataccttaacaaaattttaaacatagatctgtatttttaaacttttagggacttttttaagatgacacagtgagccattttagggataggtggtgaattttactcattacgtaaaatgaggatagaataagggtggtggatgaaaagtgtaaatagacgaataaaaatgagcaattacagctatcataaaaatatgttactccctccatttcagaccataggtcgttttggtcaaagtgaaactatttcaagtttgaccaagtttgtaaaaaaacaaagtaacattttaacccaagacaaatatattatgaaaatatattcaattatcgatttgataaaactaatttggtgttgtaaatattactatatttatctacaaacttagtcaaacttaaagtaatttgacttcgacgaaagtcaaaatgacttataatctgaaatggtgggagtaagtagtacatatcacatcctcaaaatcttacaagcagagagaaatataaccttatttgatcttacaacattgtcatcaatctggccagaattaggctgaattattcccattgcagacctatgccaactacttatcatacttttgggcaaacaataataacacccaagaaactctcggaatcaagaaggtaaatttgaggaacctttttcatttcgatagatgacttcttgtttgcaattttacatcaaatgtatgagcattcatttgaaatatatttctatatgctaatatttcagggaagtgtgaatgaatgggttagatgccacaacaatgatctaccatacaccgaagacaccacgactagcattatcatcgtaatgttacattaaaaggttaccgtgctttagtctacaggtaaagtaacaacatcaccattcaccaagttactcacatgcataaacattgtcttgctgcttttataagctgttagatggtcaatctttagttaaacttaagtcgatcatatagataaatgcacatgatggggaatgtcacataataaacacaggaatactacaagaaatgattgagagattatgttttgaatcaaaaatatcattttcaactatacatattgttgcatgtgatctatttgcaatgttctttgtgaggaga

SEQ ID NO: 20172 - DNA, 1029 bp, Oryza sativa
ggattaacttcagtgtacgtccaaagcttctgattcagggcatgccacttggttcacttccgcaaccaacaagatatacaatagtaaaatttataagatgatagccgatcggccgatcggccgataggccgatgttgtatcgtatcagttgatgaacaaaataatcagctacaagcatgaaggatactgtacataaattagatttagattgaatataattataaataacttttctttaataaaaccaatcctataggtcaaacccaatcgatgaagcataagattaataaagtttaaagtcggccataatataattatataacctaaattactagccaatggaaagatgcttgtagattagacctaaaatacatgcgatcggttgtagaggtaaatgtcatgcatttactaattctatcattttcttaaatacaagcaattacaatagatcgggccgagacaacattaattgcttataactaagagtacgtaaattaataactatatggatttatatcgtagccgatgaagtaacttaggtgattaaagataacatatcggatgtagctctgatacaaccttatataagagtattgtttcaattaaatctactaacaagtttcaatcccagtagatcggacctagccaagatagtgtgagattagttaaaggctttatagattaaaatgtttgatatacttgtataagatgatagatatagcaaattaagtaaaagacagcgagtaatctaaaataaaaatagttatattaggtatgaccagctgaaagtccaatgctatcgttattggcaatccaagagcaagttaggtcttacaatttcaattacaacgtagtaggtcaaacctaactaatgcaacatcaagttataatggaagtcgtaaggtctaagcaaacctttgattgtttctcagggtggtagatacactaaacaatctaaatcgacgagagcaatttagacgatatcggctatatctaggttgaaccagtcgatatagataaataacattg

SEQ ID NO: 20173 - DNA, 25985 bp, Oryza sativa
cgttaacaaggttttttctaaaatttcatgtgatcgtttataaaaacatctttaagttattaggtatctccttgattgtggaggaaacttttaatgaaagtcacataggcctttcacatcacatgcacagtttgatggtgagaaatttgatcaatatcagagcatgagacaccactcaatatcaagttgagagctttgcagttatcttcaaaatcaactttacttgtactatcagaggcatccaggataatataacctctaagaatgttttgctaaacatcaagacctgacacataatataagattgcatcttttgtttccaaaactgaaatcaactccataaaaaaacatgaggcttggttcaaaaccaattgcccatggctaatcgaaagagagcaaaaacgtgcctctcgtaccacttgtacgattgaaacgcgagaacaaattgtactagagggtgggtgaatggtaggtaaaatgagtggaagtcaaattatcgaacttcaaaccatcaaaacccactccaatctcaaaagccaaaggggcactagtttacggttagacagcgaagtgtaccacagtctgatcagacctaggtccaatcagaccacctgtacaggcctggttggccagctagatgagtgtcttttggcggaggttgggatgttttcttatcttttgacataacctaccattcaaacctcctctggtagacttggttctcatgttttgatcatacagtttcatctttatatctatagatggtacactttgagacctgtatccctattttctatatgattacgtacccaagaaaggtggttataatgatttagtatatctactatatatgaacaaccattccaactcaccagctatatatatatatatgtgtgtgtgtgtgcgcgcgcgcacgcgcgcgctactctaacatatttagagagattggttggcatgtaactgattctatatcatgtttatgaactattaaagaatttaacatattgttatgtgcagtggtgaccatgattctgttgtgccatttctcggtacacaaacctgggtgagattgcttggctatccaattgtagatgactggagagcctggcatgtggatggacaatctgcggggtgagtttgaagattgtgttattagtattgttgtttggttatgtaaccaaatctgttgcacaggttcaccatagcatatggaaacaacttgacatttgctactgttaaggtacaacatatcaatgcacaaccaattttcttatattcatagtaatttccagaggttgttatatatgaatgaagttatattatatatgactcttaaaatttcaaatttataatgcaaacagaaaccatcatgatcgatcaggattttagcgtatattggttctagctatatttacataactgattggcatgtggtaaatattaaagccgggaacaaacagatttttaattgatatagctttttccaaaaaatttgaaaataaaagcctcccaaaaattgttttctgattcaaacattgttttacgacgctatcctgaatcctcattgccatactgaaatggtcaatgcaaaataaaatagttgatgcaccctgagaaggaccttgccacatcactgtatatatatgggaacatttatcgccaaaaggttcgttgttagaaatatgttcattgaatgttttttttacaacttatacaaaataggtcaaaatatagtaacaggctgaagaactctttgtgaaactgtttatacgtttttcacaccaattaaatcaagcttcacagaatttctgagaaaatcattcgctctataggtggcacattagctggaaaattctgaggaaaaatgataaatatttaatctttccgctagtgtaatttggttgggattacatggtaatatgaaacattattggatggatattatatactgaagaaaaagacctgaatagaaataataggaaagtaggatatccaccgaccatcaatgccggccttatctatatccaccagatcgacggcatttggtagcttttgttacgaaattattgggtgatctcatccataccttggatgggattggcaaccgagtattagccatggcttagtgatcaattagaacaacttaattgtgcttcataaggggacatgccttttcaggatatgttcacatcccctcctggtctataaatatttgaaatcatccatgtaaaacctagaattgaatacaaagaaactcctcctttgctcaatctctctcgctctctcgtttcttctcaacacgttatcagcactgctcgtgaagaagataaaggaggaaatcaatcaaggagccagcatttgaaggtatgatgcctaccttgggtgtaatgcctaccttgggtgtgattcttgacgccattctcggcctccctggttggcaccagaatcaccgtctacaccaccttctatgctgctcgttgtcgtagcactagggctaccgcatcacccacatcacccacttcgaagcatggatccgggtaggtggccgccgccaccaaccccggcgccgcatggtcgctgacgccacgcggcctctgcctcgccggcctctgcacagctttcccccacctcactggacgtgatgctgtgatagttgggtttgggcaagccactattacactttgataggtatacgagttacaatcgaggatgtcttactgtatcccgattcaacccgtacattattaagttatagagatatccatcaaaatgggatccccattaaaacccatatgcataattaagatgaattttttctcttaactaaaccaaatggatatggcaaacgcagcgataaaattccatctctcacatctagattgtactagacatacattaatctcattgcacaagttgcatacagagtaatttttcaaaacgtcgatgcattccacacttggcatgatcgacttaggcaccccgatattgagatgatgagaacatttattggcaactgtattattcataatttcaacacagatagatttgtcaaaacctctgattttgtatgcactgcatgtgctactacgaaacagattttgagaccctcttaattcaaaattacagccgaatcacttaaaaattccttgaacgcattattcaaggacatatctagggaaattcctattatattagaccggccatgcagacctggtcggaccaccggtctcgacaggaagctagggacacaaatattcaaacgaaatagatgccgagtttatttaaattcagacgtgtatttcttaggattagaagatgattggagaattccctcatatattatatcaaaaatcttacccttagggttgatcggaaaattcggtggcaagcgtttaaacatatctgcttgatggtgagttatattgcataaatatggatgtggcactatttaagtgcttagatggtgatcgatccaaggttgctatgggggaagttcatgaaaggattcgtggtactcatcaatcggcccacaagataaattgttttttcaagtactatagagggtgtgatgcttgtcaatggttcggcaaccgccttgctgaatcttattatcaaaccatggttgttccaaggttgggcttaggatttcataggtcaaatttatttgtcatcctcaaaagggcatcggtacgtactagttgcgacggattacttcatcaagtgggccgaggccatgacactcaaaaacaggactcatgtggagataattcactttattttgaattttaatttattgttaatttatcttgaatcagaggatttgaaaatctatatgtgttgaaattagaggatttatcggttgaggaaaataaaaattgatgacacacaatcttgatgatgtgatcgataagagtttaaaggctttagaggagatagaaaaggagaaaaaaaaaagagtagtcaaagcctataacaaaaaagtaagagcaaagacgcttcaagtaggagacttggtatggaagacaatttttctttcggttctagatctaaggagttcggtaaatggttacctagttgggagggtccttatcgaatatgtggaatcattcgagaaaatgcatattttcttgaaactttacagggaggatgattttagagagcggtcaatgggaaatccttgcaaaaaattactccctccgttgactttttcttacatgtttgactattcgccttattcaaaaattttatggaaatgtataagatataaatcacacttaaagtactatgagtgataaaacaactcgtaacaaaataaattataattacgtaaattttttgaataagacgaatggtcaaacatgtgaggaaaagtcaacggcgtcatctattaaaaacggagatagtacttcccgagtatttggcaagatgcttaggaggtgatatgaccggtaattagtttatcgccctaagatcacatgttatacacttttaggttcacaagttcacccaaaaggcagggggcatgtgttaactcccaaatttggcacctagattcgaagtaggaaaatattgccaaagtttggaaggcatcggatatccttcaaggggccagtctaaactccgagtatgggctagtctgaccggcggcaagtcgccggtcagactggctaaatccgagtctgaaacaaatttcgtcggatctcgggtttccttgcatggggagatattttttgaattctaattggtctctacctggaatttgctgtggagaaggtccgtaggaagcaagaccaccccccttataagggctaaggcatgttcaattggatacacaatctactttcaacacaattagcaaattgaattgctttttcaatatcgtatctactttttgtttagttctagcttagttttatccatcgctgaaagtcattcgtccacaccgtaagaatgcaattatccctttataggtttatcatgtaaaccttctgttcatccacgagacggatgtttatcctttgttcgatctaaatcggtttcgctaaccattttggtcttacaaaacccatcttgatttagttttggctagatcgaggtggttggtgactccatatactgcaagatgtttaggtatcctgattgtgattatcttcttgaaaagaaaagttgccaacagatgaatgcatgcttgaagagctctatgaaagaatgtacaacaagcaatatcagacaatagttaatatagtttatgcaaaacaagaagtatggttgtaatgctgagcactctaagtagtgtggtttgaagttaattaacagcaataaattcattttgaacaattcaatatttgagcaacactgatgatctaggctattaattaactaaattgttagcacaacaaaccatagttatatgacattcatagtcatttatcatcctacgcaagacgcgtctaataactgatcatcaaaattgatgacatgtgttgggtcacaaatttagtccaacactgataagggttcatcttcaacttttattcatcccacagataagtgcctatgtgatgggtcatttgtttccgtcacagatatcgttcaccaacgtactagtgatctttctccattaccaagataaatagcaatctcgaattgctagatctattttatttaggacttctatttttttgacggaatatttagccttttacatgttatgtctgtgctttacaatattgtgttcctaaatttaactgttggatggcggacatactgcaccagagtaccaaccggagagatgcttagccatgtttagacgatggatttccaacatgcctctttgataaattaattagttacccggcttgctgcacacttataaagatgggtgtatttccttgccgatttatggggaattgacttgcatcaatgttgtacccaattctgaattgggtaattttaccatctccggaggtaaatttaaactttgctatctctaaataatagatatcaaaatttttattgccaaattttggtatgccttctcaaggaccgtaaaagttctgatatgaatgtcatggttgttgaaaatgatatttgtatggaaccgatctggtcatatgctgtggtagcaatcctgaacaagtggttcaaaacaataactttgaccaaacatttgaagagttgtacttccacttgtctaaattaaatcaagcttagatggttattttcaattctgtatggccgtttttctttttgttgtgatgctcaatgtttggcatatatatattgtaaggaaaatagtaatattttttctataaacatggtcaacttataatatgatacggagggaatatttatgaatttggcttctatattctaaagcaactcgactgaaacactgacgcttaccttcggaatatcaactatacctaaactaaccatgtaagaaacttaaaccccaccaagaaagccacacacaatataatatacttgctctactagcctagccctactaatacgtaggtcaatatgtagcctaggccgagaaaaacctagtggataactggataactggccgagaaaaacctaggccaaccaggatctagagcatccaggatagtgtggaaggagcctacacgacaagtccacacgggtgtataccatttaatctacatggtatacccactacaagattcctaacttttaccaagggggtttaaaccgtcggccacttattaaaattgtcagccatacatattccagggtggataccgtcagcaacttcccctcagccacatgtggtcggtaattgatcatattgccgagggtaccctcggtaaccatgtacccgaggatttcatcccgagggtttacggttggtctttttttcatagaccacgcatggtctttcttgccgaccacatttcccgagcgtataccattggttattcttattcttactgagaggtttattttcccgtcaaattgtgagaatcctcggctattaaccgatggttctgtaggccttcggaaatagtatttgccataggtttttatataacgtcatccattcgttaccctcagaatagtatagctgagaggttatttaggttacatggaaaagtaaatcaaacccttggtaatttgatattttctaaaaaaaagcaaatttaaactgtacccatttttaattattcttataaaagtaacatactacgtagtcacatcaaaacaaatttcagcttaattaatccctaaatagatccatgggaagttcaaccatagatatataaccaaattgttcaaaaatatttatcatccatcaccatagcaaaactaatataccccgttggtcactaatagttatttccgagagttaaatcaaacccctcggttactaatataccccatcggacactaataataatttccgagagttaaattaaacacctcggttactaatataccccgtcggccactaataataatttctgagagttaattaaacctctcagttactaatataccctgtcggacacttataaccatttccgagtggtatcttataactctcactcactgatatatcccgtcggccacatgctaaatagccgaatgttctcgtaacaaccctcattaaaatttcaaacggtcggccacctaaatcttcctgacggtctgtaggtttttttgcttggacgcttggcaaatcttaggattctagtagtgaccacgcgctagcggtcacttgctagcagagacggtctgatcacccaggccatgcatgaactagatgtccgtggctagcttaggatttgggccagtcctgggtccacccaacattggtagggatggaaataaactgtcatagaaacggcaggaaaatagcccaaccatttctgtatgaagaggtaattgtgttttccccttgttgtaaaactcaattataattttaccccttattgtaaaactcaattgtaattttacgtttacttttctggggttgtgattcttcccttcctttttaatacgaagcttctgtttgccctcattctgtatggtagtttggtgagcaaattaagtgtgttaaaaaaagaagaaatttctgagaaaatatgaaaaggaccattatactcccaaactaaatataatacgtccattggttcgagtccatcccgatatggctcctcgccgatctgatccctagccaattaatggccaaccctaactggagcagcatggcagcagcgtgcaagctgactagtggtcggcctcgcctgggcgacggagaggcgagcaaaacacagcgcaaggggaaccaggtggcccagggcaacgagcaaaaggaggcatgggccagcaaaaggtggcatggcaggctaggtgaagctgggcggtgcagcattaatgtcctcttccacaaggagtccagactacggctggcatcgatattttcgattttcttttctcgctgaactcctgcgcgttgctcccattagtgctccctatgcattagcatctctttgttcttcggatatgggaggcaatgagttggatcttaggtttgtcaaatcatgaagaaattaggcttaaaaaattcgtctcacaatttgcacgtaatctgtgtaattagcttttttatctatatttaattctctatgcatgcatgtgtccaaatattcgatgtgataaggtgaaaagtttttgcgtaggaactaaacagggccttatgcattttataaacaaaacatttaacctccaaaacacaggggaaatataatcaacgagagtggggaggtgacttgtcttgccatggttctattccctgctcagcaacgtaatggacctctttgttccccatctaaataataagagcacacgtgacaatccataaatacaaatatgcatgaaaagtaaacatgctcaaaaatggatgctcttttaactgtgaataggtactgttatatcatgattttagtggaagaatttctgttttatcgcattccaaatgcaggttataaattttaaagttacacctcaaaattgtgatgcttatgtatatttcgaatttttgtggcaatttcaccaaatataagttcacaggattacacagcataaaaatattaatctaacaaatttttgttaacttcacttggagctataatgagtttcctatgaatttttaaatttaacacattaattttcagtacatcaataagtcctaaactattattctatccattccattaagggggcctgttttttttctaccctataattcaccaacaaagtcttacacattacattcctcattcctcattcatcaaatccaacgaaccatattcatctgcatcagattgaacgtgtgagatcgagtccccccactcccaccgctttcttcccctccactcaccaactccctccgcactgacccacggcctcgccccgctcgcgattctagccccgacatgctgcaaatccacaaaccctaactactcgcaaccccctcgccgtcccacaaaccctatatcctcatgatcccatagccctcttctgcgccgcccccgatttctgcctcgactactccatccacactgccgagtccgttgccgatatcactcttctccgcactcagccattgggcaacggacgccgctcttctccgtgcttagcagctggctacctggtcatccacatccctcgtgctgctccccatccccatcactgtttcaccgccactgatctcaagcatcatcacctcctcttgccaactaccgatctccaccgatggttcaatgtcgccctcctcgctggtctcgccctgccgatttgcttcgccgatgcgctgccatccccggagcctcagcttctctgctgccacaccgtgtcgcactcaaaccattccttcgatccaagaaatctgtgattggggcattctacttattcatcaatttctgtggcagtgcaatgtacgtttcattagtacaacgaaatatttgcagcgtttaatttcattcaacagggtcatgtatggtggatgtatgtacggtttcagatcgtggttttggatgaataaattgcgttcaggttttctctttttttggaaaaattggttctatagcattagaagttcatattgttggtttaacagcaccaaatattaccgattcattttaatagcactgaaagtttcatccgttcatgtttctaacacttctgttacttttgcactttttgccgttagctttgaccgcaattgacccagcgaactacactgattaaaatctgtgcccttacgtgtaggtcttcatccctcccagcctgtcctctcacttgccacaatccagccctcacctagctggtgtttggatgtagagactaaactttagtacatgtcatattggatgttttgatactaatttagagtattaaatataaactaataataaaactaattgcataaatgagagctaattcgcgagacaaattttaaagcctaattaattcataattagcaaatgtttattatagcatcatataggctaatcatggattaattaggctcaatagattcatctcgcgaattagtctaaggttatagaatgggttttgtaattagttcatatttaatacttcaaattagcgtccaaacatccgatgtgacaggacttaaaaatttttagctccatctaacctatatacgctgctgccgccacccccgcggccctgtcacgcggaaggcgtggacggccagagggtttgtccggcagccttgccctgtcgatgttactgccccgttcttcgctttagcctcgcactgtgcagaacatgttgccgccacccaatccatcagcagcacgtacatacgtctcgcaaccttgccctgtcagcacggatccacgtctatgcctagcacgagctcctcttccaaccaacagcaatctgacgcatcatcctgcaagtttaaacgaattatcaggtattcaacccttcatcggcaattatagggcaaggtagttcttacaatcttaaccataacatactacatcaaacctaactaatgcaacactatgttataattaaacccaatagatctaagcaagctgataattatatattattctaacataacaaacttgtttaagccataccggtctaatctagatagatcggccgataagggtaaacaatgatgtcaatttagattaaacaatgcatatgatcaatgtccgattccactaagattggatcaaactagaactctatgtctaatttaagaaaactattataaactctgactcactgacgacttgtagcggctaaacattaccaaacacacttggtccgatctcaacacgactccaccaacttagaaaacaaggaaactacgatatactctccttaattctgaagctaactcaaacttgaaaatctctgagattatgacatgaaagcctccttcgactctatctttgtacagttactatttccacatggctcggtcgattgccaaatttctgtgactattccacccctgtcgcgcccttcagattttcacacctaaatgcacgaatcttggaccaaatataccttctaatccttctctcccctatttccacttctaccggcgaaaaaaaaatcaatggatcaggtcgctaatcacggacacgcacacaatgcggtggtggcagaccgcagatggacgaacgcggccatgggccggtggtggccacttcggacacttcgtcgtctgtccactactttccgctgtcaaatttctgtgataatgtcaggaacgatgaagatactgcacataatcagttaagttcagacaagacagaggctgtgtttagatccaaagtttgaatccaaacttcagtccttttccatcacatcaaccagtcatacatacaacttttcagtcacatcatctccaatttcaaccaaaatctaaactttgcgctgaactaaacacaaccagagctaaagatggcatgaattgatgaagaaagtgcaccaatgtgaaaactatccaaaattctggagtaatatttgtgtatggccagccaagcaaagagcttgttgtgcagaagatgaaggaagcaagaaatggccaagaaatagtctgattcgcccggtgatgagtcggcggtcccctctacttcatcggaactcgcaggggagaagtgccctaggcgacgaacatccgatgtctccgccgccttttattcctacgagcgcgattaacgggctagcgctggatgatcagtcaatcaactttttggttcaacctatgacatattcgacagttttaagggaaaatacattcactgtgaccatagtgtatttacgttgtaacaagggtgcagttaaactggtaacagcgtagctaaggtacagttacagtttaactatgatgtagctttagtttgtactccctccatttcgttatgtttgacgtccgtattcaactcaaaagcagttttaatatttgacgctggtatacacccaaaaactctctttccaactttgcccttcgcccatatacatcagtcataccactgcttccacaactgttagattcggtgccgccgacgacatccatcgcgctgtcgtagtccgagcgccgctaccggcagtcgatgctttgttggtgtcctgcctcctaactcccctcctcatgctccctgccaatgcggccttcctcacgtagtcgctccatgctcgttgaagagatttgtggcggtgtggcctcaccctctgtcgaaacatgaattcggcaataataaaagagggtagcacacgagacctaaatgtggatggatgcggagacaaaggatttagacagattcaggccttctcaatgagaggtaataccctactcctgtttggggatttgaatccgtcgggtgtgtattgatctgacgatctagttgtgctcatgccccctagagggcctccagcccaccttatataggatggggggcaggattacaagatagaaaccttaaccaatacggtatcggttttctaaatctattttacaatattatcaaattaggactttaggccgctccataatataaaaggaaacataatacccaagtcatgatctgttacatattccatagatataagttatcccctataaccagtcggataaccatgccgtgtgggtatgtggtacccataatctccacagtagcccctgagaccttcactgtcgaaaagataatcttctctcgacccagattactccaaagccaagtgcttcaatcatctttgccatggtctcccgagtacttttaccaaatatgaagactgtggagggctgaaaaataaagtcaagtacatcgactatatgcacctaataggtgtagcccccgactatatatgtggttagctaaacaaactaagcatatagtcaagtaataaataatccaaccaaccgagtggttttgataattgtaatcaaccaagtgacttgatatcaatatatagcatatgcggtgtgaatcccccaaataacatgatccaagtgatataccgactgctttgtaaaaattgatgcgagcaacctaaagttgactacatcattgaaaattcacatagcaaaacagctataaaaaagctcgaatgctgtgaataaagaaattaccaaagtattgggcatacgccatgcgcacactgctttaacagatgtgcttaagtccctaaaagacacatgttttcaccacacccgaaaatatacggcatatgtggtgtaaaatccgagtaaataaactcataaaggatttaccaaccgcctgaaaaatgaccaagatatataatcagcctaagccataatattggtcaataaaaatgcacacttacgtggcaaaaagcaacgatattgtatccaatcaattgcttaaaaactcaaacagtaccttgacttatataaaaaagtcagcgaggcagctatataaagctttactatttgacaccttttaagatgcattgtaccaactcctaaaaagttgagtaactgcggtataaaaggattttaagatatttggcactggatcacgcgcactttggcctaagcaaaaagtgcctaagtccctaaaagaatgtgacatgccacacctaaaaatatgggctgcagacatattagacctaggccaaaaaatatgccttcgacaccctttaaaggatgacgcatgtatcatgctcccgagtaataaatcttccaggtgatatagaccaagtgtaactcatatgaatagcttctgatctgagtgattatcccttatgggatactccaaaatagatataaaaattgaatctcgactagcgcaagtactcagctgttagccctcacgacaaataatgagtggtccagtcgttgagcatgagaaatcgactcatgaccatgaatccatgttgaatgtatccggaataaatccaaattgaagatataatcctcgcgcttgtgttgatgagcccctaagcatgtagcttatccttctgttgtagtcacaattgtccattgatagtagctgacaccatcggcatggagacgaaatgaccaacatgaagatgatatcacccatcaaagctgacgaaaatgttggtagtagtaaagacaatgacaccaatcaaaggtgatgaagtcgcatagccatggaggcgaagaaaccagtcggcatcagataagtcagccagcagagaagacgaaggtgcccagcaacggtgacagagttgtgcagccatggcagcaaaaataatcagtcgatgacagacgagtcgctcggtgcagaagacgaagactcccaaaagtaggggcataataagccagccgtgaaagcaaagacaccatgggcggcagtagaggcaagctggtggtgaagacgtagacgctcatcaaaggcaatggcgcaatccatcaatcatgaagatgaagaaaatagtcagcgacggcaaacacatccgacagtaatgatgattagcggcaacagagatagccggctatgatgacgaagttgcgcatcaaatggcagcagagtaggcatagccaaagaggcatggtaggatgttaatgaagatgacgatgtcagtgatctggtcaatagtagtgttgcagctgatgataatgatgagatcttttatcagcagttgcatagtaagccaaccgtgaagacaaaataacaagtcggcgaagtcgtagtcatccattagcaacggcggagacatcagggccaatgaagtagatgtgctggtgatgatgtcagtaacaacaatccatcaaactgttgagaggaaatccatgctcaagtattttcttaatgttggcatgtgtgtgacgaagattgatgcaacgcctcttgatttatgaagatgacagtagaacttggtgctatagctgttgcatatgcttcacttggaggaaagtagatgttgttgtccttttatgatccgagtgatgttgttggcatgaagaagccaaaattgccggtgtaataattggagtcgctgaaattaaatgtcggctctgaagcgaagacgaagataataactccccaaattgactcgttgattgattgattgcttcatcttgacataaagcttgtcgaattttttgagagtcttgtatttgtgtagcccccgactctttggttagttgagaaacaactgaacatagagtcgagaactgtagcttcttgtcgtcgagtagtcattgcttgagtgaacatacgtgttgaaaatgtctgagtagaaatattgaagattggaacaccacttgttgtagtaaaataacacggcatcatatttcatgacacatgccgagatgtcgagtctcttgtagacgtcgtggctgatgaagtagcaaaacttgcaaagtagcagcaattgagtttgccggtgccgaagataataaagatgaagtcgctccactatggtgacaaagttgcaaagccgtgatgaagtgaacacgagtcagcggcaacagtagaaaactggtggcgaagacgtgtagttgtgaagatagatactccagtcggttgagcggcggcataataggctagccatgaagacgatgacgtccatcagtagtggtagtggtataaactagccgtagaggcgagggcactagtcagcagcagacgagacgaccggcggtgaaaacaataaggccaatcaaccctggaagaatcatgcagccatgggagtgagaaaccagttggtagcagatgtagatagcttgcattgaagatcatgacgcctattagtggtggcggcgacgtggccaaccgtgaagacgatagcaccagtaggcatcatacaaggcggcccgtcagtgaagatgtagacgtccaacaatggtgacataataggccagccgtgcaggtggaaacaccaatcggcggcggacgaggcagccggtcggtgaagacgtagacgaccaacattggtggcataataggccagccgtgcaggcggaaacaccagtcggcggcggacgaggcggccggtcggtgaatacgtagacgcccaacgacggcggcatattaggccagccatgtaggcggaaacaccagtcggcggaggacgaggcggccggcggtgaagtcgtggacgcccatcaacggcagcataataggccagccgtgcaggcggagataccagtcggcggtggcgaaggcagccggcggtgaagtcgtagacgcccatcaacggcggcataataggccagccgtgcaggcagagataccaatcagtgacggcgaaggcagccggcggtgaaagcgtagacgcccaacaacggtggtgtgaccatccatccgtataggcgagagcaccattcggcgacggcgaaggcaagccggctgtgaagacatagacgcccaacaacggtgatgtgaccatccaaccgcataggcgaagacaccagtcggcggtgacgacagcgagccggtgataatgttctgactgatccattcctgaagcataggagataagcttaaagccatgaatccctattatgcatatccggatctggatcttgcagaacaaacatataggatgagtagtatctgatgtaaatacggtactcggggaaaattcaagtattttaaaatgtttataaatatgtatttctcctcttatcaattttgatttccccgagtagatgactcattacgtttaaacactctgcccaactagtcatagcccccacgcatcgggagtcggcctaagcacttcccaaacatgcatatgagtgacatgagttcgtcattaatggaacaaagtttcacgaatcagaatttactactcgggtacttttgcaattgttaagagcagaaaataaatttatcttatctctatgcttttgatttattccgaataatacttagcaccttgcattacccagtccatccaacaagcccccgggtgctaggaatcggcccaaaggcaactatccatcagcaaaccaaacggaaagcataggaagatagaactccataactcgataggcacttttgtactcagattatattgcaagcaatcaagataaatattataaaaattgtttaaaaaatatgatataacatctgtagcccccgactcactagtcaacggcgaaccagttgatgtagtgaggcagaggaaaaggaaaatatcatataaacaaagttaatgatgacttagctttgtaatattccccttgatgatggcagaggtggccaatgtgggaacaaagtcgtccgtcaataacaatgaagacaccagtcgggggcgaaagaaggcggtcgacggtgaaagcgaagatgcccaccaacggcggcataataggccaaccgtgtaggcagagacaccagtcggggcggcaaaggcaagccggtcggtgaagacgtggatgcccatgaacggtggtgtgactaatcaaccgtataggcaaggacaccagtcggcggcgacggaggcaggccggtcggtgaagttgtagacgcccaacaacggcggcataatatgccagccgtgtaggcggagacaccagtcagtggcacaacggcggcataataggctagccatgtaagtggaaacaccagtcggtggcgacgaaggtaggtcggttgataaagtcgtggacgctcaataatggcggcataatagggcagccatgtaggcggagacaccaatcggcggcggcgaaggtaagccggttggtgaagatgtgcatgcccaacaacagcggtataataggccagccgtgtaggcggagacaccaatcggcggcggcgaaggcaagctgtggatgaagatgtagacgatagcaccagtcggctgcggcgagggcgagcaggtcggtgaagacatagatgcccaacaacagtagtgtgaccaactaaccgtataggcgaggacaccagtcgacggcggtaaggcaagccggttggtgaagatgatgtcgccaccagcaacggcggcggagaacaccaaccatggaggcgaagagaccagtcggcagcgacgaaggcggccggcggtacggaatcttgataacctgatacgaggctgtgtggcttgatgcaatttttggcccatcttaattaggtcttagccgagtaggataaccagacaatgtcgtagccaagcaagagtcaggttagcttgttctcgatcggatttggctgttaataaaacaattttgccgatggaacacaatagctcgatagtctgggacttcgatttgtgcttgacaaagatctgtatacataagcatatatacggccatgcaatctgaggactccatccaattggttggcaagattgccatgcgtgcatgcatgtatatgtagatggaagaatacacttgcatgattggttggcctggtatccatatatgctttaatgcgtatgggctggatggatatactagttggtgtccattatcaagggtagctcatgatagccgattgacgatgtatatgtatagcaattcttctcggatgtagttgcaaaaccattttgtatatttgtatccaataaaacatgtgtgcttgactgcttgattccgcttttctctgccaaggagcgatcgatctatgcccatatgcttgtacgtctcgtcgtcttacgtagctctggatacctctggctttgaattgacgtgaacgagcggagtcaggctgatgggaaactcgccgaaggcttgtcatgatgaggaacgaattcagacgactgattttcgacggctgcaatgctatccatgcttccgtacagaaaaacttggcttggaaaaagatgagtcgacgatgctggtggcagccatagtagattgaatctaaaactcgctgtggtagtctggtagagtggttgttatcctctgattggatcttcttcgactggtttgaaatcaagtcagagaaaaagagcttgttgaaattgtcggcggcaaggaagtcaaagctggtgaaccgaaggcgaaaaccggcgactcatgaagttgattccatcgcacttgtcaatagaaactcgacgcgcccctacctggcgcgtcaactatcgaaacatgaattcggcaatagtaaaagggggtagcgcacaagacctaaaagtggatagacaggttcaggccctctcaatgagaggtaataccctactactgtttggggatttgaatccgccgggtgtgtattgatctaacgatctagttgtgctcatgccccctagagagcctcctgcccaccttatataggatggggggcaggattagaagatagaaaccttaaccaatacggtatcggtttcctaaatctattttacaatattatcaaatcaggactttagaccgctccataatataaaaggaaacgtaatacccaagtcatgatctgttacatatttcatagatataagttattccctataaccagtcggataaccatgtcgtgtgggtaggtggtaccctcaatgcctcctctggtcctccctcgttgatgccccgacgtcttgcgtgaacgcccctgcgtcgatcagctccaatccgctagttatcctcatggcagaatcgccctgctcaccaatggggtagggacaactggcgaggagatgaagggagaggagaagatgctcctgttgatgctcaggtgtggcttcgtttccttgttcttcttcatcacaagttgtcaacttcccccaaatccttttcggatgaaggcgatatttttctctttttctgtccacagaagatgttcttgatttctaacaacagttcagtgcaacaatttgcaccgctgaatcatctgcaatcttcagagaaagatgcaattctgctgcttcaccagctcattcaattcagaaccagaacaagaaaaagatcactgggtagatcactgggtgttcaatggtgaactgaaactgaaccgaattgtccataacacctgtatgcagcagcagaccgcattctgctacattcatacaacccaaagatcctgatgaaacatttcttcattgtagtattgatctgaatatcttgagtaatgtcacttcaactcaacagcacgaaaagcttgtgcaattttgacaatactcttgtaaagttaacaatatggtttcttgtgaactgtgacttcttgtaaagttaacaagggtaaaattatggtgcaataaaggatgccgattttttctggatatcttgtgaattttgaataagaatgaacaattctgtgtctttgcatttgtgcaatgaggttgaccattaggagcaaagccagaacagggtgcaattagcattcaaacagagagaggagggaattccaaaagaaaaaaaaatagaggtgaatttgttttcttggctactaaatgttgaatctatataggatgaatttggctaccatccctccgccgccgcatgcctcgccccgccgcaacctcatgctgacccgccgccggtgacgccatgggctgcttgcacggccgcccctccaccgcagccccgccgcgaaggcttcccgtcgccgcctcctactgttgctgttgcggagatgtacaagcagggagcggatgcttctacggaggcggaggctaacgagaagggtgagcagccggccgtcgccgccgcaggtccgctggtgaagagggagaggcgtggtcgtcgaggtcggctgccgcacgtgcacacgcataccaaggtgcgccatcggggggagcttcgcatacaagacgcgcggtgagcaggtcgccgctgggtggcccgcatggctctctgccatctccagcgacgccatcgacggctggactcctcgccgcgcagccactggtgctctgctccatggtcacctgccccaccggcgcggtctggatgaacgcagcagcaggggagaccgtagaaataactcagcaacgggagggcaaactcgtcaattcactagttccttaattttgtcgaagctgtcggaaacgacatatataaaaaagaagggtgaggtatcagaaaaagagatggtaccagaaaatagcacagaaaaagagatggtaccagaaaatagcacataattttttcccttttaaccataagtatatgtctttagtttttctttgatttgtagcatcccattacatttgaggggctaagttctcaatttaaaaatgttgcatatatctggttggatgtagatatttgccatttattgggatggaaaaaagactaatttatccttcttctactcatctttccccttttcttcctcccgtcgatcttgccagtgcgtcagtgggcagccatggtgcggcaatgcagcgtagcagccagcatgcaatgcagttgtgtgcagtgctgctgccgggactaaggctgacgctgcggccagcgcatgcggcgcaacgatggcgaggtgcacagcgcaacggtggcgaggcacgtggtggctgacatggcttatggcgcaacatttgatgtggttactcgccgtggtggtcgcacagcttcccggtagcttgcgtcgtacaacctcattggctgcacctcgtcctcatccgccgcaatcgctgtcggtcaccccgccaccgtcgccacggtctccgcttcttcgctcgctgagctaaatagatcagaattccaaattcatgtttggttacaataaaggataaatttgtcttttcacatctctaatcatggctaaccaatcgattcagatagaaaatgtgacggaagtgctacaaattgaagcaaaacttgtgacatgtgcttctggttgaaaggggaattttcttttaccggtgttttttctacatcgaattttctctttatttttttcactggtaaatagagtagtataatggtcctgccacattccttgttgagtaaatcttaaagatcgcttttcatccaattaaaaaaaagaggaaagtgcgagaccagctagcacttacagaatcacaagtacatatataggacaagtacgtgcttaattcgtactactcccggttgaatgaaatttgattctcataaaaaacaacgtaatacagtatatgatagattctagtagtataaatttggacagattgtgattagatttatagtcctacaagatcttttcatatttgtagtaataggatatgccaaatctaatgcagattcgttttctttttaagagacggagtacatgtaggacaatgaagtctgatagaaagcagttccaggcgtcactactcgtctgtacgaaatctgacgacgcagggtccagactccaccagtccaccctgtaattcatggcgaaggacgaggaaggtgagcacaggacgaacagcaacagcaagctcgaaactaatccggtgataaatgcatgcgccccaacttccaactcacagttcctcctcgtcattcaaaggaaagtggcaggcaggctagctgctcggttgacacacgagcacacacaagacaaatgccgccacgccggccggcggcgcagtgcgtccgatatatggcggcgttctggttcatcatcctcctcgtcactttcttctccggcttcgctgccgccaccaccggcgtgaccacgtccacctcgaaccagaagccgacgtatatcaccagccttccgggactcgacggcgcgctgccttcccttctcgagaccgggtacgtgcgtccgtccatgccgatgacgatggacgactgtaggtctgtagctacgtgcatccattgaaaattacattttcccgctgctctagttggtgtgcaagtcgtggtgctcgtgtcaaaatcttgtcaggtacgtgaccgtcgacgaggagaacggggcagagctgttctactacttcgtggagtcggagggcgaccccggccgtgaccccgtcctcctctggctcaccggcggccaccgctgcagcgtgctcagtggattggtcttcgagatcggtgagccatccatacatataccgattaatcaatccgcgtgcactctccgtgctactactgctgatatgacaacggtggccaggcccggtggagctcgtcagggagccgtatgacggcatcagcctgccgcggctgcggtggaacccaaactcgtggaccaaggtggctagcatcctcttcgtggactcaccggtcggcgcaggcttctcattctcccgtgaccccaacggctacgacgtcggcgacgtctctgcttcgctgcagctcatcgaatttctctacaaggtactagcataaacagtctgacatgcacctacgtgcatgcacggtgaatgtgttgccgttggtggtttcgttgtttctgctcgattcatgcatgatctctcggtcgtttgacatagtggttcagcgcgcatgaggattaccttgcaaacccattctacctcggaggaggttcatacgccgcgaagctcgtaccattcatcacccagaagatctcagaaggtacgtatatatgtaacttcgctttcattttctttctttgggagtttttaggctcttttgcagcgatcaggttttccaaataaatgctgtaaattgtttacttacttatgattatctattaaaatttcactggctactctgctttcaggtattgaagctggagtgaggccgattattaacctcaaggtactcttctagttacctataagttttgcaataacaggcgaggccaattattgatcagcaacacagttagcaaactcacattatccaacttacaaccaactatagtatgaagcttataatctagtaaaatagttacaattgagtatggaccaatttgtatttctgggtgatgaacagggctatacggtcggtaatccccttacaggtgatagcattgactttgattcgcgagtgccatactgccatggagttggagtaatttcagatcagttgtataaggtaagaaccttactcttttaactcaataatcaaccaccatatattatagcctagtcctcccatgaatcgctaggatttgcccattcatgtgtcacggagatgtgggtgattgagagttaattactgacacatgcaacttcaaaccctaatgaattaatttgctccatctgtgcatgctacacttgagacttcctccagtaagattaagtgatctttgtttctcacatgcatgtggtcgactcaagacgataatggataactgccatggaaagggttacagtaaccccaggacttttatttgtgcaaaagctatgtccaagttcaacgaagtaaggaacattacaatttacaaatacctaaccgattttgcaataccctatgtcgacttgtttcgccagtggttcaagtcatctttttaattactgttggattgctctaagattcatgctgtcagtttctcactgaggactactaccgtgtgtttcgctaatatatgatgttagtttctaaatgtttgttgaccattcattttaaacttactctgttattgcagccacacaaagtggcggcaagaaagaaaagggcaagaaagactgatcatcctggcctgtctccctcttcgtagaaaaaaaattaggtatcatgtttgttttatcaattaaggtactacaaacattacttttagttttgcatatttatattaaaatttaaaaaaaatatgtacactggataaggagaccttagacataaggtctcctgtaataggcccaaacacttatctttaacgggtttgggcttggtcagtgatcagttgtcactggtgagtccagtcacctttgatgggtgaccggcccatcggcccatcagaggcacactcacctctgacgggtccgtattttccggcccgtcaaaggtgaggatctccacaagccaatgtgtagttgcaacccgtcacaggtagacacctttgacgggtgcatattttccaacccgtcatacctgagactcacctcctacgagttcaagatatgaacccatcacaggaatagaaagtcatcttaaaaaaatggtgcccagttgcaaccatagaaaattggtaatagaagccgaagaactaataattaaccccaaacatttcaaactaattcctttcaaaagatggcaagaagccgaagaacttacaaggtttacaataggaaccgaaaaacaaactacaaaactaaaaactactgggaaactacaaggtttgagacactgcatttcagggaaaatgttaagattctaattttctagctacatcacaataaaaacatctctagtatcttcaagaaaaacaagacaaaagttcaaaggtcttcttctagaatcaattaatctccattggcaacacatcatggggcttcaacaagaccacacccgattcagaaacttgtaatcgatgacttgcaacatctgaaacaaaatcgtaagcacataaacacattgatcagtacttgggagtggattaatccggaggaggaagctacggcggtggccgcaagaggatggaggaggagggcgcttggggacggaagagaaggctgtccggcgcggacacggtcgcctcctagaggtc

SEQ ID NO: 20174 - DNA, 7346 bp, Oryza sativa
  unsure (1)..(7346): unsure at all n locations
tccgcacgccgtcgagccctcctcactgccgccacgcaccagatcgagaaataagagaagggggaggaggatgggggtaccgccgccaccgctggccgcctagcgccgccgcaccacctcgccgcttcgccttcgcaccagcgccgccgccacgcgccgctgagccgccgcccaccgccaccgccgcctctcccgagggccgtcgagtcctccgccgcccggtccccttttcttctgtggataagggagagagagaaaggcccccttttgtttctatggataagaggagagagagagtgagggagagagagaggatactctagtcaagcctagtcaatccccccacccacacctgtgacggctgtattgacgggtccgtttgagctgagttagcctcacctttgacggtttataaggatgcaacccgtcacaggtaactagtcacctgtaacaggccggaagtggaaaccgccagaggtgactaattacttctgacagctttcacttccggcccgtcagaggtgactaattacttatgacgggttgtagaaggatgccttaccgatgacggcgtcctgtaggatccgtcaaaggtgaccctcatcactaaccggtactaaatcccgtcacagatataccgtcaaagacgtgaggatctagtgtagtgacaaatagtcaaacctatcaacaacatcgtcactacaagaatctatttaatctatgacgaaaaaaattcgtcatagatcactgaaaattcgtcatagaaatatgtctgtgacaattctcttatcgtcatctattgagcgtcatagattaattttgccgacgttttctccgaaatcgtcacggatcagtacaatctatgacttttaaaccgtcataaaacgcttttaggctcgtgtagtccagcccatgcccaacctttgtgacaaaattaaatgtcacagatggttgccacgtggcggccaacattgcaggtgacatggtcgttgacacgtgtgtgtgatgacgtgtcactgatgacgtggcagctaaagttagcaaatatttttaaacggcccattatttttttgacgggccattaattttttaacagtccattaattttttacaatggtccattaattatttaacagcggcccattatttttttagaactggcccattttaaaataggcccatttcaaaactggcctattttgtcaaccaactatcagatcaaagcccactaaacaggcccattaaatttgagcccaccaaattcaatccaatttcacataccatctcagattcaaacctaataacagataccatctcagattcaactaataacagatacaatcataatacaacagaattcaaacaatagttcatctcagattcaacctaataacaacctaataacagatagtctcagatactgacaatcaaccgaagcttagcattctccctcttctcagctttcagttctgcactcatccttgatcgcttagtgtgcatcccaacattccgaaggaacacactcttcttgtggttgcgctcaagtacactagctacaacctgaagcacagacttgggttgttcgggtgtagccatcctttttctcgctgaagtggcacattttgaacaaatcaaacgcatcatgttctttaccctcatcctcgttcttatattcctgaaaatcatgtttatatggtagattacttaatcggtgacaacacttgatagtaggaaaaaaatgaaaataaataaacagtgaacaagaagaaggttagcatgcaagtatgtacgtatagatttgctgaaagggaggaaggaaaattacctggagagaaattgtgcaacttgaggtatatccatgtcattatatattttagtagcaaatgcctcagctcatatgaacaaatcaaatgagaggtactgaagtctatgacatgacaactcacaagaaatactgaagccgcagcaactctaactcgccatcgctcttggtcgttgctacggctaacatgcataaaagaaattaacagatatagccaaaaagagacccaacatacacatggaatgagttagcttaggcctagcaaaactcacaagcataataggaggacatagacatagcaaaatcagaattccggcagtaggcaaatcttaggcattgttggacttaggcacagcaaaacctgtaggatagtatagcaaaatcctctaccttaggcattgcaaaaatagtaacagatttgcctaagcctaacaagttaagatttatccatagcaaaagaggtgttacttaggcacaacaaaatcctgatgttatatatagacattgcaaaacagtaagagttatatatagaaaaacatgtgaatgactacatagatatagcacaaaagtaaaagtaatacataacaaaaatcatgagttaggcatagcgtaattgttggaactagacataggaaaatcaatgagttagtaaaattaacagtctcaagattaacataggcataaaaagggaatatctggagtggggttggcccggagagcggctacgagaaggactgctgcgactgcgagagcggctgcaaccacggcagagacgccaccgccatggaagcggaagccgacgcaccactgctccccccagtcctcctgaacagccatgaacacactaccatgagcaaaacacatcatgcatgaccagaacacagcatggaattggacggaggacggagatggaggcggaggagctctccacggtggtggtggaggcggtcgagaaggagacctcgcccttggctcgactggcctggcccccccgactcatcggctgcctccgcgtcctcatccttcacactcagcacggggggacccgtctcggccggcgtcctcctagggcgacgcaggcgactcccatgccctagccactgccgccaccctcctcctcccatccgcctcgccgccacccaagtggcccaccatcaaatcatctagctgtaaggatgacggtggcgaggctccttatccccccagtagcattgtggttggggcacctaggcgcccaaggtggaggttgcctagatctgggtcaccatggttggatccgatgaggggatgttggtgggcatctttggccgtggtggtaggccgtgaggtaacaggagtagtagagttagcggctggatgataggcagtgatagagacaattgctggtcctctaggcggtgatggagattgttgttgggttacaggagacggatacacgaccgccgaggttggatccctccagatccgcttggtggggacaggtggtagcggtgacggtagtgacgacgcggttgggttactttgtgcctgaacagctgcagcagtggaggagaatgctagcagggtagtgggcggtggtgaaggcaacaatgggggctgtcggatttggcatccccatatgcagatccaacgtgctcttgaccagatccgaagaggtggcgggatggatggcgtcaaggtggcgcgatgaatagtgacggcgtgtggctaggaagtgacatggtgccttgatatggctttccccggcgaggtggccctcggcaacaacgagcgatgacgatgcaggaggggtgacgaaggcggcagtcctcccctaaccccttctcctatcatggtgacggtggcggtgatgtggtttgtccatttgtgtcactactacaaaaacggtttttcatggcgtcaccctaaaattttcgctggtggccatacgcgaaaactgcagcaacaaagtaacaaggggtggggggcttcggaccgccagcgaaaattgatcttcgctagcaacggagttgagcgggccaccagcaaagatgtcgcagttttcgctgacggcgaacttaagacacagctagagaagatggcaaatttttgctggcgggcgagtggcgtggcctccagcgaagatgtagctatctttgctagtggccgacttaagccaccaccactcatattggctttacaagcggataacttaagtgacaaccatcgaaaattgattttcgttgtcggctgctgctaaagagaacagcctgtgaaaatcatcgccacactaaaaaaaatagtgacattaaaaaccaccacccacctactgcctccctctcctcgctcctcctcctcctctctagatccacctacccacccaccggccaccgcctcctcctcctctcaagatccctctcctcctccctcaccggcggcactccatccctcacccaacggcggtcgtcgtacccctctcctcctccctccccaccagcggcgtacaacggctccaagatgctctcggcgatggcggctctcacgtcaggatctctcggcggcgggtggtggcacagcaagaccagcggtggcacaacaaaggggatgcggcggtagcgaaattgccctcccctcacctcccctcctctgtccataggggaggaggccagcagtggcacccttgccctcccctctcctcctaggcctgtctagaggggaggaggccggcagcagcggcaacaacattaatagaggaaatggcttccttcacctccccttttccaaatctggcaggaggggtggcagccagcagatggccggaggtggtggcttcggcgaccgcttgtccccaatggctttggtggctagggttcttgtgaattgtgggatacgctggggagctagggttttagtgatgaatttttatgttccgttcttccatttgatgcagcggtgatgcagacgattcgatttgaatttcatgtttgatatgtggaaatgggatgattagatttgaatttcttgtttgattcatggaagagggcagctgaatgcatatggttttttttgttgccaaaatccatctgcactgtcggtcatcttaactcaccgcttgcaaaaattggatttccacagatggtcggttaaacctagttgcttgcgaaaaccattttcactggcagttgggctaggttgcccactagtgaaaatgatttatcgctggcggctggttgccgccattgaaaatggtgcattttggccattggttgctggcggcagtgctgaccgtcgtagaaaacccaagctggctgccaagaaaaatcaattttgtagtagtgtatagataagacggagagactgcggtgctcactagagtggtactgatggtgacagctctcctccatcacgacgatgatctacggtgctagcaatggagggatgtagtggcactagcgcggtgtgacaatgtgcgggagacatgtctcttcctcaggatgggactcctacatggtgtctgtctggcgatggggcgctagtgtggcggctagtgggtgcaagggaaagaggttctctggtcgaaagcctaagctgttttagggtgaacagcggcagcgttttctagcactgcttggaggcgttgttgtgaagtcttcttccttcccaatcgaatcctttgggtgaaaactttgtccttgtttccagggataggcgatggctgcgccctaggcgtcgcagctttgttggaggtattgtttgaaggtcatttcgcactaatctattctgtagagggtttgttttccagctgtggcgcttttgtccaccattttggcgggtccacgtggtggagagcagatccatgcttctctctcgccctctccctctcagatttgagtgcaatgggatgttgtgttcttgtctatttctcagtggcgggccatgtgtcgaggcatgtggcatgacatgttgtatttcctttttctatctatagccttctagggctatagtcttgtaaaacttttctattatatcaaatgatatctctcactatcatgtgcgggtttcgtttaaaaaatagaatggagctagctagggagtattagggctccctgatgttttccaatcctgattgttgcaaataatagaagggaaagtgtggtaattgccaatccgattttagtgaaggtcatcatcaacatctctagttccccagtttctagtacagcttaccgtgggtgtctcttttttggtgttccataaagtggaaagcgcgataatttaggatgtactaatagatccgaaatttggaaattatagaattttcagaattttttaatccgaaataattaaatttgtacaaatttggtcaatgatggggcgaaggttggtgggagaccagaagggttggcaagaggaggaagatcgagaactccacctccccgcatggaaaaaggtgttggccattaacgcgtgattaattaagtattagcccataaaaacttgaaaatggattaatataattttttaaaacaacttccctatagaaaacttttgcaaaaaaaacgcatcatttatcagtttgaaaagtgtgcgtgcggaaaaagaagaaggtgagttggttaagaagggtggagaacatagccagttttgaacttacttgggtgttgtgtccatgcctctaataatctttcagcctatcttcttattggttctctattctactgctcctccgtgtaaataatacttgacattttggataagagtgatatcaaatattaaaatatttgactataaatattttcttaaaatatatatattactttatcatatatatagattagtctcaaaaagtactttaataaaatcatacatttgttgatatttgtatctatattttaataaaaagtattggtcaaagttgtttctttaaactgtatcattgtttaaatggcaagtattatctatctagagggactagtttttaatatgatttgataataataaccattctacccattttagataaacctgcagtggccaggggtttaggatggatagatggttttgaagtagatatagttgagatgtcttcgaaatatcctttgccctagattcaaaattctttcctatatcttccatttaaattttttgctgattttttaaattttatttagagtgaattgtactttgggcagaatttgtcaggaagttttactttggaccacctttcacataatatttttctttgaactacgtattttggccctatttcattttggaccagcccaactctcttagcacatcaacagcctcaagaacatcgacatgctcatgtcgacgatcttcctaatttacatatatgtcatgcttttgatggataagtgattggatgtgactacagaacagtattagggtgatctaagagcaataagggtaaagatacctaatccaaactgaaaaacaaaggataatggatggcccgaagtaaaatcactcttatttattacnnnnnnnnnnnnnnnnnnnnnnnnnnnnnnnnnnnnnnnnn

SEQ ID NO: 20175 - DNA, 6009 bp, Oryza sativa
  unsure (1)..(6009): unsure at all n locations
nnnnnnnnnnnnnnnnnnnnnnnnnnnnnnnnnnnnnnnnnnnnnnnnnnnnnnnttccggtgtgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggccggtcctggacaggggtttaatgcacattcagcttagaaattctggttcgtgaatttctgggcgtgacaagttggtatcagagccgaccttgaccgtaggacaagccaactggaaacctaagagccctctgaacccctcttcatctgcatatgctttttgcacttggatttgtttcgggaaaaattttggggttttgttcttctgagtttgtgggaaaaatcttggtcgcttatttaattggatttctcgactagggacagtctagggtttggtaaaagtttatttggagtttatttgacagtcagttgggaatttatcgggtgatatgcattaggtcgtgtctatgttcgatggggcaattttatgcgcatcattttccatgcaacaagtttatgcattaagctatggtttagtcagtcgcattagtgtctttatccgggttcatgaaaaatgttctatgcataaaaatcatcatgctcggcgagttacttagtcatttgttgctttatttaatttggttttgagcatgtgttggttcctatccctctgtactctttagatgtcagacctgttcttcgatcgcaagcgccgctccaagcttcagagtcgccgcccttagctttatcgtcttcttagttttgtttgcttgctagtttccgtgcttaggtttgttgcttgtgggttagtcggcggtcgatatcatgtgtgagtggtatgacagccttaattaggaattgtgtgcctctttttcagtgttttaatccagattaagataatggcacttaatttcataagaaaaattagtttccgagccatccgttttcttcctttctcttatttctacctatcccctccagatggtgaagacaaggaatgatccccgtgactccagcgacgccaggggcagcgaagagcagaccgatggagctcatgtcagtggtgcatctggcagcagatcatctccaccgcccgaaaacccaacagtcactcaaatgatgacaatgatgatgcaacagatgcagcaacattaccatcagatgttgcagcaggcgcaacagaaccagcagtttggtcctccaccatcacacgtgtccaaactgttagactttcttcgtatccagccacccactttctcaagcaccaccaacccaatggaggccaacgactggctccgtgctattgagaagaagctgaacctactgcaatgcaacgaccaagagaaagttgcttttgctacacaccagttgcaaggtcccgcttctgcctggtgggataactacgtggcgacccgtctagatgcaacggaggttacttgggcagagttttgtcaaagcttcaggaaggcacagattcctgaagggattatggcacaacagaagagagagttccgtgcgctccagcaaggaaccatgtcagttacagagtacttgcatgagttcaaccgccttgcgcgctacgcccctgaggacgtgcgcaccgatgctgagaagcaggagaagtttttgtttgggctcgacgatgaattgaccaaccagctaatctccggagtttatgaggactttgagaagcttgtggacaaggctattcgtcaggaagagcaacgcaacaaaatggaccgaaaaagaaaggcagctcagatcagctttcctcaggggaacaatcagaagcctcgcttcatgacgggacagctaggtgggccttccaccctgatcgtctgtcagcaccgtccctatcacccgagtaacttcgacaacgattacaacggtggcagtcacaacaacagtaagcagcgcaaccacaactcgactccacccccactaatggcaccagctcagtcagatccgccaactgtgtcagttcagtcagaacaacccaagaagggggctgtaggaaagccaggaccctgcttcaactgtggcaagcacggccactttgctggcaagtgtccgaagctgaatcgcactggacccaggttcatccaggcccgcgccaatcatgtgtctgcagaggaagcacaggcagcaccagaggtcgtgttgggcacgtttccagtgaactcatatccagcaacagttctctttgattcaggtgcctcgcattctttcatttccaaaagatttgctgggacacatggattatcggtagtggaacttaaaataccgatgcaggttcatacccctggaaatgatatgaggacagcacactactgcccctcggtgactatagagatcaaaagatcaccgtttctatccaacctcatccttctcgaatctaaagacctggatgtcattcttggaatggattggttgaccagaaacaagggagtgattgactgcgcaagccgcaccatcaccctaaccaacgacaaaggggggaagatcaccttccgttccccagcgtcgcagaagtccgtagcgagtctgaatcaggctgctattgagggtcagacagaaacagtggagaaaagtcccaggaagttggaggatattcctatagtacaagagtatcctgaggtgttcccagaagacctcactacaatgccaccgaagagagaaatcgagttccggatcgatttggcacccgggactgctccaatttacaagaggccgtacagaatggcagctaatgagctagcagaggtcaagaagcaggttgacgaacagctgcagaaagggtacatccgaccgagtacttcaccttggggtgctccggttatctttgtggagaagaaagacaagaccaagaggatgtgcgtggattatcgcgcccttaatgaggtcacaatcaagaacaaatatccgttgccaagaattgatgacctgtttgatcagctaaaaggagctaaggtgttttccaagatagacctacgatcaggctatcatcagttgagaattcgggaagaggatattcccaagacagccttcaccactcggtatgggttgtttgagtgcacggttatgtcctttggactcaccaatgcaccggctttcttcatgaacttgatgaacaaagtgtttatggagtttcttgacaagtttgtcgtggtattcattgacgacatacttatttattcaaaatcagaagaggaacatgagcagcatctccgcctggtactcgagatattgaaggagcaccaactatatgccaagtttagcaagtgtgacttctggttatcggaggtcaaatttctgggtcacatcatttctgctcaaggcgtggcagtggatccatcaaatgtggagtcagttacaaagtggaccccaccaaagacagtttctcagatccggagttttcttggacttgcgggctattaccgtcggttcatcgaaaatttctctaagattgccaggcccatgacacagttgctaaagaaagatgaaaaattcaaatggtcagctgagtgcaaccaaagttttgaagaactcaagaagaagttagtctccgcaccagttctaattctgccagatcagacgaaagacttccaggtctactgtgatgcatctcgccaaggattgggatgtgtgttgatgcaagaaggcagagtggtcgcatatgcttcgcgacagttgcgcccacacgagaccaattatcccactcatgaccttgagttggcagcagtggttcatgctctgaaaatctggcggcactatcttattggcaaccgctgtgaagtttacactgatcataagagcctgaagtacatcttcacccagcccgacttaaatctccggcaacgaagatggctggagttgattaaagattatgacatggggatacactatcatccaggcaaagcaaatgtggtagcagatgctctgagcagaaagagctattgcaatgcagtatataccgaagtcatgtgtgacaaattgcagcaagatcttgagcacctaaatttgggcatcgtagaacacgggtacgtagctgccctagaggcccggcctacgctcgtggatcaagtcagagcagctcaagtaaatgatcctgaaatagctgagctgaaaaagaatatgagggttggaaaagctcgagatttccatgaggatgagaatggcacaatctggttgggagaaagattgtgtgtgcctgacgacaaagaactgaaggatctcatactcacagaagctcatcaaactcagtattcaattcatcccggcagtactaaaatgtaccaggacctcaaagagaaattctggtgggccagcatgagaagagaaatagccgaattcgtcgcactctgcgatgtttgtcagcgagtcaaagcagagcatcagaggcccgcaggactgctacaaccccttcagatcccggaatggaaatgggaagaaatcggaatggatttcataacaggtttgcccagaacgtcgtcggggcacgattcaatctgggtggtcgtggatcgactcaccaaagttgctcattttattccagtacacactacctatacgggcaaaaggttggcggagctctacctctcgagaatcatgtgtctgcatggggtacctaagaagatagtatctgatcgagggagtcagttcacttcaaagttctggcagaaactgcaagaagaattggggactcgtttgaatttcagcacggcttatcatccgcaaacagatggtcagaccgagcgagtaaatcaaatcttggaagatatgttgagagcctgtgcgcttgactttggcggagcctgggataaaagtctgccttatgcggaattctcttacaacaatagttatcagtccagtttgcaaatggcaccgtttgaagcattgtacggacgaaagtgccgcacaccacttttctgggatcaaacaggtgagcgccaactgtttgggacagaagtgttaaccgaagcagaggagaaagttaggactgtcagagaaaggctaagaattgcgcaatctcgacagaagagttatgctgacaaccgccgaagagagcttactttcgaagcaggggattatgtgtaccttcgtgtcactccgcttcggggagtacaccgcttccaaaccaaaggcaagttggcaccacgctttgtgggaccatacaggatcttggaacgcagaggtgaagtcgcttaccagcttgagctcccatctaatatggttggtatccacgatgtgtttcatgtgtctcaactgaagaagtgtttgagggtacctgaggaacaagctagctcagagcacattgacatccaggaagatctgacttatgtggagaagccgatttgtatcctcgagaccagtgagagaaggaccagaaacaaggtgatcaagttttgcaaagttcagtggagccaccactcggaagaagaagccacctgggaaagagaagatgaattgaaggccgcccatccgcacctcttcgccagctcttccgaatctcggggtcgagattctgtttaaggggggtaggtttgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcaaaatatgctaacaggatttttagtggaattttcagagccctagaaataattttaaccaattaaaaatcaccaaagggcaattttaattccaggaaaaaaaaaccct

SEQ ID NO: 20176 - DNA, 547 bp, Oryza sativa
  unsure (1)..(547): unsure at all n locations
ctatagggcgaattcgagctcggtacccattcaactgctgcctgtcaccagagggcgagatctgcacatcaaaatttcaggagaaaccatgagcgaagtaacggacttaactgtcatcgaaatcaagccggaacaggccccagtgctttacgtagcgggcggccttgatgcttatctcgagcaaatccgccaggcagtaaacgaagtgccggacctgtccacgaagaaaggacgtgaccgtgtcgcctctctggcagcgcaggtatcacgcagtaagacggcaattgaaaagccgggccgagagtacctgaagcgcctgaaagaggctgtgcgacctgctgaggccgaaattaagcgtttcgttgatgcatgtgacgagcttcgcgacgcaacccgccgcccactcaccgaatgggaagccgagcaggaacgcattaaggctgaagaagccatgaacgcgctgcacgccgaagcgctggaaatgaacatnnnnnnnnnnnnnnnnnnnnnnnnnnnnnnnnnnnnnnnnnnnnnnnnnnnnnnnnnn

SEQ ID NO: 20177 - DNA, 581 bp, Oryza sativa
ttttcctcctttctttcggatgggccgtggcccatctcctcctttcctccccctcctccctgctgggccggccgcaggccgaggcccagccggccgcccgcctccctccctcccggggtcgccgacaggtggggcccacctgtcggacccgtctcccacctcccgccttcccgctcgcgccgtcccgccgaaaccgctgccgccgcacccacttcctccgctttccccgcgcccacgccacgtcgccgcgcccacgccacgtcgccgccctctccccgcgtctcccggccgcgccagcgcacgagaggggcgggattcgattttgaatctccccccaccttctctctctcctcccccacgtcgccggcgaaatcggagcgcctcccggccacgtccgcctccccctccgcctataaaatgctccccatgccctcctctctcgtttttcgctctcaccgctccatcccgtgccccctaccgagctcgcaccgccgccacttacgccgccgcccgtcgccgcactccggccgtgtgccgccgtcgctagagccgccgccgcactaagccaccgccaccactag

SEQ ID NO: 20178 - DNA, 485 bp, Oryza sativa
tgatgtgactgaaaagttgtgtgtgtatgacaggttgatgtgatgaaaaagtttggatccaaactttacatctaaacacagcctaaacagcgcctatgtatacgagaaatgaatgtactcgtacgtacatatacggccaccgtatattatacaattatccgcacagcaccgtgcatttcacagcataaatggccgttcaatcaacgtgacccgaatgctctgctctggacgctgcagtttttgagcccattttttacctcggcggcggtccggtgaaaatttggtcccgccacagtgcgtctctgttcaccgcggcattggataggttgatatggacttgctcggcttgtcccgttgcactcgtgacgcattcgattcaagtatgcagtataccacacgagctgcaaccgctgctcgacaacgacctgaggttggctgaaaacgtccgtcgtgcacgctttaagcttgcagttcgaactgtgctt

SEQ ID NO: 20179 - DNA, 625 bp, Oryza sativa
gcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaaacacggcgattcatggatcgaggagttgccagcggtgctctaggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagctttgtagagatgacctcgactacttggaagaacgaaggcggcgtgcggccctccgagccgcacgctaccagcagagcctgcggcgctaccatcagcgccacgtccgggcccgatcactctgcgtcgacgacctcgtcttacgccgcgtccaaacgcgtgctagattgagcaagctctcaccaatgtgggagggtccgtatcgagtgatcggcgtcccccggccgggctccatacggctggccatgggcgacggcactgagttgcctaacccatggaacatcgagcaccttcgtcgcttctacccctg

SEQ ID NO: 20180 - DNA, 589 bp, Oryza sativa
gtgtattcacgttgggctcttgtgtgttcaagatcatccgaatgatagaccatcgatgtcatctgttgtttttatgttagaaaatgaaagcacgctgcttcctgcaccaaagcagcctgtgtattttgaaatgaagaaccacggaacacaagaagcgacagaagaaagtgtgtactctgtgaatacaatgagtaccacaacactggagggacgctagactaagaggtcaagctttactatacatgatctcctcgcctgctcttcgtctctgtcgcgtggggccagcggccgacgacggcgcggggctggcgggaggtgggcgacgaccgaccggagatagagaaggagaggagaggggctgacgggtggggcccacgttactttccacgctggcacggtacagtggcacgtcacatatgcaaaaatagcaaatagttaagaaattacctctctccaatggcaaattattaagtgcaatatttggataattggcaaacctcaaaatggcaaatagttaaattcgggtcaagattggatcggtaccctatctgcctctttttatgggccgaaaccgccgaatccctcgccg

SEQ ID NO: 20181 - DNA, 1061 bp, Oryza sativa
ataatactgtgtagctctaggatcgtctttataaaatggctttgggcaactaagtgacttttaaatgccgtttactgcaaaacttaacccctatcttattatccccttgtactcctttgcattaattgtgcatctccggtgtggcctgctgagtactgtggttgtactcattcttgctcaatcttttccccccttcagtaagagaagctttggagaagaagtcttaggtggagtcctggcttataccccagttgagcgcctgtgaagatggagccgtaggcccgctagtccgctgctgtttatttttgtttgtcaggcctgaagtgcctttgtaataatgtaaatattatcgatataataaagatgtgtcttttataccatgtttgtgtggtgtaccccggcttttcctgggacggggattaatacactggcgttcgggaaaaggcaattttcccggtcgcgacacagactacccggggcggtccgtcttctttctcccttttgcaatggcagggctggttccgctattttcttctttcttcatggatgttctggagttctacgatctccagatggcgcacctcacccccaacgcggtgatgacattggccatcttcgcgcatctgtgcgagatgttcattggggtgcgcccatctcttcggctgttccggtggttctttaccgtgcagtcggtgtcgccgccatcggtagtcggtggctgctacttccagccacgggggccggcgctgaaccgctacatcccctgcgccctccgcaagaagtgggacgactggaagagcgattggttctacactcccctcgccgacgaagcgcgcctccgacttccgagccagcccccggcgcaggcctccagttggcgggcgccggtagatctgggggatggctatgacgctgtcctcgaccgcctggcgggcctgcgatcccaggggctcacaggggccatggtgtatggcgactacctccgtcgtcggattgcgccgctccagcggcgcgctcggggcgcctgggagtacaccgggtccgaagactacatgaggacc

SEQ ID NO: 20182 - DNA, 684 bp, Oryza sativa
  unsure (1)..(684): unsure at all n locations
tggcagttacggaattcaccatcgccgaaatgcagcgcgcgttagactcatccgccgggaaagcgagggccctccgcttggggggcgagatagggcccggcatgttttgggatgaagtctcccatttggatcgcgccggtcgcaaggcgggcctttggaaaggccagacaatgaagtactccaccaacaagggaggcttcgttcagcacctttcgaagatggccggggttttccagaagttcccgaggagttcgagaagaccgtcaagtcatcctcgagggacttcgcccaagaagcgttggagctcgtcttggcgagttaccaggcaagggaccccaatttttttccgtgaatggcgctgaatgagttccttcttggaattgaagaaagcgcgggggggaaggtcgggaatgccgcggacaaattggtcaaaagtttgaagggttgggcccttgggttggggttggccccaaattcgaagaagaaggggaagccaacgggtgaaaaggcaagtaagaagagggcgggcgaccggggggaatggaattaagccccagggccccggttatttttaggttttttctttttttttattttaaggctttcaggctttttttttgtatnnnnnnnnnnnnnnnnnnnnnnnnnnnnnnnnnnnnnnnnnnnnnnnnnnnnnnnnnnnnn

SEQ ID NO: 20183 - DNA, 7696 bp, Oryza sativa
  unsure (1)..(7696): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnntgtacgcgtcattctatcttgggaaacatggctgcagtgctgcacggtttgaacttcaggtttatctggtaaagatcaaatggtgaactgaaaacagtaggtgtccatcttgttcaggcagagatgtgtttataaacttcagaatctgtattactcctggtcgaggtagaagttgatacttggaaattggaatgataaacagatgatattctcgttgtttatacacaggacaagctacaggtttcgcagaattaaaatgcatacgaatgcaaagagaatttgtcctctgcttgcaaggggccaatgatatatactgtatgagaagaccaacaaaaagattcctgtaagagattctgggcaatgttcagagttcagagacttgcaaactctcagatgatggacagtgtcatcgaccataacccggtcagaatgtctctataccaattttgcacaaatctgacgacgtgatatatatcataatcgagctgaaaagattagcattggctagttacaaacagcaagttgacaggctataataatctcatactatactcctacttgaaaaggattcaaaagattgcttctttatactgtactgacgatggtagaactgtactacagtatagaattcagtctaggttcttcagacttgccaatggcttgaacaagaataaaaacagagacatctttcgaactgaagaagcaaccatcaaaataaaaaggctcgtgaattacaatatattggagctgaagaagcaatgttcagctttccatccacactagccgcggcaaccccctagcctccgccgccgccgcgcccaccttcttccccgacgccgaggacgacgacgacgacagcgccacgtccaagtccgcctccggtggttccccggccatcccgcctccgacaacggcgccatgctttccgccgccgagggatacgacggcgaggaccgcgtcagcgcgctccccgacgacctcctcgtcgcccgcctcccttcaagggcgcgactcgcaccgccgcgctcgcctcccgctggcggcgcgtctggagctccacgccgctcatcctccgcggcaagccccttgtgcgccggcgtggagggccctaggggcggcgaggtcgacgatggccgccgcccacggcgaggtccccgtggaggcggtggtggctagcgcgtggaggaagcgcggcggcggcggcgctggtcgccgatcttctcctctccgccgccgaggccgtgggcgttgcagccgtcgaccgcgccctcgccggtcacccggaccccttccgcgtcgtgcaccggtccgagctcgcagagtcctcaaccatctgctcgcctgcaagcctcgcgctcgcgctcaacagagaggaggaaccgaggaccggctgacatggcatcctgatatatgggacccacgttggtcccatgctgactcagccgccacatagaccgaaatcggggtcaaaaccaccgaaggatctcgggtgatcggttttgtttagttaagggactatatatatatatggttttatggtttaagtatgtttttttatctcgctgacaagttgagggaccttgggtgtactttttcccccaattaacacggtgcacgacacgacacacggcgcgattgtactttacctaccgtcccctctctcgatcggcttacggacaatgcgtatgacgcacgcccggattaacgtcagttgtaagtcgatggtcggccatgaatctacatgtcagtccagacgcacgaatgcatgactcaggtccagttcttttcttccacaagacttagataaatattaagattttcgtgacacgcttttcaaactgttaaatgataaatgatgtgtttcgtacaaaaactttttatataaaagttgcactaaaatatcatattaatctatttttcaagtttgtaagaattaaaactcaatcaatcatacgttaatagcatattgttttgcataaaaacttaggggctgtttagttgatggccataagttactacactttgccatacttaaggttagacaagtttgaccatgttagatgattgtttggttggcttccacaagtgtggcaagattcctcttttgtaatctaggtcccacatgtaagtgtctctaaaaagtgtggcatggtttcattttgttggctagagtgtggcttggattttgatggcctcatctttggcaagtttggttaagaaagcatggtaaacctagtcaatgttagtatctgaaccaaacagccccttaatctccatcttcatcttcaatattcaaacaccaccgtagtattgtgtagtactctaccagctatgcttaccattgctgagagcagcgtgatatgacgatctatttgtccactccatattgacacttcaatcaaccacccaactcgcaccgcaccggttttattttataataaaggtgatattctggatatagtgctcgtcagaatgtttcttttaggaatacttactgataagcacgccagaccacctcactggctcactacacaaattgaactctttccaaagaacagcaacaaaaataaattcatcgtcctcttcgtcatctgggctggagaggttgtagcgaccgacgacgacgatgtcggcggttgagaggaagacggcgtgcgtcaccggcggcaacggctacatcgcatctgcgctcatcaagatatgctgttggagaagggatatgctgtcaagacgacggtcagaaaccccggtgaggttctcctcctcattttttcactctctaagttcatgttttttgcagtgtttcttccattcagttcaggtgtgaaatcataggccagctagtaccatatgagctttttagcgagtgttttcgcttaaccaattagcaaatggcaggcttagccgcacatgaggacaaaatcttatccttttccaacttccaactgatagttacatatatacatatcgtgacatatgatggatcgaattattatgagactttatatgatctcaaaaagatggtgtgaattttcagagttcagtttcacctctcaaagattctactaattgctgcgatttgtattcagatgacatggcgaagaactcccatctcaaggacttgcaggcacttgaccccttgaaggtgttccgtgctgacatcggcgaagaaggcagcttggacgatgccgtcgccggctgcgactacgccttcctcgtcgctgctccgatgaacttcaattcagagaatcctgaggtgaaaagcttacacccttcgtcttaaaaaaaaaaaaaactaatattacctacaaacctgaaaacatgtgtctatctaagattgtatataggaatttatttttttttacaaggtagtacttggcaccactaattaagatccctactgactacgagatagctagttttcgtccgtttccaatccatgttcatccaactttgatgtgctctactgctctccatttcgtttttttttccgacgttgatggtggcagaaagatttggttgaagccgccgtcaatggaacgctcaacgcgatgagatcgtgcgcgaaggcggggacggtgaagcgcgtgatcataacatcgtcggacgcagcgatctccagaaggccgctgcaaggcgacgggcatgtgctggacgaggaatcctggtctgacgttgactacctgagaacggagaagccgctagcctgggtgacgttcctctcttgacattttcacatctccatcttatccataaatttaagaaaacttttacagtattatactgacagtacaaataatcgaaaaaaatattattttttcctcctgcttcaatataatatagtataaaattaaaggggataaaattgtctttttatactattggtggagggtaattctgtaaactcataatttatagtgaaatactcccaccgtctaaaaaaccatatgtcacattctagcactccctcagtattttaatgtgtgacgccgttaacttttttatcaacgtttaaccattcgttttattcaaaatttttgtgcaaatacaaaaatatctatgtcatgcttaaagaacattagatgataaatcaagtcacaataaaataaatgataaatacatttttttaataagatgaatggtcaaatgttagtcaaaaagtcaaccgcgtcataaattaaaatacggagagagtacgaggttgtgttttttttaggacggagggagtagagataggcattattttcaccaccatgaggtgccgcgccgctgcaaactagcacaatggatgaaaattattaaaataccattgttaatttaataaaaattcttaaaatactcagtatattgtatagaaaagttctctaaatttagggcctgtttagattgtaacaaaaataaaccttaccaagttttggcaatgttaaaattttggcaagatgctaatattatcaaaattttggcaggatttcttatatattgactaaatttagcaataaactaaacatagactttttttataagtttaccaaaaataaatattgtatggttgaaaatggcgtttgcgtttgcaggcgtactgtgtctccaaggtgcttttggagaaggcagcatgcaagttcgcggaggagaacaacatgagcctcgtcaccgtattcccggtgttcaccttgggcgcagcgccggcgccggtggcgaggacgagcgtccccggcatcctctccctgctatccggtgagttagaagcaccagcaccagcgatcaaatcaacaagctagctcccaccaaagtctcaacacttgcaggtggttcttagatcccaccttaaaaatttacaccccgtcacatcgaatatttgaacagctatataaaatattaaatataggctagaaaataactaattacaagattacgactaatttgtgagacgaatctggtattacagtaaacattcgctaatgataaattaattaggcttaataaattcatctcgcggtttattagcgatgctgtaattagttttttattaatgccccaacaactcttacgacaccctatataatatccgatgttacacgccaaaactttaccgcgtctctgaatataaacacacctaagttggcttctgtttattacttctcaggtgatgagacgcatctcgaagtcctgaagcccctgcaatcgttcaccggctacgtgtcgatcgttcacgtcgacgacctctgccgcgccgagatattcctcgccgagaaggagtcatcgtcattgtcgtcggcagagtcgtcggcgaggtacatctgctgcagcttcaacaccaccgtcttggcgcttgcccgtttcatggccggaaggtacccgcagtacaacgtcaaaaccgaccggtacgatcgaattgttggccaacttcgaaatccaacatagatatacatgcatgctgtgttcgatctgacgagcgagtgatgatctctgttatctttgcagcttcgacgggatgcctgagaaaccgagagtctgctgttcgtcggagaagctgatcagggaagggttcgaccgttcgagttcaagtacacgaatttgggcgacatacttgatgaccttgtggagtaaggcagggccctgggaattctaccacattgaacgaacagctcatgctgctctactttcaacctactcccttcgtcaaaaaaacgaaactaagactggatgtgacatatcctttcgtccaaaaaaacgaaactaagactggatgtgacatattctagtacaacgaatctggacaggtgtatatccagatttgtaatactaagatatgtcacattcagtactaggatggtttaggatggtttttatgggatagagggggtagatgtcacgaggaccaaactatatatgcgcttgtgaaataagtggtctgtgcctttaaacatctcaaagaaaaaaaaatacagtgttttaagatgagcctaatacacagtagataatggcaaaaaaaattaataccttatagggtatcctttggtcttgcatgtcatttaaatagttatatatatttttaaaaaaattaacaagattcatttggatgatacgtaagaaataaggagatgtccattttgagggaccaaggctccgttcatttggtctgttagggatgccacttgtttttttagccgcttcccaaactgttaaatgatgtatattatgaaaagttttaaagcttctttaaaaaaaatctaataaaaccatttgtcatatttatagtaattaatactccctccgtttcatattataaatcatctagttaaaccttttaagtaaagggtttgactaagtttataaaaaaaaactagcaacatgtaaaaaaaattaatttcattaaatactacattaaagatattttaataatgtgtttgttttgttttaaaatattgctatattttttataaacttgattaaatttaaaaaggtagaatagaaaaaaaattcaaaacaacaatactatgaaaatggagaaagtattcaattaacctgacactaataatttagtctcatttagcatttgtgaaaaatcctaaatttctagcaccacatccaaactcagcccaaaagagcttatccggatagtggccatccactttgcccaaaaagaaacgtgctatgcagcctcgggggttccttatttagtgtatatgcgctagcaaagtacgtagtgcaacactttatccaatttcctttcttgttaaaaacttttaactcagatttaaaagcttgcatgtgaagatttgaaaattttcgcattaatatttaaaatttcaagtcagatttaaaaattttcaaataaggatttttaacttttaactcaagatttaaaactttcaaatcaaattcgataacttttaaccatgatttgaaaaaaaataaatctatatttgaaaatttcaactcagaattgaaactttcatttcaaaatttaaaactttcaactcaaattcaaaacttccaaatgaaattgaagatgaaagattcaatttctaaaataaaaaattcgcaaaaaaatagccaaaaaaaagcgcatgagggcgccgcgtaagctttccttcccgttcactcccaggctctcggcgcatggtcgcccattcccgatcccctccctcgcgagaaaattgcatatgtaccactcgtaaaaactggcttcgctataatgccattctcaagataggattcgcccaaacgccactcttaacacgtgggtattcgctggaatgccactttcgggcttttttccatttcgaaaatacttttcatcaatttcaatttttcttggactattatgcccctgagtcaactgattcagtcggactctttcttctcttcgtttcaatctagcgaccgaacgcgagaagtcgagaagagaagcggcagcgacaccggcgccgcccaccaccactgcatcgccgccgcggcgtgcct

SEQ ID NO: 20184 - DNA, 2828 bp, Oryza sativa
catcagccccaatgaacacggtgcacagggatagtcacacgacacggcgcgattgcagtagcactgtacctaccgtccgtcccatctctcgatcggcttatggacaacgtgtatgacgcacggccgtattaacgtcagttggatgccgatggacggccatgaatccatcggtccagacgcacgcatgctcctttgactctaccagctacgcataccattgctgagagcgtgatatgacgatcttgttgtccactccatattgacactttaacccagctgacgtgcgtaatcgacgctccgactcaggacctgtttagattcatgggttacttttcagtcctctttcaaatagctgcaaataatctaaaagttataaataggtgagctatttcagggctatttgaaaataacacatccaaaaaaactatcccccttaagaatactaattagggctatttcaggtggggcccactaaaaaatgtcttttctctttatctctctccatgagaaagtgcattaaagattaaatagctcttaaaataacccttggatctaaacaacttgagactattttattggatggctatttttttcttaaaaattagtagtttttaaaataactcttagctaattctctatacatgtctcaatcaaccacccaactcgcaccgcaccggttttattttacaataaggtgatattctggatatagtgcatgatgtcagcatgtttcttttcggtagtacttaaaaaaaatcttactgataagcacgccagaccacctcactagacaaattgaactcttcccaaagtacagcaacaaacataaattcctcgtcctcttcgtctcatctgggctggtgggttgttgtagcgaccgatcgacgacgacgatgtcggcggtcgagaggaagacggcgtgcgtcaccggcggcaacgggtacatcgcttctgcgctcatcaagatgctgttggagaagggatatgctgtcaacacgacggtcagaaaccccggtaagattctcctccttttttcactctctagttcgtgttttttactttttttgcagtgtttcttccattcatatgatcatatcctcggcctgctagtaccatatgagctaattagcgagtgttttcgcttaaccactcattagcaaatggcaggcttagccgcacatgtggacaatatcatatctttcgaaagggagaagttgtcaaatcttatccttttccaacttccaaccgatagttacatatatatatcgtgacatatgatggatcaaaatatgatgcgactttatcaatacgatggtgtgaattttcagagtttcagtttcatctctgaagattccactaattgctgcggtttgtattcagatgacatggcgaagaactcccacctcaaggacttgcaggcacttggccccttgaaggtcttccgcgccgacatggacgaagaaggaagcttcgacgatgccatcgccggctgcgactacgccttcctcgtcgccgctccgatgaacttcaattcagagaatcctgaggtgaacagctaattaacatcactattgactctgatactctgtaactgatgtgctctactaatcttgatttcctttttttttttttttttttgcgatgttgatggtggtggcagaaagatctggttgaagccgccgtcaatggaacgctcaacgcgatgagatcgtgcgcgaaagtagggacggtgaagcgcgtgatcataacatcgtcggacgcagcgatctccagaaggccgctgcaaggcgacgggtatgtgctggacgaggagtcctggtctgacgtcgactacctgagaacagagaagccgccagcctgggtgacgttcctctctcttgacattttcacatctccatcttatccataaattcaagaaaacttttaccgtacaatatatactaatatatgctactactagtatgtgctgccagtacaaacaattcaaagatttttatgaatatttccttgtgctttaatatattatagtataaaattaaagggggtaaaattgtctttccatactattggataagggtaattatgtaaactcacaacttatagcgaaatactccctccgttaaaaaaaaatctcgtaacatcctagagtgtctagattcgttttactagaatagtaggatgtgtcataagaggttgagttatttaaggacagagggagtagagataggcattattttcaccaccatgagacactgcgctgttgcaaactagaatgaaaattactaaaataccatttttaatttgataaaaattcttaaaatactcagtatattggaccgaaaagttctttaaatttaccaacgaaaataagcttgcacccaattggcaatggcatttgcgtttgcaggcgtacagtgtgtccaaggtgcttttggagaaggccgcatgcaagttcgcggaggagaacaacatgagcctcgtcaccgtgttcccggtgttcaccttgggcgcagcgccggcgccggtggcgaggacgagcgtccccggcatcctctccttgctatccggtgagctagaagcaccagcaacagcaatcaaatcaacaagctagctcccacaaagggcctgtttggggggagcttctagctgctgcagtatattctagaattagaagttgctctaaacagttcagcttttgatttagattataagaagatataattgtaaaatccaaaaaatgaagctgggaaacacaatttttccagattgtaatcttaaaactccaaacagaccccaagtctcaacactctttgcaacgcgtgttacac

SEQ ID NO: 20185 - DNA, 11743 bp, Oryza sativa
tacttctcaggtgatgagacggcatctcgaagtcctgaagcccctgcagtgggtcaccggctccgtgtcgatcgttcacgtcgacgacctctgccgcgccgagatattcctcgccgagaaggagtcatcgtcattgtcgtcggcagagtcgtcggcgaggtacatctgctgcagcttcaacaccaccgtcttggcgcttgcccgtttcatggccggaaggtacccgcagtacaacgtcaaaaccgaccggtacgatcgaattgttgaccaacttggaaatccaaaatagataaatattgttgtgttcgatctgacgagcgagtgatcgtctctgtatctttgcagcttcgacgggatgcctgagaaaccgagagtctgctgttcgtcggagaagctgatcagggaagggttcgagttcaagtacacgaatatgggcgacatactcgatgaccttgtagagtacggcagggccctgggaattctaccacattgaacgaatagctgatgctgctctaccttcaacctagctgtcacgaggaccgaactggagtatgcgcttgcgaaataagtgatcagtgtttttaaagaaaaaaaaatagtacagtgttttaagatgagcctaatacacagtggataatggcaatgaagtttaatacccttagagcatatccttcgttcttgcatgtcatttatatattttttataaaaaaatttaacaagaatcatttggttgatacgtaagaaattaggggatgtccattttgagggacctaaggctccgttcgttggtctgttagggatgccacttgtttttttagccgcttcataaactgttaaaagatgtatattatggacatgtttttaagtttctttaaaaaatctaataaaaccatttggcatatttatagtagttaatactacatccatttcatattataaatcattttgaactttttttgtcaaacattttcagtaaaaggtttgactaagtttatagaaaaaattagcaacatttacaacacaaaatttatttcattaaacactacattaaatatatttcattaaacacgaccgtgcctgggccgtgccgcccggatggccatctatacatccggtcatagatttggtttttatttgtagtactcgtcaacaactagcatgtgtcacattcgatacttggttgattttttatgagacgaaaggagtactcctcaatcagatatcaaccaaacaaccacccactttcatatcaactgaacagttctgtaaggacagttccgtaaatggtccatccttctttccatagatggtccaaccccgcacatagtgttgcatcctcgtcctaaaataatttgaaatgtttggatcagggactaaaactttaagccatgtcacatcggatgtttggacactaattagaagtaccagaacattagtgtgccggttggcacactttctttatagcccgatacattgtttagcgtgtgtttgaaacatgaaaattttgtaagatatttttagcatttcgttcaacttctatgttccattaaatattgtattctcttgcatatcgttctgagcataatctcctgtaatgttaatttgggattgtgtgttctctatgtttctggtggacgattaattatagatgttgagtttctaacaaatttttgatataattaaatactataaagtattaagaaagtagaaagtaggtggagttaaataatagaaggttctctgaaaaaaatattagaagattaatatttttttaaaaaaaggagtgattgtaataaaaaaaagttacagaaaatcgtaaacttacaaagcttgctctcaataatccataatactcttgatgtccacaaatattaggtggaaggatccaactcctaaatgctagaagtagaatttgaagttaagtagtggcctattgacggtctttgtgttcactccacccctcatttttctaggtcactatagtctgctccactctcttttttatagagcagaaaaaactttgttgagctttagctacagaaaagctggaaggtcctgccaaattgagcactgcgtgtcgtatcactcacctcttgatttaattttcttcatgtcttacttctaaccattctgtcatttttcaactatattttatttaataaatggcattatagttttttcactccatacttatctctctaagaaaaagattgggaatattttatattagtggaggaagtacacttggttcataagatacgatggtaactggaaactgaaaaaaggaggaattgaaatggtcaattgacttggtgctacacggtgatacgatagctgaggaccctgttgctcatattttttattggatttccctttttttttttaataattctgagttttcttctatcggatatttgaatgcctctaggagtgatgttgttgcaaaggactataatctagatgtataagtctatggatctagatactttaactagacttatcttaaattatgatttatatttgagtggttctagaaagtctctatgtttattgcgaagtgatgtacagttagaagcttctggaagctgatttttttttttaccgggtgggaacagctagatgttctggatgctgtgttgttaaggtacaactttttcttaaaagaaactgctaaggtactacttgcttttagaattatcacataacactgtagttttctattttgcttgatcttctgtatttttttccttagacaaaattcatgatttatttgataagctaggggcgccacgtggcccaatcaaaagctggcataaccactggctttagattaatagatagattaaacgtagactaatgacaaaactcattacataaccctggactaattcgtgagatgaatctattgagcctaattaatccatgattagtctatgtgatgctatagtaaacatgtgctaattatgaattgattaggcttaaaaaatgtctcgtgaattaactctcatttatgcaattagtcttgtaattattctatgtttaatactctaaattagcatccaaatatccaatgtgacatggaataaagtttactccctgaatacaaacatacctttgcatctaaataacaaagatttcttattggtgacaactgacaagcatatcctatcagatgaacgtcagtgacagtgactgtactcttgtactcttacaaccgccgtcttcattccagtaagctatttctctcaggaggacgtagtggagcctggaggggacgaagtagccggcggcacggcgatgtcagcggttgggatgaagacggcgtgcgtgaccggcgggaacgggtatatcgcttcggcgctcatcaagatgctgcttcagaagggatatgctgtcaacacgacagtcagaaaccctggtgagattcttcccccttttttgttgttcatgatttcagttacaggctgtgattagtttcatgccaaaattagaagttcaatgaaattagaacgatgtaatgaaaaagttagaaatttatgtatgtaggaaagttcgatgtgacgaaaaagttgaaagtttaaagaagaaaaatgaaatctaaacagggccacagtctttctcccattcagattcaaaaatcttttggtcagaggtagtttatttgctgaactgtcgtcatgaacaatagaaaaagttcttctatctgcaccatatagaaaatctttatatgttccaactgatatagtgacatatgctggaaacgatggatgcaaatctttatgatctcaattctcaagacaacgctacgaattttcagagttcagtttcacatctgacgatcctactcttgtgtattcagatgacatgaggaagaattcccatctcaaggggttggaggcactaggcaccttgaaggtcttccgtgccgaccttgacgaagatggcagcttcgatgaagccgtcaacggctgcgattacgccttcctcgtcgccgctccggtgaatctccagtcagagaatcctgaggtgaacagctagcttagctaattaatccggttttctctaatcgacgtcacagttgacagttgtcttgtgtcatctgatgataagcatgctctttagtctctagtactgaaattaatttgctcttaacttctacgatgacaaattaagctgggtttcctgccaacgtttgatggcagaaagagatgattgaagccggcgtccaaggaaccctgaacgtgatgagatcgtgcctgagagccggcacggtgaagcgcgtgattctgacatcgtcggcggccgccgtcgccctccgtccgctgcaaggcggcgtcggccatgtcctggacgagtcgtcctggtccgacgtcgactacctgacgagagagaagccaccatcttgggtcacattctactcctttcttttttggtcctccatcaaatcattcatatacattttttaccgggctgatgaaaatgacggctggctgatgctagcacaccccattgtttttgcgtttgcgttttgcaggcgtatggtgtctcgaaggtgcttttggagaaggcggcgtgcaaattcgcggaggagaacgacatcagcctcatcaccgtgctcccggtgttcaccttgggcgcggcgccgacgccgttgaccacaacaagcatcccaactacgctctccttgctgtctggtgagagcctgagaaacatacgtcaaatttaagaagctactcttttatttgttcagattcaagatatatcacattttatatttgatttgtttattttagaattaagagagtatgtacttccattatgtgttacgattgacgttgtttctttttcaggtgatgaggcgcagctaaaaaccctgaaaggcctggcggccaccggctccattccggtggttcacgtggacgacgtctgccgcgccgagatattcctcgcggagaaggagtcggcgtcggggaggtacatctgcagcagcctcagcaccaccgtgatggcgctcgcacgtttcgcggcagcaaaataccctcagtacaacgtccaaaccgactggtacatatacacgaactggcactttcagtttcaactttcaagtgactgatcgatcgacacatgcatttcttgagagaacctgatgagccagcgataatctttgtttgctcgtagtttcgaagggttccctgagaagccgagagtgtgctattcgtcggagaagctgacgagggaagggttcgagttcaagtggacggatctggacgagatattcggcgacctcgtcgagtacggcaaggccctggggattctaccgcactgaattgatggttgctccgtcaatttggagttttggacataaaaattctcttgtgaaattgttagtcctcttgtcttgtgaaataagtcattgttgtgtgttacggtatggtaatctctttatgatacggaccctttcactaccacagaacatgtgaaaaacctcttaaggtatcggttttctcaaccgacactagggatgcggcaccaatgagtgctccagcaccaatcccattttaaaaaccacacctttgagaccacttgcgatctataaaaaggctcgatgcatggctggatccaattaaccattattgttatgggctctctaacccgtaaacaaggtggcccatagcaaatttagaataagttcatttaaagtcccttaatttgaatctgattttcgtccttgtactggaaaaactaggtatgatgggtccctcaacttacaaaaccagtgcaaacaagatccatcaccaacattgttctcatttttcgctgacgtggcacctacgtggctaatttaattaggtttttggataacgtggcattgtcgtggcatttacgtggcaatttaatttggaaaataataaaaactgttagcctacatgttagttagaaaaaaataattaagaccggtggggcccacgtgagccccacatgtcattctcacaatcctcttcttccacctctctccccatctccctctcttcattgtatctctctcctctctcttctcctccctccaggcgcaacggccgacggacagcgtggaggagggcggtggtcggtggggagaaggggtggctgttgacagaaaacacgaggcctgggagatctacttaactccagtgcaggtccaaaactcgccttcggatgtgtgagcgtgtcagttgatttgatcctgcaatcaacaagaaataaagacaaaagaaccgtggttaaatctataaatgatagccgatcggccagatgccgatgacatatcatttatatccgagccgatgtcatctgtgtatcgatcggcaatcgtgaatgagtaaggaaaaactaaatctacttgatcggctgtagatattaacgatatataattcttatgtcgatgtatacttaaatcaggttgtcggtgacatgggatcgggagtatcatgactagaggtttgaggcagacacaatcgcccacgtggcctggcaccctcgggggacgtcgggcccgagggtgatgtgttcgccctcctcttagtccccccgatggggtcgggctgcacccccctcggccccgagggccgaggcgccccgacccctcgtgggttttcgctccgcgtgtatgggttaggtgagcacagtggggctcacctaaccacattaattgcggtttggctgagcgtgtcacaccgcatgtagcgcagtgcagtgcactcgtttatccggtctgtgaccagtcacagaccggtcagatcgcgggttaggtggcggcaggcggtctgacgcacgcctcgccccatcccgtcaggacgagggcttctaggcgctcgtccccagctggagctagcgtgttacctcccagagatggcacgttagccctgatcagatatatgccaggcttcatcctaaccattacaagcaaaatgtagtgtgaaggagagccaacgtgcagatagctaagctgacgcgtggtggacaagaatgaccgatttgtgaccattctgacaccggtcatgtcgccagcagacagccatgattctacgtcgcgcctgctcccggcgaaagtggaggtaggtgcgggccgttccatcagaaggtgactcgaacggcaaccatgcaaatctccgtctatttctgagaaggtgggggaaatccccacagaaaaaagagggaaatggtgcatgtggtatccccttaagatataaaaggaggaccttgaccactgagagaagggggagctttttcttggattgattttttccagattcggaacctagaacaagggagaggttggctcacactttgtagctgcttcatacacagatccaccaaaacacaggagtagggtattacgcttctcagcggcccgaacctgtatacatcgccggtgtcttctgtgcttccggtctcgcgaaccttccacatacagattgggagcttagagtctcacccagggtccccggccgaaccggcaaaggggggccagcgcggtctcccggtgaggagccccacgctccgtcatctggcgcgccaggtaggggactctgcgagtgatcttctgagctcttgcgctctttcgtgtgcaccaagcttttcctgttcagcctcatggctgagcaagcaaagggggacgacctctctccgagtgtgagtggcgacgacggggagccgaacccacgccgtcgagctcgtactccaccgccccctccacgccaaagtcctaagcggggggaggcgctcgagagggtcgaaagatccgcgacttcaccgatcgcgggcgatggaaaagaacggcgagatggggagcgtcgcctcctcgtctacggcgacggcagcacgccccagggcgcgctccaagctacgggcgcgctcttacgccacccgcctgtcgtccctgacccggagtctccagcccaacgatggctggacgacgtggccaaattggtcatgacggcgcggcagcgcctagatgctggtgggcggtcctccgccaccaaggcctctggtgctgctaccaccggctccgcgtcgtcaagacggagggcacgacgagcggcagccgctgttcgccgttcggccgtcactccttcgtcgactccttcgacccgggaagatctgcgtggggagcaggacgcccgcaccagcatcgagcgccggcgtaatgaccgaagtgctgcccacgcaacggagggcgcttctcgtccagagtgtcacctcgacacggacgtgggaatcagccctccgtgcccccggttggtggtgtcggctgtagagcctttgtggcgagtcttcggaatgtccgttggcccccaaggttccggcccaccatcgccgaaaaatatgacggcagcatcaaccccgccgagtttctccaggtctacacgaccgggattgaggccgccgggggtgacgacagggtcatggcgaatttctttcccatggccctgaaggggcaggcgcggggttggctaatgaacttgccacctgcatctgtccactcttgggaggatttgtgccaacagttcaccatgaacttccaaggcacatatccgcgccccggtgaggaagcggacttgcacgcagtacagcgaagggacgatgagtcacttcgatcgtacattcagcggttctgtcaagtccgcaataccataccatgcatccctgcacacgcggtaatctacgcgttcagggggggcgtgcggcacaaccgcatgctcgaaaagatcgcctccaaagagccccagactaccgcggagctttttcagctcgcggaccgagtggctcgtaaggaggaggcatggacctggaacccctccggttccggagtggcagcttcggccgcccccggatccgccgctcagacagggcggcgtgacaggaggaggaagaagaggtcagtccattccgacgacgagggtcatgtcctcgccgtcgagggcgcttcgcgggccacccaaaaggggaggccagcgagcgacaaaaagaaaaaggccggcgctcccagcagggagcgcccagccggcaagtggtgcaccgtccacaacacttcccttcacgacctcgcggactgccgtgcagtcaaaagtttggctgagcggacgaggaagtgggaggaagagaggaggcaggagcgccgagagggcaagtccccggcggttccttccggcaatcggcgaagtgaggccaagaagaaggcccccgccgaggacatcgacgacggcgatgatgacctaggtttccaagagcctggggccaccattgccactgtcgatggaggagcgtgtgctcacatttctcgccggagcctcaaggccatgaagcgagagcttctggccgcggcccctactcatgaggcgacgcgccgggcgcggtggtcggaggttgccctaactttcgaccagaccgaccacccaccgtgcgttgcccggggagggcagattgcgatggtggtttctcccaccgtttgcaacgtgaagtggggcgtgtcctcattgatggaggagcagccctcaacatcctttcccccgcagcctttgatgccatcaaggccccggggatgatgctccggccgtcccagccaatcatcggtgtgacgccggggcacacttggccgctaggtcatatcgacctcccggtcaccttcggtggacccgccaatttccgcacggagcgagtgaacttcgatgtggcggacctcagtctgccctacaacgcggtcctggggaggcccgcgttggtgaagttcatggcggcggtccactacgcctacctccagatgaagatgccgggccccgatggccccatctctgtccatggcgacctcaaagtcgcgctcgcttgtatggagcagcgcgcggaccgcctcgccgtcgtgtccaagcccgagggtggcgacgagaggcttggcacatccgcccccgccgccccgaggcagcggatagtcacgtgcgatgaggtcccagtcaaggaggttgtcctgggcgacggcccgtccaagaccacacggatcggtggtctcttggatggcaaataggaagacgcgctcgtctctttcttgcgggcaaacgctgacgtcttcgcatggagaccggcggatatgcccggggtccccagggaggtgattgagcaccgtctcgccgtacggccgggcgcaaggccggtccggcagaaagtgcggcgccaggccccggaacgtcaagccttcatccgcgaggaggtggcgtgacttctggaggccggattcatccgcgaggtcatccatccggagtggctggcgaacccggtggtcgttcccaaggcgaacggcaagcttcgaatgtgcatcgactacaccgaccttaacaaggcatgtcctaaggatccttaccccctgcctcgcatagatcagattgtcgactccacagcggggtgcgaccttttgtgttttctagatgcatactctggttatcatcaaattcgcatggctagggaggatgaggaaaaaactgcgttcattacccccataggaacttattgttatacgacaatgcccttcgggttaaagaatgcaggtcctacttttcaacgtactactcgaatttctttgggtagccaattaggacgtaatgttgaggcttatgtcgatgacttggttgtaaagacgcgcaaccaggaaacgttactttcagatctagcggaaacttttgagagcctccgctccgcccgcataaaactgaaccccgataagtgcgtgttcggtgtacctacgggcaagcttctcgggttcttggtctctgcccgaggcatcgaggccaaccccgagaagatacgagctatagagcggatgcgcccccccagcaagcttagggatgtgcaatgcgtcaccggttgcatggtcgccctaagtcggttcatatcgaggctgggagagaaggcgttacccttatttaagctcctcaaacgctccgggccgtttacttggacggaggaggctgaacgtgccctcactcagttgaaggtgtatctcagctctcccccagttctggtcgccccagagccaaatgaacccttgctactctacttagcggcgaccccgcaagtggttagtgcggcgttggtcgtggaacgcgatgaggacaatcctcattccgcgcacccccaccttgtgccgacttggcccgggagagagcagggaggagaggcccccgagccgaacggtggcccaaggcccccgacgaccggagatggccctctgcccgcttgtcagacggtgctaggagcccccgacccccaagaaggccccgaggccactgcgggaaggccgcacctatcgccctctgaccccgaggctaaccctgtgccgatttggcccgggagagagcagggaggagaggcccccgagcagaacggtggcccaaggctcccgacgaccggagatggccctctgcccgcttgtccgacgacgccaggggcccccgacccccaggacggccccgaagccactgtgggaaagccgcccccgtcgtcctccgaccccgaggtcgtcggcacagaagacgagtgcgccccgcgaggccgctcgggtgaagagcgccccagggatgcggcccctagcgaaaaggatcggccccaccgaaaggtgcagcggcccgtctactttgttagtgaggccctccgggatgccaagacccgataccctcaggcccagaaaatgctttacgctgttctgatggcctcgagg

SEQ ID NO: 20186 - DNA, 1426 bp, Oryza sativa
tctgagtttgatttgcactttgaaccacgccacgctatcaagagccaggccctcgccgactttgtggcagaatggaccccggctcccgagctcgtctcggtccccgaaaccggctcgggtccctcgcagctgcctcacaccgcccactgggtgatgcagttcgacggctccctgtctcttcagggcgccggtgcgggggtcacgttgacctctccgagtggagacgtcctcaaatacttggtccgcctcgactttcgagcgaccaataatatggcagagtacgagggactccttgccggactcagagtggcagctggactggggatccgccgcctcctggtgttaggcgattcccagctggtcgttaaccaagtctgtaaggagtaccggtgctctgactcgcagatggacgcctacgtgcgccaagtacggcgtatggagcgccattttgacgggattgagcttcggcacgttcccagacgggataacatgatggccgacgagctctcacggctcgcgtcctcgcgagcccagaccccaccgggcgcctttgaagaaaggcttgcccagccgtcggcgcgacccgaccccttaggggagacggatgcgcctaaccggcccccgaggcccgtcggagtccaggcctcgggacccgaggggagtgctcccagctcccttagattgattgcttggatcgccgagatccaagcatacctcacagataagactctacccgaggaccgcgaagggagtgaacgcgtccatcgcatctccaaacgctacgtgctggtagaagggaccctctatcggcgcgcggctaatggaatcctcctgaagtgcactcctcgggaacaaggcgttgtgcttcttgccgatatccatgaaggcgaatgcggagcacactccgcctcgcgcaccttggttggtaaagcttttcgccaaggtttctattggccgacagctctcaatgatgcggtcgacctggtccaccgatgtagagcgtgtcaattccacgccaagcaaatccatcagccggcccaggccctgcagaccataccactttcgtggccatttgctgtctggggactcgatatcctgggaccgtttaggcgggccccgggcgggtttgagtatctgtatgtcgcgatcgacaagttcactaagtggcccgaggcttatccggtcgtcaagatcgataagcactccgcacttaaattcattaagggcatcacggcccggtttggagtgcctaaccgtattattacggataatggcacccaattcactagtgaactcttcggcgactactgcgaagacatgggcatcaagctttggtttgcctcacctgcccaccccagaagcaatggccaagtggagcgcgccaatgcagaaatcctcaaaggccttaaaaccaagaccttcaata

SEQ ID NO: 20187 - DNA, 1926 bp, Oryza sativa
  unsure (1)..(1926): unsure at all n locations
nnnnnnnnnnnnnnnnnnnnnnnnnnnnnnnnnnnnnnnnnnnnnnnnnnnnnnnnnatgcagaaatcctcaaaggccttaaaaccaagaccttcaatattctcaagaaacacggcgattcatggatcgaggagttgccagcggtgctctaggcgaaccgaaccacaccaagccgagcaaccggggaaacgcctttcttcctcgtctacggcgcagaagcggttctcccatccgagctcaccctgaggtctcctcgggccaccatgtactgcgaggctgatcaagatcagctttgtagagatgacctcgactacttggaagaacgaaggcggcgtgcgggcctccgagccgcacgctaccagcagagcctgcggcgctaccatcagcgccacgtccgggcccgatcactctgcgtcgacgacctcgtcttacgccgcgtccaaacgcgtgctagattgagcaagctctcaccaatgtgggagggtccgtatcgagtgatcggcgtcccccggccgggctccatacggctggccatgggcgacggcactgagttgcctaacccatggaacatcgagcaccttcgtcgcttctacccctgggggggggtcgggtgttaggtttttggctcgggccaaccccgtaccccccccctcgggtgtgcatggttggccgggggctaccacacatgcacattctcttttctcttatttcagtatttcaataaaagcagtttcaatttcctaagggctgtatctgtgccgttttttcctttttgaagaattttgacttgaaataagatcactcgtgctcaaccttgccctcgggggctcggttcggtcagctaaaatcgccaaacggggcccagaaccgagccgtgccctggggcgtggtgaactccgggggggggaatcggcaaaaacccacaatcgggtcacccataaccctcggtcaccacgttcccggcctggccagcctcgacatgtggatctccccaggcactagccccgacccgcgcctttcgaggactgggacttgggcacgagtccttaaatcaagctaagacacaaaaggaccacggcacagatcatcctcatctcatttgtatagcaaagtaaaattaacacaaaaattttcatcatttttgattgcagattaagttgatctatacaaaaaagaggcctgaaggccttagaagaaagaaaaagaaaaaactagagattagcgggggcctgggggctcaatccgatgcgcccgggtcgccggcctcgtcgtcactgtcgtctgcaccgctggcgtcgccctcctcgtcggagttgggggcgaacgcgagccgaggggccgagccctcgaagctgtggacgatgtggtcggcggcatcccggacctgcgcgcgcgcgctgtcttcagtcccaggagggaactcatccagcgccatccacggagagaagttggggtccctggcctggtagctcgccaggacgagctccaccgctccttgggcgaggtccctcgaggatgacttgacggtcttctcgagctcctcggggagctgctggagagccccggccatcttcgagaggtgctgagcgaggcctccctggttggtggagtacttcattgtctggcctttccagaggcccgcctgccgaccggcgcgatccagatgggagactgcatcccaaagcatgccgggccctatctcgcccgccaagcggagggcctcggcttccccggcggatgagtctagcgcgcgctgcatgtcggcgatggtgagttcggtagctgcgaggcgggtggctaagtcactttcgcccgcagccgccccgccgctgcgtgccctcgagtccagctccttctcccgcgcctcgaggtcagcggcccgctggtccagtgcggccctactcggcgcggacacattctagattg

SEQ ID NO: 20188 - DNA, 1623 bp, Oryza sativa
ctctcgggcagcggcggcatcaaggaccccctgggcggcgtcgagctttttctttagctccgcctcccagctcccgtattgaaggcggagggtgtcctgcgcctcgttcatcacggtggtggcgatgagggcagccccccgctcctcctccacctcttgagcgatctccgccagcgccgtcttacgggcttcaagatctgagacgtgccggcggtgtgccttgcggcccgcttccaccatggcctccaccgatcgccgcccctcctcgacacgcgcccatgcggcgtcgagctccgcacgctccgcctgcagggcctccacctgggcacttaacccatccaacaccgcggtgtttgcggcggctaaggcctgcagaaggggctctgcgctcagcggggcgacggaaggcgtggggaagagctgccttggagaagatgtcgcgcggctcggcccgccaatggacgtgccggactcggggatgttccccggacctgtttggtcctgggcgtcgcccgaaggagtgggcccaggcgacgcgcccgcagcctcgtcgccagctgccccggaagttgtcgcctgagcgtcgcccgagggagtgggcccaagcgatgcgcccgcgacctcgtcgcgagctgcctcggaagaaaccattgcctcgtcctggcgaaatccggctttctcccgagcggcttcctcggcctggtgggctcgggcggcctcctcccgagcggtatcctcagcctggcgagcccgggcgggctcccgggcggcctcttcagcttcccgtaggcgatctgcggcctctcgccggtcagattctcgcctccgtgcctctgcggccgccggatcctcggcctcagattggccagacttggaatgacgggagggacgcgacgggatctcgctaaaacagaagaaaagaccagaagacgaacaaagacgggtgagtgaaaactcgcgttgaagagaatggatacagccccgatgagtgagagatgaacctgcgagggggtcggttgaacgaccactttggaggggagatgaggtttccccgagatggttctgtctcccccatcttgcggagccgtttcttcttgcgctccccctcgggctgtgatgttggcgcggcccctccgggcgcctgctgctggcacgcactgccccgccccctcggggaggagatgggggaggtgttcgtcccagcttcctcttcccccggtcgtcgatagggcggttgctccccgagcccctgacgcggggcccaaaagcacgaccccctcctggggtagattgatcccccttgcggctcccgcctgcgccgtcgtggccctttggagctccctcctctgaggccccgactgccgtcataatggtcaagatggaggcgcggtctggatcgctgcagagggggaggattccttggggaatgagggccgcctccacggagttgagattcagcacccgttggaccaatatcttgaagtcctcaggagcccagtcccatctcactccctggtgggtcctcatgtagtcttcggacccggtgtactcccaggcgccccgagcgcgccgctggagcggcgcaatccgacgacggaggtagtcgccatacaccatggcccc

SEQ ID NO: 20189 - DNA, 8877 bp, Oryza sativa
ccgcgccaccccgtgctgacgtcagccctggaatatattgcgcaataattaattaaggactttttctttattagtaaaaacacagtgaatcttctaaaattcataactaattcatccgagctccgtttaagtccattcaagtctcagtaaatcaagaaaaatgtgtagaatccataaaaatggttttgtttcctgtttcagtagtcttatagcatgttttgcttgtgtgctttgtttgtcgcgtagatttcgcccgtttcgtcgatccgcagtttctcgaagacgttgctgtggttccatcagtgcgagagcaaggcaagtcatacattgcaattgatcatattgtacctaatttacaaatgtcccgcatttctattaaatattgcattgttttacaatatcatgtgggatgggtcctattactcagctatatgttgtttcccttatgccaatgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacagttgtacacctctgatcagagtaaaactattcgaatagccgtgcccgcggttatgggcggtcgaccagattcaccgtgattagtttcaccctagttagcttttggaactggttaggtcaggtggtggtttgggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttctcagttgaagatgtctcgaagaggttggttccgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggccggtcctggacaggggtttaatgcacattcagcttagaaattctggttcgtgaatttctgggcgtgacaatctcccaagacatggtgttgcctggtaaccggtgcttgcacttttcactccgtgcagcatctgataccgagttgaagatttcactctttgccttcatagaaacacttttacctaggtcatcttgcttacttaatgacaaggtgactgttgcggggcaattactatcaggggtcttccttgagcgatgcagagcatgtttctgtttatcaatcacctttcggcctacttctttcatgctggagaacgtctttgccaatctcttttatcaatcatctttcggcttatctctaacaggtggtattctttaatgtggattgcggacgcttctggggacgatgaggtcctttggcttgctgcctttccgtgaaaccttgatgtggttcgtcaaaaagctgcactgactaccttcaaggaaatacgttgcttgctatctgtatctatgccactagggtttaattgccgatgatcatctttagtgcttcctcgagatggggagcatccaaattgttcttctgccatatcacctttgacccttttctgatacctgatagactaattaccaaccatcgactactatgttctcaaatattgatgtctcctggatcttcttaactgtttgcaggtatatccgaacttatcaatgtagaggcatggcgggtacccttatgggtttcatccaacaatccttatcttgatctgtaaaaggcgtatccaaactcctatccccaactactgtctcattggctttttaacccaacacagtttaattggttttcttttccatcaacaggttggttattaactcgagtttataatatagttcttctgacacgagaccctaggtctccttgtcagtaaacaattatacatatgatcacatatccgcatcttccacaagaatcctcttagaacttgtctgtattacccatttctcccttattacacgaatacaaggcactgccttaaacaaaaagggaaggtgcttatcattggtacattgtatcctcaacatgaatcatccctaaacatagcaagctcattgtttaaaatcatgaatatatttgtttattacatgattgctgcatactttcgattacacaatgataagtagcaaactgaaaaccacaaacatggctgctcattttgattccggagagatatagctggcattgttctagtgactgcatcatccttgattggttctgtgatgatgtgataggactgcataatgctatcattcgcaggagaagcttccttctgattgctggttgaagcggatgacggttttctgcttggtatcgccctcctgaggttgattgccctttgcttggcctggagtaggtcggggagagacacaacttcttccatcgacgacaactctttgctgaggctgtcggtgcagagaatggttggtgctaaagatattattgctatgatttattgcagagttaggtggagcaggaggagcattggtgttgtggatgatatcgtcgatgttgctgttggagctgactagctgacgagacaatcgtagggtcgttcgttggatttctgcggtcttggtcaacaacacactgagttggcaatccttgggcacatgatttgtaccttcgcacagaaagcatgtgaccttgcgggtgggacactcccctggtggatggtcttcttcacaataagcgcagagtgtgagacacatgctagcaatgtgtccaatttctccacaacggatacatgcttttgattccatctcttcctcaccgagatgtcggggagactcatcttcatcatccgaggagacttgatctgacccttcactatcagatactctgccaccatggcttagaaggtgctgggtcaactgtcgtgcacctcggaaggtatttcctctttgacgtctaggaatagttatccctgcgggaggccattcggtgctgctaatagccatcttacgtacttcttcttcagttcgcatcggcgcttttctcttctgattcttactcttcttgcctttggcttgcttagtacgtgaccccacgtggtacgaagggctaggaggaaagcaattcccgggattcaatggattctctccattgggctctctactttgcacactaggctgcaagcttgacttggtgcgaggaggctggtttagcgatgtctgccctgttaaaccaaaggaaggggcttctttggcatatacccatggacaattcagggcatagtgtccttgttctctacaatcgtgacaaaaggggacatcctcttctggcattggaagctcattgacctgggtggcaaatgctcgatcaaacacatactgattttggtcttgacttccaaccaatggtagctgtgaactaagcggcatgcttggaatggaccaagggtgtgccctggttaactctcttgaggccagtggtggattgagttgaaaacttgagttactggaggcataccctctgacattctttcctttttctctgttaaacatctgttacagggattgaggtgagagaggaaacaagctaggaaagaatagaccagaactagggacaggaccttaaaggaactaactctctttgttgatgtgttgtttgtttcacttattctgcaagttgattaagcaaacaacctagcatggttacatcacacccccccgatgcaaaccacgcgctacacacacaagcaaggaacacacgactaacaacactaccctacagggtggcttaggttctgcgacgggttctccaagatcttcactgcttcacagctggcttcactgcttcctccacttcgctagcggatcctgcagtcttccggagcttcggcgaacaattggcgacatcttcttcttcgcaaactaaccatctagtactagtggaaatccgaagaaggaagaagggagtaaaccttttgcaaatagcattaggggaaggagaaaaaaaaggaactttcgcaaatagttttatttataaaatatgtccttaggttttatccacttggcttatcctacagtcgagatggctctgataccatcttgtcgcgaccgggaaaattgccttttcccgaacaccagtgtattaatccccgtcccaggaaaagccgggtacaccacacaaacatggtataaaagacacatctttattatatcgataatatttacattattacaaaggtacttcaggcctgacaaacaaaaataaacagcagcggactagcgggcctacggctccatcttcacaggcgctcaactggggtataagccaggactccacctaagacttcttctccaaagcttctcttactgaaggggggaaaagattgagcaagaatgagtacaaccacagtactcagcaggccacaccggagatgcacaattaatgcaaaggagtacaaggggataataagataggggttaagttttgcagtaaacggcatttaaaagtcacttagttgcccaaagccattttataaagacgatcctagagctacacagtattattaatcaaggccgtgaacccacacgaacctgccttaacccaaggcctacgatgattcagaccgaactggcaacccgaccctgggtcccagctcgtcccaagccaacccaggccaaccattccacattttagttgttgagcaaattttaagaattaaaacactgacttgggtacattgctcggcttgcccataaccgagggcgcggctattcgaatagattatactctgatcagaggtgtacatctttacccacaagacacatcttcctcacgtgtaaccacgtgccacataccaccacggtatacggacggaagacgtgacatagttcccaacccatcctagccataaacaagagtaccgacccaatcctgcctacggccggaacccccgggacaggcaggcaggactgagccccaagcagcagggcaccaaccctctgccacgacatctcgactaccgggccgcagctcgtgtagccttcatttgccctggagaatgtccatcgacccccgacttcatccatctccaatccgtgtacttttgtttataaccagactgagccacaaactaagccttacccactagacatgtggaagtacggtagtgctttgcaacagaggcccgagcttaatccttatagtggccggggtgctacttcccacaactggcatgcacccaaaccccaccgaaaacaggttttaggggttttgaaaggggaagagaggtgtatgtccaattccaccataaaccaacaattccaaagtgtccaaatgatatgagaattcccaaagtctaaagttataaaatcacctaatgttgcctaattaaccagcgaagcatctacctaagttcatactagtggaaccataaatagagtacccactagttggggttttattttcctagggtgaacaaggtaataataacaatagcaataataatgtcttaacaacgataaataggcatggctaaataaaacagtgataacgcgggaatttaaataaagcggtaatgcaataatttaaatcaaaataattttataaactgtgattcaatatgctcaaggatgatgtgacttgccttgctcgctttcccaaacaccggcttcaacttccacgaagagcggatcttccgaagctgcagcgtctacacgactaacggaaaagaaacggcttttactctaataaactccacataacagcagaaacaaagcacaaaaatgggttcttgacttcttaaggaaaaattagagacttgaacggtccaattccgagttcaaatggccaagatatagccatttgaagtttatatgctctttaaatggatatttacgaatttcttcatttaaattttaattaaaaactcatttattgcgtcagccgggagagagggcgcgcggaccgggtccacgggagtggggcccacgcgtcagcctctcggtccacggtggaccgggtgcacgcggctgacggcggccggcgccgtgggtcccacgcgtcagccgcacccgcgggcgcgggcggctgacggccgggccccacctggcagccgcggggcgcgcccgaaggcggcctcgccggcacggccgacgggagacggcgcgcccgcgccccgatggtcaccgccggcgaccaccggcgcggcggagcggcgcccgagagagcggagaagagagggaagggaaaggggcggtccacggttcaccccgggacgacgaggacggcggaaacgacgaccggagtggaggaaagcggcggcgcggttcgggacggcgaggacgacggtgctccggcggtcggcgggcgaaacggaggagcggacgaggtcgacgacgacgcggcgaagccgatggaggtgacgccgagacgggaggaagtccggggcgacgacggcggcgaaccggagctcggcggcgacggcggagagagaggaggacggcgcgagcacgaatccgacggggagagcgagcggcgagcggcggaaacggaggagagaggcacggggaacaattatatagcgccgggagggagagagagaggccggaggggaaggaaacggccgcggcgatctcgggcgccattgatgccggcgaggtttaggggaaagattccgagcgaatccgagggagagagagagggaaaagcggggggaaacggagagggaatcacggggagtgatttccccctctttaatgcgcgcggggatggcgggatgcggcggaatccgcggcggcggcggcgctagggcacgggcgggcggcgggagcggcgcgagaaaggcgatgacaggtgggccccacccgtcagcgagggtggcgggcgggcccgcctgtcagcggcgtgcgcgcgggggagggcccgagtgggccgcggggaggagagagagggaaagagcgaggtgggccgagccggcccaagagaggaagggggggaaagaagacttcttttagggtttttctttttataaacctttttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagcgaatgatttttaattcgggatgaatttatcaggacgtgacaaatccaccccccttataagaatctcgtccccgagattcgaggaggctagcaagaagataggttgggcggtcttctcttcttgtccgacttcttccgtcgcatcttttataacgaacttgcctaacaaaacttctccactctggactgcttggctcaatctcctgttgcagatggagtcttctcttcacctgacttttccctggttgcacctctagctgacttcgactggattgtggcacttgaagatggggcttcagttccagaactttgcatagttcatatctttggagtcaacctcatacaagttacccacttcatgtcatgcgtcgagatcagctcgtcattactaagataccatgcttgtcatttgcttctaactcgccaccaactgcctcatattagctttcctggtctccgggtgatagctacttctgctatttgatgcaagggtcgataactttgcctttgaattatgcttcccaagagaaccaacttatcccactggacatgctttgacgtcttcccaaatggctttactgctggacttcttattgtctggtcgttatccggccaaatttgaagcttcgttgttagatgtgattttactctgacctctgtagactatcttcgaacatatcacttgtttcataactgggaatagctcccacgaacaagcaactcagattcactttctttatgttcagtttactttccgctattctcttcatgttgtcatcatttagcattcaacgtattcctgtgcaccttcagccttgatgtgttctttcccattggatcatctctgtcacgccctgaagttcccctcccttgctctaaattcataaaataaatcgtccgaagaaattgtttaatttaacctagagagaaaccctaaagtaataaatgcaaataataatcggaatcggcatgtggaatttttcttggattctacatgtcaaaatatgctaacaggatttttagtggaattttcagagccctagaaataattttaaccaattaaaaatcaccaa

SEQ ID NO: 20190 - DNA, 1242 bp, Oryza sativa
agccggcccaagagaggaagggggggaagaagacttcttttagggtttttctttttataaacctttttaactttgtttatttcttaataattattatttgtgctctgaaaattccactaaaatttgagggctctttttagaccaaggagaatttaacaaaaattctccgggccacatttgaatttttcttgtacgtattttagtgtttgccaatttcttttcgaattttaattaattctattattccttttagcgaatgatttttaattcgggatgaatttatcaggacgtgacagtctggcgccgggcgtccctcgcccagcgtgactatctcccggccggtggccgattccggcatgaagcggcgcggcagcccagcctgcctctcgctcacgatgcgggagggcggcagcacgctaccatcgagcagagcggagccccgtgccatggcgccggaggaagagaagattaagagcgagcgcgtgtggcgagggtagggcgcaggaaaggaggagttagggcgcaagcagcaaagacaaggggaataatggcgaaaggaaggaaacaagtcccttcctcagtgcctttatacccttgccaacgctatgcccggctcctcgtttctcgcgcccactatttcgccccctcgtttctcgcgcccacgcttccactaatcccattcgcccgcttgcggcgcatgaggtggatatgcggttgtggcggtcgaggtagatcatatcgtgcgcgcgttaattacgctcgccaaccgaagcgacgttaccatatcttcagatgaaacgaatcgccatgtccagattcgtgtgctactcgagtaatgtggcagtcttgaagagaccgctcattgttgacagccgaattaccactgccgatgtgcgtgatttgtgaccgtttggttttctgcccaattgtggagaccggtcccacctgtcaccaggccttaggagtggcgtcacgcccgaccgcttcccttaaggagggcgatcgccctggcataacgccgggggctactgtcggtgacatgggatcgggagtatcatgactagaggtttgaggcagacacaatcgcccacgtggcctggcaccctcgggggacgtcgggcccgagggtgatgtgttcgccctcctcttagtccccccgagggggtcgggctgcacccccctcggccccgagggccgaggcgccctgacccctcgtgggttttcgctccgcgtgtatgggtt

SEQ ID NO: 20191 - DNA, 19161 bp, Oryza sativa
  unsure (1)..(19161): unsure at all n locations
gatttgtgaccattctgacaccggtcatgtcgccagcagacagccatgattctacgtcgcgcctgctcccggcgaaagtggaggtaggtgcgggccgttccatcagaaggtgactcgaacggcaaccatgcaaatctccgtctatttctgagaaggtgggggaaatccccacagaaaaaagagggaaatggtgcatgtggtatccccttaagatataaaaggaggaccttgaccactgagagaagggggagctttttcttggattgattttttccagattcggaacctagaacaagggagaggttggctcacactttgtagctgcttcatacacagatccaccaaaacacaggagtagggtattacgcttctcagcggcccgaacctgtatacatcgccggtgtcttctgtgcttccggtctcgcgaaccttccacatacagattgggagcttagagtctcacctagggtccccggccgaaccggcaaaggggggccagcgcggtctcccggtgaggagccccatgctccgtcacaggtgattgggatagatcggtcatcatgccgagaccgtataaatcacttagatcgaaatatacatctataacaggactatatatgtttatagcgtagccgatcagatagatctagcgtgtatcggctaatactccgatactactctatattaagatattgaagcaataataatatatcaaacaagagtttaacatatttagttatggcagtatcttaacataaatggcagatttaacatattaatgaagcaaataggataactgtagttaaatcagatacgatcggctgaaactccgatgctattctaatcaacaactaggtggcaggctagagatcaatattctaagcacgacttaatagatcaaactcgattgatgcagcattaagtatgaaaagaagaacaatatctagacaatcaagccgctagaagattcatagaatggtagatatcttatataatctaaatcaacgttgagatctaacctaatcggctgtcttttgcgtgcaaatgtctgccgaagatagattagacaatgatactgctatagattatgtaaaatatatgataacttgacgaattatataaatgagatacgagtgtcatgaagatggaagcgctaatccctaagaacataattcgtcataacgagttttacctcttgtcgaagatcgaaaccgatgcagctcaacccgaaagcaagaactcgtcgaaataaaactaaagcaaaaggtggcgatgcgccggaattatattgaatgtgtctgtctaaattacatagggctcggggtctatttatacccgaggattacaagatatgcccataccggacacgactattatctctaacaaactctaaactatcacaagtctttgcggcagactcttgcccacacttatctataaggaatttacataaataatcctaattaatagatacaattgatttcccaggactctatccatgcgtggcaatcatcttgaagcacatcaacctgagccggacgtcgcgcacaagttcttttgtcagaatcgactgtatcggcttatttagcttaacccgacattaggcgatcctagccatagccgatcctaaccgtagccgattcagactccagccgattcttgctctgttccagaactcgatctccgcctccaactcttcttgaccaaatcccctttactgatacgaatacttaccaaattctgttgttaacagtggcgcatacaactatacgatacgggggctgctagctggcgcgtgcgcgccaacagcgagcactccctcctcccctttagtcttaaccactatattagttaatatagttaacactaatggtggtaactaggaaagattctggagattttttgggagatttttttactaacagattgaaaatattttaggttagatttgaaaactttcgatttaagttttaaattttaaagtcaaattttgaaaactttcaactcagatttgaaaactttcaactcgagaatcgagattcaaaaactttcaagtccagatttgaaaattttgaaaactttcaatttgagatttgaaaactttcaactcgagattcgaaaactttcaactcgagatttgaaaactttcaactcgagatttgaaaattttgaaaactttcaaatcgagatatgtaaactttctagtcgagatttgaaaactttcaagtttaggtttgaaaattttcaactcaaaatttataaactttcaaactcaaaacatgataaagataaaaaaaatcagaaaaaagtaggaaagaaaaggaaaaaaaggttaaaaaaacgaaaaaaagcgcggagaagtcgcgcgtgcgccgacgcagcggcgctgggccttctgggcctgaaacgcgcgccgccggcagcacgcgcgctaactagcattagcgcggacttaccgggggttcctaggaggcgcgtgcgcgccgactgcttaattcgcgcagccgcgcgcgtctcctcgacgtcttgtccgcgcgcttccgccgctaattatggcaattagtgttaattactgtcattagtattatttttaaaacagtaacaacgtaaataattcagttaccagttttttttagaaaagtaatggaaagttttaaatttgtagtcaaaagattttgaaatttgagctgaaaattttaaattttgatttcaactttttaaattttgatatagaagttttcaagttgagttgaaagttttcaaaattgaagttgaaagtttttaaatttgagtaaaaagtttcaaaaattgagttgaaagttttgaaatttgacttgaaagtttgtaatttgatttgaaagtttcgaatttttagttgaaagtttttgaattgagatgaaaattctaaaattgtgagttgaaaactttcaaatttgaatcgaaagtttttgaattttgagatgaaaattctaaaattgtgagttgaaaactttcaaatttaaatcgaaagttttcaaatgctgagtggaaagttttcaaattttgagttgaaagttttcaaaattttcaatttaaaaatttaatcttctgttaaaaagtttagttaaatgttctaatcactgcgtgcatgtatgtacgtggattgtccaattacaattaggagatactattactaattgagtgtgttactcaacgtgcatatggggcatatatacgtacatgactgaatcatcgttaatcaccgttgaaaagtcactaggcccagcaggcccatgtcagacgcgaagctgaggcgctgccgtcgcgaaacgctcgctgacttgcgggaactagcaatcttgatacgggcgtcctgcactgctcgagccatgcgcgtacaaccagacgtgtataaacacatggtggacgtactttgacctgaaaaagaaatatacatggtgcacagtggagaaggggtggacaggacagaggacacacgggactagtttgtggatgcaagactctttcggtaatgaattacaaacaacgccttgcatgattgcatcatcgccctaaattgaaacagcgatgatatgataccatctctggttgttgcatttagcgacaggcgatcagatcagaggaacgccggtaataactgaactatcgtcgtcctagctagttctcaggcggactgggaggggtcgaagtaggcggcgtgtcctcccgacgagatgtcagcggttgagatgaagacggcgtgcgtgaccggcgggaacgggtatatcgcttcggcgctcatcaagatgctgcttcagaagggatatgctgtcaacacgacggtcagaaacccaggtggtattatttcccgttttaatcttctgttcatacgtattcagcccttgttaagttccaaacatttttatcaaacttccaacttttccatcacatcaaaacttttctacacacaaacttccaacttttccatattctaatttcaagcaaacctccaattttgacgtgaactaagcacagttaaagttttccttcctttcagattcaggggtggaatctttggtccgcagtagcatattttctgaattgtcgtcatgaacaacagaaagaaagtcctactttgtgataaaaaagattctagaaaaataataagatatataccaatccagagatatattcaaatttcaacttatacaattattagaacaaaaataacaaatttggttgcaaattacacgttttatttgagtcaaatttgtcgttttcatttctacttatgtaagctgattttgaacttgtattgtttgtgaaataatatatcacatattgatcaatcttgttaattttttaagaaaaataatgattttttttggcgaaatgcaaaataacgagagaacattcccgaggatgaatatttttttcgcgaacgcgcaaaaagattgcacttcaatatatattagaagaaaatgagtttttgttacacaacacaatcagccagactggcttatgccaaggaaagaggaaaaaagcaaaaaaaaaaaaaagtaaactaaagcttaggaagtactacggcggctaaacgcaactcctaacagcgggaaggggcatagccacgctacactcccaaaaaatccccaaaagtggcaccacagatgaccctccgagaggatggattccaggaccacagggactgaagagagcaccgagtcaaaaacccagaagttccgttccttccacggctgccaagagaccagagcaccagggtcctgaggatgaatagaattttcccttctacttagcaaatgccaaatgccactcttacctgcaccatgtagaaaatattttttttagataatgtagaaaatatttacatgttcaaaccgatagtcgcacctaattcatatagtgaaatatgctggaaaggatgcaaatcgttatgatctcaattctcaagacgacgctactacgagtttccagagttcagttctgcctctgaagatcctactcttgtgtattcagatgacatgaagaagacttcccatctcaaggacttggaagcactaggccccttggaggtcttccgcgctgacatggacgaagaaggcagcttcgacgatgccgttgccggctgcgattacgccttcctcgtcgccgctccggtgaatttccagtcacagaatcctgaggtgaacagctagctaattagcgcgctttctctaatcgacaccactgcatgttgtgttgtctcatctctgatgatatatatatatatatatatatatatatgctctctaagtctccagttctgaaattaatttgctcttgatttctacgatgacaaagctgcatttgtacgttaatttatggcagaaagagcttattgaagccggcgtccaaggaaccatgaatgtgatgaggtcgtgcgtgagagccggcacggtgaagcgcgtgatcctcacatcgtcggcgcccgccgtctccggcaggccgctgcaaggcgacggccatgtcctggacgaggattcctggtccgacgtcgagtacctgacgaaagagaagccaccagcttgggtcacgttctaccttttttgagcctccatctcatccctacaatttttttgataatgcatagaaatccatctctatatccactcaaacaaacgttacgaatagaagtacttaaactctaaaaagaagaaacaatgctactactagaagactagtatactccataaagatgatgacgccctaatgcttatagatggccatatggctcgagacccgcggcccagcccaaggcatgccaatttagcccggcccaagcacgtcacagcccaaccggggtcgtgctcgtgccggcctgacccgacagccgggctgtgcttgggccactcccttggcacggtggaccggtccggcacggcatgatcgaacaaaaatagtggagggatgtaaaatagacttatgctagcccaaagacaagaggaatacaaaatagatttatttttcagccatatgaacacagcccacagagtttaggtaggaaaaatagacttattctgtagagaagcacgataggttgtcgtgccttcgggctagcccagcacggcttgagtcttactgggccgtgtgtgtagcccgtgagctggcacggcacgtcccggtgtgtagggccaggccggcccgactgacctcaccctaggcatggctgtgccgggcgatctatttggcatctatactaacgttagcataccccattattgtttttcgcaggcgtatagtgtctcaaaggtgctcatggagaaggcagcatgcaaattagcggaggagaacaacatcagcctcatcaccgtgttcccggtgttcactttgggtgcagcgccgacgccgacggccgcaacaagcgtctcagctatgctctccttgctatctagtgagaacctgatcgagagacatgcgccaaattagtttaagaagatcagcgagcacaaattcgactgatcgatgctagctgttttctgttttttcaggtgatgagacgcagctaaaaaccctgaaaggcctggcagcaaccggccccattccgacagttcacgtggacgacctctgccgcgccgaggtattcgtcgccgagaaggagtcggcgtcggggaggtacatctgcagcagcctcagcaccaccgtcgtggcattcgcccgtttcgtggcaggaaagcaccctcggtacaacgtcaaaactgacgggtacgtacttacgtacgaactggcaatctggcactctcagtttcgagttatagcgacacaaacttctactacattcgttttaaaaaaaatccaattctaaatttgaatctggacataaattcaggattgggtttttttttacggaggtagtacggtgaatcagggaagagaactgacggtgaatcggtgatcgtctcttgtatgcgtatattggcagcttccaagggttccctgagaagccgagagtgtgctattcgtcggagaagctggtgagggaagggttcgagttcaagtggacggatctggacgaggtatttgacgacctcatcgagtatggcaaggtcctggggattctaccgcaatgaaccgctgatgatgctccttcactttggagtttggactggtcactcttgtgtgaaatgaagtcattgtcgtggtgtgttagtacttgtcacgacacacggtatggcaagatacgataagtacttctattgttatgggctctactacaaataaggaagcgatggatcggccgcacaaattaggcccatcacaatgcaagcgtcatatcccgcacgattctgaatcacaccacgcgacgcgacgcccgcacgggcaacagcgacaccgcactccgcacgcaggcacccgcgatcgcagcggaaaccgccacataatgctgttcgcgatgagcccccccgcgtaccggtgaatctgcgtgcgccacgcgcgcgcgacgccacgcgacgcgtgcagaatcgatcgcgcgcggccgggatgggatccggacgggacgacgattgatctcggagcgagtgaggtgcggcgttaagatccaacgcaggagtcgtgacatcctgcacgtacgtacacgtgctggacttggactgacgtggtggcagcagctactactgcatgccaaaacccttgagacgtcgcgagcgaatagaacgccactgcccgggcggacaccatgtgggactaaaaaaacgtacacgatcgtacgtgctcgatcgatgacgggagaattggaagggagcgcatggtggacacgaggaaaagagaagatttagaaggaacgtatggtgaagtattagtatataatttattactccttctgttctagattacaagacgttttaactgttttaagtttgaacaattttgtaaaaaaaatactaagacaaatttattaaaaaacatatttaattattgatttgatgaaactaatttagtattataaatattactatattacctataaactttgactttgaccaaagttaaaacgtcttataacctaaaacggagagtaattataaactatcttgaatttaaaaataagttaatatgatttttagaataatttttctatataattttcttaaaaaaatccatcaatagttcgggaaacgtgtgtgcagagaatgagagaaatcttttctcagtgtacaactgcataacacggtcttaaagagaaatcttctctcaatatatagctgccgaactaaataatcatagttctccataaaaatgaaaaaaaaaaaccttatcattagggatgtgtcgggcatggccagctatgggcacttgggcagcagtgcagcactgccccactccgatacatcgatggcaatccttttcttctcagccggataaagccttgtagatataaaaaattgacttctcaaatcatctggttggactatgagtagaccaaatacattacgcacatttctcttgagcatatatacgccactaataaacagctcaagacaaccaaacgcaggcgcccatatcagccacggcatgcattgccatacttaatccatgttagattcaaagtcgccttatcggataggtatttttgtgcagcacggcaacctgtccaaaaagcacacaagtactagtacatgactgtaaaatgcaaagccaatcgcaattacagtcttccaattccaacttgtccaaagatacttcaccttggagtgcgtttagtttacgttaaaattaaaaatttggttgaaattgaaacgatgtgacaaaaaaagttaaaattttatatgtgtaaaaaagttttgacgtgatgaaaaagttgaaagtttgaaaaaaaaaaggtttagaactaaactcagccctaatgcatccaacgatggtaatcaccacgccagatgtgacaaatacgctgtagatccaaatcctggatcggaagagcatgtactagcagtagtccagaaaaatgattttgtcgcaactgttgacagtaagcagagttaagaaactgcgtaaataacttccaaataaaacaaacaaaacacacacaactcacacaaagtacacaactcacaaacacaggcaactcgctctccctacaaatacaacagggcgcaccgtgcaaaaacgcatcgccccccacgccaccgagcgacacgcacgcacgcacacgcgcgcgccgaccgagcggatagccatgtcgacggaggcgctcctcgccggcggaggcggcggtggcggtggaggcgaggtgaaacggcgcgtgagcatcgacgacgcgctggcgtggcacgcgggggagttcgggcggtggcagctgcggcacttcgtgctggtgtcgtcggcgtggctgctggaggcgctgcacaccatggtcatcatcttcgccgaccgggagccggccatggtgtgcgccgccggggacggccggtgcggcgaccgctgcgccggcgccggcgccgccgcggggaccgggtgggagtgggccagcgggcgcgcctcgtcgacggtgtccgagtggggcctcgtctgcggcgagcggtacaaggtcggcctcgtccaggccatcttcttcgccggatgcatgattggtcagtgctccaattctcgtccaaattaccttcgtttccaagtagtttttttttttgacgaattacgcaacggaatgccaaaatgcaaaatactaagattggatgaaacgcttgccttaattgtggcatcgacgtgagaggcaatacgtaatatacgagactaatccgtgaaacaaaaataggctagcatttcaaactagattggacgatggattgcagaccgcgacgttccgggagatttcgtggtggtgcatttttgcagcccggaatcgtacgtgtggctccagctagtttggttgcatacggccgcatcttggagctagctagccagccagccagccagccaacatcccagcgtgtgctactgtagttcattgtcccatccgtttaatttttctactagtaacagataaagggtccgatttactactgaacaattgcatatttgcatcacactcgttaacaatttagattggttgtcattacacatgagattagatttgacaggtcaactttatgccatcagccactcagcattagcatcgtcgacataatggatgtaaattactgagcattatctgcacaagcggcgccgtgccaatgcctcccttatctttccgcggctgctggcggctgggagattaattaattaggttccggacagttcggtgttcagcttttgcttgactcctgtaccgtcttaacatcatctttcgctaactttaattccaaaagctgtcgatcgatcgaacccaatatgctgcctggaccctgttagccgtgggttcctgcatgcgtggctgcgctcactgtcgttatttgctttagcccaacctgtcactgttgttaacctactgtcaatataattgatcaggtcactgaattgattacgttatctcacggtgctcgatgaaaagctagccgtctagttcggctgatctgatctaaatcacgtggcaataggccggatgcagattgtgtctcgcagaaatttccttccttgtttctcagcgcatgtttaaatagctgttattttcaagctttttgtttggattggccagaacaagatatactttcgaatcttttgactggtactagcatctccctgcctgacaccggtatctttggaattttggatggggactggaagccaagatgtgagatcaataaatcatttgaatcgcattatatcggttactacataatcaccaaaatcaagcttgtcgaatcctggtagtgatcaatagctcctaaccttttttttttagaactactaatagctacttcaccatgtctgtttcggcggtggcattaaccagtcaagatcgccggcgctggtggcccatttgggcctaattttcatcatcaacgtaggctagttattaggctgggccttggcccagtagctgacacagtcgatgggccagttttcctttcctttttgatttggtgacagaagtaattgtagctgagttccacaaagaaaaagaaaaaaaaaagaagtagaaataattttagctgtgttgtcttggcaggcgccggcgtgttcggacacctatcggattcgttcctcggtcggaagggctcgctgcaggtggtctgcgtcctcaatggcgtcttcggcatgctcaccgcgatggcgcccaactactgggcgtacgccgcgctgcgcctcctcaccggcttcagcgccggcagcgtcggcctctgctccttcgtcctcgccaccgagcccgtcggcccctcccgacgcggcgccgcggggatgtccaccttctacttcttctccggcgggatcgccgccctcgccggcatcgcggcgctgttcccgacgtcctggaggatgctctacgtggtcacgtccctgccgtcgctcgtgttcgtcgtcgccgtgctgccgttcgtctcggagtccccgcggtggtacctcgtgcgccgccgcgccgacgacgcgatgcgcgtcgtgcgcgccatcgcgtccagcaatggcaggagcattcctgacgacgtgtccctcaagctcgacgacgagggagacgacgacaacggcgccggcgcaggcaaggtcgtcgactcgtcagcgtcggcgtcgggctccatcatcgacgtgttccggtcgcggacgacgaggttcaggctggtgctctcggtggtgatcaacctgctcgcctcggtggtgtactacggcctcagcctcaacgtcgtcaacctcaagaccaacctctacgtcagcgtcctggtgaactcgctcgccgagatgcccgcctacctcctcacagcgctgctcctcgaccgtttcggccggaagccgctcgccatcggcaccatgcttctcagcggcatctcctgctccgccggcagcctcatcgccggcgccggcgccatgaggtatacgtaatctccaatcatccaatcaaattcagctacgcgaacaaatttctgatcgatagagggcagggtggcaaggctggcgtgcggggtggtggggatcttcggcatggcggcgacgtacaacctgctgttcatctacacggcggagctgttcccgacgccggtgcggaacgcggcgctggggtgcacgtcgcaggcgtcgcagatgggcgccatcctggcgccgctggtggtggtgctcggggagcgcgtgccgttcgcgctgttcggcgtgtcgggcctcgtcggcgggttcctcgtgttctgcctgccggagacgaagaacaagcccatgtacgacaccatggccggcctggaggaaggggagaagaccctcctaaaatgatcatggaaaacatgcatgtgatgcgagtgattctgctcggaatcggcgggaattggtggattcttctacgtgttggtcgctcgtgcaaccggagacaaattgattttgggccgttttccgctggaaacaccgtgtttgggctgggcttttgtgactacgctcatgagtcgccctggctactaccacagcaagtctactaagcagtacagctacagcaaatttctttcggaatcctgactacacttgctgtgttgctctgttcccgtcttaatttcttcctttctcattcaggagctagtaatgaaaacgctgaaccgatcagcctccatcatgaaacctgcttcgtaccagtaactactactgtgagtacctgatcgaaattcattgtcgtttgaatgggtagttaactgagccactagccgtatttactcgtgaaacaactccaaacactgaaacgagcaggaacagagccgctgttggctgcaccggtacaagactataaagcgccgtctacttcagaatactaactgtgcacttaggctgtgtttagatctaaagtttggattcaaacttcagtccttttctatcatatcaatctgtcatacacacacaacttttcagtcacatctccaatttcaaccaaaatacaaactttggatccaactaaacacagcccttaacccacatcttggatctgcaacggcaacggtagactcagttatatactggggacatcggttagctgaataacctgaaatgtgcatcataatagtttgatcaaatcctacgggacatctgatctctatcacctgcttaccaccctagtatactcctacttctaccttccatgccgatgcgaaatgcgtgaccgcttgagacgcaagtggccatctgaaggaattcagaaatggaagcaacgacatgtccagcttcttccccatgcatccatttcccggccatggccaacaacaacgccattgccgcgggagtagtcactcggtactgtgctcaatgcgatgtgacgcgagctggttcgcaataatttcgcacgcctgacacacagaagcccatcatctcatcacacatcatcaccacacacgccgagccaaccctgtcaagtcactgccaacacgatgctgccaatggccaagggctagccactagccataaccatcacgtgttcttttttttttcatgtagtacaactcatttaggactaattaatcctcctctgagcaccattagcttcacgtactgacagtcttaaaccacacttccaaagttactagagcagttactgtacgtagtactccgtaccgtgggggcagtttactgtgctccgctgaacacaattatcagtagtacaagagatgggagaagcacagtgcgagctgcaggctgaagcgtgcacgaacgacgtttacagccagcctcaggtcgttgtcgagcagcggttgcagctcgtgtggtatactgcatacttgaatcggatgcgtcacgagtgcaacgggacaagccgagcaagtccatattaacctatccaatgccgcggtgaacagcgacgcaccgtggcgggagcaaattttcaccgggacgacgacgaggtaaaaaatgggctcaaaaactgcagcgtccagagcagagcattcgggtcacgttgattggacggccatttatgctgtgaaatgcacggtgctgtgcggataattgtataatatacggtggccgtatatgtacgtacgagtacattcatttctcgtatacataggcgctgtttaggctgtgtttagatgtaaagtttggatccaaactttttcatcacatcaacctgtcatacacacacaacttttcagtcacatcatcttcaatttcaaccaaaatccaaactttgcgctgaactaaacacagccttagttctaaagttttttttctaaactttcaactttcgatcacatcaaacattttatacacacacaacttttcaatcacatcgtaccaatttcaaccaacttccaaatttcagtgtgaactaaacatagtcttatacagctgttagcacactagtaacagtaccacacaaaatgatattcccccattacattttaagtgcagtcataagtttctgtgttcaactttgatcctctgtcttatttaacctttttttgtaatgagtatgtccatattcatagtcatataatgggtctcatcccatcctatgctgctacattttgggacggagggagtatttttattatttttagatgataaaatataaataatacttttatgtatgacttatgttctttaattttttaaaaagtattttaaataagatatatgatcaaagatgcacacaagaacttatgactacgcttaaaatgggacagagggagcacgtaacaattttagtgcggcagtgctaatgttgacaagagtactccttacattccaaattaaactaatttagaatgagatacgagtatgagatagtatgacacacaattttactactactccccttgtctcaaaataagttaaataagatttgatccattttaatactaaaaaatccaaaggtttcaatttttaaaaggaaaacatttagaaatcctttaaacgccctaaacgttgtctctaccatcaacggtacaatttttaaatttgaaaacaaaaatcaaacacttgagacctgacagctggagagggggtccagcagcaggagaggtttgcggttttcacttcgaaaagttgcggattgaaaagatgagtccaaactcccaaaacttttgcttttccccggacgggacacgggagacggggagagtactcgcgttgtacacgggagaaaagcataattattgcaggttcagtgggtgatgtcactattatccgctgtaaaggaatgtccccacattcagtaaatatctttactggagtacagtaaaggttataaggaaaatactacagaatggtaaaccgttcggacgaaatgagtgtatccaataattatcggttgatattctgtttggacaaaagcttgatacctaatatcagctgctatctctgatgtataattccgtttgaattcgaatggaatactgtaatatgctatctccgtcttaaaatataataatttttacatagctaaaaatacttatattttaaaacgaagagagtatcattttccgaaagctaatcacgattgaaatggacaccaggcaagcacgcattggttatgcgcatcctccataccgtaccataccagcatgagccatatatcacctctttccgactgtatcttccttgaagaacaatgcagatttgcgggggatgaaagccagtaagccactgcccactagtcctactaaaatggaagcttagcgtacgattaaactctgatggcgcggtaaaaactgtaacgttaacacgagcggttttgtgacttttgtgtgaactcgacaaggacaaaagattatgcgcatcggctggggcgtcgcgaaagcgaaaggaggaggaggagagagcccgtggaatgatgcgtcatgagtttcgttctctgcagtaaaaaatcgacggggcaggagaggcatcatcgtcgttctctgcaccaaaactcatgccatcgatcgcatcgcagcatttttttcacaaccgggggggcgcctttgataaagggtggtgatggctccctgctcattcacagctggagcctacgcctccctgctccctcctggggaactgttcctaatcgagtgattagcattaactaaattggctaatcacgtggattgacagccttaaaatagggtgctggtattaggcttcgacgtcaccgcctgatccttgaatgttttttactgcttgtagtatagttgctgcagctgagattccatttctgatctgaacatctagcatttcacatttctaatccaagtaccccgtatagtgatactttgtactgctgtgttagttctacttaatcaaagacttgactataatccacacgggtaagtgggtcaatagatctgcatcaggtttttgaatgctccttccgttgcaagccatcctgcagactccatcaagccgtgctagccgtgcaatgcaagtgcaagcaggctagcaacagagggcgcagcactttatgtatcgctgatcttctacttcccctgcacgactctgtttgggccaagctgtttttactgtcacctttttttctctttaccgtgtcacgtactagtcctacatacgggcccactcgccagctgtaaccaactagtgtactgtttcacgtacggctagctggctagctgtgctgagcaagcaagagcaagcgaggcagaaacaattctttccccgactggtcacagcggctgtggccagtagccgcgtagctcagcgagagaaagaaagaaagaaagggtgtgtttagatggggaaaaggaaatttttgggtgtcatattgaacgtttgaccggatgttggaaggggtttttggacacgaatgaaaaaactaatttcagaactcgcctggaaaccgcgagacgaatcttttgagactaattaagccgtcattagcacatgtggttactgtagcgcttatggctaatcacggactaattaggcttaaaagattcgtctcgcgatttccttcataactgtgcaattagtttttctttttatctatatttaatgcttcatgcatatatccaaagattcgatataatgtttttgggaaaaaaatttggggaactaaagaggcccaagcgtgctgaaagctcgctgtgaacaaagccgcaaaagttggagaaatccacagcagctgagctgtgcacgcagactgtagtagtagtagagcgctagactgaccactggtccctatctcctgacgcgtgggtcccccgttgcccaacggctagcttggcctccgacgtggcgccctcgtgtcacgtgccacccttccaccgtaagccaaacgtctcgcctatataaacatcgcacccagcttcagcttgagattgagcccatcagtcgagtcgatcgaacagcacagcaagtgagcagtgacaatggcgtctctggccgtcgtggtggtggtggtggcggtggtgtgcgccgccggtgtggcggcggcgggcaagttcgacgacgtggtggagccgagctgggccaacgaccacgtcgtgtacgagggcgacctcctcaagctccgcctcgacagctcgtccggtacgtgttcaactgttcatcgtcttcgccgttgaagtttttgtggtgaatgggtgaagatgttctcgatctgcatttgggggacagatgaccagaatgttttgtgttgtggatgcaggcggcgggttcgcgtcgaagagcaagttcctgtacggcaaggcgaccgccgacctgaagctcgtggcgggggattccgccggagttgtcactgctttctatgtgagtgagtgcatcaggctgtgctctgtgcttcgctacgctttcctccatctgcttcgaacctgccattattgattcttcatcctgcattagcttaaacaagattaactggggtaaatgacaccattagtagtatgcactactgtagtaaatacagtacaaacgtttttcgaggcagtgttggggacatgcttgaccatgtctgtcgggggaagctgccaagaatcaatttacaaagaacagcggcacgtgaactcgtgcagcaataggacaacgttctttaaagatggccgcttttcactaatcacccccgattaatccattacttaattaactggagttaaaactaaatttagctgaatttggcttgcagctgtcgtccggcggggacaagcacaacgagttcgacttcgagttcctgggcaacgtcaccggcgagccgtacctggtgcagaccaacctgtacatcgacggcgtcggcaaccgggagcagcgcatcgacctgtggttcgaccccaccgccgacttccacacctacgccgtgctctggaaccccagccaggtcgtcttcctcgtcgacgacacccccatccgcgtctacgagaacaagaacgccaccgccgccgtcaagggccaccaccgccacgccgccgccgccaatggcaccagcaacgccacatcggcggcggcgtccgtgccgccgttcccgtcgccgcagccgatgtcggtgtacagctccatctggaacgcggacgactgggcgacgcagggcgggcgggtgaagacggactggtcgcacgcgccgttcgtggccacgttccgcgacgtccgcgtcgagggttgcgcgtgggcggcgaacgccacggactcggacgccggcgaggtggcgcggtgcacggggagctcgtggggcaaggaggggaggtactggtggaaggagaaggacatggaggagctcaccgtgcaccagaaccaccagctcgtgtgggcgcgcgcgcaccacctcgtctacgactactgcgtcgacaccgaccgcttccccgtccagccgccggagtgcgccggacggtgaccgtcgatctcgtcgccggttaggatggatcgatggatggaactgctggtttctttcttggttagcaaatcaaatggcaggtagtttatctcagatgaacttaggtgatggtagttcatcgtaattctgtgtctctgtgggggtgtatctgtaaaaaattgttactcggcttccactgctgttctgctgctgctgcatttnnnnnnnnnnnnnnnnnnnnnnnnnnnnnnnnnnnnnnnnnnnnnnnnnnnnnnnnnnnnnnnnnn

SEQ ID NO: 20192 - DNA, 9026 bp, Oryza sativa
ctgctggtttctttcttggttagcaaatcaaatggcaggtagtttatctcagatgaacttaggtgatggtagttcatcgtaattctgtgtctctgtgggggtgtatctgtaaaaaattgttactcggcttccactgctgttctgctgctgctgcatttcttcagtcttccgatctggacgatgctcacttttaacttcaaatcgaaatgcaaatgcccaatgccatcattcattcatttggtcctcctcacggtgaaaaatcaatgaatgccatctgaaagatcactgatgtattgatggctttaattcagagatcaaccgagtaataagaagaggtgtaccgagaggtacaataaacctgtggtccatttgatcgactcgtacattattactattacagatctcactgtttggggtgcaggacgagagagtccgaagagataaggcatcgatcagtactagtactaggactgaccaggcttttgccttgcccctcctcatcacgggtcagtagaatcagaatactgaaacagctgagatggtcacgagatgatgctcttgccttcgccttgatccctcttttgcatgctcactttgttctgaagggaccagcctagttttcgctttagccaaactctctcggcttgtctttcttttgccagctacacagctggacaggtcgcagtagtactatacgtatgccggtagagtggtagaccgtagagggaatgcagagcgagtgattgattggcacgttctgtaccaatgtaggactagtgtataccaccgaaaatacagatgcagatgtgccgcaacggcgcaacttggagacgtaataataccttgcttttgcttttgaatgcagcaagtgcgagagagctccaagctaggtgtacacctgtgaacgaggcaacactgtatctacggatgaaaacggccagaaaacgtttcaatcgtatccatcactatattttctcgaagacggaattcaaaacataaatactggaaagaaaacggtatcgaaaatataaaaaaaaacaactgatactacggatgattatcaacggaaaaccggtaagaaatatcagaaacattgaccataaaaatcacaattcaatttgcatagctatatgttctgatgaaataaaatcaaagttacactatgtaaattacaatttgtctttctttcaacaatagattaggggtttgattgatgaattgacgatactatagactatgggttgagtaaagaattagatcatatatatgatggcgcatttagaaacagtaaaatataacagcaaaattgtttccgttttcatttttgtcggtaaccctttccatataactcgaccagtaaaataaaaggaattgctaactggctacctgctgatctaccctatattcaccaacttggtttactcatctttgactgttacactcttacattcatcactcaacggttgagatcatccctgtgaaatccaacgctccatgtaatcttcacctcccacctggcaccataaccccaacccgactcccgtcttccacgcgattcttcctcccctttccttcccgtcttccacgctacagattgcgcctcctcaatttctcattgtctcgcgaatttttgcgcctaggtcgccctcactcgaagcgacgacaccctcgtttccctctctgcccaccatgccacgtgcaagtcctttgccgatgaccatggagagaccgtcaaaatctgttggtcgccgtcaccgatacagccgatagcgcctcctttccctattgatctgttgctagagaatggggcgagggtcaagcgcaatgcccaagcccagactccaacccaacccacaaatcgtttgcacccttctgcaccgatcgccgtaaccggtcggctgccataagcggttctctgtctacccaactcgccggtcaatagatcgcaacgccccaccacatttcgtccctggtcggctgctgcttgctcttccactaatttgatcttgcaatttcaaaatcataatgcttcagcagtggaatttgcggataaggtcaggtacatttatctcaaatttacctgattcttgatgttgcatgcaaaatttcctagccgcccgggttgccatagatgagacttgtggcgttctttttgttgatatgtctgcaaatgggatagcttaaccaaattatggagttgtggcactttactaaagtctgaatgtacatttcatttgtattatggggtataggccaacaacttttaatatgagcttttgctgtaatcttgatttaattcgttgatatgctgagggatcgtggcatccttcccattacatgttcctgatctgttctgtcagtgatgcttggtgtcaaggtacgcccactgggcttccacacgaaccatggcgaggtgctgttccgctgctgggacatggtaaaatcttttagaccaaaccatttgatgtgctagcttatatcgtgcttgtctatacctgctaaaatcacttctacaaaactgtatgatggttccggtaagaaagtcaaatcgatcggtaatgttcagaattgagaaacatgaatattgatctgtgcagtcttcaggaagtgttgagttctgtgtgagtaaatgagtatgtaagtaggggagaagcactgcaagtagtgatttgtctatggcatatatcatcatgatctgctccttgtataaagagcttcagaattcagattaatttttttagagaaataattcagattaatttcacaaactagattgatcagggttttgccgaaccttgtctatcttaacttagtgcaaatatcagtttgtcaaatcactgttcacgtttttttttcccatgtggatatgcatttgcaaataagtacgtagcagtattttggagaccttgatttggatgtaatatatatgtgtttcttgttttataatttaggtcttcttaattcatagattgccttgtacctcttgatgggtggctatcaaagctctattagtctaaaacaatagtattaatcttactttgatactttaatgtttgatatgccctttctgtaagttgttcatgggtccttgcaaaagaaacaaatgctcattgctgtctagattagtttctagaaattcgatttggaccaggtatgtccaacagaatgagattcggattttcttttggcgtactatatatggctgcaagttcgggtgcgatcgtctgaataactgaatgtactgcaaattgcaaaactagctcattaacttggatcatttaccaatttgctaagtcctattcaactgtaagctgacgttgatctacacaccttattcagtataaaagcagcacaacattatcttaacaatgaagaatgagaggctttcaacccggaaaaaaaaaagaatgaggggctttcatatgtttcgagatgcatagtgcactattttctggtctaaaatggagctgattcatatgcttgtctatacttggagcaagcaattcagtccatgaatctcctttctatgtgtattgacaatcatgactccaacacagtatgcactaacctgttttagccttttatatgcccaggcaaccagcagatctcttgcttaattgcataaaaattttaattctatgtctttgtacttaattaaaattatttatttagggaaaacgagttacatatatcgtttgcagataatgttaccatctatgtgtacacgctctactaaatcattttaaaggataaccatagctttttagtccattattaattaatttgggtataacagcgtaaccacaatcgttacttgcaacttttgatgaatgagaatagagcatttcgttatttctgaacaaatatattactgcctccgttttaggttataagattttctagcattgcccacattgatatatatatgttaatgtgtgtctagattcattaacatatatattgtaaagagaataggagagaacaccactctccccaatgaggggggtgaccatatattatagtctttccaatatacaagatccttagaggagtatacaaggaagctaaggatacaaaagaatcctatacatatatggctatacattcctaatgcccgcccgcagtcacaacaggaggatcacgaatgcaaagattggacctgaaatcagtgaacaactgcacaagcagccccttggtcatgatatcggtgaactgatgggacgacggtacatggagcacatggacctgtcttagagccaccttctcccgaacgaagtgaatgtcgatctcaatgtgcttcgtacgacgatgatgcaccggattggccgtcatgtagacagcgctgacgttgtcaccgtaaacaacggttgcagaggcgatgggagcatgaagctcctggagaagctgtcgaagccagcagcattcggcgacggcgtgagcaacagcgcggtactcagcctccgcgctagaccgggagacagtcgtctgacgcttggaagaccaagagatcggattgtcgccgaggaagacgtagtatccggaggtggagcgccgggagtcgggacagctggcccagtcggcattagaataagccgtcagagacttgacagggccggtgctgatgtggagtccggtggagagagcctttgacgtaagcgcagaatgcacttgaccaaggcaaggtggggctcccgtggatcatgcatgaagaggcagacttactgaacagcataggcgagctctggccgagtgagagtgaggtactgcagagtgcctgcaaggctcctgtactcggtcggatccttgacgggggcgccgtcggaggcggaaagcttggcccgagcatcaaccggggtggcggtggggtggcattcagacatgccggctcgctgaagaagatcgacggcgtactgtcgctgggacaggaagaggccaacggaggagcgacggacggaggttctctatcaaatatgatatttccaaaaatagccatacatatttttaaacctttcttaaatgctggatagagaattgtgatacaaatggtgattattgatgaaaaaaatagaaaacctttaattgatatttgtttatgcatgtagaagtagaaaaataatagtgaacagattacttctcttgattgcgacttgaactttcatactgagagctactccggtttgtgataataatatttaaataaatttggacctcgaaatagtaaaataatttttaagtagaaaatttgctagatatcgccgtagcgttagcatgggcaaattactagtttattttggttggttaagaatttctgtaactgtttttaccactaaccatgtttccactttctacggctccatggtgtagccgaaggcctgggttcattttaggaaggaaggcccagcagcccagtacatgacaaccatgtgcacagacctagagtttgagacaatacaaaacaaaacatgggagggcgtcatttgccaaacatagtaccacctcggaagtcttcaagaaatgaatctagcttaaaatgcaaaacctttgaccgctaagcacgaccttacttgaacaggatctgttctataggctcgtaccgttgcatccttgactaataaggaggcaagcactcaagcttggttgatgacgcatgacctgtgggccagagcgtgattgacggcccggatcatttccgtgtgaattgatcccgcggctgtagaggatcgttccttgccgggctttcgcttggtcagggttggcccataggttgtctgacaggcatcattttttttttcagttatcttcaccactccattaattaggccgttttttcaatatttaggagaagcctgaattactaacagtaaaatctttgacaagcccaagtcatccgcatgacaatccaaacagtaatttgtagatttttgtaatcatagtgtgttattatccttcatcaattgatacttctgctgctcacattgatcattcatcaattgatacttctgctgctcacattgatcatttggactacctcgtaataaatggaaatccaagttcatgctacggagcattggactgataattaaggtgttttagtcacatcatgcatatacacaacaaatctgaggtacaagatctcaacaacgtactccctccgtctaaaaaagacaaatcctaactagtgaaattaagtgagcatacatagtggtactactaaggctatgtttagatttgacataccacatcgaatatacggacgcatatttaaagtattaaatgtagtataataacaaaataaattacagaattcgccccgagatgaatttattaagtctaataaatcaatcattagcaaatgtttattgtagcaccacattattaaatcatggcgcgattaggcttaaaagattcgtttcgtaatttacacacaatctatgtgattaattattttttcgtttatatttaatactctaagcatgtatccaaacattcgatgtgacattgtgtaaaattttatcaaagggattgccctgaagactgctatgcaggtccagacttggacgaaattaaattacagcatctttcatgattatgtcaaggccctgatcacatcagctgggtcctcagaaacataaacccccatgttaaattgcattatcatcagtttgggcacggatcagtacgacagtacactattggatacaatttccatctactaatgtttacaggtggagtttttaaccacgtgatggctatgtgaaggagtaagataaactgtaggagaaaagcatttcgtagtgggccatgaagcctttcaggacatgtattgcagtatgggccggcccattacgcaattggaggacaacaaagactagtattagtaccacctcggctatccacatagatcaaagctggtttaaaagagttgtgcagatgatccatggcacgaccttacttgaacaggatctgttctataggctcgtaccgttgcatccttgactaataaggaggcaagcactcaagcttggttgatgacgcatgacctgtgggccagagcgtgattaacggccggatcatgtcactggctgattcgatcccacggctgtagaggatcgttccttgccgggcctcgcttggccaggatggctctcaggttgtctgacaggctcccaattttttttttcgttttgcattgagttttctccgtcgcatgtttgcagcgtgttcaaaaagttcgcagctgtatttcacttatttacggcgccacattttcatgccgtttgtgccaactatcccgagctagtgaatacagcttagcttcacacaacaccggtgacccgctgacctgctcgtacctcgtaccgtcgtacggcacagcattgctggaattaagggtgtgatcgatactgcttgctgctgcagcaaccgtggctgcaagagctaaaaatggctgcagcggcagcagctgaaaaacagccacagccatagcggcagcagcagatagcagttccgatcaggccctaaatccaagtcctagctaaacaggatgctccattgaacagccaaaccggcctcacatggtctatccaaggacctgccagttagccacgaaatatttcgtgaaaagccagctgaaggctgaagccctttttgcactgaaatgagtatgcgtgcgggcctgatgatccgtggcattgttgctgcggggacatccatgcactgcagggtaatggaggagctgattgagccatatgtctcgctgcaaaggcttcctcctttcggtggttagcccagagcctctcccagagatcgacccagaccagcatgcagtaatcgaatcccgttcgatgattcgatctactaaattcgcaaaggctgtagcgcgcacatggcgccaacaggcaacagtccgggccatttcgccatgccccgggggatccctctgacgcctcacttgagattccttgaaagttgcgaacacatttgtggttttatcttcacttgtgaaagaagacgtgtcatcgtatgatctctactttcttttcaagaaagtcttctgggtgatcttatgagcactctgactatctgaacgctgcctaataattcacataaagctcgggcgccagttcacagttttcatacctggactactgctactgtgttagtgcagtagtgctatagctaatgatatggggcatccaattagttgggtcctcacctggtcggtccatacatgaacctgacgcccccgtgctgtgctggcttctacgttttcatcaccgaaaatattgcagtcccacacgctctctaggttaaggagcaactggcggcttggtgcatatacagtagtactcttgatcagtgaagacctaggtaacagggtactatagcaggttcctgtgcacaatgatgtgaagcaaaatataaatgcttaatttgtcaacattgtatacaacgcgcgtcaaaggaatcatttcaagaatgatcccatcttctgatgtagtggtgtccaaggctccatatacagctgccccagtgtataatgcatggaaagtacagaactatgtacatctcattgtgcaggaactcgtcacgaaacgcaatcatatatacagtaaaacatttttttttgtgtgtggaagtgccctttctgtgatcatgctgctggtagtgcccaataagctaagcaccaccaagtatattcccattgtcagtagtcaccagggcattcatcaagtcggttgatatatattgtcaggtagggacatcggagctagctagcagcttggccccggccgccggcgaccatcacggccgggatgatccgacgccatcccggctacttttcacagatcatcgcatgcttgccatggacgacaatgcagagaaaatactcttacctgttgctaattaaacgtctaagtcaaacacagaaactgaaaacgaatgtacactaagttttgcctaattagttcttgttgcgatctacgcaatggtttcgtcagcgacgaggaaagaatgcacacagg

SEQ ID NO: 20193 - DNA, 41815 bp, Oryza sativa
gcattcaattattcatcacaaaccctgttgttttattgcctttaattatggacaggatagtgtttgtttgtttatgacgtaacgggcgcgcaccagtatatattgtcactagacagtgggttttgttaggtaagtagtactgagaatgtagcctcatcattaagagttcaagatcattaacacggcgtacacttgttttgtctcaatagcatgtgttcccactgtgatgagatcagtctcgtgaacaatcccgtgcatatatgggttattaaaagcatcatcagacgtatggttgacctcttgcttggttgggttatctgtccactgtcctaaccacgtgtgttaggcgcagagatcacaagcttgctagatcgatctcacgtacggccacactacattaccatacagttacgccgaaattaaaacaagatgccagatcactcacccaacttagctaagctccaatcgatccgtgcccaacccaaccgtcccggcagctgtcgggacaaactgagtagactccgagcgtgtcgatctaattctaaagtcagagcacactttgacgaacaggttgacccactgcgacccaggaatcaaacagctagtaggaaactagcatttgtctcagcctaatagcccaaagatgccctcgtgtgtcctactgtccttagcccggccgtgtcaacgcccagcctaaaccggccaacacgtcaacgatccgtgtcgcagagcgtgtgcttttcctgacgcgacggatgccggcgctactgctacttcctacccctccgaaaccgacgccgcggccgggttgggtttgggtcttgggtcagcgtcgacgtcgtcgctggcctcgtcggtttcggaggcacgtgttacaggccgggaaccctcgatcgatcgcgcggccgcgcgcacgcacgcgcgtctggtttgctccgcgatgttgcggtgcgcactagccagcggaggactcgtcgcgtgtacaggttgccgtggcgatcgagcgcgcggcgtgcgtgtccacgtacgtacgccgccccgcgcgcacgcgcacgccgtcgtgtttcgcacaccggcagccggaccattctagccggcgcgcgggcgcgagcgagcgagcggcaggtcggtcggtttcgggagacctcgtgccctgggtggcacggcagtggcaggggggacagcgtagcgtaacgtagcttgccatctacgactggacgactccaccaacaaaacattagactctataaattaaaatctgtatatatgtttgtggctagcaaaaatggtaaattcgagtataaagttacaggcaggataagtaagtgttcgcaagaggaaattgattgcacgcttctaacacaaaccatgcacgagcatgataataatactatatatttgtagttatgggtcaagctaccatcccaccttgtgctaataaccaatccttcaacgaaaacgcatccaagagatcgatcgagattactactactactactgctgtcatcatctccaggttctgcaaagtgcgaattaccggtgaagtatcactactactcgatcaagtcaggcaggcaggggaggaggaaagagatcaacctctgaacataaactagtaatttcacctctgaaaaaaacacccccagcactcgataggggaaaaaaaacggaatgaatcgaaagttgacctccattccaaaccccaatcattccgatcgggcggtcaaagcttcgtcgatacgtggcagcgacgtcgctggcccccggccacggggagggagggacacggcgtggtgtgtcgctggacgccgcgattcagatttcagaggaggatgctgtccctgtcccgccttttgactcggcgttccgatcgatcgatcggtcgatcggctaagcgagtagtagcagcagcagtggagtgccgtgcgttgttcagagttgcaggtgcatgcgtgcgtgcgtgtgtgcgcgagagagaatgagaacgggtggcgtttgtggtgtgtggcttggcaaggcgggatggagggtgagtgggcggctggctttttccgggcacgcgtgcgacccaatcgggccccgcgcttttgacgccttcgccgccgcagtcataagcgtgacgtcaacgcccggggtcttcattcttcaatcgcttaaactggctactatggctaactaattgcctaagctgtaccgccggtccgccgcccgccgtgtgttgtagcctaggccggccaccgtctgtctagaaaagattctaagattctgtttgaaacatatatattatcatcttttacaatattccaagattttgtttgaaacagattgtcgagtaaattattacgacagattatctatttaattgtaaacatatgttaagtattttgataaatatgtaatttaaaacatatgggcaaagcaatgcattaaaaaatttattccgtagtaaattacaggggtatcatctaagtaatattagctgattatattgacatcgcatgtctattattatcagtcacaaatcgacgagcctagacgactgcataggatcactggccttagttatggtgtagcagaaagtaacttttctttcgcgaatgctcattgcatgtcaatatattagaagagtttttgttatacaactcaatcagtcagacatgcctatggggggagggagaaaaaaacaaaagctacaaccaggtaaaggaaagaaaaaaaaactactacggaaaaggctactccgatcagcgggagggtggaggcagaaccataccacactcctaataagcccccaaaagcagcaacaccagcagaagaccacatacgagtatacgaccctccgagaggatagactccagaactactgagaccgaggagagcgcagagtcgaataccctagagttccactccttccatagctaccaagagacgagaaggaccggggagtcgaagttggcgcgaagatgcttagataagcagaccctagaagacagccactagacctgaagcgagctgtcacggggggagggcaacctagccagagggcgacaacatgtggtgctagatctgtcgagcgaatacacagttgaagagggtgtggttcgccatctcaagattctgtgtgcaaaaggggcaggctgagtgctatcaatatcacgcttctggagaagatcagccgtccagcaacgctgctaaaatgcaaaccagatgaagaatttacgtttaaggagaaagtacattaattatatatctgctgagtactctaaattaccaactagtactcaattatgacttatgcccttgccttcatttcaaaattttaatagtactagcgccgtgtttagttccgaaatatttcttcaaacttccaattttttcatcacatcaaaacttttctacacacataaacttctaacttttctgtcacatcgtttcaatttcaaccaaactttcaattttggcgtgaactcacagctagaacaataaccagtctcttcattcagaggatctctctatgtactacggcgaatacgatggtttcctgaccataagtagaagaataatgtgttgactatgcatgatgggcggatgcacgcttaatttggccatattgcaccgtgccatgcatctaacgtcctgattggatgtatatgtgtgccaggagcgagcggcgaggaaaaacaaaaacgtcgaagagtacaaatacgcattgactgtcgacctgcaggtctgaactctgagagagaatataatacatggacaaaaatccaaaaaggagaaaggcagaatcataagaatccaagacaaatcgccggccgatgcatgcctaacgcgacatgaggggttcttgttcctctatcacaatctgcttttccaaacgaaactgatatgagtacgtatgagattaatttacttctcattaagtttgtaatttgcgaagttatatgctacgactgtacttgggacagaggtgtattgttctttgatttattttgatctgtcactcttctatcttcacttcttacacacatacgcatgttttcaggcaactaatacactactagagaattaatctttgttggatcgctaaaaaacggttcgaataagaaccgggactaagattatctttatagtccctgttaaaaagctgaagggaattttttgatcttagtcctggttgataacatttttagttccggtttaaaaagtcatcaggccttactatctttagtcccaccaaccggaactaaagattaacatttagtcccggttatttataccaaccaggaccaaagattgaaaaaaaaattcaaccgcacactcctcggtggaagggaggcggtgcccgggcgggcaggtggaagggagggtggcataggcggcggccgagcgggcggaggggtcgtcggcaacgctgatgtcgatgtgcggattgttggttttgtgatgtgtggacttgtgttgtttgttgagcatgtgaattagtaatgtcaatgttctatgaattcgtgtagtcattttgatccgtgaattttgtgatgttggtgagtttagctgtgaatttgtgacgttggtgagttcggcgtgaaatcaatatgctgacaacaaaaatacaatgaaaaaaaaggaaaaaaaactttagttccggtttgtaacaccaataggtactaaagatttatctttaaacccagttatttgaatcgggactaaaaatggacatctttaattccggattgggcatcccggtaacatatccaggattaaaaggtgtttcgaactgggagtgacgtgggtttctccagtagtgataggagataatctcaacttgtatatatggatgtgactctgtgagaagtgcgcgagattcacagtcacattttttatttttaaaacttgtatataaaaattaaatttaaatctatatgttcgtgaatttatatatatatatatatatatatctattttttttaaaaaaaccgctttttaggtgacataaaaaagagggacgtcccataggaaaaatgactttcacacatacccgctttaattaataagtcgtttagtcttacaatataacaatcagtatatgtgcatatcattctgcatgccactcaagtactacatgatttaattagcgcaacatcatatatatactacaatgacagcaggcgtgcaaataaaatataatttgtagaggtcagagggtacgtgtgtaatttgtgtttagattgtgacgttgagtttatcttctagtgtgaaatgctatacaataaactaaagttgatgggaagattaacaataattaccaacgagaaagtaattcgtagagagttagattagagcaattgatgaagactatggtacacacaaacaagacttcttggtacaggccgggaattaggtgccgcagctcattacccctttacggttaggtgatatcatcaaacattccctctaatcgttctaatttttatttgtttctgttgctatcgctaagacttcttttgagaggtcaatgcctttgattacatagaatttattcgctagtctttcactgcttgttttatttgcagaaggataataagacattaatttaaactgattcgacatatttatcctgattctatcgtgaaaagcatgcatgcatattgctatcaattaatcaattattgaagtgatattaatattgtgtaccccccaaaaaaaataaatataagagaatctcaaaattgctgacaaatggcatgtctagctagtactagtgtgtgctaccactactggaacatcgtaaaataaaaaaaagaaagaaatggaggtaggaatttctagacatagcacaacagtatagctagatgtgatatgtttggcacaaataaagggaattttcttttttgtctaatctccttttaattaattccaaaggaataatataatctatattcctatatgagttacactgcacacatccaccccccctacatttcttacagatgctctttctgaggaacgacaattatgatccaactaattaattaccagacaaaaaacaaagctggtacattttttttacagtagtacacaagcagctagggctataggtgtccaaacgggcggcacggcccggcccggcacgggcacggttccggcacggcccgtttcagcacggcccgttaggcacggctgatgaaacgggccgtgccgtgccggcccacgtgccgagccgccggcccaagcacggcccgtggatggccgggccgtgcccgtgccggcacggcacgcccgcggcccacgggccgttcggggcacggcggcccgtgaaggcaggccgccagcccgccagcctgcagtgcacagtgtttttttttaaaaaaaaagcaaaggaaatgtataaggaaaaaaaaattaaaaatggaaataaaatgtttaaaaaaagtaatgatttactaatgttaaaaaatgaaaaaatggtatttaaaaaatggaaataaaagttttttaaaaaagtaatgatttgctaatgttaaaaaaaagaaaaaatggtatttttttgttgtgttgaaaaatttaaaaatatagattgtgattcattattttgaaataatttaaagataaatccacacttgcgaaaatattgcaaaagaatttgttaaaaatagtaatgacctttattgatgtttatatcattacaggatacaatgatacatgctgcctcgttaaaaactttgtcatgtaaaaactcataggggaaaatgagaaaaccatgacaaagaaaagagtacagctcaaaggtcagaactacttctaacaaaattctactggggttggtctggatccaggtagagttgctcgaactgggcggccaattcttggttgtccgcagtgtattgggcatgttgtcgagcaagctcccagtctttaacgcttagtagcatttcgacgtggtcgctgcgcagagtcgtcctccggtcttcgatgattcggccgcatagactgaaggccgattcggaggacaccgtcgacacgggcaccgtcaacacatcccgtgctagttttgaaagcacaggatatgttatcttgtggtcattccaccacccgaggacgttgaaatcttgtgcttcgtggtggatggcgtcgctgtccaaataaccggacaactcttcggccacaacatgcgaagaggcgtctccacttgtagccgacgaactgccaccaccttggattgaacttgaagacgatccaccccaaatcctaccccactgtatcttcttcttacctgtagtggggataggagggggtctctgctggcgaacttcctgaaactttacttcatatcttccaaaaacctcatataatttacatctaacctcagtataaaaagaactataatctacacctatagtatctccaacaagtgataaaatagcagacaatccccttaatttacacctaggatctaaaacaaaagcaagagcatacaacataggtatatttttccaatatttcaaatatttttgtttcatgtgaaagacaggttcagttagaacgtcatcattttcgtattatttaaataaagtagcaatttcaagaaggttgtgcaaaattatattagcagttggataataaacttgtgacaaagttagagtacaatcataaaaagtttctagaaattggtaaaatttttggacaattgcccaaacatgctcgttcagtactgaagacccgtcactgtttcttgggccaccacgtgactgaacaaaatcagaaagtaaactactataaggtaaaacaacttttaacattaaatacgttgcattccaccgatgctctgcatcggtggcaaacttacgagctttcacaccggccgcattgcaaaacctcttccatgcagcaatccgcgggttagaagcagttaaccacgcgattgcttgacgaacagcatcgatgtggtcacctaccctcttcatgccagtcttaacaatcaaattaattatatgacatgcacaacgctgatggagtagaaaagattgagcatacacacaaaataaaggttgcaatatttcaatagccctagaattagcagatgcattatctagggtgacagcaaatattttatcagcaagattaaattcattaattacttccctaattctttcagctatgttttctcctgtatgtgagacatctattaacctaagccctaaaactctcttttgtaattgccaatcatcatcaacaaaatgaacaactacgctaagataatcctctctagctctactactccatatatctgaagtaacactaacagagaaagtacatgtactaaacagttccttaagtgcagttgcttccttgtgataaacattctctaaatctctagttgatgtttgcctactcacagttttaaacctagggttatgagattgctgaatgtaatgttcaaaagcaggggactccccaaagttcaggggtaaatcttgcctggcgattaaccggacaagagattcccgagcaaccatgggatcgtactcccaactgtgtaccgtaccgtctgggtttaccataagttgctgctgccggagttgtattccttgcttcttggcacacgactccgcatggcgcttgaggtgacctgtaccaccagaagaacgagcagataaaatttgcctacatattctacaacgggctttcgatacctcccttccgtcggggcatgtttcctttatctcgtcgaagctttgccacacaccggaggttctcgatctcttcgagccggtgtgtgtcgaaacacttccgctcgcggttccggaaaatccttccgaagctgtctccgcctgaaccggtacctcctcaacgacagccgtatgaaccggtacctcctccacagatggtggagttggagccgatccggaggtaccgtcaaaccccgacatgtagttggggtcgaaatcacccaaggtgaacgacggcgactggtatggaaagttcggatccattctgaaaatttaaaccgacataaacaaattttcgaatatttattgaattcacaaacacaatacaaataatacacaaatttgaatattacttacatctttccaactgcgagctcttcaaacctctgcgatcaaactgttgaactacgaaactaattttgatttttgacaaaatttgagcaaattttgtcaaaataaaaaaaaatgcacacttgagaacaaagagagcacttaaaacacttgagagcacaagatgaggagtgtgggatgaggagaaatggctggggttcatgccctatttatagggcgaaatttgagattttttggaattttttcgaaatttttatgaattttttagcctcccaacggttattttcaaatttgaacggtcaaatagccgttagtgccacgtggcgccttcccattcgaccgccgcccgccctgtccgcgcctgacgggccgccggcgtgccgtgccgtgccgtgccgcgggccgtgccgtgccggcccgctacagtagccgtgccgtgccgtgccggcccacgggctcggccagcggcccaagcacggcacggctactcgtgccgtgccggcacggcccgttactgtagcaggccgtgccgggccgtgcctgctacaggttcggccgtgccccgggccgcccgtttggcccggcccatttggccacctctagctagggcatgtcaaaaccctaagactaccatgcatagactacatttatgcatgcatgcatatactactgacataactaaattaagtacacatatcccaaggggaattaagctcttctaacatccattagtgcagtagtagtactgaactctctgtgggttgttgaacaaccgctggatcatgatcagttgcaccagaataacctgacgcaatgccggacgaccggcaacgacccccggccggtttatccggcgcctcatctccggtgtggtcagacagccaaaattctcctcctcgatctcatctcccctctttccaaacggtttatatatatatacacaagctatacatctttccactacttctcctcagctcgctttccccttcaccactgcaacttgctcatcacccacacaccaagcaagcactcactctctcttgctagctctctccaccacaagaagaaactagctagccaagaaacggaggatcgatcgaggttcaggatagagattattacatcgtcgtggtcgtcgatcatgggggatcatcagatgatgcacgcagctccggcggcgatgtacaacggcggcggtggtacgacgagctctcatggcgtgtggtggagcaacgcggtgggggtaccggcggcggcgacgtgctcgacgacgacggagctcgccgggtacaccgcctggtcgtcggctctggccgctggatacgatggcatggtagctgacaacggcggcaagcaggcgaagagcaccaccacggcgtcgtcggagtcgcccggcaacaacagctcggtgaccttccaagagccggcgagcatccccgacccggccgccgtcgccgccgtgccgcagccggggctcgccggcttcaccgactggacccagcctttcatgtgagttatatatacaagccaattaattaactcgtactagctaccatatcatatggagagctagcttagctgagatcgatcctgacatgtttgcatgcgattttgtgtacgtttcatcaggaacaacggtgctggtctgcatgagtttctgcaagatggccaccatgacatgagcgcgtcgagcttgatgaatcactcatcaaataacctagcactgcagcaagcaggtcaccaccacgagctgctgtccagcttcggctcagacctgctcttgtcgccgacgtcgccgtacggcggattccagtcctcgctgctgaggagcctcatggagccgacggcgaagcagcagcagcagcagccggctttggctggactccagcagtatcatcagtaccagcagcagatgggacacgcaccagcagctgctgccaagttcgcgcaggcagttggggccagggattcactccagttcaccaacgacgcgccgttctggaacccttctgccggattcggcatgccggcggctgtggcggtggcggcggcggcggcgcaagatcaagctagcgttcgctctgccaaacgctcgtcgccggcgccgccgcgtgcggcagcaacccttgcattaaaggtttgtacatagatgatgcatgcatacaagatagctagctagttctgtcattagctactttaattttagggcattgtgattgatgttttgttatgtgtatacgtgtagactgctatggaaggagtaggggactctagctcagtgatcaccaagaaggagacagcgttcaagaaaccgagactcgagacaccgtcgccattgccgaccttcaaggtagatagatactcacagagacatagctagctgctatgcatcatgagttgaactcaatctggtttaattagtataaaacagtctgcattatttgatgtcacaataatatataggtcatgcaatttaagagatcgatatagatgcatctttactaaagttgttcgtatgtgcaaattgcaatatacttcaggttaggaaggagaagctaggggacaggatcacagcgctccaacaactagtctctccttttggaaaggtgagggaggcttttgatggccaatgtgcactatattacaaacaacaagagtgcttggaactatgcatcaacatcttctgtgcaaaagagttcttcctttttgatctcctcctcctttcgagatctatacactatatgcaaaacaacacaatcttattctcttctcgatgtgcgcgcgtgcagacggataccgcatcggtgctccatgagaccatcgagtacatcaagttcctgcacgaccaagttggtgtaagtgtgtgcaagtacaccatgattccccacctttaattatagcatcctggagcacgaactcgcacgtttcttcagatgaatcatgcatcagagattcagagaagagagactgatgatcagtgttacctgaacattgtcttgtgttttgttttctgcaggctcttagtgctccatacttgaagaacggtgcccatcaagtgccccacttgaaggtattgccagtgttggatgctgcatgcttgctctccttttcagcattctgatcgatcactgtacttatgatcgatctgtgtgtgtcatctctgttcaagccagtgctgatgatggcttctgcaattgatttgtttcgtttcagaactcaagtcctgacaagtccaagcacggcgagatatcactgaagggccgggggctttgtctggtgccgatatcgagcacgttcgccgttgccagcgaggtgcccgtcgagctgtggactccatttggtgccaactttattaggtagaagaacaagtcctggaactgaagaacactgatcagaagcgtcaaattaacgatcgagtagctagctgctaatatagtcgcctagctagcacaaatcgagatctgatgtttcttgattgtatctacgtactagttgtatgatgataatttcgtaaccctagtagtactgatgctgtggctgtaatcagcaaagcactgagctagttagctagatgaacctttggaatgagtgcttgaagacttggattcattcttcaggttcatcacagaataaggaatcggctagttgagaggggacagaattatgtactgatcatcatcaggttcttatgattggttgctaggttgcatcgtatcaatgagtagttgcggaagaatttgttatagaattgatggttcgattcaatggtggatcaattaagtaatgtagcaggtttctctctgttgattgtaccaaataaaagtgccatctctttgattaatgataccttttgcttgcttctcttttaaatctgaccgcatgttttgctattaagtagagcttcaagaatttgtgcatgtgtttcttttgcttaattatttccagaactttcaggttaacaattccatttctgtagtgcatatcagcatgccgaacacttctgcttgggcatattctactcatctactgcattttattattatatgaacaaagataggaaaaatgcaaattgatccattgataaaatcatattaggaagatattttgacgtatgctgtcaagttcctataatttcggtgctcagtattatatcaaagaatggttagatttatcatatatggaaatgcaaaccatttaatttggcaagaaaaatattttcacaaatataataattttataattaccattttgtgacttgactactgacttcggtaattccgtatatctcttttacccactgacccccttgttagggacgctaacttcgactggctggtctatatatgccagtatgcttatgctggtagcattgcaccatatccaacccggcaacatatcctatgcacacaggccctcacgtgtacacacgtgcacaccaactaaaaaatatcacaaaaaaatctagaaaaaatcatacacatactttcaattgtattacacctagggttaaaatcttaacgtcaaattcattatattttagccgtaacaaaaaaaacaaaaaatctaacagttttaaggttgcaattttgtcagaattttatcttttttgttattctctatgtagaatgaatttgaagatgcgactttgcacgtagatgtaatactattgaaagtacatgtatgaattttcctagaattttttgtgataatttttagttggtgtacatggtgtgtacacgtgagggcatgtgtgcataggatacgctcccatccaacccttatggtctagttgagtccatacgcgtggattagtgactgcatgagcgaagcctttaccctttttccagagaaaattgaacttttttttatcacaccaatgctcttcaaaagaaattcaacgcaccacatgtccaatacaattctggttctgttgagggtgttgaaatttcaaatagcatgagtaaaaccatagcttttaacccccaaaacgaactttttaccaagattcatggttggtatacagagtcaaaattcaacagaaatgctcttcaaaagaatttcagtgccaaaaagtagagggagatatgtcaaatagttgattttcacccaatccattaatatttgtactgcacgaatacaattctatttgaaccctttatttcttagaactgagtgaaccatcatgtgtatctgtcatggaatttgattcaagtttcacttgtatgagagctacaaccatacatgttattctccttagtgaaatggtaaaccaaatgcgacgaactcctgtaaagctagcagacaagaacaattcaacatcatgcgcaaaaacacaataatagaattcagtccttactgaaccactatgtacatctagaagatatatattataaaaatatataaaagtttggtcaatcaataaggagcattaccctttttctctttatttaccaaaacatttagaaatccatgagctagacatctgcattgcatccaccatctgcctccccggtttgcctttgccctgtattgtcagctcagagactcacatagctgcattggttctctgcatgctcaattctgttagaacatttttacatgactagccaccagaatgcacaatatggccggcttgcgagagtacctgacagtgacaaaagaaggctacactgcaaactcatctcagtctcggccacctgttaactgaacctatcagatccaacaaagatcagcaagacaatgtttttgtagctataatatgatactattgctgaatgccattttctttttctgctgacaaagtgatgaaatgtggatgattgggctgagttaggctgcaatgttgaagaaagcagatctctgaaatcttacaggtcatggtcacttgaaaggggctttcctaccttcctgatactgagagatttgcaagagcctcacttgctgacattgtcatttactggaagtcaagcccttgtacttccaacggtttctatcagctgcatctcaaatccgactgctcacagctgtaaaattattcactttttttctgaatctctgatgaaagtcaagcatgtgcttccatgtcagatctcctcctcgctttgctttgagatctcgacgagttctcgttaacctcgatgggtgatggacacagacgggttggtcgccgtcagttgtagtagatccgacgggattgtccgcggcggcggcgaccgaggtgacggccggcggctgcgaagcgaggtcagggaagcggaggagatggaggacgagccgccggagagcagaccgccggcggcgagggattcggcggtttcggcccatgagaagaggcagatagggtaccgatccaatcttgacccgaatttaactatttgccattttgaggtttgccaattatccaaatattgcacttaataatttgccattggagagaggtaatttcttaactatttgctatttttgcatatgtgacgtgccactgtaccgtgccagcgtggaaagtaacgtgggccccacccgtcagcccctctcctctccttctctatctccggtcggtcgtcgcccacctcccgccagccccgcgccgtcgtcggccgctggccccacgcgacagagacgaagagcaggcgaggagtcctggcagcaggcgcgtggcgcgctccctggcgaccaacaaatggacagcgcatcggcgaggaagcccgcgaggccaaagagaaggcatgcggcggagaaggccggggtggagaggaggcggcgaagcgtggcgcggcgggaggtggttgccgaggagaagaccttcggcgagctcggcatggcttcggcgaactcgccggccgctgtcgcgtggatcggcgaggcacgtcggatcggagtcgggggagacgagaaggagtagtggtggtggacactgtcgacggtgcggggcgagcggggctggcggggggatgggcgagcgcgggctggtggccgacgacggctcagggtcagtgcgggccggtgggaggtgggcggcgaccggagatagagaagaaggtgaggagaggggctgacgggtgaggtccacgttgcttttcacgctggcacgtacggtggcatgacacgtaagcaaaagtggcaaatagttaagaaattacctctacaaattattaaatacaaacataagagggatatttgaataattggcaaacctaaaagtggcaaatagttaaattccgctccaaaggtaggcccgaataactaactatacgggccctttcttcaacttgggtccaaacaaatcggcccgtacccacgagtgggccgatgcagcaggaatgggcttgttcaagttttagattgcagtcaggcaatggacaaatggcatagaagattagaagatggaactatactgatgttttccatccattccattctgagctaacccttacggcatgtttggcgacttaacaaaaagggattggtagtttagaggaggaagttgggagtttcatttttatttctcgtcccttggtagtagagatgagaatcatacaaagtttgagtgggaattaaagttcaagtgatgacatacaattcagatatatcctgacatacttaagaagggaatcccctccaaattaactgttactaaacacatattgaaaagttgagattttgctctcaaactctccttcctaattcattctaaaactccgacacccaccatccaaacaatttcctccaaccaaacgcgcccttaataagatgattgcatttcactgacataactaggatctacaatagatgtcaggacaattgtccgtcgtccatttggcaacggatacaaaatttgttgataatggattatattcgtttcaaaagcagaagcaatgaatcaccattcctacaataacgcatagctgcagaaaatgccgaaatttacagacaaggataaaacaaatataaacattcatctcccctccaaggctgtaatgctcacgccattcacggaattttccatattctctcttgcatattcagttgcgcgttttttgtgcacaaaaaatataggttgctttggttgaggtagcggtgcagtattgttctctaacatgaacacaacagatgacatcagcggcctatcatctggatggtcctgaatgcacaagagcgctatgtggatacatctcaaaacttcatggagtggacaactctccacaacgctcgagtccaccaaatcccttgcatttccatctttccataagctccaagactacaccaacagaatataagaatcagttacaaaagtatgcatcgtttgagctgaagaaattaagcattctgctgctcttacataagctataaggtttgggaagcccattatgagatggggtgagctgatcctgaagccacttatgatctccaaaagtagaataccaaagctatatatgtcagacttgacagaaaagattccttccattgcatattcaggagacatgtacccactgtttgttaagcggtgaggaatgcaccgtttgaatcagtaaacatgtaaatttgatcacattaagcattagataattcatgcatcacttactatgtcccaacaacacgggtggtgtttgcttgttgctggtttccaccaaagatccgtgccatgccgaaatctgatattttgggactcatttcagcgtccagcaagatattgcctgctttgagatctctatgaataattgttaatcttgaatcttggtggagataaagaagccctcttgctacccctttaattattttgaaccggtttggccaatcaagcactgtttttcttgtagcatctcccaatattaacatgaacaaagtgtatcgtcagccatcattcagtatatatttttactaattcactaatcatttaatataaggccggaaatcagaacataccaaaaaggaaggcatccaagcttttgttcggcaagtattcatagatcagtaacttttcatcttcatgaatgcagcaaccaacaagtttaactagatttctgtgctgcaatcttgcaataaggacgacttcattcctaaactcctctattccttgcccagaacccttactgagccttttaacagctacttccttgccaccttccagaattccctatgtgagcaaccaaatgttcaattaaacaagtaaaagccaaatattaactggaaatgtcaagctatgacattaaaaaaaaaagaaatatcaagatatatcttctccttaccttgtaaactttgccaaaacctccttttccaagcatattataactggagaaattgtttgttgcaattacgacctcttcaaacccaatgaatggaaaatccacatcttcagccccaagttcatttgaggcactcaagtattgtaccataattttgttctggatttccttgcttcgctgtttgcctaacaagaacagtattatatagaaattgttttactaacaaaactacatggactgcattttgagaagtgatgtgagtgttgttgtaccccttgatttgcatatccacacaaggcatatgcatgtgaggatcagtaggctagccacaactggaaggacaatcttcactacatcagtctccttcttgactgctgcagaaatatagtccatacaagagaatgggactttcaggttctcttcataagctgcttgcaagtgcatggactagatgcactttactattagtaatgtttcattttaaccatatttgatgctactacagacttcagatgaattgtgaattttacaggcagatttagtgtgtctgcaaacatcagaggaagtggtaaattggcaaatctttacacattgggcaatagagtattgggtcccatagtagcagaagtggcacgccaaaagataggccacaagttgctaatgcagcaggataccaatttgagtcctgtcaatggtacatgaactggactgaccaagaaatgcatcggctagaaaaaacaaattactgaaatcggtgtcaactgaacaattggtcgtaatatactaggctatgtttcgtgaccaccattatctttcctaatataacttcctcaactaaagagtaagagcaacaagtgcctaattcagcaaggtgcccattcagtatgaaatggattagaaagcatagatcagaaagaatgctttataaaacagtttagaaagctctgggtcaagttaaaaagcataaaaaaaaatgcgtaatcaaattaattaatacttaacagtgcataagtggagtaagtatgggcattaatcacaatgtagaggcatatgatgggcagggaatgataaaaagtaccagttgggctcggaagccggaggtacagattctcaccaccaccagtgacctttgccaggtctagaagctcccccatccaaaccaagcacctcgatgtgtcacccatcatgctggcagtgctcaggttcgcgtaagcatatgctgtgcaagagcagttgtgcctgcactcttccatgcactcatcaaggcttctgttcctgatgtacaagaacttgtcaggtgttttcatgccaggcaaggtcaagaaactatctccatagctacatttcatctgctcctttctcacacatcctcttgaaatgttaagaccatcaggcttgaatccatcaaggcacttgcatgttgggaatgcctccgcagcatcacaataaccaaatggtccacaggaggcatatctttcgcaagtataagagggattgctgaataacacagaccatgcaaacaagttgctgttccagatcagcatctttattgttcctgtgtagtcgagcatcaagcgcatgctaggagagtcatcagaaacagagtacatcatgtatatctcattccctttgttgatgattgtctggtatgtcacagagctggtattactctggaacatagcagagaccaacgcaccattccatgccccactacgccagtatggacttgttccattccaaaccaaaacctggaaatccgagttggggtcaccactgagggaaaagttgccggttgatggatcatcagggcccttccaagaaacaatgcgctgagcaacctggccattgtatttcagcaagagcttcatgccagggaggatggtatcagtcaaatgatcaaagctctgccacaagattgtgtggttaggagatcgaaggaccaaattaccagaattaagaagaactaccgtggctccagaacctccagtggtgatgttgttccttgcttcccaaagagtgtggcctcccgattcagacaacacaaggtcagaactgttggagatgaagagcatggcagaagaaggggcagtgattgggttgtcacggttggcaacccacaccacggtgcgattgggaatcttgtggtaccatatgccaacatataaggtagcatttgagtttgttggggagaagaaaccaagagcaaaaacaccaccatccgagattagcatgtcaccagggtagagtggctttgcaggtgttagctgatcatctgatttgcacaaagaaatcaagaacacgagtacgaaaacggtagcgaaagccgtgcccattaggccttctattctgtgtaaggttgagtaagcatggaagcaattcttccctccaattgtaggaagctcttatcagcgaggacacgcaattggtaggaactatgaacaacaagccaaacaagggtcggtctcatccagctgaacaaagttgactcaaatgatttggccatccagcaaatcgtctgcccaacttgagccagcaactacataatgccgtctgagtgaaggttccttgaatttcattaccagggacagtaagtcaaatacatcggcacatctccatccagaaatacaaagtcgaaagttcatcgaacatgtgtgagtatgacagttaaaaggggggaatattgagaaactggctggctcaccaagtcaccatcggttttagctcgcggcggaggcgactgaagcggaccttaggtctccggggaaatctcgccgtagacggccggcggctgtgatgggaggtccctggcggcggaggtaggagtagggcaccgtcgaaggggacatgacgcgagtcccccgacgaggccccggtcgtggccgtcggcgagggaggttgaagcggagggacaaggaggcaccggcgggcgggcatggtgggcaggctgtgcgcgcggcggcggcggcggcggcggcgcgccgccggctgcacaggttgtcggaccgagaagcttcgccggctcgccgccgaaggattcggcccacggacatgaattggatcgtaaaccattgcttccgaatcaatctgggcttgcccatatccatactgagctgcaaaggtcatcgtggccgtttcctcaccatgcggcccagtaaatcggcccgtcacatccaccccacttcgctttcgtcagagatcgccgccgtcgccgtcgccgccgtcgccgccgccgccgctggatggaaccggatctgcctgcgcgtgctcgatagcttgcaagaccgatcagttggcgaatcctgaatgccgcagcggcgcagccgcctcggctgcttcccgtcgggcggcgctcccatggaaggatggggattggttccgttaacgcagatggtgcgtatttcttcaggccttagatccatgagagttccagtgcgccattgattaatagggtttatccagatctccactgtggaatgtggattgtgattgagagtattgcttcctggttggtggtggtgtgcaggtttcgccttggcctggggctttccatgaataaggcggcgccggcgtgctttgctgctttggacaacgcagcagcggatgcccttcaaagttcaaactcgtcacctgtaagcagactgcttctttcctatgcaatgctatcaaatgataggatttggccaaacgatttgcatttattagtctgcaaatttcagagcaagccaaggctgcagtagcagaaatagttaagtttctgaaatatggatgtatggaagcattccttttatgcaaccaagcaacaaagaaaatgctggttacaatgtattgctcagaacattttctgtgtataaatttgaattgctaatgtataagtgtacaactacaagctacagaagtttatagactaaacagggaatggtgtaataaacatttaacgtccctctagtgctgtgatactcacgttatttacagatctttccttgttttctctagtgtctttagttccatagaccctagctgtcaaataagcagactcctttggggtaggaagagcagctgtctcgttctctaacatgaacacaatggatgacatgagtggcctggcagttgggtcatcttgaacacatgaaagtgctatttgaatacatcgtaaaacttcgtgaagtagacaactctcccgaattgatgagtccaccaaatccattgcatttccatctttccataaactccacgcctgaaccaagatatacaagaaagttgtggtcaatttattttgcaatgttttactgattaaaatgttgaggattgcagtccacttacgaaggttataagattttggaaatccattatgagatggggcgaactgatctttaagccacttacaagctccaacagtagcaccccaaaactgtaggtgtcagacttgacagaaaaggagccttccaaagcatattcaggagacatgtaaccgctgtttagatcattccaaaaacaatgtaatgtgcagtttgaattagttataatgaaaacatatatcattaggtggtctacaggttacttactatgtcccaactactctggtagtattttcttgttgcttatttccttcaaagatccttgccatcccaaaatctgatattttgggactcatatttgtgtccaacaagatgttgcttgctttgagatccctgtgaattatcgttaaccttgaatcttggtgcaaataaagaagccctctcgctatacctttgattatcatgaaccgggtcgtccaatcgagaactgattttcttttagcatcttccaagattaatgtgaaacaaagttaattgtcattaaccatgaatatcctcaagaatgtttgtattatacgaccacaaataagtgagtaacaacgtaccaaaaaggaaagtatccaagcttttattaggcaagtattcgtagatgagtaacttctcatcttcgtgaatgcaataactgataagcctaactaaatttctatgctgcaatttggcaatcagaactacttcatttctgaactcctccacaccttgctgagaacccttactaagccttttgactgcaatctccttgccaccttccaacactccctgcacaagcacacactctttcaattgaacaagagaatataaaagatatttcttctgaaattgccaaggtaaaaccttttgtaccttgtaaacttttccaaaaccacctttcccaagcatgttgtgatcagaaaaattgttcgttgcagtgacaatgtcttctaagcaaataaatggaagttctagattgtcattctcaagttcactggaatccttcaaatgttgtagtctatgtttcttctgaatttccttgcttcggtgtatgcctggcaggaaagcctttcatataaattgttaccttagaaacaatgcagcctgaaaagcttagttggtgttggcctacctcttgatttgcatatccacgcaagacatatgcacatgagtatcaacaggcttgttataaccggaagtacgatcttcgggatgtcactcttcttcttgttaactgcagaatacggcccaccaagagaacacggattataaaatttgaggttgatatggagtagcacattggatatatgttctttttcctttaacagaaggtatatattccttttttgttttcttcagaagagtcctatcaagtagtgaacatttttttgttcgtggaaaatcttggcctggcaagacctctgcatattcagttcttcagaaattctataccatgccttgcaagtgtatatatggatgttgcttttaattcgatgagcaggctatctaattaagagctttattttcaccgcagggcaagagaaattgggcataccagtagagtcggccaaccggaggtacagattctcaccaatgttggccctcccagtgtcagcaagttcccctgaccaaagcaagcaccttgcctggtcggctccggtcaagttggcgtaagcgtaggccgtgcacgagcagttgcggctgcactcggccgcgcactcatcgaagcttctattccggacatgcaagaacttgtcagggaccttcattccggccatggtcacgaagcgatcatctctgccttcggcatctcaattgctgcttcctccggcatcctctcgaaaaagagttggagccatcaggctcaaacccatcgaggcattggcacctcgggatggctgccgttgcgtcgcagtagccgaatggaccacacgaggcgtagggatcgcacacgatggtgggtgatgggcgctggacgacgactgtccatgacgacgcgctgtcgttccaagccaggaacttcaaggtacccgtgtagtccagttgaagacgcttgtaaggtgagccatcagaggttgtgtatatgatgtagaactcatcatccgtgctcaccgatgtttcgtagatgagagaggtactgaatgagaagaccgaagaccacatgctgctaggcccaaatccaataaagcggatatatggtctggtaccgttccaaaggaagatctgaaggtttgagctgggatcaccgctgatggagaagtctccggtggaggggtcatctgggcccttccaagcgatgcaccgcatggcgacttgtgccttgtagctcaccaaaaacctcatgcccatcagaagggtgtcagttgggtgatcaaagctctgccatatggttgtaccattcggcaaccggagaaccaagttccccgagtcgagcagcgccgcgtaagctccgtcgcctccggtggccgtgacgttcgtcgtccaaagggtgtgattgccggaatccgacaggacaaggttagagctgttgctgatggcgagcgttgcgaatgaaggggtggtgattgggttgtcgcggttggcgacccaaacgtacgtgcgctcggactcggagatgttgtggtaccatatgccgaggaagaagctctggttggaggctgttggggagaagaagccgagcgcgaagaccctgcctttggagatgagtacgtcgccgggggagatcagtcgatttgcctgtgtgagctggtcatcgcctttgcaggaagagatgaggaacagcaaggagatgaaaactgggaggcaggccataatctggtaaatctcatatggccttgttcttggctcgcctgtggctatgaagcgtgaacaattggcacctttgatttttgctactaatccatacacgactcttttctgaacagtgaatttagtacggtgggccaacgaagtaacgcctgaccgggacttgtctgcccctctggtgaagacgcagtgtcaaaccgcaaactaattactgtagctacgacatcagggtcagctgattaaactttcgagagagacgcgaccgtgaaaagttggcaagagagcgaaacctcgcggcatgcgcgtgtgtcggccggtcgccgccatggcgcgttacgcaatgccgagaggcagcaggtaggcaggtagtcagtgttgtaatgcaacttgtgcggttgtgcctggcacacgggaagtccgaaacatcttcgctgactctcctgaacaaaaacaacaaagaaaacgaaaatttcagtctcaaaacgttgcgcgtgagcgtgatgacgctgggacacacggggactttgtacactaatcaacacaggagttgatggcgtcaagtcgtcgattttttgaattttatttatttaaatatttacataataattttctagaaaacttttagaaatctacacctaaaaaacgacgtctaggagagagttttattttttttatgacgtggcacacgggtgttggcataccgcgtaaaaagaggccggctattttgcaagcaattgccttgacatcttcccaaaagactataaggaggccacctgcaaaaataaccgagaatgttattttacaggcaaccccttgtcacatcttttgagatgttgtgaaatggccgcttgcaaaatgctctagccatcatttcacatataatcccatataaccttctaataaggcggtaagaatgctacttcagcctctttctatgtgaccgttaacatgcaccaatgaatatgtgccacgtcaaaaaaaaacgttctgctaaaagtggtaggggtgtagattatagaaatttgaaaaaatatttcaataaataaaattaataataaacagaatttgtgtcgtcaacggcttgctgacgtgctccatggcagcgctggggctgtaacagccggcctggccttatgggcttcatggattaaacatgggccgcgggtgctatatgtgggccaatccatccgtggccgtgtacgcagggccgaatcagacccagttgggccgcaggtacaaaacccttccgcgtggagttcagacgacggagaagagggcaccgaccaccgagccggcagcgggcggcgccaaccgggaaggcggttcgtccgccaccgcgagcgcgcgaggtggcgcggcggcggcgtcagcgccggtgttgccaggcgagagagctagtggttccgcgtgtccggggagcagacgtatcacggattcaccacatcgtggcagggcaggttggttaccacccccttgatccttttgcccccaaatctcttgccgatttgcccatttggaagcgacgaggagacatcatttgcattggaagtaggaaccacaggcgctgaagattcacacaacagcttcttctttttttttcagtccttcggtgctgcgggagcactttggtttggagaccttccgccaaacgaagatggactttcagagacctgaacaagcatagcaggtgatcaaatcacaacaaaactgcctgtgcaagtcattcttttcaacatctcatgagtgaattgcacatggaaccacttatttatttttacccatatgttgcaaatcggattaggggtacatcaatctgcttatgcaatgcattcttttacaagatctataaacctcagctcctactgtagtaatgtacaactgcagaaactgcttgagagtttaatctcttacagtctagcggccttctagcgctgtcaggctcgcgttattaacggaactttccgagccttgtctttcttcttcgtcgtaatgcctttgcacgaaatatataggctgcttcggtattgggcgtgccatgtcctcgttgtccagcatcgacacaactaatgacatatgcggcctggcatttgggctgtcctgaacacacaatagtccaatatggatgcattgcaatacttcattaagcaaacagctctccagaaccattttgtctacgaaagcctctgccattccatctttccacaagttccatgcctgaaagtaataacattagtaaagatttcttaacttgttttaactatattgtgttcgaattgttaacataagtattggtagcagcatgcacttacataagctataaggttcggaaaatccatcacaatatgatgaggggagctgatctttaatccacttacaatctccagtagcaatacgccaaagctataggtgtcagatttgactgaaaaaatgccttccattgcatattcaggtgccatgtagccgctatttaaatcatttgcaagcaagcaggaaaaaagtgaataagttcaagcacatgaatatgttgaacaagtcggctagagaacaagtccacttactaggtcccaacgactcgtctagtacttgcttgctgttcactgtttccaaaaatccttgccataccaaaatctgatatttttgggttcatctctgcatccaacaagatgttgcttgtcttgagatctctatgaattatcatcattcttgaatcttgatggagataaagaagtcctctagctacccctttgattatgttaaaccttgtttgccaatcaatcacagacttcattgcgtgatctaccaagaaaatggataatggacaggaatgaacccattagagaattcgataatgttgactcctccattagagtatgcactttgtcttaatggaaattcaggtggggaacctctcccctccggtgaacattccaaaaaaaaaaaatcaagacttttttttaatgcatccttttctgaaaaacaagcttttcatttaatatctgataaaacttaccaaagaggaatttgtctaagcttttgttgggtaagtattcataaataagcaacttctcatctccatgaatgcaacaaccaagaagtctaactaggttcttatgctgcagttttgcaataagaactacttcattcctaaattgctctaccccttgctcagaatccttgttaagccttttaacagcaacttccatgccatcttccaatgttccctgtggtatttcattaccatggagacatggtgttaaacaagaataaagtgacatgaatgctacactcacattgtgtaatttacaaggtaaaattttataccaccttatatactttgccaaaaccaccttttccaagcatgttagtttcatggaaaccgtttgttgcagaggtgaggtcttcatagctaatatcagggaactctagattttgatcccatgagtcatgaaaagcactcaagtatcctagctccgtttttttaagtacttccttgtttcgtcgtatgcctaatataaatatcaaaacatgtcaacacaacaatattacatttagcagctgcatattgcaagtagctgttatctcttgctttacctcttgactcgcatttacagagtacaacgcatgagcatgctgtcagtatcagcaggcatgctatagctgggagtacaatctttacaatgttcttgttgtttactgcagaatgacatttatcgtcatgttcatggagaatgtggggcaattgctagagaaaacatcatgagacggcgcatacctgcaggagagccggcgagtcgaaggtacaggttctcaccaacggcactggctttctccgagtcgagaagctcccccatccataccaagcaccttgaggggtcacccgtcgtgaggatagttctcaagttggcataagcgtatgccgtgcacgagcagttgcggtcgcactcatcggcacactcctcaaaggttctgttcctgatgtacaagaacttgtccggcaccttcatccctggtaaggtgaagaaatggtcttggccaccgcatctcagctcctcctttcttcggcatcctctggaagagttgaggctaaatccatcggccggctcgaagccatcaaggcacttgcactcctggaagctgccggtgatgtcgcagtagccgaacggcccgcaggcgccgtagtggagacagccatggcctggtcgctcgaatgggctcgtccaagtcgatgatacgttgttccatgcccggaagctcacgttcccggtgtagtccagcttccagtgtgtcaaaatgccatcagctgcgttgtatatcgcgtagatctcctcgccattgtcaacgatctgggaccatatgtacctggtgaggccggtgcccgtcgcgccgttccagacaccgttgcgccacgacgggctcgccccatgccaaatgacaatatgaacccccaattggtcagggtaaccgctgaggaaaaactcgcaggtgaacggttcgcgacgacccttcaaagcaactacgcgcaccgcttcatggttctggtatgttcgtccatagctggaagccagggaggccagggaggatcgtgtccgtggggtgatcgggcaaccggagcacgaagttgcccgtgttctgcagcaccgcggtggctccaccacctccgatggtgaccgtgttcgccgtggtccccttggagtcggatagcacaagcccggaggtgttggtaacagccagcctcgccgtatgggtggtgattgggttgtcgcggttggcgacccagacataggtgcgctccgggatgttgttgtaccatatgccaaggtagagcaggcttggggttgagttggtggtggtcagggagaagaagccgacagcaaagacgccgccatccgagatgagcttgtcgccgccggggaagatgagtggctttgccggtgttaggcggtcatcggattggcagaaactaatcaagaacatgaagatgactacatgcagtctggtcatattctcttgtaaattccttggaaagcactacaatcctacatagagacgatagaacagagttgtgagattattgggccaaccttcttgtcggcagtatagagtaactagtgcagctagcttcgtaaaagagtaggattatactatcgtaattgttatatttcccaggccctgaaatagcgcaatagatattctgtattcctgtgttgagagtgagaaaattgggattatactaccgtaaaagagtggtttcgctggaatgctatcccttcaaactgattcattaaaatgctattctaaattgaaggtgttcaccaaaatgctattttcgtttttttaggtaaatagaaatgttttttctcaattataacttttttccggaccaaaatacccctgatgcgggcccacctgtcatactccctctactctctcctcctcttcatctctctcgagggagcgccggtggttggaagcgagcagtggccgacagcgccgttgaagctcggtgtcggcctgtacgacagcgccggcgactcgccaccggcgtacgacggcgcggtgctcggcggctgcgatggcgcgcggaggcgccgctgctcgtggtacagcacctgcaccaccgtctgcaccggccacataagcatttagtggagtgattaacgaaggatttagccattttttagtgatcgatgtgaatggcagcttctaaccttcaagtagatgtcgatggcgtggtacatgccgtcctcgttgaacctggcgtgctccgggatgagctcggcgagggcggtgaactagtcaatggacaggttctcgtcggaggcgatctcggcgaggtagctctccatgagcctgccgacctgggcgacgtcgttgtgcggcggcgacaccgctgagctgaagtcgtcgtcggtggtgcaatccagccgtggcggcgccgccgccgcgtcgccctcatggtcgaggtagccggccaggatcctctgcacggcgtcaatgtcgtaggccgttgtggcggcggcgtcgggcgaggaggacgggatgaggaggtcgtcgagcacgggctagccgagctgcgccgccatcagcttttcgaggtcgagccggcacgccagcgacggggacgcggtgccggccactgatcgccttccgccaccggcgcttcctcgatagaggggagggggagaaggaaagagtggagagtatgacatgtgggcccgtagcaggggtattttggtccagaaaaaagttaaaattgaggaaaaaaatttctatttacccaaaagagtgaaaatagcactttggtgaacacctccagtttaagatagcattttagtgaattagtttgaagagatagcattccagcgaaaccactcttttacgatagtataatcccaattttctcgttgagagtggccagatgatcagaacgacacgctagtagttgtatgtcaccgttaagattgaagacccgatttattgctcaatgacttttattttcagtgcttgatgaagcaagtcagcacgcacagggcatttgctagtcttcaggagaaccacttgcaacggcagtacggcaggcaagctattttaccagcacaactaatcacagatttacaggcaagtgttttgctgtgcatctccacaaatatttcccggtgattcttcccagcgtcctgacttccgagccagtgatgagagtgagacggtggaggtgcttcaccgggcagcggcggagaggcattggcatgggccgcggcgagggaataccagaacaaattcggcccaccagtccgcgaccggaactgtgagattcgtgggccgtgaaagtgctcgtgatgggctattgggcctaggtcgattgatctgtggacgaagacgaacgtgcttcggttacttcgccggcggagtggtggttggcggcggtggggggcggtgagccggcgacggtcggcaccgcacgtcgaagcgcccggcgtccgcggtctgccgctcccggtggagctcggcgaggtggcggaggcgttgcagcctaagagaggaagcgctcggttgaggcggtggacggcggagtagcggcggccgtgggggcaggtgccggcgccaccgccaccgcagccggcttaggcggaagagacggcgggcctaacctgctactgtcccgtccccttacgcggtcacaagccattgacgccaagctggttccccttggcccttgccacttccacgccggcagcaacatccctgctacttgaggccaggtacagcttcttctttttttttttagaggtaaatggatagaaatccggcctctatggaatggaaatcatggccaggcattgctaatttggatatctatttcaataccaaccatagtctttggttattatcttctattaaaagccggcttatgaccttttggctaaaacaaatggtttaattggtttttaaaaatgccattataatttgtgtatttgtaaacatgtcacattcttttaggtttatgattaacttcagataaaagcaaccacatgtggaatagaaatacagtgtttgcaaatttgtaagcaataccttgtctgcaatgtaacattttttatatataaataccaatcaataagattaatattcacaagcattcttcaccacgcagcaaactccactgttttccattaaagatttaaagtcatatatcacatcactgaaattcattatcataagcattaaattgtaaaaacatagaattatctatgctgaaatcatgtatagtaaagcttgacctcttagtctagcgtccctccagtgttgtggtactcattgtattcacagagtacacactttcttctgtcgcttcttgtgttccgtggttcttcatttcaaaatacacaggctgctttggtgcaggaagcagcgtgctttcattttctaacataaaaacaacagatgacatcgatggtctatcattcggatgatcttgaacacacaagagcccaacgtgaatacacctgaaagcttcatgaagtggataactgtcaacaaaaaacttgtccaacaattctgttgcatttccatctttccataatctccatgcctgtagaatgaagttctgaccaaagttactaatgcctgttgctccaaaatactgctgactgctaaagtttaatttggtatcaaaattatcggcattttagagtacttacataggctgtaaggctgaaaaagtttggtgtgagtttagatgaactgattttcaggccactgacaatctccaaaagaagaacaccaaagctgtatgtatctgacttgaccgaaaaggcaccacccaacacatattcaggagacatgtaaccactgtataaaccatttcattagcaatgaatgcacaatcgttggcaaggattaattcacagtttgaatttaactagtcaataaaacctagagtgttgaaaactatctagtgggctaattactagttattacttactatgttccaacaactcgagtggtgtttgcttgctgctgattaccatgaaaaatccttgcaataccaaagtctgatattttggggttcatttctgtgtccaacaagatgttgcttgctttgagatctctatgaattattgtcagtcttgaatcttggtgaagataaagaagcccttttgctatccctttgattattttgaaccttgttggccaatcaagcacatattttcttgtagcatctttcaacaagatcagtatgtacaaaatctaatgttagtcatcataaatatattttagtcaatgtaagaacctttttgcaatgggatagaaagtcataacacaccaaaaaggaaggcgtccaagcttttgttaggcaagtattcatagatcagtaacttctcatcttcatgaatgcagcaaccaagaagtctaactaggttcctgtgctgcagttttgcaattagaaccacttcattcctaaactcttcaatgccttgtccagaaccctcattaagccttttgacagcaacttccgtgcctccctccaatattcccttcatgttgtcatcaatataaatagggaaacgctggggcagtaatattttatatagtttcaaaacgtgttatgatgtagataaatttagtactctttcttaccttgtaaactttgccaaagcctccccttccaagtagattggactcacagaaattatctgttgcagccacaatatctccaaagctaataaatggaaatttcacattttcacctccaagttcattggaggtgcccggatattctagcatcagtctcttttggatttccttgttttgtttccctgataaagttcaacacatgagatttttacaatatacttaagaaggtaccatctggaggcactatacaattttagtgtaaattcccggtatctctatagtgtcgaggcaccagtgctatctcaagaaccgtaagtcattgtcaatgcatttatctttcaaattacgaagtagctttacatttggaagacaaggccttatatcatctacctctgtgcttgcatatccaggtaaggactatgcatgtgagtagcagcatgcatactgttatcggaacaacaatcttcagtaacctgtttttctttccaactgcagaaatgtacacctcagatgttagtgttatggcatggagcataacttggaaagttaagtgttcatataactacatttttttataggaactctcatataatatcatgagcattgccactatctgaaaacgaggcgacagtgtgaaattttgcttaccaggaggctcagcaaggcggaggtacaggttctcaccaaggctggccttcttctctgagtcgacaagctcccctgtccaaaccaagcatcttgacgggtcagccatggtgccgccactgctcaagttggcgtaagcatatgccttgcaagagcagttgctgctgcactcggccgcgcactggtcgaagctcctgttccggatctgcaagaacttgtcggggaccttcatgtcaggcaatgacacgaagcggtgaccgccctctccgcatctcagctcttcctttctccggcatcctgattgcgagatgctgggatctacaggctcgaacccatcgaggcaccggcacgccgggacggcccccgtgaagtcgcagtagccaaacgggccgcacgagccatagacctcgcagctgccggcggcggggcgctggaagatcaacatccatgacgacgagctgttgtcccagctcaggaacatcatcgtgcccgtgctgtcaagtgtgaggcgtgtgtagatggagctgtcggagacagtgtatgagtagtagagcttgttccctgagtcgatgagtgtttgatacatgaataagctgctgttactcggatactgggcgccggacaccgtcacgctggttctgacgccgttacggcagtatggcttggtcccgttccaggtcatgccctggaggtccgagctggggtcgaggctgaaggagaaatctccagtggatgggtcatcatggctcctccacgcagtgaggcgtccgatgatctcggacttgtagctcatcaagaacatcatgcctgcgaggatggtatcagtcgggtgatcgaagctttgccatatgtcggtgccgtttggcaaccggagaacgaagttccccgtgtcgagcagcacggcggaggctccggtgacgctgatcttggttgtccaaagaatgtggccttgggagtccgacagcaccatgcctgagctgttggtgatggcaagggtcgctgacgaaggggtggtgattgggttgtcgcggttggcaacccacacaacggtgcgctgggggatgttgtggaaccagactccaacatagaggctattgctgaagttggccggggggaagaagccgagggcaaagatgccgcccttggagatgagcatctcgctgggaaagattggctttcccagtgtcagctggtcatcggttttgcatagaggaatcgagagcagcaggaggaacatgagaaaatagaccatattgcctgttagactttctgcttcgtttgcttgtcatgggtcaagttatatctttcattcataatgcagatatggactggtgtagttggagttcaattcccttgctgtcacctcatctgaagatcaggagaaatgtgagatggctaagtcctgattcagactcatggacagagacagtaaaggaccctgtctgaattctgatgaccaggtcacctggtcatgatactccaagtcgtgtgacaatgctgcacgaaaacgaaagaatgctgctgccatggactttggagtgataggctagtgcaggcaaaagcgaaacctcacgtgcgttccatggctccacgtggtgtcacaggcccttgatgctgccactctccatttgaagaagtacaataggtattaaaaccaattatgatttttatcccaagttatatatatatttttttgaaggaaaggcaagtaatcgtagtctttactgctctcttttagcttacctagttttgagcacagtggtttcaattctccactctcttttttcttaatcgcctagtgcagaaacttccaactcaccaataattgagcgaaattgcttatggaagaatttccttttttttttttttgtaaaccattgaagatgaaccatacacccacaaagcaatcatattcctaggttcttgcacaattgatcaagtggtgaattctacagccagctatatctgaaatttaaacatctaacgtccttgtagtgtggtaagacttgtactgttcacagacttgttggcatcctctcttgccccttctgccatgcaattccttggcacaaaatatgcaggttgcttagaagtaggaagtgttgtggcttcattctcgaacatggccacaactgatgacatgagtggtctagcatttgggtcttcctgaacgcataacagtcctacatggatacagagcaaaaactcattaagcgaatagcactccagaataattgagtccacaaatttctctgcctttccatctttccacaagctccatgcctgaacaaagagaggagatatcctaatcagtgctaaatcctagctgttgaaattttgttcatctcaatatttcatagaacttacacaggctataaggtttggaaaatccattataagatgagttgagctgatcttacaaccacttataagttccaagactaaaacaccaaagctatatgtgtcagacttgacagagaagatgccttccattgcatattcaggagacatgtaaccactgtttgaatcgtgccaccaataacaagaagtgtgggtaatttgaaagtatccaagtatataaaatttagtattttaatcataagtagtgcaagagttactcactatgtcccgactacatgtttagtgtttgcttgatgctggttgccaccaaagatccttgccataccaaaatctgatattttggggctcatctcctcatccaataaaatattgctggctttgagatctctgtgaattactctcattcttgaatcttggtggagataaacaagacctctggctactcctttgattatgttgaaccttgtttgccaatcaagtataggcttttttgaatcatctaccatgaacagtatgaaacaagacttaaagttgttcaggcacctctcccaccaaaagtgataaagggaaaatgaatatatgattaggcgtaccaaaaagaaagtaatccaagcttttgttgcgtaaatattcaaaaataagaagcttttcatctccatgaatacagcagccaagaagcctaactagatttttgtgctgcaatttgtcaataagaacaacttcatttgtaaaatgctctatcccttgtgtgcaacctgtgttgagccttttgacagcaacttctctcccgccttccaatttcccctgtgtaatacaatcattttaaatttataaaatattgtaggattctccagtgtttgtgattgtcagcctgaattgtttaccttataaaccttaccgaaacctccttttccaagaatgttggaatcgctgaaattgtttgttgccgcgacaacgtattcaaaattaacatgtgaaaattctaaattctgctcaattagttcttgagatctaaggtttcctagcagcattctgttctgatttttgttgtttctccgtttgcctaataacaccgatgctgtcagtacaattacaggaagacatcatactatgaattcataagtaacggcccttgccataccttttgattgccatttcctgacaaggtatatgcatgtgagcatcagcaggcatggaataattgtgactaaaaccaccactagatatctgttctttttcttatcttcagaagtgtgtcctatcaagagaagtaaacaaaattatgagaatttctaaaccataagtatgcatggatgttgcttttaatttgatgtgcagactatctaagattttgttgtctctgcaggggaagaaatggtgagcataccaggagagtcggctaaccggaggtataggttgtcaccaaggcttgccctcgccatgtcagcaagatccccagtccagagcaagcaccttgactgatcggacatggtgtcggctttggtcaagttgccataagcataatcgtaggccatgcatgagcagttgtggctgcacttggccatgcactcctcgaagcttctgttctggacttgcaagaacttgtcagggagcttcattccagacatggtcacgaaatggttcctacctccgcatcccaactgttgctttcttcgacatcctctcgaagagttgaaatcacttggctcgaatccatcaaggcactggcatctggggatggccaatgtgaagtcgcagtagccgaatgggccacatgaggcgtagagattgcagtcaccagcggccgctggctgttgagagatgactgtccagaacgatgagctcccgttccaactcaggaacctcatgttgcccatgtagtcaagcttgattcgtgtgtatggggagccatcagaggttgtgtacataatgtacaactcatccctagtgttcacaagtgatttgtacatcaaagtggcaatgttgctcccgtatgcttcaccggacactaacactctattaagtgaaagtgcaatgaaacggtaatatggcttggtcccgtgccagatgaaggcctgaaggtttgatctggggtcgctgtggtaggagaagtccccggtggatgggtcattcggtcccttccaagcgacaagtcgcatggcgacttgtgccttgtatctcaggaaaaacttcttgttggggagaagggtatcagttgggtgatcaaagctttgccatgcggttgtattgtccggcagccgaagaaccaagtttcctgagtctagcagcactgcataagctcggtcacctctggtgttgatgttggccatcgtcgttcaaaaggtgtggccttctaaatctgacaatacaaagttagaactattgctgatggcgagcatcgcagatgaaggggcagtgatcggcttgtcacggttggcaatccaaacgtatgtgcgctctgggatgttgttgtaccatatgccgaggaataagctctggttggaagttgctggggagaagaagccgagtgcgaaaaccccgttctgggagacgagcacgtcgccagggtagagtttctttgcttgtgtcagctgatcatcgcacttgcagaatgagaagatgaaaagagggaagcaagccataccattcatttggtcttgttcttagctttgcctagttgcctgcaaagcgtagagaaatagcacacacacatatgggtgtttaattatctgatgcatacatgattctcctgagtcttgactcttgactcttgaggagcacgcggttggaccaaaggaagcagcgtaataacgaatggccgagactattctgtccgtcgagataaagttttgctacgaattcaaactgaactgtggggagactacggtgaagtggcctgacgagagcataggcgtagctggtattagtactcagtgttgtgatgctaacttgtgcagtttgtggctggctggctggctcggtggcaccgggacaacctcgcaactagaaatatcgacgcttgaacgcttgtgcacaacagaaaacttactacaactatttctgtagacgacaacatgaaggttggaggatcaacgatttatgctcaagaacaattgatggagactactgaaggatcaaggaagttgtttgcgttacgcaaggagacgacagggattaccccaagagactttccttcttttttttttttgtaaaccattgaaaatgaaccatacacccacaaagcaatcatattcctaggttcttgcacaattgatcaagtggtgaattctacagccagctaaatctgaaattaaacatctaacgtccttgtagtgtggtaagacttatactgttcacagacttgttggcatcctctcttgcccctcctgccatgcaattccttggcacaaaatatgcaggttgcttaggagtaggaagtgttgtggcttcattctcgagcatggccacaactgatgacatgagtggtctagcatttgggtcttcctgaacgcataacagtcctacatggatacagagcaaaaactcattaagtgaatatatctgcagaataattgagtccacgagatcctctgcctttccattcttccacaagctccatgcctgaaccaagggaacaaagttcctaattagtgcaaaatcctagctattgaaactttatgcattttgatatttcttagaacttacacacttacacaggctataagatttggaaaacccattataagatgaggagagcttatcttagagccgcttataagttccaaaactaaaacaccaaagctgtaggtgtcagacttgacagagaagatgccttccattgcatatcaggagacatgtaaccactatatgaatcatgtcaccaacgagtgtaagttatttaagtgttttccaagtatataaaagttagtattgtaatcataagtagtgcaatagttactcactatgtcccgactacatgtctagtgtttgcttgatgctggttgccaccaaagatccttgtcatgccaaaatctgatattttggggctcatcccctcatccaataaaatgttgctcgctttgagatctctgtgaattattgtcatcctcgaatcttggtggagataaacaagtcctctagctactcctttgattatgttgaaccgtgtttgccagtcaagcatagacttttttgaatcatctaccgtgaacaatataaaacgata

SEQ ID NO: 20194 - DNA, 715 bp, Oryza sativa
  unsure (1)..(715): unsure at all n locations
nnnnnnnnnnnnnnnnnnnnnnnnnnnnnnnnnnnnnnnnnnnnnnnnnnnnnnnnnnnnnnnnnatacaaaaaatgaatgtgctcgtacgtacatatccggccaccgtatattatacaattatccgcacagcaccgtgcatttcacagcataaatggccgtccaatcaacgtgacccgaatgctctgctctggacgctgcagtttttgagcccattttttacctcgtcgtcgtcccggtgaaaatttgctcccgccacggtgcgtcgctgttcaccgcggcattggataggttgatatggacttgctcggcttgtcccgttgcactcgtgacgcatccgattcaagtatgcagtataccacacgagctgcaaccgctgctcgacaacgacctgaagctggctgtaaacgtcgttcgtgcacgcttcagcctgcagctcgcactgtgcttctcccatctcttgtactactgataattgtgttcagcggagcacagtaaactgcccccacggtacggagtactacgtacagtaactgctctagtaactttggaagtgtggtttaagactgtcagtacgtgaagctaatggtgctcagaggaggattaattagtcctaaatgagttgtactacatgaaaaaaaagagaacacgtgatgggtatggctagtggctaacccttggcattggcagcatcgtgatagcagagactggacag

SEQ ID NO: 20195 - DNA, 520 bp, Oryza sativa
ggttaggtcaggtggtggttggggcctgttgcaacgtggtgtaacgttggacagtgattggttaatatggattaattactacaactgttttactgctttcaactactgctttgaaatgccggctttatgcaaaagaacctttagcctcccttggatatatcttgcatcatacctcctcttccggtgtgacttgctgagtacagtgggtagtactcagtcttgctctcttttcccccacaccagagttgaagtccttctcagttgaagatgtctcgaagaggttggtttcgtcgctgccgtcaaggatgcctgtggaatggagtcgcccgctgcaggagtcaagtcttcaggcttagctcgcttttctctttttccgctgcatttgtaatcttttatatttttgtaagacgtggatctgtatgtcaacaattgtcgtttgtgtaccctggccggtcctggacaggggtttaatgcacattcagcttagaaattctggttcgtgaatttctgggcgtgacaa

SEQ ID NO: 20196 - DNA, 12500 bp, Oryza sativa
  unsure (1)..(12500): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnncaatttgacacacacccatgacatggtaaagagacatctcgtcagataaaaaattagcacaatggcaagttggcaactagtgctatagatcaatggaacagtagtacaaacttaagctgaaaatcaattagcgaaggatcagttcagtgcttacgtttgaagaggtggttctcgaggctgccatgctccatgtactcgtagacgaggaggcggttctcgtcctcgcagcagtagccgaccagcttcaccaggttgggatgccgaagctggccaaggaagatcacctctgcctgcaagcaacgacgtcagaatcatcagaaatcaggtagtagtagtagtagcagcgaatcagcagcatgatcacgtccatttcagtggcactgttgcattgggcagcatgattagatcactggaaacttatccgaccgtcgccggaaccgtcacatcgtccaactacccctcccttgttctttgcctcgcacgtcctaatcgtgctgcttaagatatttttaaacctgtttgattatgttctagatgatcgtgtgagtagtagtagtattagttgatctgaaattaaacaatctgtaattaattgtttaggccaagcgtttcagaaaccgggtttccgaagctactggcccctgacagttactgaattttaccagataaaatttcagattcaatttttttaatgaataattggtagttaactagtcataagtcgtaaaagttcaaaattttcaaatataaaatttgaataatacagtcttttaggtggtaacctctagtcgaccgataaccaaactaattaccgctgatcagtctctgtttgatgggaaactaaatagcattaggaaagaaacgattgggtaatttgactgaacattccctgttgctacaggagaaacgacacaactttgcttctatgcaataaataaaaggaaaatcgacactttcccaaagaaaaacaataatattaatttaaaaaacaaaatcaacgatatctcatatctctcaccctcaaaaagaaaaaaaaaatactgttcctcacctgcaaatttcagttatctagagggttactcaatgccctaggatattcatatactgggatacatatatttgagtgatccttgcaaggcaactactactctaccaattaagctatatttgatggccactcttttactataagaaaccatgtgagaaaatgttgtttcccccaagcattagatttagggactcttccaaggaagctggcactacactatctcagattaattactccaagcttaattgttaatcttatacaaacataatcgatcaatctgatttaattatcgcattaaatgattaactaactaaagtgattaacgcgtgcatgtctaattaatcaaatgaaatcatatcacttttttattctatttttttgatgattaagtggaaaagggacacgtggaggggtgaagtaccagccattccttgtggccctgggcgccctcgggatcccagagcttgacggcgatggcctgcgggcggaggcccggcttgacgccgtcgccgacgaggcccttgtagaccggcccgaagccgccctcgccgaggaagttgccggagacgaacccgcgggtggcgtcgcggagctcggcgacggtgaagacgtggaggttggaccccaccagcgacaccgacaggtcctggtccgccgcccccgtcaggtccgtgaacgacagccgccgcaggccgccgccgccgccgccgcggggacgcaccttcttccccccgctcttcttcttccctccgccgccgccgccgccgaggcagccggtcaggaggaacccccacagcgaccacggccacgccgccgcctccttctccttcttcctcgccgccgccgccacaaccttgcaatcgctggatgacctcatctccgccgcgggctatacgcagctagcatgcgccgtcgccgtcggcggcggggcgagctcgtcggcggcgagcgagcggagctgatcggagaagacgcgggggtttgctttttggttggcgatttggtggtgtgcgtggcaagcgagagggggctgtgtgtgtcacgagtggatatataggcgaaggcgagaggctgcaggtggggcccacctgtcagggcgggatggaatggcctttgatcatctcgtgtgtgtttttgtgtgtgtgttgaccattgggggatatttttaattttgattaatgggggataatctagagtcgacctgcaggcatgcaatttgatttgtttttgtgatgatgcgaaatttggatgaggttgatgtgacgatttttatatgtggtgatggtgcgatgtgcttcccccggcctttacctaccttgtattgcgacatgcaaagactagcgtgctaattaattgtgtccatctttttcttgttcatttttgtatcgtggaaatggatggatggaagcaagcatggccatacactccagtgtgtttcatacttcgtattagatttttctcatcatatagaaaattcgaccaaaacatgtttaagtattacatttttcatgtctcgaaatggtgcaaatctttataaaagaaactttgcgtgtataaatttaaaatttataagaatgctttttttagaacaaccttttgactttgttttattcaattcattcgtttatattctcgaatattatcatagaaccaaattattcatcgttaattcatccattcagctgcatgcaaagaagtacttactccgttttacggtgtaagtcattctagcatttcctacatatatattgatgttaatgaatctagatagatatatatgtctagattcgttaacatcaatatgaatgtgggaaatgctaaaacggaattgctagaggactgtcgacaattttcttgagtgaaaactgtcaaatttcttagtcgttgattccgctttaagatttgtgctgagatattttgctattaaatctaaacccttttttcacaagctagtcccatcattgtatgtttacggtagatttgttcaaagttatatctaagttacattccagttacattctagttacattgtagttacactgtaattacattgtaattacattgtaattatagtgtaactacactataactatattgttatctctatataaattacatataaagttgcatatattattttaatacatatatataagttattattattataatatagttctagtgaaattatatactatagttagatttgaaagttttcccctcaaaaaacactcgacagttttttagctagtcccatgttaaaatgacttacattgtgaaacggatggagtaccaaattggtgaccgtgtccctgtgtgtacgtacgtatacgagccgaccaacgcgaacaaaggaacgcatcaacccagcttcaggcaatgcagccaaattaagaccaattcatcagaaagagagaaagaaaaatccagtgatcaccaactcaaactattaactgcccccaaattaaagaaagaaaagcaacaccaccgtctgttgcaatgcaagcaaacgcatcagactttcagagaaaaaaaagaaatgcgccgtaaaggaggtcgcttgattccagtccatgcatacgcgtttttgactcggaacaagcaaaggaggaggaagaggaaatgagccgacgatggatggatcgagaggtgtttgcaagagtcccaatcgcgagaagagatgccaatattctcgtcggtttggaggtttcttggtcgatctgactgaatattttgatcactattcgtcgatcagtcagtgcgtgcaagctgctgcccagcatcgatgtgatgtacttagagcaagtttaatagcatagcccactactagcttcaattcatctataggcaatctaatagcttattcatataatagttacatatatactacactattaatatctggtcccacatggcatacacacactaagtcttggagtccatgctacagctggctacaaatctgtagcccgctgttcttctttctcctcatttatctttttaaaatatatttacagctggtttatagtatgctattggacatgctcttaatggtggcaaatggcggccaaaacgacgtttgtctgtgtgtgcaggtcgttgtcgattggtcatcgttgccaccactggaatccgggcatccagctgcgacctgcgactgcatctgcatgcaccatccagatgagaacaccttgctgggaatctgagttcacgacatcaacatggttatgaagttccaaatgtagcaaatgcagagttagatagtacagtatttgagagtattaattattttaaatttaaaatttagaataatttgatttttattcaactttcatatagaattcttttgaaagaaaaacgtactgtgtttagtagttcgggaaacgtgcacgtaaaaaacgagatattttttcatctctatcttctactctcaaaaccttacagttggtgcccagcaagtttaggagattgttggcttattagccgagccatagccatggtctatttttttagcattggttctagaaccattaatgatacaaatataaatgttttacctgtatttttttttagtttgcttgttcagttttttaggcataccaactatagctcaacaatcagagttgtgtttcaatgggtatgtgtatgcctcagtaactttcaagcatatgtaaatagaacacgcacttggtacactgaaattaaattcgtcaaagagggtcaaacaatattgatctgttaacatttttaactgaagttacagtaattaaaaacaaaccatgtggccccaaacaagccaagtgagaacataaccaaagctcgtttcattttcaattccttttccttctagagggaaagtatatattgtaaagtacgtgtgctcggtgacagagaaagaggcttctcatgtatggatctgatgtcggtatgatttactaatcgtgccactgatcatgtggcgcaggaattgccatgcatgtaccacgagttgctcctctgaataatggccatgggaagatagggacactctacccatgtaatcgagtatatatcttatcaaaaaagaattcatccgataagaagctattcaagttttaaattatttcggatcaaaatatttagaaatttcggtaccatcggtgcccccaatagaaatggtcaaaactgaaattttgaagcctggttcttggttagctacttagctaattcttggtgcccaatcaagaactaatcaggaaattaattactggttagttacatatgtccagtgggaaaaccatatgcacaatgggtcaatggctgttaattgattagtacatgacctgatgagacggccgtgcaagcacgcatgcatgctgcatgaattcaggcaaggatcaaatgtttaattagtgtaatcctctttgctgcagtaggttgtcaaacactaggagtaggaactgattaagtcagaactggggttaggttaagggtaatcctgtaatctgcatttgatgataataacagattatttgccaaggactacttgcttccaagaaacatcattctggaaaccatcaaaccaagtgcctacgtgctttgcaaggtgaagaaaaaacaaaagaactgaagagcttcgaatgcaaatatgtactatattgtttctgaaatcaatcatctgcaccaactctgcagtgacgaccttcttaatttcaggatctttgaaaaaaaaaactcggttttgagttttgacgtctaattaatggcggctcttgtacacacgatgatcaaagagagattagccatgcaactaattaagaagccgtttttgtgtatagattgtgttactttcttgtttttctccggtagctggtgaagcgtagcagaagtccatcgcttcagaaatgacagtcaactgttccatgcatatgctttggaatgcttgcaatgcgtgtgcagagatacaatataaaatccttccatccactttgacttttgcagtggatgctgatctctgtcagccaaaatgattcagagaaacaacttggctatgtaccacgtgatcagttaatcgagacacttatttttagataatgagataattattgaattcaaccaattacaataaggtgatacaaaacaatcttactaagtattttcaggaagattgtaaaaatcttgattcagctctacacttctacgactttacaatcctaattaaagaacctgattctacgattctagtagatagaatccacgattttacaattcctacatatactattttttatttgcgatcctactcagagacctctgatttaggatcatgattttaacaaccttagttctcattgagttcaataaagctttatttatctattaaaaaacataataagttcgtttttaaaaacaatctgtaagtttctttcctcggaaagaaaatgtgattagtccgtacatgatcttccgtatatctaattagaattagttttctcctcaatgacaataaacctgaaattaatcagcttgatgaaattgacacgttctagaaacacttgtgaaggacaggttaacttcgtgagatacggggtaggtttgcaatctctttccatgaagagatcaaatgtcacgagactcctcaccaaactgctaagcatcgacctctacgtcatatgcatactttctgaacttactttcctatgcaatatgcacttcttgcttcctgactgttactagtttctcctcttctctgtacctgaagataaacacttcggcaggtacaaccgcagccttaagataatgattttgacccctaaagcatctatcattatcatctactaaacaagctaatgctctagatacatgcataaatgcattgcatggtttcttggtttgatcagagaaacaagaagatagggggaaaaattcagtgtcaggggttcttgatttggttcaggatgggcattagctactggttttgttcattcttgctcccctacgtgagcacatattcccaatcagaattctttaagatgatgttctgctgatgtttcttccgtatatatccatatggatttgcagtgctgttggtgtgcacatcaatcttagttggagtaatgcattcttcacaggcctgttgattggtgcaggatttagttaatttatcacaacttgtcggctacaagcaagcaaatgttatgcagtagctagcttaatcattttttaattagagaacatctagctactagcttgattacttcttaattagagacgatctttagcttgatttagtcaacccattctgtacactgaactgaatactaaccacaccttttgaatacgaatgctgccttcctcaatggacacattacctgacatttgaaatgaagaaaaaacaggtctatgccgctacagaaaaccaagtcaccaggctagtcgtaaataactatcttatacttgataatgcaatcaaattgattatctttgtcaaaagcagatagcttttcttttaatataggcattttaaccagccttgctccaatagcaacatcaatcagcatatatgtagtcattactttaactagcattgttaactttctaagtaagtggtttgtcttcacacattttcaatggacattagaccagcagcaggcatgtgtgctgatcaacaaactctcatggtaggtgtgattaaaacagggtttgaaggcatagacaaattaaactactgtccaaatagacaagaaagttaatctgtcttcaaatatctagtcttctcaaactgattagctggccatattttactactcttgggtgagagcacttggttccaacctccaagtgccccctccaagaaaaacagctaaagtggtatgaaaaagttgatgagcatggttagctcatcttggtgagtgcttcttttgtctcttgtgtattttggatgatgcagggttttttttttttgtcaactcttttggcatttgtgttctttgttttgctacattctctattggactttgcaactgtcccattcttttgtgtggcattttcctttgtcaggatccctttctagctgtgcagtgcagatgaacaatccaattccagtgcttcaattcccttcccttttttgggaggtcttcactccctttcactaccaagttagtgcatgcctgcaggtcgactctagaggcttatcaaaaaattgtgagaacagtgaaatcacttttcatgctctttgctgcacctccaaattagtatacgagtattttagaacttctgtaatgtggggattcttgatgaaaggaagcagaccatggtttagattagagtcaacttttgctcacccaaattttttggtaactaaaataatatcacaaaaaatatttagtttgataacaatgtttgccaatactgttacactaccaaatatgggcagggcgaaaattggctccaaagttccaaattaaaaccccatatttcctcgtgcggtgcggaatgtgcatgattggattagcattgactttcagaagatgataaaaaatgactacgtggatgggtctcgcaagatacatggagccaccaccatagggaacaacatttttttgcagatgattccaatgacgtgcgaaagaattcgatgacaaatttgataatatgcaccaacagcaggcaagcaaattttcaacaaaagtcatatggccataaagccataaacatcttgtcaacctacaaatatgggcctctatgtgcagtcatataagctagacaatcaatatcgttatgtccgtctctagcacgctgatgtgctcctggccaagtccttggatagttggatcacaagaacaagaacagaagatatgatcaaacccaactttgatggcctggccttcacttcacagccatatccatcctgcctaacaagtaacagtgactagactctgttacgtggtctaatccaaagcaaatttatccaaattctgaaaggaagccgaacaagcacgaaagtcacagaatgggcaaaaacaaggatgaaagatttcgaccgttcaaaaataccgacctctatgggtaaaaagaaaatttccactacctcaaaaggagaagagatcaaagttgaactcttacattgcagtcagcatagcatgcctcttctgtcactggataatcagggtaacgagaaggtgaccacggaaacttattaatgcgaacgacgcaactatattaaagaatctgtacagcaccccagctaacaaaggggtgaaaaaccactgccaaaatttggtaacacgacaacaggcggtgtgacagtttctgtcaggaaaaacacggcccacacatcactcttttgcctatcccatctgtttagcttcacccgaatcgccttacaaaaaatttcaagctcggagcagaacaatgatcacttccagagaaatatcaaaacaaacataatgaaaccctgtatgctcacagcagaaactctggggatgtatcccctgcatctcactaacatgccttgatcaaggaactttgccacggtagccaggctcggtaaaaatattcccgcagtatacatctgcaagcatacaagggtaatttttcatcagttatgtgccactggcataaactacactgaaacatgcattgaggtcagatttcacaataatgcgaggtatgattactgatattgaaaggtgtatgaatagagcttcggatgctccatcattacagaatataggctaaaccagaagctttacatcaactatattaccaccctaatggtggtgaggacaacaagggagtgcccaacgaagatgcacaccatgtatacagcaaaataatgctccatggggagagatattttaataacagatgggtcaaagatgcaaaaaagaagtgtatcaaaatcaagggaataccttctgatctcagaaatggtagagctttatgtacatagatgatacaactaccctgcaaattatagcaagttaacacaaagatgtgaaggcaataatacaagcaagtcatgcaggaataagcatattgttgataagccaagaaaagaatgaaataactacctatattcaaattgtagaactgaggaatctttcactggcaaacagatttaaaataattgaatgacgctatctgaagacaagactcccattctgctgttgtcttattttcatgacaagtgattcataaaatgacttgaatgccttgatatcatttccctgtgatggagaaaagtaaaagtgaaaaatttaaatttgatacagcagataagagatcagattacaaattcctgaattatgtcagcatcttattactttgtttgtaataaaaccatagaacaaacaccattgctttagtaatacgacaaacaaatgataattacccattgaatcattactcaagtctgaaggtaaatgctaaatacttgctctctcatataagccacaacaaataaactagagctccatcatggtactaacaacttcccaaacctcgatggcattttgatggcaagtcaaccagttatcaacgagacagcaacacaatgtacttacatttaacttcgtaaattaagggaacggttcaactttttaaaattgcaatgatagctatgttctagcttttgtgcagttagcaacctcaaacacagtggaatcaaaagaacaagcatacctgtaacttttggtagtactgttcagcaaggtctggtgggcagtgtgcttctcgaagttttgttacaaaatttacaacaaagttctcgccaaatctttcatacataaccttttgagccatcatgatttcaccaaacagggcaatctaagaaagaagcagattagactaagctcttgaatgtaaagaaatacatccatcaccacgcaaaagtcatgtccatttcaactatagtaatgaagtaaaatgacaagacaataagttgtgagacaacaatcatttaaaggaagaaaataactcatgttctatttgcttttagattagtaattaactaaatgataacctagcaagactgtcaccgagaattgcattgctacatgcctactttggccactgagcctctaatcatttatgccctccttgagaagtaatgaaagcaccaagacatagctcattgcatcccattggccaactgaattttcaattgtcatattaacattccatcagcaaagggaacagattagtttgacgctcccttacatagtagtggggcatatagaaatatttgcagattgtatttcaaatttaagagaaagtagagtgtattctcgcttctagggaccaacatgaaactgtggggcttgggaatgtcaaaagaggttgtgaccaataagattcaaatgtcgcaacccagtctgcttgagaacaattaaaaggcatttatggcaatagaattcaaacactacctagtggcactttaaacatcatgagaataatatatgaaaggttggttacagaaaacatatacattgtcaaagtacaaagaaatttatcgctcaagttaaatattctaagaatttttaagaaatcagtgtgcccaacaagctacataatcacctgaatagtttatatagagtggagatttagattgccatttgatccaagtaaatctgatgtttaggaagtgataagagatcacatattagactacaaactgcagtttcacctccaatcggacacctataggctggaggtcacaatcaaatgcctataaaccctatcaggacggacattaataaaattaccaagaatttaatgaagcaatagacaaacagtataataactacttgatggtatacatttaacacagtaaaacaggtacgagaaatttagatagatatagattgtatggttgacaggtcctaccgaaattccatcacggaagttaaatgacttgtcaaggacactctgcaaacagcaaccagtagcgaacttctcaatcataaacactcggaagccaggaagctgaggaaaacaagaaatacatgacattatgagtaatgcaactgcccaagtactagatagactcttcaaaacatgacataagaagaactgaacgcaacaataccttatcttcaatttcagagctactacaccagtctttgataaggttgccaaaagtctgtacgcatgtctacaaaacaataaccgagtataaaatagacaattctatttaaagtggagatggagaatgtaactcgcttgaagtgg

SEQ ID NO: 20197 - DNA, 7467 bp, Oryza sativa
gaacaaagtagacaaaaggtagcaattcagatggggcctactagctgatgaagaaccaagccagctacaaacaatagtgtgtgactaactatgcaataagccaagaacattatcatatcaagatgattgccatatatgtagcatggttgttaaggcggtaaggctatagcagtaaaacgctaaggcatggcgatgccataacctatgtggttagcagcgatcagaagaaaaccagcctagcaggccagcccacaaaagcccaatatccttcataccagcccaaagacaaagaaataaccctaacacccgcaccaggtgtgtctctcctctcacagcgccgcccccgatgtcgtttcttcctcacggctctatcgcttcttcctcgcaccggctcttcttaatcatgctagctctattcctctatctgtgctcccttccccctgattcagaatgaatcaagtgcttctctctgtatgtgctccttcccttggatggatctggcggctgctcccttgagtcaagatgaatctggcgcaggggagagaagagagtggaaaccagagctaagggggagcaaaatggtgatgacatggagcagagaaaagggaaaagggtgtagttgctgccgccttcacctctccctctccctctctgcattaagccctaaggcggagggatgccttgaccccctcagggtgccctagcactatagcgatgccatagcgacgccttaacagccatgatatttagtgactaacaacaaaacaaaatgcttagagaaaacaacattaaactaattggttaacacacaaattaatgcagtaatatagtgggtcttatttaccaattcaatttacctcagtattgcttgcaaacccatttaaaaaggcatcgtgtgatagtatcacagataaatgacttgcgatggcaggaaacacatcctccaataaggcatttgctgaagatttaaacttgcatattatttggtttattaagtacagaaattccgacatatcttttgcctgtaaaaagatgatgtcagcaagggccgcaaaatagaattatatgtacgacaatattgtttttagagaaataataaggtactaatttgatgttgcatcaaatagtaatatgcagttcaacaggtactagaaaaacattaaggctaagacacaagaaattaacacaattgcacaaaagaatgtttaatggatttctgtggacaatcatatattcattgatttccattgttgtttggattgacagtctacacaatcctttcctttgtatattgctattttaagaactatatgataccccttgcattgctgcagtacgaatgaatgaaaataagctgcagaactgtgatgaaacaataagatggagaaataatattaactgtaaacaaaatagttgtagaactactaaattattattagagtccataaagtggacattgtccgctcaaagggatgggccaaagagggggaaaagtgagatgtggagtctaactgggccaatccactgtatggccctaaagcggtccttgtagaacagaacatcgatctaatttaatggttaatactatgatccaatggctgaaataattttgatggtatgattaacaacagaggcacctttttgttgtataagtatataaaagaaacattacaaagtacgatagtttccaaagtcctgccgttattattcctcagagaaatacagctaaaacaggacagttaccgaaaaagggaacacaggtgctacagttactattagagatcgcaatagcttgcaaaaccaataaccaggaaacagggacatgaaatacctcattatcaacgagcaactgtcgcagtgcaattggaatacatggaagcaccgaaatgcctaatatctcaaccatacggtggagaaatgatatgatctgtatttcagcattgcataagttacaaattggttaatcatccaagcagtaaattgcaaaagatgttgataacagttacttaccttagatcgcaggggcttcacattaggaaatgagatgaggacttgcaaaactacatcaagggtctgagaacaatacgaaaaaaaaatcacatacgaaaaatggaaattatgcacatatatgataattaaaaagcatatatatacgtggaatggagaatgacagaatgtaccttcttgaacataacgccaagtgtcggcctgcttcccatcacaagccgttcattaaatccctaaaaaaggacagcatccagacacagtaagatcaagcattaatacttgaggcacttgccatatacagaaccaaagatttggcatatgagcgaatcagaacgtttttttagaaataaaatgatatactacgttcacggaatgtgatattgccaactcctcgtgatgtgtgaggatgaacagcataccttgctgatcatagtcaatgcaacaataatctgttgaagacctatagctcttggagatgattcttcaagtccttgtgctttggcatccataacaagtgactcgatctggattgattttcaccgatgaatgtaagattcttaaacccataggacctaaggccagcataaacagggggagaaagagatcgatgatcacctgttgacagagaggattaagtaaagctgtcaagcactgaacctgcttatctggtgacacctcttcaatgccgatcaacagtcccacagcctaaaatcataacaagcgtcattgatccaagattagtgttcccagtgtaaaacaacagctagacaaaggtgagaacattgtacctcgaatatttggctgccatcctctgagctggagaacttaatatctttgtttgcccagtccgtagcagtgaattgcactagggcatcttgcaagctctgttaactcatagacacacataactcagatctataatagaaaactagactggcttaaacctattaaaagagatagaggaaatacctgcaaaatggtatccaagtaaggcactagcttagccttcaacagcctgatagctctcatgagcaagtatcctgcatggcagctcacgtgggcattctgatggtgtatgccacgctcatccaagaacacagtaagcagatgtggcacatattggtcattctcctgcatgaacttgatatagcggctaattgtgtctaggtacactaatgcaactaggcggtgtgtgtggcataagaatctcgctgaaaggagcattgggacaagctccctaattaacccagctccagtccggatctcttcctcacccactatttccccaagccggtaaaacagagtaagcgcgacctcaacatcctcaacactaacttctgcagatgaaagggccgtcacaagcaaccctcttatgaacagctgagtggcacctggtgccacacgacaaatgctccgaaatagtgcaattaaatccttccgctgctctgccatcaggtcttcctcctccttccctatcttgtcaaggacatcaagatgacccctataaactggatcatatgacatctgcatccgcaccacctccagtatctgtcccaagtgtccaagttgcttctctgtcggtgccttcatcgtactcacatacccagataaaaactcaagcaccgagcccgaatcaacctcatcatcatcgccgctctctgcggccgcaaatacagctggcagcacctcttccagcatttccaatgccgcggctccatcagcatcactagagccaagcttgcgataacactcgagagcctcgacagcgtatgccgtcaccaaatgtgccattttcaaaccgctgtcagggctaccaaaccccttctgggcagacatgagcgacctcagcaacgccacctttgccctcgcgtccatcctctttgctgccacagcagagaggcaccccaccgccgcggcagcaagaggagccacgctccccggggacagcgcaatgtcaaagagcaagggaacaaacacgtcattcgcgaccagggagacatcgatccaggagatgcacctccgcgccgcatcgagggctactccggcgacggcggggtcggcggcgcggagggacacggcggcctcgtgccagtggcgggcgatctggggcacgcactgcgcgcgcatggcgtccttgaccctcccggcatcggaggcctcctcggcgttgcgcgggtagtcctgggagagcaggtcatcgtcgagggagacgaggacgcgggcgaacatgtcggtgggtcccggcagcggcggcgagggcgggatgagatcgaggaagtaggaagggtagacatgggggtactcgaagcggacgaggagggcgaggagctgggcgagcttgttgcggaggaagggaggggaggcggcgttggaggagacggcgagggagagcagcgaggagcggaggagggcgaggtcgtcggggagggcgaggcggcggcggaagaggagcgcgtcgtggatggtctggaggcaccagaagtggacgtgggcgtgcggggaggaggcgaggccgtagaggcagaggtggaggagcgacgacggcggggtctcgtcgcgggcgcgcgcgcagtaggcgagcgcctcggcgcgcacggccggggaggcggcggccgcggcgggggaatccgaggcgagcaggatggcctgctcgaggtcgtccatggcggtggcggtggtggcggaggaatctggggcggggcggaggggggaaaggaagagggggccaaagggaaggcggagttggggttgatataggagaggagagggtttgctcctcttcctctccactgcggtgcttttctttcccttcccttctttcttcctgtctaatcttccgtttttgccggatttcgtgggtttatggacggttttggttttgggtttgggtttgggtttttaggtttaggactagggaggggagggtcttttgatatttttttaatctaaaaataaattattttgcattgtcctttgagaaatatctagctctaaaagaaatattaaaggaatattagcaatacttgaaaaaaataacaatgtcgtatacatatgaattgatcatgtgtcactctcagacattattatgcaagtattttttgcgcattacatatataatatgagttttgaagtttttatgcaggctccaagttgacaattgcaatccttagggtttcgactcctcagctggttgggacgttatgtgcatggaataattattgctcggggtatagaagttacgtgtttccttaattacaacataccaaacctatcgtttctatgaaaacattcaagatttgacatgtatttattttggtgttggttaaatcatatttttggacggtcagagattccttgtttgtgcatatcattattgatacatgacacaattagtagggatgtagatgggctgggtcaacccatttacccagtgacccaacccacgatctatggggcaaaaaccatatgggtcaacccacaatttcacctaggctaacatgggttggtggcctcgtgacgcacggaccacgcatggggttgacccatatcttacaccacgtttacgcactcacaggctccagtagatgttggtgggtggaggcgacgacggcgtgcatctgcgtcaacactacagcaaaatcggtagcctacttctcatgctcattacctcatcatctatatctccacctctgctcaccccttgtgcttgacgtcgggctcggcatccaattcaacatgtgtctcttggagctccggtcaccatgtttgtgaatttcaccatagaaaagatcacgggaggctgaggctagaggctcttagtagtgcttgcttaacggcccagtgtcctcatcgtgttcctcattgctagcatcgtctttctgctagagatccaacaaggcatagactatgacaaaatcaagatgttgctccagaggatcaggggcatcggcgttgtgggcgacaagttggacaatatcgccactatgaaagccatgtaactagacgagatcgaaccttttgcagtgccagtactcatgcatatgcttattcaacttttgggttatgggtcgacccatgggtcaactgcctaggaacgttgcgggggcaagatgacccatgacccataatctagcacggggggcgtggtgggcagggtttcccttaccggcggttaccggacttatcgcggggtacggtaatataaataccgcggtaacctccttaaattcaaataaatttaaaaaataatttgaatttttgataaattttgcacggtttttcatggtttttcacggttaccgcggtaaccgtgcttaccgccggggcgcggtaaccccggccccggcggtttaagaaaccctgatggtgggtcaagccttggggtcgacctaccagtatccctaacagttattctttattataggtaacggtattaccatattatcttattgttctcatcaaacacatgtgttgaaaagataaactaatagtagtgatattactcgacgagaaaagaaccatgtcaagtgattaacacattccacttccgagttcttacaatggttcaaaagacgcttctcttctcttattttcccctttctttgttgtctcttatctaactttctatccattgggatgtggcaatcttactgccaaaatgttaaagataaaaccaatgatgttttttaacaagaaaaaaatatttatcgacacttgtctggcttactatagtggtttgaaagacaactttctcctatttcatctatgtcacgtgattcctttagggctccaaccgtgtgtccggtgtgacatgggactcttaaaatagtaaaatccccttgtgatgcatttgcatagttcatctacatggagattccacaacaaaaacaccaggacaacacatcaagaaacaaaaatctaatttctttttagcttccaaaaaaaatctccttccttcttggaccaaaatggcgataaaaccccaaaccacagcccaacatcccagcataacaaaccaagagagaaacaagcctaaaagaagcaaggcccagcccaatagcccatcaagctcaccattcctcgcctcctagggtttcctcctatccaatccaccaactccgcctcgccgcctccatccctcccattcccgaacacgtccccaaggtaagccggcggcggcggcgatgacgacgagcctgaggaagaaccgcaagaagcgcggccacgtgtccgccggccacggccgcatcgggaagcaccggaagcacccgggaggccggggcaacgccggaggcatgcaccaccaccgcatcctcttcgacaagtaccacccgggctactttggcaaggtcggcatgcgctacttccacaggctccgcaacaagttctactccccggcggtgaacgtggagcggctctggtcgatggtgcccgccgagcaggcggcggaggccgccggcg

SEQ ID NO: 20198 - DNA, 6294 bp, Oryza sativa
ccagttcatgtcagatgcttcagatatatcaatgctattttgtgctgccaattatgattcgttcgatctgacttggcatgcccgcgttatattagatcgtctgatcatgttatgtacttgtctgccaaattatgtggatggtaaggttcacattagttttgatctggcctctgcattatgcttcattacaaatttacaattatctgaaatatgttgagaaatgtatgatgttcctgataagaacccatatttataagttaactgtagacatgtactagtaataagcatgttgaatacttcgggttctgccatgttctggattatcttttagccatatttctgaaaattagatgtaaacctatagcaagcgctgtttgggttctgtgccacatgacaaacttctcagtgatttactgatttgcattttttttctctctatgaaaatttttggtccatttaggcattccatggttgtctgaattattctagaccagtaacttgagcactgattaattatgttattcattcacaaattattggataggatcaatcatgtagctgtcctttctggaaaattcatgtctgctagatactggatgattaaaatgtcatggttgtttgtcagaattattctattgttatttggggatttgttctactaggttgtctactgtctaggggcaggggctggatgatgatcatgttggtcattttgttgtctagtgtcttgtcattcaaccctgctcgcagttcaaatttctgtgggtgctggagtacatggttccgcacttgcactatagatgttgaaatgaaccagcgcgaagtgcagtcatgatgtttttgtgatgaagtattctgatgtttcatattgcgagatatcagtttccactcattttgaaattttgagtagcatgggtggtactgatttcttctcgtgtttcataagtagatcttctgtacggtgaagtcttggtaaatatttcaagaaatatggatgtgcgaaattgatattaggggtgtgtttagtttacgccaaaattggaagtttggttgaaattgaaacaatgtgatggaaaagttggagtagcatttgcccgttgcaatgggacaggcccatacaatcggggataggccgagagggtggattgaggaggtgatgagtccgctttttatgaactgtgatcgatcctgtcgttgttgctttgtactagtagtaaatggtaatgcttgacgtaatgacatgtgtcctagtggacaatgtttcaatctaagctttcaaacttagcgtgcctaacttcaaacaaacttggggtgtgtttagttcacgccaaaattggaagtttgattgaaattggaatgatatgatggaaaagttggaagtttgtgtgtataggaaagttttaatgtgatggaaaaattagaagtttgaagaaaaagttatgaactgaacctccattgcgttgtcgaactgtcagtcattgtctcatcaccatgcaatgtcttgttttgcatcacatcacgctattggtttttttgcgtgaatcagcgtaagtcggatacttcaacatgtcaatggctgtggttatatctaaagtttgatccaaacttcagtccttttttatcacatcaacctgtcacacacacaacttttcagtcacatcatctctaatttcaagcaaaatccaaactttggatccaactaaacacagccattaatatgtcattgtcctgtagcagtatacccttcaatgtttcctgattgatcattgcgtaatgcataacaacactgtcaacacatcatgtttagcccataacaacactgtcaacacatcatgtttagcccctttgaatcacaggaatgaaaaaacggagaaataggaaaaacataagattatgataggaatgtaagtgtaaaacaaaggattgcaaaacacaggaaaaacataggaatgaccgtttgattggaccactggaaaaacacaagaatttgaggagagataaagactcaaaggatttctatttgatgaggagagataaagactcaaaggatgaatttgaggagagataaagactcaaaggatttctatttgatgaggagagataaagactcaaaggatttctatttgaggagagataaagactcaaaggatttcttccatgaggttctacctcttgttaaaattcctccaaaacttgtatgggaagaggcattccataggaatttcatagtattccataggtttcattcctttgattcaaagggctttgtaggaaaaatttctataggaataaaatcctctaagggcccctttgaatcgcaggattaagaaaacgtaggaataggaaaaacgtcagattttgataggaatgcaaatataaaacagagaattgcaaaacacaggaatgaccgtttgattaaaccacatgaaaaacacaggaattggatgagagagatagactcaaagaaaagttagaagctcttgctaaattttctccaaaatctctataggattatccattccataggaatttcaaagaattggataggattcaatcatttgtttcaaagggctttataggaaattttcctataggattaaaatcctctaaaattcctatattttttctccaaatcaaaggggccctaaaatttctatgaatttcctttgaatcaaagggggccttacaaactccctgggggagagttgcagaatcgagaacgtcagtgcgtggtggttttgatccgttgatgcttctgctcgcaagagatgcgcctgcacgtttggttgaaagcgttggagaggttgcaaccgagcgccgctggatcgctggccggcctcaccggggcatcctcctccgtcggcgcgcagggcccggccggccatcattgccgccgacactgaatcacaaccattcgcaatcatgctgctgctatcactgtgcacacggttggccgatgcaggaggcggacagataccagtatccagtacatcgcatgccattcgcatgtaccgttccaaactcctccatctcacacacttttttttttcccttcaaaacgcagtagagacgtacaaattcgttttttttatgggagggaggagtagatgttaatcgtgcgtgcatatttattcatataatacacatgcacaatctacatccctataatcatctcatctcagatgattaggtcattatatcttcatatcgatgaaatcaccataggtttctcgctctcaatggtctacggtttatcacagaaaaaataattagtataaatacgaatatccttatcaagcctagaacttaaactcgaatggacatgtttcactatgagagacctaaccagttgaggtacgtttactttgttcatctcacacatttttgtgcttgagaaaaacacacactagtacatactacatactacagttctcatcccctgaagcaatatttatatacacatcacggtcgttttctggagtcgtcatcgaagaaacacggcgcaacgatctgatcctgacagtgaacggaagaggtaaaggaaagagcaaagggaaattagccaagccaggccaaagccgcccgtttcatctccggcttctgctgatgcttttgccgaaccggcaagcaacacctcgtccgcacgcacaagcaaccgagacgacgccgtccgtctctcgtccgtccgtttcccccggcgaaacggccgccgtcctctttcctcctatcggtccatgatgcgcgggccccaccgtgccgcgggacccacgtgacagagaggagcgggcacgtttcgccgtttctgcacgccgcttgtggacgaggaggggagggagtttccactgaaaccgtgtcgtcgttctaatccttttcccagtgttttgctttgctgatcctcttgcgccatatctttgcccaagacaccctcaactttacattaaatcatgtatggtcacactgctgacggatacttacgattgtttaatttacccaatgggattttaaagcctcttttaaatcacagtaatgaaaaaaaatagaggaatagaaaaaaaatacatgattctaacagaaatataagtgcaaaacagataattgtaaaacatatgaaaaaatataaaaactaccgtttgattgaaccacataaaaaacacttaccatagaatggataaaaaagatagattcaaaggaatctcttgctaacttttctccaaaattttcataggattacctatttcataggaaatgataggatataattcaatccgttgtttgaaagatttttatagtaattatttttcatataattgaaatcctccaaaatttctatatttttttctataaattaaaggggctcttagcttttattgattttctttttgtttctccgggagtctgcaggatttttgttttagcttgtgtacgaggtgatgcctatgatgcacaagctaaccatgagacgccaatgtccaattttcgggcccctttaaatcgtaggaatgaaaaaaatagatgaataggaaaaaatcaggattctgacaggaatgcaattgtataacagaggattacaaaacacaggaaaaacataggaatgaccatttgattggaccacaggaaaaacgcaggaatcagatgagagagatagactcagaggaaatgttccaagaggttagacctcttgctaactttcctccaaaatatgcataagattacccattccataggaaattcataggaattttagaggattttattcctataggaatttttcctatatagccctttgaatcaaaggaatggatcctataaaatcctataaaattcctatggaatacctcttcccatgcaagttttggaggaaatttaacatgaggtagaacctcttggtaactttcctttgagtctatctctctcatccaattcatgtgtttttcctgcggttcaatcaaacgatcattcctgtgtttttcctgcgttttgcaattctatgttttacacttacattcctatcaaaatcctacgtttttcctattcctacgttttctcaatcctacgatttaaaagggcccttaaaggattgaataggattcaatcccttaaaggattgaataggattcaatcctttgtttcaaaggccttcataggatttttttccataggattgaaatcctccaaaattcctacatttttcctacaaatcaaaggggcccttcatgtgctttggagtgtcacattctcaaggttccatactatcatgggttataagcactgaccacatcttagaaaaaaaatactttcatctaatggatttgcatggatatatttcattacttatgtccattatatgaaacaaaccgatgagaaaacactaacattgatggtggagttgaccatgtttaaatcctggttctccacgaatattatgcacgcacggataaggttttcaataggtatgtaagtgtgatacacatgtataaccgagcgagtatgtgttttcattttaaaagaaaagaagctaatggcttaacacctatgcaaatgcatgagtatattaactttccaaatctaaaggtttactaatacgaggtgtaaaacaggcacgagtgtggtgcgggtgtacagggatgtgtatgcatcttccatgtaatcaagaatgtacactggtgtgaatgtgtcttcagtgtaatcaggaatgtacgtaagatgtgtatgcgtcatccgtataattagaaaaaaaaactagggcttaatcagattgtagccaaaataacccttatcaatttttcggtaagttgataatgttaccaaaattttggcaggattttttttatgtatttaccaaactttggcaagaagctaaatgtatacacacctttgacaattttatcaaaaataatataatttaaaatagtatcaatctgaacagcccctaatgaattaacacctatgtaaatgcaaaaagaacagcactaaaatatttcatgtgtaaaacacaaatggccactcgaaacaacctcccagctaagctaagctaggctagcctactattcataacctcaccaccacgcgcgaaaccaaaccacctcgactatttcttctctctctctctctttcccacccatgcctctccctcctcctccaccaccaccacccctctcccctcttctcctcctcctcctcctccattcgccattcctccccgcccagctccccctaatcctgcacgcgcgcgcgtgcggggaggcaatggcgccggcgaaggtgatatcctgcgcggtggtcaaatgtggcgga

SEQ ID NO: 20199 - DNA, 615 bp, Oryza sativa
atgatgttaagacggtacaggagtcaagcaaaagctgaacaccgaactgtccggaacctaattaattaatctcccagccgccagcagccgcggaaagataagggaggcattggcacggcgccgcttgtgcagataatgctcagtaatttacatccattatgtcgacgatgctaatgctgagtggctgatggcataaagttgacctgtcaaatctaatctcatgtgtaatgacaaccaatctaaattgttaacgagtgtgatgcaaatatgcaattgttcagtagtaaatcggaccctttatctgttactagtagaaaaattaaacggatgggacaatgaactacagtagcacacgctgggatgttggctggctggctggctggctagctagctccaagatgcggccgtatgcaaccaaactagctggagccacacgtacgattccgggctgcaaaaatgcaccaccacgaaatctcccggaacgtcgcggtctgcaatccatcgtccaatctagtttgaaatgctagcctatttttgtttcacggattagtctcgtatattacgtattgcctctcacgtcgatgccacaattaaggcaagcgtttcatccaatct

SEQ ID NO: 20200 - DNA, 653 bp, Oryza sativa
actgcagaaatgtacacctcagatgttagtgttatggcatggagcataacttggaaaggtaagtgttcatataactacatttttttataggaactctcatataatatcatgagcattgccactatctgaaaacgaggcgacagtgtgaaattttgcttaccaggaggctcagcaaggcggaggtacaggttctcaccaaggctggccttcttctctgagtcgacaagctcccctgtccaaaccaagcatcttgacgggtcagccatggtgccgccactgctcaagttggcgtaagcatatgccttgcaagagcagttgctgctgcactcggccgcgcactggtcgaagctcctgttccggatctgcaagaacttgtcggggaccttcatgtcaggcaatgacacgaagcggtgaccgccctctccgcatctcagctcttcctttctccggcatcctgattgcgagatgctgggatctacaggctcgaacccatcgaggcaccggcacgccgggacggcccccgtgaagtcgcagtagccaaacgggccgcacgagccatagacctcgcagctgccggcggcggggcgctggaagatcaacatccatgacgacgagctgttgtcccagctcaggaacatcatcgtgcccgtgct

SEQ ID NO: 20201 - DNA, 818 bp, Oryza sativa
taggtattaaaaccaattatgatttttatcccaagttatatatatatttttttgaaggaaaggcaagtaatcgtagtctttactgctctcttttagcttacctagttttgagcacagtggtttcaattctccactctcttttttcttaatcgcctagtgcagaaacttccaactcaccaataattgagcgaaattgcttatggaagaatttccttttttttttttttgtaaaccattgaagatgaaccatacacccacaaagcaatcatattcctaggttcttgcacaattgatcaagtggtgaattctacagccagctatatctgaaatttaaacatctaacgtccttgtagtgtggtaagacttgtactgttcacagacttgttggcatcctctcttgccccttctgccatgcaattccttggcacaaaatatgcaggttgcttagaagtaggaagtgttgtggcttcattctcgaacatggccacaactgatgacatgagtggtctagcatttgggtcttcctgaacgcataacagtcctacatggatacagagcaaaaactcattaagcgaatagcactccagaataggggatccacaaatgtcgctgcctttccatctttccacaagctccatgcctgaacaaagagaggagatatcctaatcagtgctaaatcctagctgttgaaattttgttcatctcaatatttcatagaacttacacaggctataaggtttggaaaatccattataagatgagttgagctgatcttacaaccacttataagttccaagactaaaacaccaaagctatat

SEQ ID NO: 20202 - DNA, 592 bp, Oryza sativa
tgataacttgggtattaaaatgactagatgttggtttaggagatgcttagccatgcttagttcaactagtgcacaaaaggggaccacattaaagcatagacttgattattggcaatagctttggattagtgccaccgcaatggtgttggctaattaaaatacactacatggtgggctgtgggtgcatggttttgctagacgtgcccatggcgattaaggaccggttcgcgggatgccctggaagaatttatcgtacttaccacaagccagcgtgggcaacggctgggcttgtagtgtagcttttctctagccgacgtacccaggcgagggtgggcgtgatggagttgggtcggccggggtgtccggttgatcggctgccggattcaccgcggcacgaaaggggggctgcccgttgcctgctggggacgggggcgaaccctaaggtgtggtgcgatcggttagagggggttatgcgaagggtcctgtcacggcctctttccggtatgtcgtggtggcatgtcggcgcacgggaacgtgtcgtggggctgtgtcttgtgggtacaagtgtacacctctgatcagagtaaaacta

SEQ ID NO: 20203 - DNA, 2170 bp, Oryza sativa
gatctggcgtagtgcgggaagcctcacgctcctcctctatttatacatgaaaaaccctcctactcaaagtagacgtaggactcctattcacaataggactcaaaccttaatttccaaactcatctaaaccggaattcaatccacatagaatcccagccatatagcaaatctcagcgccgtcaaccgagccggactcggtctcctacgctcgtcccagctaactcgctcctgcggcttgtcctcccaggccgagccaaccagcaagcagcaagctgcacatgtacagcaccgtacatgcaaacacacacatgcatatgcaacagcatgcatatgcaccatgctacagtaccacgagtaaccaaatattatcacacaatttccttcgcgaacaccgacgcttgcacgcacacctcgtgaagcccgttgcgaagatctctcccacacgatatccatccaccgtgtgccatctcgtatccaacttcgtcatccggtatccttaaccgtctggacctcaactcctccctgagtctagtcccgatctccaccgttgaccgaagttgacctccaagaatcctgactctagtcaccttctcatatggtatcccgaccacactagacctctgctcctccctgagcatagtcccggtcctcaccattgaccaaggccgacctcaagtcacctgcacacaatcagacaaaacaaccgttcctgggcacagatatcacaacctgacccacattagtcacacgcactcacaccaacattcacacaaactctcaaaccaattctttgaataaatcattcgcacagccaattattcatcacaaataataatcatgacagtgatttcacatatagctagtactctgcttcaagttcggggatgcatggagatcgtcacgctggtcagtaaacatgcatcaccatacatatagtcatcacaatcccatagggcaagttgtacattgatcactgccgaaaatttgacattttggccccttttgaaaactatttgcaaatttggtccctggcaaaaactatcaccagatctggaccccgaccttagcgcaaggccgacggcgctgaggttgaacaactcagcgccaaccgcatcggcgctgagtacttgacggccctaagggaaggatgaacggaacggcgcaatgccagcgccgaccgacttggcgctaagcttcgggacctcagcgccatcgggtctggcgcggaggtcctatcacctttggccgacccgcgcacagcagccggggccttctttcttcctcagtggctctcgactgaggcgcgcgggcgccgaaccatctctctcttcccctccaaaaaatcgaaaaaatctccactaaatcgtcgcattttggaggggaaattattggaggacatagtggcaaggtattctcctcagaatcctctcgtcatttcgcatttttttgcttggatttgctcattgatggatgaaccctagaatcgtgatttggggttattttcccaaattagttggttctctactctgtggttgtagttgttgttggtgatgtaatggttagatgctcatagaaccctaatttttagtggagattttcggcacttagggaagaaccctaatttttcccccaaattagtaaagaacacttcttttttgtttaattttcatcacaatgcgagagttcaaatttaggatggatcgttacaaatggaagtttgcgtatgtttagatatttatggacaatttcgttgggggacatagttgtaggttagatttttttttattgcaaattcaagtttttaaaaaatgcaatatgctaatatgtcggttaatgttgtagatggatagattagtacgattgcactatggtggttcggtggtagagcaaagtaacagtggtaacaatttcgaggggatgagtgttaagcaacttatatttggtggaaaacctagttttgaggagttagtttgtcatacaaaggatgtgctggggtggagcaatcagtctatagctatacaaggtagatatgatgttggagcaggacccatttcacacaagtacatgctagatttgaatggggagttggagtggaacacatatgtggatatagtgttgggctcccaattcaagtcgcttgaggtggttgcttcgaagcttgatcgtactg

SEQ ID NO: 20204 - DNA, 629 bp, Oryza sativa
aaaaattggaagatcaaattataaatgtttgaatcatgagagacgctccgttgccctctacttgcagtattctactccaagtagaattaatctcaaccgtttattttaaagggtagattagtaaagtgctaaaaccgaataggggtaaatctggcacttaatttttttttctcatttgtgcgtcctatggtcaagcgtcgccgatccctcttcatcgaacagcagagtcgccgtttcctcattaatcaaaaaggagagcgcagggaaagaaaaagaaaagtagatcgtgaggtccggccaccgccggcgcttgtgcatcgcgttccatagatgtttcttgctgtaggtatttggtttccattcagcttgattgtttcatatgaaatttaaatatattagttatatatctgaatattacacacgatggacaaatcgaaacactccaatccagcaatgacagatacaaggcaacggaagaataatccggtatgttttttacatagactttacaattgcaattacaacaagtaatatacattgaaccacaaaaacgatgatatacacagatgggtactttcaaaaccacaagctgttaataagctatagttctgaaaaaaaacatggccata

SEQ ID NO: 20205 - DNA, 731 bp, Oryza sativa
agcttaaaatgggtgacgtggtcgaactgatccctttggctcaatgcaatcctgaggctggaggttatgcgagggagttccaccaaatgtatgaccaccggctcacagtttcgcagtcgtgacaactctaggataccaaaaactatgtacatatatatacatgacagattgacagcccatcaagatcgtcggaagtttaggtttccctttactgacaaatagaagcactactcgggaatcatctgaaaaagatcaaggaatcgtttccctgtgccaaatgcgcgcgcgtgtgtgacatatcttttacatttgtgtttgtttatatgttaactaaagaggagtagagtgtcaatacgtgaaacatttctggagttttagtccaagaaatgatccctgtttgggacagtgtatcattgtaagcttctatggctgtgcaatgtgtgacgtttcttcaactgaaatatatgaaaatatatgggtttcctgcctgcatctgcttgctctgactgatatagcatactacttactaacccagatttgaagtgcagctgagtttaaccacttactgtcacatggaacaaacgaaaagtgtatcattgtaagcttctatggctgtgcaatgtgtgacgtttcctcaactgaaatatatgaaattatatggctttcctgcctgcatctgctattctgcttgctctgactgataaagcatagtactacttactaacctagat

SEQ ID NO: 20206 - DNA, 3730 bp, Oryza sativa
atttttgctaaaaatcaaggtaaaaaacacattattctccattccttctcaatatatcgatcatcatatatttttcttcgtatgttgttaatttcaagtggatcgtagatggatatactatgcgcatcgttcgtctaccgagtatagagagggggtcactgaatttgtcacatttgcggataatgacagaaaaagtaggatgagcatgcacatgttgtgtccatgtagggactgtaagaatgaacagatgatcgttgatagcgataaagtgcatgctcatttgataatgaatggatttatgaagaaatatacctgctgcaccaagcatggagagcaagaggcgcctgatgtcgcagctgaagatttgttggatcaggatgcagagaacaccgccgcagctcgagaaggcatgttcgtaccttctcctttaggtggagagaccatatatttggacactcaatgtctatctacaatgttgcatgacattgaagatgtaaaggacaacgacagagattttgagaagtttagtaagttggtggaagattgtcagatgcccttgtatgatggatacaagtcgaagcacagcaagttgtcatgcgtgttggaactcatgaagcttaaggctagtaatggctggtcggacaagagttttacaaaacttcttgagctgttaaaggacctgttgccagaggggaacaatttaccgcagacaacatatgaagcgaagcaagtattatgtccgttgggcctgaaggtcagaagaattcatgcatgtccgaatgactgcattttgtactacaaggaatacgctgacttggatgtctgccctgtctgtggggcatcaagatacaaacgagcaaagagtgaaggtgaaggaagtaagtcaaagaggggaggcccagcaaaggtggtgtggtatctcccaattgcggagcgcatgaagagaatgtttgcgaatatggaacaagctaagctagtgcgctggcatgccgaagaacggaaagtcgatagtatgctgaggcacccagcagattcagtacagtggaggacaatcgataggatttaccaggaattctcaaatgacccaagaaacatgcgtttcgcaatgtgtacggacggcattaatccatttggtgatttgagcagtcgtcacggtacatggccagttctgcttgttaactataaccttcctccctggttatgttcaaaagaaagtatattattcttgccatgctcatgcaaggaccgagacaacctgccaacgatatcgatgtgttccttgaaccgataatcgatgacttcgaaaggctatggaatgagggcacacgaacatgggacgcatatgcacaagagtatttcaacctccatgtgatgctgttttgtaccatcaatgattatccggcccttggaaactttctggccaaactgtgaaagggaaatgggcgtgttcggagtgtatggaggaaacaagatgcaaatggttgaagcattcacacaagacggtctacatgggtcacaggagatttctcccaaggtatcacccgtataggaatatgagaaagaatttcaatggacacagagatatagccggacccccggcagagctaacagggacagaggtgcacaatttagtgatgggaataactaacgagtttggaaaaaagaggaaagttggaaagacaaaagagaagagcacatcaaaggaaaaaacagaggagcatgtggaaaaacaaaagacaaaagagaggagcatgtggaaaaagaagtcaatattttggagactaccatactggaaggatcttgaagttcgccactacatagatttgatgcatgtcgagaagaatgtatgcgagagtttaatgggattactgcttaacccaggtactacaaaggatggtctcaacgcctgacgagatctggaagaaatgggtgttcgctcggaagtacatcccataaccacggaatccggcagggtttaccttcctccagcctgctacactctctcgaaagaagagaagattgatttactaacatgtttgagtggtataaaggttccatctggttactcatcaagaatcagtaggctcgtttcactgcaagatcttaagttggtaggaatgaagtcgcatgattgcgacgttcttatcacacagctgttgcccgttgaaataaggaatattttgcctcctaaggtgcgacacacgatccagcggttgtgttccttcttccatgcaatcggccagaagatcattgatcccgagggactagatgaactacaggcagaacttgtgagaaccctatgtcatcttgagatgtactttcctccaactttctttgacataatggaacatcttcccgtgcaccttgtgaggcaaacgaagtgctgtggtccagcattcatgacacagatgtatccttgcgaaaggtacctggggatccttaagggttatgtatggaaccgttcacaccccgaggggagtatcatcgagagttacaccaccgaagaggtcatcgatttttgtgtggactacatgtcagaaacatcttcaattggattaccacgatctcatcacgaagggaggcttgatggtgttggtactgttggaagaaagactattaggttggatcggaaggtgtacgataaagctcatttcacggtactgcagcatatgactgaggtggtgccgtacgttgacgaacgccttgcagttctccgacaagagaacccaggccgatcagagagttgggtcagaaataagcacatgtcttctttcaacgagtggctgaagaaccgaattgccaggttgcagaacttgtctagtgaaacacttcagtggttgtcacagggtcctaaatggagtgccaccacctggcaaggatatgacataaatggatacacctttcacacggtaaagcaagacagcaaatgcaccatgcagaacagtgggttacgcatcgaggctgctagtgacggtggtcgtcgtgatcaatactatggtagagttgagcaaatattggagctagattacttgaagttcaaagtcccgttgtttcgttgtcgatgggtcgatcttcgcaatgtaaaagttgacaatgaaggtttcaccactgtcaacttggctaacaacgcgtacaaggatgaaccgttcgttctcgctaaacaagttgttcaagtgttctacatagttgacccgtgtaacaagaaactacatgttgttcgcgaagagaaaaggagaattgttggattggacaatattgcagacgaggatgattacaaccagcacgtccacggtataggtcaagaaatacctctagaagaggaggaagaagaagatgaagttcaatatgcacgcgtcgaccatgaggaaggattatttttgtaatttatgtacgtagtttatgtctacatgtctgttatctatatgactctgatatgttcgcaatgatcaatagtatattccttatgaaatagtcaaataaaataattaagtgaagcacccactagaagtgaaataaaataattaagcaagtataaccattggaaataaaataataaaattagtaaaataatgtagtgcaattactactgttagtgaaataaaataattaagtataacaaaatatgtagtgtatgtggaaatatgttaaagaaaataaaagaactaagtgaaataaaataaaataaaattgttgtaggcaaactcatctgtgacgggctctaactgtgggg

SEQ ID NO: 20207 - DNA, 3960 bp, Oryza sativa
ctcttgaccgggacctccacggtgagcacacgcccccacctccccttgtttactattggtcgccgattaccccctcttctcctccttagcaccgccgtgccaagaagccgccgccgcgccgccgtgccgagaagccgtgcgccgtgcgccggccgggactcgtcgtcgccgtgcgccgcctcctctgctcgtcatctcctctccaggtacccctctctctctctctgatgccgatgaatggaatggtgcagtggatggatgaatgaatgatgcaatgcaatggatgaatgaatgatgaactttggatgaacgatgaattttggggacaattgtgctctttctgaattgaaaatgcatatgtataattgtgccattttgaaacttgaatgtggatttaagtgccattttgacatgttaccattcatggagtgtatactgctttatatgttgttttgttcccttttgctagaactattgaattttggggataatgtttacatttagctgaaaaaggatggattgatagattggcaacagtgtggttagctagctagaaatagtttgtctagctagctagttaggggttatgttcgcttttcatttttttccctgtgctttccctgtgccccttattcatttttttctgcatagattatctacacttgttctttttttaatgcataagatcaaattatctacacttgttctttttttctgcataagaacagatttcctcctagcagctgatttcctctttttttcccttcatgcaaatgatggtaattgatgcataatttctgagcaaaactgaggccatatctttcatagtataccccttattacattggatctaatgctatttagtataatggtaggaaatttataagctttttcgtaaaaattagaccatgacaacgcccggcgcaaacccgccctccccaacacctgcgaggatccaggaagaagcaaacccagccacggagacagttgccgaaggtcatccctcgacaacagcggtcgaacaacccgaaattcatggtaatttataggacaaattttcaccacatgaccacataaattttagctagcaccctttaccaaatgttgccttctgtttgtgctgcagaattgccgtaggaacaacatacgtcgatgtcgggcgggacaagtgcaagtaggtcgagtagaaatccccggtcacaaaatatatggccgaccacagtgcaagttataagagaggttgacgctagtggtaggcccacggcgcccaggactgtcattggaagatggtctaactgctgcgggctggcggcacgtgagaacttcgggatcctctataaagatatcggtaaggtcacagaagccgagaaagaacgagcttggacggcaatggagaaatggttcacatttccggctgaagcaaaggataggctcaagcggaaggcattccataagatgtgcaaagcttggaagaattggaagtcgaagctcttcaccaagtttgtcaacccgcccagcaatcatacgccgttcgatgaataccctcaaataaccgaagcggtgtgggaggaattctgctctctcaagaacacccaagagtttagggaatcaagcgaggcacatcgcctactgcaacagcggaatgagcacccgcatcggctgggcaccgcagggtacatcggcaaggaggcaatatgggcccaagaagatgcagccgcagcagcaacgaatgtccctcccccgttttcagacatccctgaacaaagagctcgcaactgggcgcgggcaaggggtaaggtcaacccggacggctctgtcacatttgagaacaaaattgatgccgtcgtctatcaggaactggtgagttcactacttaacctaactaatttctgttcgtataaagtacaagttcgtataaacgacttttttttttcctagttgggcttggttgctgaacaagcttcacaaagcgaggttgagtccgcgccgaagaggcgcgaatatgacatcctcagaaaggcgctcggaaccaaagaacatcctgaccggactcggggaattggtagcgatgtgccctggaagcatggactcccgcagtacagctcccaatacaggaaacggaaagtctccaaggaagagagggacgttcgtttgaaggccgaacttaaggttgaggtcattcaagaactagaagctagcatgaatgctagggtggaagaaagggttaacaaggtcctcgccgacatgaatataccctgaggcacaacacctgttgtgcatccaactcctcgtgcacaacacgacgcgagtccgtcacagcataggagtagttgtgcatccacagaggtgccagcccctggtctcccggtcgcaccactagctgcagtggaccacatcgaggtaattgatgttatccgatccatatctaataaaaaacctttacacgttccaatattaaattcaaactttcacatatgcagggcgcagcacagtgtgtcctactggcgagagtccacccaactttcgctcctgaagtcgctgagggcatggctttcaagcccttggttacagacaaggtccacggcacagacctgctagctgggtatgccaaggtgtccatcgattcagtaaaggacacctggttaggctatccgctggccgtgccccccaatgatgaaatcatgactttgggcgatgcgcgcaagacgttcatacaatggcccaaagaagacatagttgtgagtccaagtcgaccgacggagcttacacctcccaagtctaagctatcaattgaggctccccgtggaccggcattgtcagtacctcattctcctggtggagctgatatggacttggcagatatagctcaaagcttggctccaataaagaccacaagaaagaccaatagctccccaccacttgtcaagggccagaagcgtgaacgcggcaaggggaaggtcggggagttggcgccggagccaaaaaggggcaaggctgtgacgtcgatgccggtgagcaaagcggggaaggtcgtgagggcgccggcccaatttgagctaggcatgccattggtggaggacaatgtgttagccgtgatgggtattgcttgccgagagctacataagcaatacatggagctaagcaatgccaagcggaaaatgagggagtcatccatagttggacatcatgaccaccagccattcctatcgtcgcctgcctatataactataggatttgatgacctcttcgaccttttcaggatccggaagttggacactggtcttctaaaatgctactccttgtaagtgcataccttctatacttgtgatatgattggactatatctcctaattaaattagttctaatacgtaaatgttttaaggttgtgttggatcgagagtcgtcgccttggtaatcaggttgggttctttgatccatccatggtgaacgaggttaatttacgacagagcttcactgaggtggttgactatgtcaaccggtgtttatgggcccatcaagacaaggagtacatcatgtgcgcacacaaccaagagtaagaggacaatatccttcgtgtatattatttttgaagttaaggttcttagtactaacgctacataaccactgcgcaggcgacattggattctcttagtcatcatacctaagtggagtagggttacctaccttaactccaataatttcaaagattatgatttcagtgaaatcaccaaggccttaaatatggcttggggcccatatgtggaaaagggtggtaggcacaaggagggcaaggacgaactttatcatgacccaagtttgcatgcgcacaacagatcggagaccaatgtggtttccacgtgtgccacaacatgtcaacatttctaagacaggtgaaagatttcgaccctgaggttgttgctaatggcgaataagctcatttcaatacaaacattggtatt

SEQ ID NO: 20208 - DNA, 6015 bp, Oryza sativa
gtgctgttggtgcactttgtaaacacagagagaagcaataaagttgttatctactttgagagttcttcaatttgtgtttcttcgggttcaggcggtagggaggaggttcgaccggcagcgtgcgagcggtccgaccagcgacggcgacaggactacgtcgagatttccatcgatttgagggtaacttttatttccgctaaaagtttttgggtttttggttttccctaccattcatccccctctggtaggcttggtttcttgcgttcgatcctacactatatatatcacggcgtgtcggccggtgcacgtcaatctcaataggcagtatatactgccctgttagaatcagctcggctatctttaataccgatttcaaggccaagattctagcttgccattgggccacgtggcagcctcaaaattcagctagacacctcagaaatccttccacgtgtccatctatatagttctacctttctccagcttattggtacacatgtgctagataactcgagggaaaaagtatccagtagaacaattacagattctagatgctttcaactatctagctgtttgcaacatttaggctccaagaggcattaaactgtctcattgaagataaatcataattggtttgggaaaaaaatataaatccataaaaaaaaggtgcagagggccggctcttacagatacaagtgaggcgccggagagaaaggcggcatcgaggaagacagcataaatatatggtaatgactgaaatatttttactaggagtcagaacgcatatatattggcaacttccgataaaacatactacctcctacttttaatagatgatgccgtttactttttatcaaacgtttaaccattcgtcttatttaaaaatttatgtaattataatttattttattgtgagttgttttatcactcaaagtattttaagcaacatttatatcttatacatttgcataattttttttataaactaatggtcaaacatgtattcaaaagtcagtgacaccatctattaaaaaacggaggaagtatatacggatttagtcctctttggaattttgtactataatttcttcttttaaaatctgcatgaaaaaaaatatagaatacatttttatcgacaagataattatgaagcaaaagacttagggcttgtttattttgctaccattttcaaccttaccaagttttggtattgccaaattttagtcaaattttggtaagttaccaaaattttggcaatgttactaaattttggcaagatttcatatgtacttactaaaatttggcaacagactgactaaatgtagccaaaattttggtaactttgtaaaaaaaaatggtatggttgaaaatggtatcaaaatgaataagcctttaggtgtgttctttttcctcttactattatggattataaagggcatgcttcacaagcttatggtttattatttgatttgttttatatcaatacatcaactttataatatttttaagctctgaaataattgttatacaccagtttcatctatagtccatcatcaatcgaaacttaaacgctacaggagcatcgtcaatcgaaacttaaatactgcaggagattaggctaatagtatgatatgcaaaatagaatatttgatgaaaatcgagataactctgaaaaaatcctgtaaattttcatattctaaacacaccctggaaaaattacatgcgttatctagcgcgtcatatggcgcgctaattttctagtttcctcgatttcaggagcatatttttcaaaatattaaatgatagacttcgtaaaaaaaatatgtatagaagttattttaaaaatgctatataaatattttttatttgtaaataactattacttaaattatttttttatcatgtttctcgttttacgtgcagctaatgtgttgtttttatccctggtttagaacacgcccttagcttgttttcgcctagctaactagcacaacacgcgtaagagaaacatgcttgtaaatagttttactcttactacatataatacttcctccattttataatataagactttctaacattatccacattcatttaaatgctaatgaatctagatatatatgtgtgactagattcattgacatatatatggatgtgtgcaatgctagaaagtcttatattatgaaatggagggagtatgtcggtattatcttgtactggttcgttaaaaaaaataattagccggtttaacgaagtgagcataattagttaggttcttttggtagaatcaatctacccaatttcaagtcgtatttatggctatttattttttcagtgatagacgtcgtatccgtcgttagcaagacattcgtgatgactttgtcaatctaaaaatgtgccggtccagtttttcggatatgtacatagaaatatggtatacgtgtgtgcgtttataagcatgagtgaacgtgtgtttgtaaaacaaacttaaacatgatgcaccatagatcacacgagcgaagcttatctagaaactgcaggctccagtttggccatcccaggctcccagcacacccgctcaatatgacagaagtttagagggagagaatatgcggtaattgttttcagtggagttggttacatactaatttcttataaaaatgttgatgattgtgtcacgttatgaacgaatcttgatttttcttataactcgcgactaattaaataaaatgttgaaatcattataaggaagaagtttataagactaccttttctattgcaatgctctttatcataaagacgaacgacctgtcactggtcatattactatataatacgctgaaacaactggtgctagggaaaggaaaaaaaagtttgaattacacctccgaactattgagcgagtaaaaattaccacctagactttagaccccctttgaatcaaatgaaattcataataattttagaggatttcggggctgtttggttcacatactaacattgcctaggtttaccatgttttcttagctaaacttaccaaaggtgaggccatcaaaatccaagccacactctagccaacaaaatgaaaccatgccacactttttagagtcacttacatgtgggacctagattacaaaagaggaatcttgccacatttgtgggagtcaaccaaacactaacctaacatgatcaaacttgcctaaccttaagtgtgacaaagtgtagcaacttatggctatcattcctataggaatttttcctataaagccttttgaatcaaaggaatgagctctatggaatcttatgaaattcctatggaatgcctcttcccatacaagttttggaggaattttaacaagaggtagaacctcatggaagaaatcctttgagtctttatctctcctcaaattcctgtattttttctgtggtccaattaaacggtcattcctatgtttttcctatgttttgcaatcctcttttttacacttacattcctgtcaaaatcctatatttttcatattcctccgtttttttattcctgtgattcaaaggggcccttagagtggttttgatcctacgtggcagactagtcaatattttttttaaaaaaatggtagtaccctgcgttcacgaaagttggtaggacccgtccatctcttattgcaggtggtttccactgatttattatgaaaattattgactttgctgccataatataggaccaaaaccactttggattgtgttaaggggattttcattcaataaaaaaattcaatattaatattaatagagcgttcgtgaaaatattaatagttgagagtgaaaaatgtatgattttcatgtctagggtttaatttgcaagtatccaataattagagggtgtaatttggacttttttccatagagaaatggggactgagtcaaacaacacatcattactgtagtagactgtgagtctgtgaagatagtataaatgtatgcttagcgcctagaggcacgccgaagccagacaggcagcgcagacactaaccgtggagtagtctgatcgatctatagaaatactgtagccaaaaactaggccaagagagagattggggtgttctgagcgtagccgaagacatggcaactgatggccacataacacacttcgctcatccacagcacctgcttctcaagacccggtatgacagcacctcgcgccatgtctgcgacatctgccgagccaagctctccggcctcgtcggctaccgctgcaacgcctgcgacttcgacatccatcaggcctgcgccgattacttcaagaagaccatcttcttcttcgcccatccgtggcataccctcactctgagctccatacccgatggaagcaccacgtggtcgtgcgacctttgcagggagaattgcccccggggaaacttcgtgtaccgctgcatccagtgcgccttcgacgtgcaccctctctgcattttgctcccgcaaacgatccgtagcccgcttcaccagcagcatgatatccacatggtcccttcatggggccgctgctccgcctgccgtgaagatttggacctttggtactaccagtgtggcttttgtctgtttaagctacatatccgttgcgtctctggcgcgccaagtggtgtcggtcagggtagcgggcctagcggagtaaggccttgtttagttcaggaaatttttttagatttagtggatatacggacacacatttgaatatttaaagtattaaacatagtctaataacaaaataaattacagatttcgtaaaaaaactgcgagacgaatttattaagcctaattaatccatcattagcaaatgtttactttaacatcacattgtcaaattatgacacaattagacttaaaagatccgcctcataatttatatacaatttgcgtaattgattttttttctacatttaatactccatgcatgtgtctaaacattcgatgtgacagcatggaattttttgttttgggaactaaaaagagccttgcaccagcaacgctgccatccgaactaccagtgatgctcagagcattgccatcgttcggcggagctgcagctctggtatcaccaagtttctcgtcaagaaaagcttcatggtcgcgattaacctagcaacaggcgggctggcatcgccggtgctcgacgtccttgaagctgtcctcgattaattgccacgtcgatgatcaccaggcctgtttggctcatctatgtatgtgtgtaagatcacctgtcgtttcaattccgttgaactttcttcttctccaataatgtgtagtaacccattgttcgatccacaagcggtataggctaagtcaagtcaaccgtatatgcccatcgaatcgcactacgccggaccaggtcatctctgacggacccaaaccctcacctttgacgggtttggtcttggtcagtgattagtggtcactgatgacaaaatcacctgtgatggatgaaacacccgtcacagataacccatctctgaccggtatataagtcatctctgacgggttaaaacttgtcacccgttacagatgagtcatcagtgacgtgtcgtaactacctgaccgtcactgatgactcatctctgacgggttgtaacttacgacccgtcactgatgacaaagcaagaaatacaatttttgaattttaaacgcaacaaaaaacctcaaaaaaatattttgaattttactagccatcctatacatggttacacatcactacctacaaattcacaatttttcacacaatataacttgtatgctacaagtgagattcgaacttaagacctcaacctccatatagagctcccttaccaactcacctacttaacacatattgactactaacccaatgttattattttgtctatgcttgtctgaatcatttaacatatatttaacaccctaaatgacttcaaatgaaaatattatcaactaaatagttatagatttcatcgtgttttataacttttacataaaaaatatcttcat

SEQ ID NO: 20209 - DNA, 11518 bp, Oryza sativa
  unsure (1)..(11518): unsure at all n locations
nnnnnnnnnnnnnnnnnnnnnnnnnnnnnnnnaaaaaatattttttgaattttactagccatcctatacatggttacacatcactacctacaaattcacaatttttcacacaatataacttgtatgctacaagtgagattcgaacttaagacctcaacctccatatagagctcccttaccaactcacctacttaacacatattgactactaacccaatgttattattttgtctatgcttgtctgaatcatttaacatatatttaacaccctaaatgacttcaaatgaaaatattatcaactaaatagttatagatttcatcgtgttttataacttttacatagaaaatatcttcatccgatgttgtttgaagaattcaaaatttcatttttcaaaatatatctcactttataacatgtaaattttgtgaaatgaaaatattttcaattataatgttgtagatctgattgagttctatgactttgatacggggcatgtatccatccatgtcatttgaaaaaaaactcaaaattttgtttttaaaagtagatctgatcacttgtaatgcatgttcggggatgtaaacgatctctaatagaaatgttgttagttataaagttgtggatatcattgagagctacaacttttatataggacatgtttcaatccgaggttttttgcaaaatttaaaaatttgaattttcactcatcactgacgggtcataactaccacccgtcagagataacgttatctgtgacgtgtgttagttaaagacccgtcagagatgagtggtctcttttgtgatggttcataatactacacccgtcacagatgacatgtcatttgtgacgagccatggttgtgacccgtcacagacgatctgtgacgggttacaagtgcaagccgtcacagatgacttcacatctgtgacgggtcctccctggtagccatatattgaagaggatattttttcggcccgtcagagatgactcatctttgatgagttgcgttggcccgtcacagatgacccgtcactaaagcccggatctgtagtagtgtcggcaagttttttgttagtatatcttgtttctgtgtcctgtgttttctgtacgtacgccttatggatgtaatgttcaaataattaagcgaagatgaagtgggagagcgaagatggctttctaaacggagacccacgagctatgttatgttatgttatgattgctctccttttctcggttcctcggtgttctctttttttcttgttcttgtatttctcttgtttcggctggtttgtcagcctatcgggttttttaaaagaaaaatggaagcgggggactagagtattgccaaatatattaaaaggatagtgttgaacctgtttgtaaggaaaatcgaaaaaaaaaaccatactaaagtgaaaccgacgaaaacattacgcagaagacacagaaagtctgagacaaaacaactgcgaaccgcagaagacgggcaagcaaggctttcgccccggactccctcaaaaggtgcagaacttctaagaagccaaagcaaaactctcgcaccatggagagataagcacaccgctccaatctcagcaccacaacgagttcaataagccacaggacacgtgaagcaccggcgaggcctaagagacctaactacagacaggcaagaccaacaccgtggacgaacaaactcctcaagcaccgaaagagaccacggccagatctgaaagcagatggccaagggaaggttttgtatagtttcttttcaataagattcaggtggggagttttcctccccggtgaccgttaaacaatactccctccgtttcatattgtaagactttctatcattgcccacattcatatatatgcatatatgtgtctagattcattaacatctatatgaatatggataacgctagaaagtcttacattgtgaaacggagaaagtaataactaagtaattgtaatcgaatatttgttgggataaaatatgtactcaaatattgttaccaacaaacataactgtatttttcagttgttccaacaactttgaaccttccaaatgtttccacaaatcttaccttttatggcagttcaacttcttcgcagaaaaatcttaattcaaccaaatgggatgtactaccgcgttcataagggcatgtacaaaggtagagactaaggtggtgtttggatccagggacttaactttagtccctgtctttagacactaatttagagtattaaatatagattacttacaaaactaattacataaatgaaagctaattcacgagacaatttttttaagcctaattaatccataattagagaatgtttactgtggcatcacataggctaatcatggattagttaggctcaatagattcgtctcgcgaattagtccaagattatgaatgggttttattaatagtctacgtttaatatttataattaatattcaaacatccgatgtgatagggacttaaaagttttagtcccatctaaacagggcctaatatgagctctctatattaattaatatcactagagactatccttctacaatagtagagacaataagatttctaaaccattaatgcactaaatatttttttattatgcttctttccttttctataccctcatgcaacaaactttctgttaataaatgctaagagtcgactctgagccgttgttatgcgtagcaacgatgtttctcattccttccttctctttcttccacgtcaccaaatttacttgcatgacaacgaagagagcccgttattaaacaccattgtacatgccctagtattgttcttctagaaactgactccctgtagaaagacttgagattaatttgatagtggtcctctctctaccattcattagaaagatgatgctacatagaggtcttgcaggaacatcaatcatcagaatgtacatgatttgcacggtaacattactccctccatacacattataagatgttttgagtttgttctgtgttataaaaatatactaacagcatccctaactcaaaacaaatgtgctacataaatatattcaattgtggatttaatgaaactaattcggtgttatatttgcatattgtaatattattttttttataaattaggtcaagtttaaaaagtatgacttagaacaaacctaaagcatattatcttataatttggagcggagggcggagggagtagtctacttagaagtacaactatatttgtcatacaactccgacaactatttgcatgtttcttatgtaactgtaatgaccccctactcccctagtagccaactagctagtgtgtcacatatgggctattattatcaatattttcaagaaagtattgttattgttactataattgttaggttttgaccatatactattctgtaaatacgttggttgtttttgaaattatagggactaattagattggattaaaagaaaagtccaagttagggacaacatgctagtggttaatttctaatttagaattaaataataacttgtttatataattaagagtccaagacagtgcaacttcatatgtattagttttaaattttagaattgttcaattttggaaatagtaaaactaaaacatcaatgttatgtccaattacttattttatttaacataatctcttaattcaatggtcatgataatgtgattcaccttataaggagattccttctagttgatctcggggctctcccaaagagtatgaataaaagaataaaaactaaaggatgtgaccacgcatattttaccacggtatttccaattacatattttatttaccacaaactctcagtactatcagttttaggtaaaccttgagaaggagggcatgaagttaatgttttatattaagaagaaaaaggaatggacctagtttataagaaaaaatgggctagaaaaccaaacaaacgcatggttaattaagaaaaatcggcaaaatctcacatagaaagcgaaaagagcatgcggtgacacaactacatagactggccacaagtcatctttcccaagcttatcacgaataacaaacagctctgacttcctatgacgtacggacaactgtctcaaaaccacctaacactttgattgtgtagtaggaccttctggatgaaacctcccagaagaaaaaacaacgtcaaagacactgccaacacccattcggtaatcggactaggtttttacgtgaatgaagagaaccactatcatgattcctccaaggaggaaatggtgtccacaaacatcgacatcactggcaatggtcatagaggcttttgcccaaagctgtcacatctgctgaactcgtctagcgatgccataatgaaggtattgtgggttatcgttgttcagctcgccataccggatgcactagctccgagtccaccataactttatcattccaactccactccacatctaaaccctcaccacacagccaggacgagaaccctctcaatactatctatgaatcaactaatcgacaactacttaacatgacagatccctcaatggtccctatttcgaactaatactattttgaaaaatactaaactaaataatccaatataactttcccgaatacctgagggtataccatactcgtatgcttcgcaaccccaaggataggaggtatgcctaatctgtaaccctaacatgaagttactaggtaccaaattttacactagaaagtacctcgaggtaccaataatttgtggcatctcaaggtaattaacaatgttggatgacaaaattgcttttcaaaatataagggatttggttagattggacacatgttggtactataaatcttaatatcgtagtaataggattatgtcacatctaaccaaatcatattttaagacgaagcgagtacctttccatataccatattattgttgtcttgcagtagccgattgggcggttgccattaaaatcatgccagaccgtagtactgctccagttttcattccctccgtcccagaatataagcatttttagcatagtgttaagtcaaagattttttaactttgactatcaatataaaaaataaaaaggtcaaccatgtaaaattgacgttactagatttaccattaaacaaactatcataatatgcaactctttttatttaaaacattttatttctatagatattgttggtaaaaaaaatatcttgaagatcgtgtcgaagtccagaaatatttatattttaggatggagggagtactacacttgctccgagttgacttgacctgacttgtaagctagcctttttaagtccggccacttggaagaggacagacaatgcataagcatcaatgcatgtaggagtaatctacaacacatgcatgtcacagacgtcgttgctgctgcagctaccgttccatgtcgtgtttagaccctagcaagtccaccgcgaatggaaccgttccatggacttgctaggtcacgttcaaatcaatgtatatgtcccaacatttcaacatccacttgtacaaacccgattgaaactgtcaggtcggagcgaaacagccataatgcaagtcttcgtcgttccatcgctgtattactttaccagaaccgtgtgatcgaactcccaccagctatcccagagtcgacttgacctagccagtccaccgcgccctgccccctccaacgatgcggccgtgtacgcgtacaagtgcaacacggagagctagcagaggcacgtacgtaaaaacagtgcaacgtgtgattgcttgctgaccaagtgaccatgtaaaaccgatggcaccatgcacatcctcacgtcaccagctagctagcttcggaggacacctgcgtacaaccagtaggaaagccaccgtgcctgccacatctgcgaattattgcgcccgtcaccggcgtcggctaccgctgcaaccaccagtccaccaccactgcagcgacttcgccatccacgaggcttgcgccgaccgcttcgcccgggacacgatccacgggttcttcgcgcacccgcagcacccgctaagagcatatacaatagcagactataaaccaacatattttaattaattaagaagataaaagagaagagagaaaagtagcggtgcaacacggactgcaagattacttctaattaattcattatctcttggagtagccgattggcattaaaatcagagttaacttgacctgacttttatttcttccgtcccataaaaaacaaacctaatatgagatatgagatatgacctgacttgtactctctccgttacatcccgtactcttatttatagaactagaatatgtcatatcccatattaggattggttttatgggatggaggaagtaagtcttagactgcgattgaatcgtggtagtatctttcctcttcggcacgaaagatgatgtgatgacccattaactacgttttagctatagaaaaaaactttaaaaataatttaatataatttttaaaagtaatttttatgtagaattcatttttaaaaacacactgttttacagtttgagaaatatatacttacgaaaatcatgaaaatagattatggaggatcgaacatagccggccggttagaagggcctgtttggtacagctccaactcctaatttagctccaggagttgagtctagagcggagttgtggagctgtctaaacccagttccacaactctagtttattttgtgagagagctccacccagctccattcccattattggtagagctgaaactgtttagctgagctccagctcctggagaggtggagctggagctggagctatgccaaacaggcccgaagcagcgggtaccagctagcctgagttatttgtgctacactcaaaacgagatagtacgtcattagtgacttagcgagtgattagttgaatataatcgattacaaacttataaatagatttatttgatttttttaaaaaaaaattataccgactacgtccaaaaatgtaaaaatttgcaaggttagatacgagtatcaagaaaacaatgtggaattaaatgagacaatattgtgattgatagagaataataagtagaggaagacattcagccccatcgtttcgcttatatatacttatacttataagcaaaatttaaatactaaaacttaattaattttgtggtttcttttatcttagtttatattataacatttaattttgattgctaagggaaagtatatgaaaattgtaagcacaaattattatttgttttgctaataagccatatgtacaagtataatcataaacgaaacgatatggatgtttgaatatggtgggaaagttgttatattttacaacaattttaaatgctataagttattatattttgggatagggaaaatatgtagaactttttcgcacgacgcatgtagttaagtaaattttcagaatttttgactagccagagttcagctataaggacgataccttaagttctcaaattcgactagagtaccagcatgttgtaaattttctgaattttcgatgagaaaattccacatgtcacagtttgctgctgttgcattccatgtcgtgttcggtacgtatttagtactatttactacaggttcaaatcaatgtatatatactacatttcctaacatttcaacatctcttgtacatacccgatcgaaactgaatcagaccggagcgaaacaaccgagtctcccgttcgtttcttctgtaaaagtggatgaaaatttggatactcatgacacgcttttcaaacggttaaacggtacatttcgtgcgaaaactttctatataaaagttgttctaaaatattagattaatccatttttcaagtttgtaataattaaaacctaattaatcacatgttattaccacctcgtttttctgtgaaacacttaatctcttaatctccatcttcatcttcctctctgtacttattacccgaattaaccgcgtgaacccatagttgactgaccttgtaaaagctcttgcaaatccactgtctggccccctccaaggatgcatcatgcgtgtatgtaagggtctgtttagtacagatccagctctcgctccatctcttctagagttggagctcagctaaacagtttcagctccacctaaaatgggagcagagttggacggagctctctcacaaaataaacacagctccacaactccactccagacccaactcctgtagctaaatttaggagttggagctctactaaacaggccctaagaaaagtattttcatctggggatatcctttatttatttcttacatgatatttaaatagttattaaaaatatatgaaaaataattaacaagatagattaattatatgaaacataaggtcaaatgcaacataaaaaaaagaacaagttaattaacttatgtctatgtatgtaagcgtgctcttctctctgtgtatatatattggcacccggaactcaaagcgcaacacaaattaagagcagtgcacacgtacgtaaaaacagtacaccgcacgagctatacgagcgagagcgatcaagctatagtgattgctggccatggaaaaccgctggcacgttgcacatccacagcaccagcttcagaggtgcacatacaaccagcgggatcagatcagccaccgtgcctgcaacatctgcgagctacccatcaccggcgtcggctaccgctgcaaccaccaccactgtagcgacttcaccatccacgaggcttgcgccgaccgcttcgcccgggacacgatccacggcttcttcgcgcacccgcggcacccgctaaccgcggttgtggcctcggcgaaccccgggtggtgcgacctgtgccaggggcggatccagcccggccgcctcgtgtaccgctgcgcggagtgcgcgttcgacgtgcacccgctgtgcacgctgctgccgatgaccatccacccggccgccgggtgccacgggcacgtcctcaacttggtcccggcgcgcggggagtgcgcggcgtgccaccgggactgctccatctggcattaccggtgcggcctatgtctgttcatgctccacatcggctgcgtttcgccggccggcgccggcggtgctccagctggtgcgaggggttggcctgccaccggtggcggcggcggctgggccgccggtagcagtcccatcgtgaggtttctgatcatgttcgcccggcaactggcggtgaatttaattgtcaatgatattacggacatcctaaatgcgctatagtaagatgtgtgtgtgtgtttatataggtgattattgtgagcaactgatagcaccgggatggttgcataagttgcaagtaagtgggagtggattgaggggacatctttttcttctaaattcgatgcaaatagttgtgaaaaattctgaaaaaaattaaaaatgtagagtataatgatacctactagtccaccaaaattcatgttcaaattcgatctacacatcgagaaacaaaaaagacaaatttatatataaacagttcgctactattcatacgctgaatttgtcttttttatatctcgacgtgtgagttgagtttggacttaagattttgtggagttatatatatgtgttgtatgaatgttgtcaaatttttctagaatttttcataactgtttagatggtttttgagcaaacgagaaaacatcccctcgagggattagaatagtttcccgcaagtaaatagatatttgagcttcatctttcgtaattggtgttctgggtgcgaggagtgggtgatgatgctcgctatcctagcttggagagatgcaaaagatgttagaaattttgtgctagtttttttttactccctccgtctctaaatatttaacgccgttgacttttttaaaacatgtttgaccgttcgtcttattcaaaaacttgtgtaaaatatgtaaaactatatgtatacataaaagtatatttaacaatgaattgaatgataggaaaaaaattaataattagttaaattttttgaataagacaaacggttaaacatattttaaaaaatcaattgcgtcaaatatttagggtgagaggaagtatctttaaaaataatgtcaatatatataaagcaagaaacatctatttgctctcgagatggaaagcattcaaacagtgacgtgtgtatgaatttttttagcctgaacaagccttattagatataaaaactatatatatgcacaaaaccgaacaataacttcatagactatttatcatagataacttcataacagtcactgatgatccgttagaggtgagcggatcctgcgtagtagtttattgtccacgaaagataaggtctgctatagagttgtgttgctttggctctatggtcacagaaatgatggtttagcccttgttttgcttgttaatttattgagtaattatataattaaccttcagtagaacaaactaagtaatgtaattagataaataataattagtaatatgcatatataattgtgggtggtgtgaaaatgtttatgtaatgtgtatggcatcgtttgagttttttatttgaattgaatatagattggagatatggagtttgttttccatgaagagctcatccaataaatccacacagctatattttagatccaccctataattaacggtttagattttttttctcatattaatatgtaatttgagagcaaacataaaagcttatttctttgcaattacactttaataagataatagtctttcggtccttccatttcaaaataactttaactttaagtttagacttggacgttcaaaacaatgtagaagaaaaaaacaccaaagtgtcgctcactaataggaaactagtatatatgcgtggataggtagataggtaggtaaggataggtaaaagatattgatggagtaaaaaaaattcatcaaattgtggattagagcatgataggtaagttgataaaggtaaacttattttgagacgaggtagaggctaaaagtaaagttattttgagactaagggggagtaagataatagctagacttaaaaataagtagaaactaagtcaaaacaagccgcatatgataattttgagttacatttttacgtgttgtacatgcatgttgcacatctcacattttttttaaaatatttttatgtacatttaagtatacacaacatttacaatttaacgtttgtacaacatgtactgtatattaacgcacaagcaatatgcttccatatatgaaaatatggagaaattagttcatgctttgactctatgaggcattatgacggagctcgtggctcctcaccgggagaccgcgcaggcccccctttgccagttcggccgggggcttagggtgagatctcaagctctctctgtatgtggaaagatcgcgtgccaggaagaaacgcgagacacggacgatgtatacaggttcgggccgctgggaagcgtaataccctactcctgtgttttttgtggatctgtgta

SEQ ID NO: 20210 - DNA, 3007 bp, Oryza sativa
  unsure (1)..(3007): unsure at all n locations
accaagggcttacgtgcgcatctctaagaggtaacacgctagctccggctggagacgtgtgcctagaggctctcgtcttgacgggacggggcgaggcgtgcgtcagaccgccagtcgccacctaaccgttgatccgaccggtctgtgactggtcacagaccggataaaagagcgcgctgcattgcgctgcatgcagcgtgacacgcttgaccagaccgcaataaatgcggttaggtgagccctaccgtgttcacccaacctatgtacatagtgcaaaccccacagggggtcggggcacctcgtccctcggggccggggcaggagcaacccgacccccccttggggaaatcaggaggagggcggacacctcaccctcgggcccgacgtccccgaaggtgccaggccacgtgggcgattccatctgcctcaagcctccgggcgcaatactcccggtcccatatcaccgacagtagcccccggcgttatgtcagggcgatcatccttctcaagggaagcggtcgggcatgacgccactcataaagcctggtgacaggtgggaccggtctccgtgattgggcagaaacccaacggtctcaaaccacgcatatcggtaacggtgtcttggccgtcagtcatgggcggtctcttcaagactgccacatcacttgagcagcgctcgaatctgggcgtgcagattcgtttcgtctggagacatggtaacgtcgcttcggtcggcgagcgtaattaacgcgcacacgatacgatctatctcgactgccacaaccgcatatccacctcatgcgccgcaagcgggcgaatggaattagtggaagcgtgggcgcgagaaacgagggagcgagatagcgagtaacgagggggcgagatagtgggcacgagaaacgaggagccggactcagcgatggcaagggtataaagccatcgaggaaaggacttgctcccttcctttcgccactattcccctttccttcgccgtttgcgccctaaactctctctttgctgcgcctcaccttcgccacacacgctcgttctcaaccctctctttctccgacgacatggcacggggctccgctctgctcgacggtagcgtactaccaccttcccgcattgtgagcgagaggcaggctgggctgccgcgccgcttcatgccggaatctgccaccggccgggagatagtgatgctgggcgaggcgcgcccagcaccagattacccggggcggtccatcttcttcctccccttcgcaatggccgggttggttcctcctttttcttctttctttatggatgttctggagttctacgatctccagatggcgcacctcacccccaacgcagtgatgactttggccatcttcgcgcacctgtgcgagatgttcattggggtgcgcccatctcttcggctgttccggtggttcttcaccgtgcagtcggtgtcgccgccgtcggtggtcggtggttgctacttccagccgcgggggccggtgttgaaccgctacatcccctgcgccctccgcaagaagtgggacgattggaagagcgactggttctacaccccccttgccaacgaagcgcgcctccgactcccaagccagcccccggctccggtctccagctggcgggcgccagtagatctgggggatgactatgacgccgtcctcgaccgcctggcgggcctgcgatctcaggggctcacaggggccatggtgtacggcgactacctccgtcgccggattgcgccgcttcagcggcgcgcccggagcgcatgggagtacaccgggtccgaggactacatgaggacccaccggggagtcagatgggattgggctcccgatgacttcaagatcgtggtccaaagggtgctgaatctcagctccgtggaggcgtctcttattcctcaaggactcctccccctctgctgcgatccagaccgcgcctccattctgaccatcatgatgggggtcggggcctcagaggaggtggctcctaagggccacgacggcgccggcgggagccaccaggaagaatcaaccccaggagggggccgtgcttctgggccccgcgtcgggggctcggggagcaaccgccctaccgacgcccgggggaagagcaaactgggaggaacacctcccccatctcctccccgagggggcggggcggtgcgtgccagcagcaggcgcccggagggggccgcgccaacctcgcagcccgagggggagcgcaagaagaagcggctgcgcaagatgggggagacagaaccatcccggggaaacctaatttcccctccaaggtggtcatttaaccgaccccctcgcaggttcgtcccatgctcattgcgaccgtcttttcttctattccaaaagcaagtttcttcttacccatcctgtttgccttctggtttttctttctgcttcagtgatgtcccgtcgcgttcctcccgccatcccaagtccggccaatccgaagccgaagatccggcggccgcagaggaacggaggcgagaatctgaccggcgagaggccgcnnnnnnnnnnnnnnnnnnnnaaaaagccgccccggaaaccgcccgggctcgccaggctgaggataccgctcgggaagaagccgcccgggcccaccaagccgaggaagccgctcgggaggaggccgcccgggcccgccaagccgaggaagccgctcgggaggaggccgcccgagtccgccaagccgaggaaaccgctcgggaggaggccgcccgagcccgccaaactgaggcgatggcgtctttcgaggcagcccacgacaaagctgctggcgcgtcgcttgggcctactccctcgggcgacgctcaggcgacagcctccgggacggctcgcgacgagcccgcgggcggatcgcctgggcccgctccctcgggcgacgcccaggaccaaacgggtccgggggacatccccaagctcagtgcgtcttctggcgggccgagccgcgtcgcattttttccaaggcggttctt

SEQ ID NO: 20211 - DNA, 431 bp, Oryza sativa
attcggcggtttcggcccatgagaagaggcagatagggtaccgatccaatcttgacccgaatttaactatttgccattttgaggtttgccaattatccaaatattgcacttaataatttgccattggagagaggtaatttcttaactatttgctatttttgcatatgtgacgtgccactgtaccgtgccagcgtggaaagtaacgtgggccccacccgtcagcccctctcctctctttttctatctccggtcggtcgtcgcccacctcccgccagccccgcgccgtcgtcggccgctggccccacgcgacagagacgaagagcaggcgaggagtccttgcagcaggcgcgtggcgcgctccctggcgaccaacaaatggacagcgcatcggcgaggaagcccgcgaggccaaagagaaggcatgcggcgga

SEQ ID NO: 20212 - DNA, 1852 bp, Oryza sativa
gactctagaggatcccctgagaaattagttggatgcaatccaaaggttgttcagttcgaggatgtcaacaattcttagctagcagttgttgatggaggagtaacatacaatggcatcatcgatgcaatgggagaggatatcattgtgcatatcattttcaaactttctcttcggcattgcttactcaagttctaaccaaattatttgttttgttgaatgattgtaggttggaccgtaggaagagcaagaagattacggactggcatgctcatcatctccatcttattgagcggtgggacaacatagcagctaacgtagtgcctcacggagtggagcacaacaagacatacttcgacgagtacctagcttggctcctgaggaactaccgcctttttcttcggccggcatggactctagctgacatagctacagatcccgaggatgttgaggagatgaacgagtatgacacccacactcgagcaggggcgacggtcgagtacgggcctgtacgtgaccgagtggtaagtattaaggctcagagttgtcatttcacatacacctacatgttctcacaatattaaatccacttgcaggcacgtgagctgatgaggtccgtgaacgacgcgggtgttgcccttggcacacctgctgggtcagagaatgaagttgggatacttcggagcgcacttcaggtaattaaccaattagttcaatccatgaatcatttcacttgcctctaacttatttgttttgttcttgcagaggctaaaacaacgaagtcggatgttagcggcaagacttggttgtaggtccacaaacgcagtcgacccacaaccaagactaacgcggacacaggccggagaaacaagtcaacaaagagctgaagaggaagggtaggaagaacatgatgaaggggaggaagaacatgaggaaggggaagaaggagatggacagagtgacgaagaggaagaggaacaacccgaagaaatcgggtcatctcagcttgcaggtgccccgcagccatcgcaaccttcccaaggtcgcccgcatagaaagagagcaccggtggaccggtacacaccttccactagtggccggaggggtcggcactagtggattactttgtacttaacactctaagcagcgttagacttatatcaaactttagatgatggttgatggatgtgttgaactctatattttgtgatggttgatggatgtgttgaactctaaatgctgtgatggttgatggatgttcagttgctgtgatgtcttaaatactatgtggctgtcaattttatgatgctgtcaatttctgtgtggctggctgtgctatgccagccactgcttgacctcagcgccaaatagaatggcgctgagattgtgcaggtcagcgccagagcagttggcgctgaggtgcacaagatcagcgccaaggtctttggcgctgagatgcagcccactcagcgacccagccatccctcgggtggcaacctcagcgccaaatcggctggcgctgagattcagcccccccaaacgtcagcagacggccatacaccgaaggaaacggccgtcaagtactcagcgccgatgcggttggcgctgagttgttcaacctcagcaccgtcggccttggcgctgaggtcggggtccagatctggtgatagtttttgccagggaccaaatttgcaaatagttttcaaaaagggccaaattgtcaaattttcggttgatcactgtattgttgcaatatccctccacgatcaaaggcttactttgggctcggtcgctccaatcaattaagagattgactctgaggttgatgatatacaatgttcaattgcgagattag

SEQ ID NO: 20213 - DNA, 4027 bp, Oryza sativa
catgaaggaacattaacaaatttatcataatttgtaactaagaatataatcataacaataaataatttagcatacattaccgtgacatttaccacaatctgctgaatttctaaatgtgtcatttgaggtcatattgtaaatatgttgtaatatgaaaagcccaacccatcttttggttgaacgaaacattgagtgcaatggctacagttatggtttttattcaccttctgtgccgctgttttgtcctgagcaatgctacacgtacaaaatttttcttactaaacatttactaacaatcatctcaaccgtttgatttaagtagatggaagttataaaaaatctagatgcactcatagcatgacatatcagtgttagtaagaatttagtaagaaaaagttagtacgtatagcattttccttttgtcctatctgtggaggcgcagccataactgcccacttcgctgctgcttgagctccgaccttgacaccttgttgccatctccccggctgttgcatgaccggatgaaccccttatcccctcttatattcaacagtaaacgatatactactaacacatagttaattaaagaggaatatgcaaatggtatcgcacatccagccataattttaatcactaactacgatttactttaaaaacgactaaagtaccactctagtaagaaaatgggaaatttagttgtgtggtaattgcaatgtgctcaaaatagagctaacatgttaaaagagcagaataaagtcagttcgggaggattattatttctatttctcacttcttctagctactttcttcctgtaagcagaatgaaacgattagtatttgctcctcattttttatagtcaaactaaaaattgaaatatatcgttgtgttaaaaaacaatgaaaatggctggtccaacatgatagaatatattgtgttcctataagctgcaaaagcattaacatatcttaaaaatgcagaacaatgcttctaatttgtaaactctaaatactacggtcattaattattatctgctatgattcaagagtctcacttcggtgccttctacctagagtagaaaaaatctgaaccgctgatctcatttgatccaatggttcagatctatttttactaccaccacacttaatggtagtagaatcgtggagggtacttttgcccaggaaaaattatctacggagggatattttcgtcctttccccccgaatcgcgcatctggagccgacacggagagaaccccgcggctcccatcaccgccttgacgacctcgcctgctccactgccctcgatgcctcctactccctcgcccccgccgcactcgccgcctcagccgccctcgacgagttcgcatctctgtccgggatcgccagagctgcgccctctcctaccgctcccccgcgtcggcccaccttccgacgagttcgcctctcggatctccgcctccgatcccagcaccgcgccaccggccgccgccgagacctcgtcctcctcgctatccccccttcctcgtcgtcggcctcctcccccatgcttggctccagccctgtccatctccgcccgccgttgatcccacagccgcgagggcaagcccccaatccatatcctcccaagcggaacccgcagcctccggagccaatgaccaccaatctctcgacctccgaatcatcatccaagactcctctcattggctgtagcgctgctctccaacggattagctgacatgagagactctttttctgctttgcaggtcagatttgatttgtttttcttgctgcttgcaggtttgcagatcgaacatctgcactgaatcttcttttttcgttggcctctaattctcgaacagtttttctgcttgtctgcagttcttggtcataatttttcctcctaaaagaagggattcaagttgaatgccagtaaactgaatccggagcaagtgagcttgttcaaatgactgagcatgacaaggtggacaagctaatgatcactacgtcaatcaacgcttgagagattcctggtgtgctatgtcctgtaattcctgtgaattcattatctcaagatggctttgggtggctttggcttgttacttatggccatgttttttttcagaactatagcttattaacagcttgtggttttgaaagtacccatctgtgtatatcatcgtttttgtggttcaatgtatattacttgttgtaattgcaattgtaaagtctatgtaaaaaacataccggattattcttccgttgccttgtatctgtcattgctggattggagtgtttcgatttgtccatcgtgtgtaatattcagatatataactaatatatttaaatttcatatgaaacaatcaagctgaatggaaaccaaatacctacagcaagaaacatctatggaacgcgatgcacaagcgccggcggtggccggacctcacgatctacttttctttttctttccctgcgctctcctttttgattaatgaggaaacggcgactctgctgttcgatgaagagggatcggcgacgcttgaccataggacgcacaaatgagaaaaaaaaattaagtgccagatttacccctattcggttttagcactttactaatctaccctttaaaataaacggttgagattaattctacttggagtagaatactgcaagtagagggcaacggagcgtctctcatgattcaaacatttataatttgatcttccaatttttcagaaggtaatttgtcatgtctaacacttcagcaactccttaatttccgaatacctattattagcaaggagaaagaagaacagggttacctaacaaggattaaatataatttgaaggacagatctttgcccatctctatatagtaaacagcatgtgtgcattcatgacaacctaaactttagtactgctatataaattggcgtaaagagattccacactgaggattaaaaataattttaaggacagaggtttgtccatctctaaatacttttaaggtaagtttatgacaattcaaagatcaattaattaatttagaccagttccaatgtcgatctatataattggcaagagatatatatgaatatggtaacacctattgctccaaaaaaaatgtgaaactctgaattaaggagattatatatctcttgcccttgagtaaatcataggccacgatcagtgagctagttagccagtgagcgtacacgtcgaatcaattttttttatataatgaagcgaatttcgacctttattttgaagaagctataaccattatgtcggatcgattagtcgagtgtatgtatatatgctcacctgtcaaatcttgatttggtaagtaaaaaaacacataaacataaattaagatgtcaattagcaactattcgcaataattaacctcttggcttactatcaattgaagacagaacaatcttctaaaaaaaaacagttcaatatgcatgtaaaatttcactatagcttgaaaagcaagacgattttattataaaatagacgattcatatgcatgctagttgagtaggtcacgtcctccattacgggacaggcaaatcaacaacggtgtttaggccctaattgtataatgaaaagtcagcctgctcaactttgtccggaagtcaacgaatcgatggattttaaagtagataaataactccatctcaatgggtcagcacgcgcagcccgggcaactgcccatgttggccgggtagttaatccgtcgctggacagacaatcatcatgggcaatttggcagttgacaattaacaatatccactagcattctactcctaattatatagtctacttgtctcttccattatggacttcttcaaaagtatgcatctataaaaaaggaaaatatatagtggaaacttgaaaactaccgttgcatcgagaaatagatgtccgagattcgtccacgtcaccatgagttaaaatttaactccagtaaaatttttaaattttaactcatgagtgaatcgccgagttaaattttaactcatag

SEQ ID NO: 20214 - DNA, 847 bp, Oryza sativa
aatttcggacatccatttctcaatctaacgatagttttcaagtttccactacatatatagtttgcactacatattttccttattgaaaagactcttcacagtagcaagctagcatagacatcgtgcgtcgttcttctccaatcctaaggttatacatacctttgggttcgtcttcaaggctcttaattggtcgttggttccgcgagtctttgagacaaagttaggtaaaaattttcacactttgcatgcaaattagtttgtttagtaatgcctcatagagtcaaagcatgaactattttctccatattttcatatatacaagcatattgcttgtgcgttaaatatacagtacatgttgtacaaacgttaaattgtaaatgttgtgtatacttaaatgtacataaaaatattttaaaaaattgtgagatgtgcaacatgcatgtacaacacgtaaaaatgttactcaaaattatcatatgcggcatgttttgacttagtttctacttatttttaagtctagctaactctcccttagtctcaaaataactttactttagcctctacctcgtgtcaaaataagtttacctttatcaacttacctatatcatgctctaattcacaattcgatgattttttttattccatcaatatcttttacctatccttacctacctatctacctatccacacatactagtttcctattagtgagtgacactttggtgttttttcttctatattgttttgaacatccaagtctaaacttaaagttattttgaaatggaaggaccgaagggttattatcttattaaagtgtaatagcaaagaaataagcttgagtattggg

SEQ ID NO: 20215 - DNA, 696 bp, Oryza sativa
acactcgtacccatcccgcacatgcaagaacttgtcagggaccttcattccggccatggtcacgaagcgatcatctctgcctcggcatctcaattgctgcttcctccggcatcctctcgaagaagagttggagccatcaggctcaaacccatcgaggcattggcacctcgggatggctgccgttgcgtcgcagtagccgaatggaccacacgaggcgtagggatcgcacacgatggtgggtgatgggcgctggacgacgactgtccatgacgacgcgctgtcgttccaagccaggaacttcaaggtacccgtgtagtccagttgaagacgcttgtaaggtgagccatcagaggttgtgtatatgatgtagaactcatcatccgtgctcaccgatgtttcgtagatgagagaggtactgaatgagaagaccgaagaccacatgctgctaggcccaaatccaataaagcggatatatggtctggtaccgttccaaaggaagatctgaaggtttgagctgggatcaccgctgatggagaagtctccggtggaggggtcatttgggccctttcaagcgatgcacccgatggcgacttgtgccttgtagctaaccaaaaaccttatgcccatcagaagggtgtcaggtgggtgatcaaagctcttgcccatatggttggaccattcgggaaccggagaacc

SEQ ID NO: 20216 - DNA, 725 bp, Oryza sativa
  unsure (1)..(725): unsure at all n locations
agcacgcgcgctaactagcattagcgcggacttaccgggggttcctagaaggcgcgtgcgcgccgactgcttaattcgcgcagccgcgcgcgtctcctcgacgtcttgtccgcgcgcttccgccgctaattatggcaattagtgttaattactgtcattagtattatttttaaaacagtaacaacgtaaataattcagttaccagttttttttagaaaagtaatggaaagttttaaatttgtagtcaaaagattttgaaatttgagctgaaaattttaaattttgatttcaactttttaaattttgatatagaagttttcaagttgagttgaaagttttcaaaattgaagttgaaagtttttaaatttgagtaaaaagtttcaaaaattgagttgaaagttttgaaatttgacttgaaagtttgtaatttgatttgaaagtttcgaatttttagttgaaagtttttgaattgagatgaaaattctaaaattgtgagttgaaaactttcaaatttgaatcgaaagtttttgaattttgagatgaaaattctaaaattgtgagttgaaaactttcaaatttaaatcgaaagttttcaaatgctgagtggaaagttttcaaattttgagttgaaagttttcaaaattttcaatttaaaaatttaatcttctgttaaaaagtttagttaaatgttctaatcactgcgggtaccagnntgtacatcaaag

SEQ ID NO: 20217 - DNA, 635 bp, Oryza sativa
  unsure (1)..(635): unsure at all n locations
nnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnagcacttctgtaattatttgtcagctgctaaatgctatgcatacctgaggaagtggagtgagctggaatttttctttgtcccccagtgttatccccttgatcagctctttcttttcttctattttgtcggtgtagagatactgcaacagtgttaaatgttactatttcttatattcttttagagaacaagttactggtactaaagtcaagaggctgtcagcaaagataatgactctcaggaacaattaatgaataaggcattttatcttaaaaaagtgaaaaaggacgacgagttaatttgagaatccagctcggataggttggggaaaggtgacaggtaggcctgttgtttgttgaaattcagataggaaaacgcagagttcattcagtctcaccttgattgga

SEQ ID NO: 20218 - DNA, 2901 bp, Oryza sativa
  unsure (1)..(2901): unsure at all n locations
ccctctcgctctttagcttctgacatgttgaagtgaccgaagctgcttgtgtgtgggggtggggcgtttggtttcctcagatgcgcgcgagcggtgacccttacctgcagcactgcgtggagacggcggcgctgctcgcggagctcggcgccggccccgccgtcgtcgccgcagggctgctgcacgacacggtcgacgacgcaggcctcggctatggctcactctccgtccaatttggcgctggtgtcgccgaccttgtgaagggggtaattatttcgatgattcgatctctcgatgattcgatctccttagctactactaactgttatttggatgacatgagcatatgcactagaaaattatttgctgggagctattttctcttgcaaaacttactgaatgtaccaaattgattccagcatgtcaacaacattagtaattagcagatcagatattttattccttgctcaactatttttgtaccatcatatgatctgcataaatttccctatgtttgagcatagtataatctgagctgaagtgcaagattagatgacaaacggctgtacttctatgataagtctttgtatgggccccctcttctttcatttttgatatttattggacttgtcaatttcctgactaggaagtggccactgctagatcattgatagcgaccgatagaactttctgattgttactttgttcattggggcttctagattatagttttttatgcctttctgaggtgggtactgagtttccgtcatctctttattatattgagcagagggaacctgcttgtattgacttgtacttcagtattgtagaatctcaacagattcctggttggttatcagatccaatcagcgtggtacagtttggtgatttttgttgcctgctcttttcattttccctgtttgtggatgggctattaaatgtatgatgctttactattttgttgtaacttggggcactttttttttcttttttctttagataatggaagctttattaagacttagtcaaatacaccaagttcttggggcacttatatatgtttagtaagcatggctgttgtctgagaacattgcgaattggctgcaatttaagttctgctgccttttctgtaggtttcaaatctaagtcatttgagcaaactggctcgtagaaatgatacagccagcagagtagatgaagctgacaaattgcgtacggttttccttgcaatggaggatgcgagagcagttctcatcaaacttgctgacagactacacaacatgaggacgttggattctttgcctaaggtcaaacaacagtgctttgcaaaggaaacgctggagatatttgctccgttggcaaatcagcttgggatcttgaattggaaggaacagcttgaaaatctgtgcttcaagtatctttaccctgagctatatgaggaactgtcatccaaccttctcgagttctacaaccaagatatgattgcagctgcaataaggcgactggaacaagcccttcaagtgaggggactatgctatcatactatatcagggaggaacaagagcatgtacagtatctacagcaagatggcaaggtaatctcgtatattatactccttttgtaggcatgaccagaatgaatcaaataattgcacttattttagttatattatttatgttgttagacaaactaacctccattttgaccaagtcaagcacaaaattcaacagaacaccctgaggaatgcttgctatcctgacatttatgtacatatcaacggatatgctaatgggatttacttgattataggaagaaactggacatggatgaaatctatgatatacatggggtgcgtgttatactcgataacaaagctgattgtttcaccactttagagattgtccatcacttgtggcctagaattcctggcaaattcaaagactacatcaacagccccaaacccaatgggtaagactctgaaaactaatactattatgcaaaaaaaagagtaagtcaccgtgataactgtatgcttgctaacttgtaggtatcaatccctgcacacggttgttctcagtgaagaaacactgccattggagatccaaattcgtacgagggacatgcatttacaggcagaatttggaattgctgcacattggagatacaaggaagctgttcgaaattgttgttcatctgttcctgaaatggtggaatgggttagatgggttgttacatggcagtgcgaaactctgcacatagatcacccttcctctcttacacatggagctccaccaagggcaatatgcagttgttcttctcagtctgatgactgtcctttttcgtattcaaaacgatgtgaccacagtggaccaatcctagtaatattactggagaatgaaaaggttggtaaccttttaaattatttgtatgttccaatgtttttttttacctgttgcctacctggtattgttgttgagcaaggaaactaatttctgaatggtgctttcagatgtcagtgcaagaattccctcaaaattcaactgtactggacctactgaagaggacttctagctatgacatgcagttgaggttaagactgaactgccatgtcgtgcacaacttgaaccaagagcttaaaatgggtgacgtggtcgaactgatccctttggctcaatgcaatcctggagctggaggttatgcgagggagttccaccaaatgtatgaccaccggctcacagtttcgcagtcgtgacaactctaggataccaaaaactatgtacatatatatacatgacagattgacagcccatcaagatcgtcggaagtttaggtttccctttactgacaaatagaagcactnnnnnnnnnnnnnnnnnnnnnnnnnnnnnnnnnnnnnnnnnn

SEQ ID NO: 20219 - DNA, 12842 bp, Oryza sativa
aacaaagctgaacctagaagaagagatgaagcgagcaacaggtacgcgagcacaattcatcgctggactttgcgcttttggcacttacatttgaggttgctgctggtgctccagactgtcagcaatgtgtagtacgctggtgtgttcttcgtccagagggtagacttcgagtggttaatggacggcacatttcagattttcactcagcaaatcctcttgatcgcacgaagtacgaaccactattctgcattccggacatctcctgtttggctgtctccatggcattagcggttcttcctcctcaccttgctgcgattatctccgtcccagcctctgaatgattgttaatccaaaccgataggtttaaatggcagaagcaatgctttgtcttcaactgttatcgtcgcctattgacgcttctggagcatgttctgtagttctaggatattaaggtcaccttaaatactaaaaaatggtttgcaaaattaaatgtgccaatgaatcgtagaacaaacaattaaaactgctacatgactgtggagtaccattgtttttaaggtggttttagaagatacaattatagctaatttgcgaacagaagcaaaaaagacgctttggccgagtggttaaggcgtgtgcctgctaagtacatggggtctccccgcgagagttcgaatctctcaggcgtcgttaattttttttcctttttttattttctcctgtttatatttttgtgttagccttttcctgtttgcattttttttggggtgagatttcagaggttaatgctcgtctagacgtctactctgtcgatgtgagactgacttgtgatcatctgttaaattgttgatccttgtgggatgtcaatgtgacgattttttgtgatcatctattaaactgtcaatccttgtgggatgtctgctatttctgtgaagtgctcccgaccccaatagatgattgatcggtgttcggtggtgggggttgggaatcatcacccacgcacgaaaaatggagtgatttattagcgcgtggttaattaagtattagctattttttttttaaaaaaattgatcaatatactccatccattccaaattaatctacatatttcataggtataccaagaccaagaaaagctaataactctctcatactatatttactctagcaacaaactcaatgcatgcaccatccccaatatttcctagccaataataaatcaaggtattgtatatgtgttataaatacttgtgtgcatggaatgcatgcatcaatgtccatttactccaatgcacaaataacgaatagactctaataaataaacacaaatgtgtagatcatttaggaataacctcaaaaaaaactatatgtagatcgatggaatggagggagtaatattttaagcaactttcgtatataattttttttgcaaaacacacgacatttagtagtttgaaaagcgtgcgcacgaaaaacgagaggggagttgggaacggctggtatcgaaaacagcgagtcatttatcgtaactcacgaacttaaatcaaacggttaagattttcctttaaaacatctctagcacttctcacttcatatggttctcacagaagaagaaacaaagagtagaaaataaaagagtcatttatcgtaactcccacgaacttaaatcaaacggttaagattttcctttaaagcatctctagcacttctcacttcatatggttctcacagaagaagaaacaaagagtagaaaataaaaaaagaaaacaaaaattaacgacgcctgagagattcgaactctcgcggggaaaccccatgtacttagcaggcacacgccttaaccactcggccaaagcgtcgcttgtgaatgcggaaagcaacaaattttacttgtttccatccaaccatgcatatacccgagcctcgaatttcatttttacctctcccgctcaaggggacgggagtttgatccgtcactctagatcctgacctaatggacaccggcgccgaccaggcaccacctcctcctcctcctccccctgtggcggccgcctccgccgccgccgacgagccgcgggacctgcgcgtggtgcgggagatcctccactcgctggggctccgggagggggactacgaggaggcggccgtgcacaagctcctgctcttcgcccaccgctacgccggcgacgtgctcggcgaggcgaaggcgtacgccggccacgccgggagggagtcgctccaggccgacgacgtccgcctcgccatccaggccaggggcatgtcctccgccgcgccgccgagccgcgaggtaattgatttgagcccgaagcccctcttcgcttttgtggaattttttttcgccggtgttgtttgctgcggaggacatcgaattttccatcgtcggttgcgaaatcgtcaggactgcgtggtttttggggttggatcttgcggttttgtgtccaaatcggagccttttagtcttaggaataggtgaatttctgcaaaaacggaatccttttgccttcggatcaggggatttgtgctatcaaggcagctcactaaccctttagcctttggatcagtgtatgttatacagatacgccatttgtagactaagacccctttaattctaaggatttattgagaaacttcataacatttgaaaaaaaaaacatgttacaaaagcagacactcattcacccctatgaacacaaaacctatccttatgaacaccccctaaaagactgaaccggcatgtgttgtgattcatgaagtcaccacaaagatgtctcgctatcaatggatatgttgcctatcaatgaaagaataattaatcataaatgcaagcacatgtaagtctagaacttgaacctgggtaggctgattccaccacaagaacctaaccagttgagctacgctcactttgctcctatttggccctttgatataaaggattggagctttttaaatcctataaaattcctatggaatgacttattacatatagattttgaaaaaaattagcaagatctcatatctcttggaaaattttcttcgagtctatttctctcttctgatacatgcatttttttcttgtggtttataaatcaaatgactattcctgtctgttttcctgtgctttatactttcattcctatcaaatttcgtgcttttcctattctccgttttttaatccaatgtttcaaaggagctttaataggtgtggatggtatacttttttggcaagaagatgatataactaaattaatgctgacaagattttttctttaaaatacttgagcttctaaccctacttaattgtcgagtgctctccaaaattcacaaagccgcaataccaaattggaaaccgctctttagcagttttcttggtttttgtgaaaaattgataaagaaatgatgaaattcagatatatttcatttaaaattggaaattcacttggttttctatttgactggttaacaaagctgttttgttaactcaagccagttcaaaacctcaaaattgcatgaaaatcaagcagtttttgttggttttgtaaaccgtgttggtcccttttattaaattttaatgtttctttactcactaggaagctcttcttttgagagcgtaggctagttcctctaaggttagttacaaggtggtgataggcatgtgaatattggataagcaagtcgatggcattgtctaaggaggaaatggtgtataaggcgacccaatggagaggaggatgaggttggaatgtggtagaggaggtcgggatacaaagaagtaggtaatagttccaactgaggatatgatgaatgggttttatggtggtgaagaagtatgcggcggaatctttgggcagcaggatgtgggagataggatcacacttgggttggaggaggttgatgtttgtggcaaaaaaaaggagcattgaatgtggctctggtagcaaaagaagaagatcaatcacaagcataggtaatttgatggcatcaatcaatgtaaaaaaaagataaaatagcatatgagagggcaaaataaggaagtgaagctagaaaataagtgcaacaaaaggagaggcaattttttacaatggaaaataaggggcacggtcaattatagaggaaaaaataactctatattacttatcttttttttaattcataaacttcataagtagagctaaaaatatgatatgatgttttgggggttatatatgatgttttttagccaaccatacattgtcatgtcaatcctagaagtctcttatctattcttgttcaaattgaattattttgcaacgtagaaatgctcggttgggcctatacaaggtcgagaaagtgacctaaactagccaccctaacatttctattatattatgcaacaaaatcatcttaagacaagttgtttttttcccaataagccagcccattaagggctttttgtgggtctattcttaaggaattttataagatcctatgttcaatcattatttaattggttgctataacgtccatatacacatgaaaaaattgtcgtaacatgacggatatcttcactttggacaggagatgcttgatatagcacataaatgcaatgaaattccaatacccaagccttgtgttccttctggatcaatctctcttccacattatgaggatatgctattgaacaaaaaacacatatttgttcctcgagtcgagccaacaccccatcaaattgaggaaactgaagatgattataatgatgatggttccaatgctaatgttgcctctcccaattccaattatgaccaagatctttttggatcgatctctcttccacactatcaagacatgttattgaaccaaaaccacctatctgttcatcgagtggagccggcacatgatcaacttgagaaaatcaaagatgatggttccaatgacaatgctgactcttctcattccaattatgtccaagattcttctggatcagtgtctcttcaacatcatcaggatatgtcattgaaccaaaaccacctatttgttcatcaagtagagctgacgcttgatcaaattgaggaaattaaagatgatggttctaatgacaatgttgactctcctaatttcaattgtgtccaagatccttctcgatcggtgtcttttccacattatcaggttatgccattgaaccaaaaccatctatcttttcatcaagtagagccgatgcttgatcaagttgaggaaattaaagatgatagttctaatgataatgtcgcctctcttgattccaattgtatccaagatccacattatcaggacatgttattgaaccaagaccacctatctgtccgtggggtagaaccgacacttgatcaagttgaggaaattgaagatgattgttccagtgacaatgttgcctctcctgattctaattatgacaaagagaagaatgacagtaacaaacagaagccttctaagaaggtttctcaactcaatactttggttgctgcaggtaaagacaaagtagattgctcaactgaactttcttagatgatcgtccaatggatgaaccattccttttcttttgaaacatgcacaatttttaatcttgcatttttattgccttttattaaacataccatgtgcctaattttagaatttaatattctcatcatagcctgaaacattgttgtaaagattttaatgcaaaacatgcatgtcttggtattgggtctatgtttgaattaaatattgtattacatggttactatagttatcataagtagtcatatatatggtcccctatgcccttggggggttgattttggtttccattaaaatctacatatgatgaaaacttgctgagctttttagcttgttttcatatcttatttaattatcacatgagcataatacatattgaataaaaaaaagcaaaatatttattggtaatgagtcgcatgtctttttgtgaagtaccacagttgttccatttgaatattagaatctacaagtttcatgaaaactgtgttgaggtgagcaaaaatactcaaaataaaagtgttgccttttgggttgagttaatgcactaataacttcaaagtaaggatgtgtagactggtcaataaccggctactagtgttgtgtttaggatggagcgttcatcatgttataaccaatacatagtttgtctagttacttaagaaggttctaaacatgaggttaaaggtgatcttagcaacttatgcaatttggtctagatattgaatgattttgagtggtttggatgagcattcatacaaacttggctgagaaagtgctattataggggagggttaatgcaagtaatgttgcatttcgacaagcgaaccaaagagacgatattctaaaatctaggaagccaatatgaggaaatgttgagtagtggcgtacaagcaaccaactagaaaagaaagatatcttgaaagtagagtgatcagggtcgacattgtgtaggaaagattataatgaaatggaaaacatacgaagaaaaactaggtagatcacgagggtgaaaaggtatgaaaaaatggagagagatagagggaaatgtgctaatagtagatgaattgttgtgacatgaccttgtcacatagaattgctagggcacactatatttacatgccaatatatttatattgcattttcctacatctaagtaattagatttctcgtacaattcatacttgggtatgatattctcatggatagttggggatgtcagcaatctatagcttacacggtcccttatgaaagactctattggtcttattgtgctccttgtgagcacatttggatacacattcaaatagattaagataactcgatggaatgtataccctcaaattctttttcgataatgtaatcaatattaccctattatttttctagcatgaaaatctcagatcaatccaaaaccatgtccaactcaatagttatatatcataataatttacaactcgtccactcataaattatatttttttaaagaaccactcaccatcccttccctcctctttttcatatttgtatccaataaacaccttgcccattctcttgctcatccttctgtctgtttgacagattggaccaatttatcactcgtagttgaaaggaacaagagcgatttaatgatatcttatcacttgtaattggacttcaagcctctttttttagaactacttcaagcctaccatcatcgagttatgcctggtgtcgtggcagctcggtagagccatgatatcgactgcgcagcattgtcacgtgtgtcatggatctagctagcctgcctttggtgtgttggtaaggcttgaggccatggggctgcgggttcagctttgtggtgttcttgaattggtggttatgtctggcacatagggtggttgtgtgtgaggatttgattgtggaatgacgaaagctttgtcaaattcttgcaagctttgatgacggcaacaatcttgagcgtcgtcacgacatcccatttctccacacaagtttccatattagaatcttggtccgatttcccaaacaagcaacggcgacgtgagcgtccccatggaattgttgctttggagaatcttcttcctatgacagtggccattattaggaacttagtggcatcttggaccatcttgtggctagggttcaccttttcgtatcggaaattatacccgcttatcaacggtttatagaaacccgataaaaaccaacaactttcggtcaacacggtatgaaaaccagctaaaactgaccggttttgaaaacatagcagtgtgcacgtgttttccgtgtaacagacaaaacaaattaggtctaatgtctagtttcacgtaaaaccgttttgttctatcttcttgatgaaaaggctatcttttgctatttaactttggaaattgctatgcatatgacccaactgtccgactcacgtacgattgaatttgatcaacggttgtaaacggctgcagtgtatatgaatatgctatcatttgattgatctataattgcttgtctctagttgtacatgagttgtacaactggatctcatgagcaattttacggttcttaaggaggtaccaaaaatttagtataaaatttggtaccttatagtacccaggtatcaaaaggtattaaatttacaatagaaaaagtgatacctcatggtacctcctcaagaaccgtaaaattactcggatctcatacatatagcagtactcttttactttcctccctgtttatccctaattaactttacactgttaggcctaattaattttctctacattcgtcccgactggattctcaagtagacgacatgcgtacgtagcatccaaatacacgactcgtgcgcccgtaagacaccaaactcccctcttaaaacgacgcgacaatcacaagccgccgcgcccctgcactgcaccaccctctcgccgccatgccgtcgcttgggatcgcgccgctgctcgacgcctacttccgccgccgcttccccgcggcgggcctcgtccaggcgtccgttccgctggacggcggcgccacgacggtgcaatgctggcgcttcccgccgggggcgagcgaggagctccccgtgctcgtcctcctccacggcttcgggccaccggcgacgtggcagtggcggcggcaggtgggcccgctctcccgccggttccgcctcgtcgtgcctgacctcctcttcttcggcggctccggcacagcggccgccgacgcgcgctcggaggcgcaccaggccgaggcggtggcgaagctcgtcgccgcggtcgtgggggcggcggcggcgcgcgtgtccgtggcgggcaccagctacggcggcttcgtggcgtaccacgtggcgaggctgctcggccccgcggccgtggcgcgggtggtgatcgcgagctccgacctgctcaaggccgacgccgacgaccgcgccctgctcccccgtggcggcgccgagcgcgtcgaggacgtgatgctcccgcgcacgccggagcggatgcgccggctgctcggtctcgcctaccaccgtccccgccgcttcagcttcaccccggccttcgtgctccgggacctcgcccaggtaacaccaccaatccaatccaccatacattgctgcctacatttgctgaacaaactcgaacaagttcttgtgcttgccatgatgccatctgacatcgagatcaagtagttcttggatcatctggatgatccgtgatgtcacctcatggaagtgtgacgtagcactgtagtatcatacaacaactgattgatcactgaatcgtcgaaagagatatggtccctgaattcccaaccgccttcgtagctagctagcactagcagtcactcacctgtcaccaactcaccaaccaatcatccctggatggagatgtctccctcaatttcccaaccgtttcgccgttcttccaatcaattcagagtttcagaccgccgttcgatccagcctagcttttccagttagagacatcctactgtttttgtgtagttgacaagcacagaggcactcacactgtgtgaatgtaattgccatctttgccaggctaataatcttccaatcaaggtgagactgaatgaactctgcgttttcctatctgaatttcaacaaacaacaggcctacctgtcacctttccccaacctatccgagctggattctcaaattaactcgtcgtcctttttcacttttttaagataaaatgccttattcattaattgttcctgagagtcattatctttgctgacagcctcttgactttagtaccagtaacttgttctctaaaagaatataagaaatagtaacatttaacactgttgcagtatctctacaccgacaaaatagaagaaaagaaagagctgatcaaggggataacactgggggacaaagaaaaattccagctcactccacttcctcaggtatgcatagcatttagcagctgacaaataattacagaagtgctttacttgccaagtttacctttatcaaatgtctctgtctgtctaatctttcaggaagttcttgtattatggggagagcatgatcagatatttcccatagagaaggcatttgaagtagcaaggtcagtacttattccttctaatataattgcattattaatacatatgaagcaaaacttttgccctctttttgtttaaaaaaaaaacagtagaattacatgttgaagttgcaccttgtaatgttacttacacaagatgaattaacgcaaatgcaggcaacttggtgcaaatgctaggttggaaatcataaagaacaccggccatatgccacaggaggaggacccgaaacggttcaatgaggccctcctgaacttcttgttaccagctccaaattcgtcgttgtgatggggatatcaatgccaacttcttgagcggctatctgtggagagtacttgatctaagttgtacattgtcttatggcacagggtaaaacttgtaccttttgagataaaagtgggaaatatgatatagagtatatgcattgtttttcttctcatatacaaaattgggttgaatcctctgcacttgctagtttctacagtaaaataaggggggaaaatgaagttccctggatttaataaggggaaaaaagccgcctctaagaatgaggggttacatacattaaaccaagcactggtaaaaaaattctattctgcgctaacttatgcgacgcctgatttgtcggacccagccaacctttacctcctgaagtaagaggagtttcgctttgatatcttgtgctaaggctccataagctgatctgttgagatccctcccctcaagcattctcactacatctggattgtctgtctgtccgactgtccctaggtaacactctgacttccttggcctgtttcaattgctctcttgcatgcaattagctcagcaaagcaagcatcctcagccgggatgatggaagaagttgtcctgcaccggatcggatcgacaagcgctcttggcgcgggtggtgatcgaatacgctctgctcgggtgcggcggcgtcaagagacgcgatgcttttgctgacatgatatgtaaacgatgcaaaatcgtattagtgtgatcattagggaatgaagacaaaagtgcaattaaaatgcttgtcagcatcacctctttctttctttctgactagctgctttttgtctgcaactcggcttgacgcattgctttgtcacgcattgagaatagttcccttctcctctgttctcatccaaagaatgatgaaaattacattatgttccccccaaaaatatggtgcagcttgttggaaagatttatgcatgaagctaagccttcatccacactatcttatgaggattgctaccgtccagcaggttgtaccgggcggtactggtaccgcgcggtaccaagacacatctaaccgttgaatccgggatgggtaggatcgggagagaaaagatgagcaagggtggatgagggagtacctgtttcgagtcgtcgttcccggcggcggcggcgtccaagtcattgtcattcccggcggcggcgcagagcaacaagggaacgctggcagcgcgggagaggataaagtctggcggcggcgcgagagagaaaaaagggaacggcggcggcgcgggagaggaaacaagtccggcggcggaagaggaacaagtccggcggcggaagaggaacacggcggtggtggcgaggaagaggaacacggcggcagcggcgaaaatcatccagcttcgctagggttcaagccgctcgatctcgatccagacccatctattgcacgcgaaattacaatactgcccttccaccgattatcatcactcggtaccgcttcggggacaaaactggtaccccgcggtaccgatctacgccagccgttcgatctgcctcgatccaacggtcaataatcggtaccgcaaggtaccgttggactgtaaaaatcctcctatcttataccacttgcattggagctaagcttcagcgagttcggtttaggattagactatggtactacaaagagtgactgagtgaagcaaaatccaaacagcaaaagtatttttcatatgtactagttacacagaggtaaaattaatgcatctcacagtttccttgaaaaatgcatcttgaagctaatgctaaagcattaaacactcagggttttaatgttcatgcatgatacagcttttctttttatcatatgcagttaatattaaacaagaacaacaaataataactaacaagaacagatagtgtcacacagtattgcaatgcacatttctggagttactttgtatttctctttttgaaactaaagagtcagtgcttatatatttgtataaaaaaaggattgcacaaataattttaggaagacagctagaaaaaaaacaaagagatatgtgcgaagaaagaattgttagctgccagttccaaatggctaatagagcaactgataactaattagactgaagaaaagagcagataacattgcctacagtgctcctacggtgcagtttctactttgctacgactgctgtgcaatggcttacgactagccaggagagatcatatcaaactagaacaactttcatcaattggaaatcgaaaagccaattcgctaattataaagcggcatatatcatgcgaacttatagataaatatatgattgcaggcttccaaattaaacaagatctgatactccttctagtggccatactgaatgaacaacaatacttgcgcagataattagggatagacattgagtaccttcttcacggcctcgcaggcattctcattatggcgaatatcgtt

SEQ ID NO: 20220 - DNA, 9025 bp, Oryza sativa
  unsure (1)..(9025): unsure at all n locations
nnnnnnnnnnnnnnnnnnnnnnnnnnnnnnnnnnnnnnnnnnnnnnnnnnnnnnnnncacagtattgcaatgcaccaatttttttctggagttactttgtatttctctttttgaaactaaagagtcagtgcttatatatttgtataaaaaaaggattgcacaaataattttaggaagacagctagaaaaaaaacaaagagatatgtgcgaagaaagaattgttagctgccagttccaaatggctaatagagcaactgataactaattagactgaagaaaagagcagataacattgcctacagtgctcctacggtgcagtttctactttgctacgactgctgtgcaatggcttacgactagccaggagagatcatatcaaactagaacaactttcatcaattggaaatcgaaaagccaattcgctaattataaagcggcatatatcatgcgaacttatagataaatatatgattgcaggcttccaaattaaacaagatctgatactccttctagtggccatactgaatgaacaacaatacttgcgcagataattagggatagacattgagtaccttcttcacggcctcgcaggcattctcattatggcgaatatcgttaccccgagcaatcatagtgtggacgtgatcgagatacccctcccagtgtgattcatcagccagagtacccagtccgtccaactcttcttggctgtagtccgcgagttcgttaggggctaaaggggcaagtaaagagcttcgcgttccgcgctcggcgttgaacttgtcaagggccttgacaaccttcttgaaattctcataccgatgagccttctcctcctcggttctgtatctccggccgtgctcgctcatccccagtcctcaaattttgccttcatggtcacctcatccaccacattgtcctcctcggcggcatcatcgacgacggcctcctccttgtcggaacacttcttgtcatagagtggtttccccccatggttcatttgggagttgaggtaatcgatgtagtcaagataggcaaatgtgccatctttcctggtgaaccttgccatgacggatggctcgatcacgtccctccaattaacagtcacctcctcctcctccttcctggtctcctccccggctgctacaggtaggaaacaaattgaagctagcaacgacgaggaaccgaatctaatctaatctaatggcgctttctttcaagaacaaggcatagatagatacctgagtcatctctatcttgcttgaaatagaggaatccgagcagcaatccagccaacgaactcgtcaaggcaagaacacctttcactgcgccacggccgacgccgagatccctctgcgcggggatggacgggagcgtgagccgctgcgcgcgagtgaagaaaattttgatctgagatctgggggaaacgggagagcgtggtgctggactactccccgccgtcgccgccgccgccgatcgctgcgcctgcgcgctgcgtgcggagaacctccgggtgaggaggggagcaagggcccggaggaacatggacatggcctcgatcgatcgatggaatcgctcacctccgccgcgcgtcgccgcgatttctagggtttagtgtttgacggacttcgccgcggatgcgcacggtgtcgaacggaattccgacaaaatccgatcaaattttgtcacagtttaaaactcgatcagtttgaactttgaagaggtcgcatgggccttgcgcacgcgcaaaattgggggccgggccaagctctaggggttacaaccatccttatttgatgggccaatatgggcttctaccttttgtctgactgccaactaaatgatattgggccgagatgttctcctactagaggcagcccaacagatttatctcgaccgaacaaattcgatccgacggttgaacagatttatctcgtccgctgttacattgttttttttaatggaaaaacctgtcacattgttcagctcatttggatattacatggaaattttctggcagtgatgagtacaatcatgtaatcaactgcactaattgttcttgagagtcattatctttgattacagcttcttgactttagtatcagtaacttatttatcaaaaagaatgagtaacagtaacaggtaacactgtgttgcagtatctctacaccgacaaaatagaagagaagagctcatcatcaaggggacaacactgggggacaaagacaaattccatctcgctccatttccccaggtattccatagcgattagcagctgatgaataattacaagagtgctttacttcccaagtttacctttatcaaatggtctttgtctgactgtctcacctttcagcaagttcttgtattgtgggggagagcatgatcagatatttcccatggagaaggcatttaaagtagcgaggtcggtacttattccttctaatataattagagtaatacatactctctccggtttcacaattctttaagatttgaaccacataatcttcaaaatacatatttaactataattttctattataatatttataataaataaatatattttacttttattataatactttgtaatgttgttttactgactttgaactaagtacttttaatgttattgttcgttaatgatataaaagtttgaatttaaccctgtccaaaacatcgagtattatggaacatgatagagtatgaagcaaagcttttgctctctttttcaaaaaaaaaatattaaaataattgcaggggaattacatgctgaggctgcaccttgtaatttcacttacacaagatgaattaatgcaaatgcagaacactttcgtgcgaatgctaggttggaaaatcataaagaacaccggccatatgccccacaggaggacccgaaacggttcaatgaggccctcctgaactcttactaccagctccaaattcattgttgtgatgggatatcaatgccagcttcttgagcggctataagcacttgatcaaaatcatatattgtctaatgatacagggtaaagtttgtaccttctgagataaaaatgggaaatataatatagagtatatgcactgtttttgttctgatatacaaaattaggttgaaatcctagacttgctagttgatacagtaaaacaaaggggaaaaatgttctctggatttaattttgagaaacagctgcaccctttattagtggttgtaggcacaataaaagactaagaacgagggggtaaattaaaccaaatactggtaagaattttctatgcagctattctgccgtaatttatcgctgcctgatttgtcatttgtcagaccaacccaacctttacctcctgaagtaagaggagtttcgctttgataccttatgctaaagctccatacacttatctgttgagatccctctccagaagcattcacgtactacatctgcaattatgcattgtctgtctgtctctacgataaaccttgacactccggacttccttggcaagttcaattgctctcgtcaagggacacgatgattttgctgacatgatctgtaaaagaagcaaagtcgtatcagtttgatgatcattaaggaatgaagacaaaagtacaaattcaaatgcctgtcagcatcacctctttctttccgactagctgctgtttgtctgcaactcggtctgacgctttgctttgtcatgcattgcgagtagttcccttttcttctgttctcatccaaagaatgatcaaaattacacgatgctccaaaaataaatatggtgcagcttgttggaaagatataagtatgctttaagctaagccatcattcacagtaaaagtagatcatttgcatttggagctgcagtttaggattttagactatggtactacaaagactgaggcaaaatccaaacagcacaagtgttattcacatctactaattactgtacagtttctacttcgctatgagcctatgattgctgtgcaatgatgacttacaactagccagaatatcagatcaaactagttggtatctgcttctcgaatataacgaccaatagccagaacaattttcaccaattggatatcgaaaggctaattcgctaattctaaagcagcatttatcacgggaacacatagattaaaatataattgctggcttccaaaacaaaagatctgatcctctttatagtagccatataccgagcaatcgcagtgtggatgtgatcaaggtactcatcccagtctgaatcatcagccatagtgataccaagtcgctcaacctcttcatcggtgtagtccgctaattcggtaggggcagctaaagggcttcgcattccgcgcttgatgtttaactcgttgatgcccttcatagccttcttgaaattctcataccgatgagccttctctttcttggttatgtatatccggccatgctccttcatccagtcttcgaattttgccttcatggctggctcatccaccgcgttgttgccatcctcgtctgtgtcggcggcatcagcatcgacgatggcctcctccaccttgtcggaacatttctggtcatagtttggtttccccccgttcatctgaacgcggaggtaaccgtagtactcaggataggcgaaggtgccatctttccttgtgaaccttgccatgacggatggctcgatcacgtccctccactttacggtctcctcctccttcctggtatactcccaagctgccacaggtacaaacaggtagggaacgaaacaaatcagtgtattgaatagtaggctaagacatttaacggtaacctctctcaaacagtttgttggcggatggcatgagtcccttcgaccgaatctgccgaaacccatggcgaagaccacgagccaaggatgatgcgaggcgaagggtcgcacgagtgcacgccgaagaaggacgacttcgccatgccgaagaaggacgacttcgccaggaccggttcgccccggcatccagcccagagaaggacggcttcgccaggtccagttcgcccccgcgagggccgaagtagccttctcggcccaccaagcttagagaccatagggccggcgatcgcccgatggcccatcaagagcccatgagcccccctttacgttatgtaaccctgtaaacgtccctttcataagggcaactatgtaaattcctcagtacaacctagaccctagaagtgagaatctgtaacggggctataaatagccccctagggccatgtaatacaggggagaaaattcaagaaatcaatatacttcgtttctttccaaccactgttaagtaaccacgtctttcgacgtatgcggttgtcgtttcgataacagctggcgccgaccgtggggacctccgagcgaaaccactgagagcgaatgccaccgaagaaggtcgtgaaggagaaggttacaaggcgaaaggaaagcgacgccggggcggacatggccgccgaagaaggagcggaaccttcggcatcaatcgccgaagtgggaggagccccgtccgcttcggcaccggcaccgtctgcttcggcgctgatcacagcattgctgccttcggcccctgccacctctgagcaggcgccaagggtggatgaagtggcgaaggcggctgcagcggcaagggcgcttcagaccagggcggagatcctttcggcaggacagctgctggtgccccctgccgctccgtcgcagccaacagtggcccaagccgcactccctgccgtgcaagttcaagtcaactccgaccctgaaacacaagccgaagccgatatggaaactattaggcagaacatggcacgactccaagacatgcttcgccaaatgcaagaacagcaacaagcgtacgaggcggcgaggcggtccagggtcccttcggcaccaatcctccaatattcggcagggtatgtcccgcctcaagtctgtccacaagtgcagtcccagcccgttccgccgcaagtctcacaggcatcggtgcacttcgccgggcagccggcagccgcagcagtgcaccaggccccctatggacaagctcagcagatcgcggcccaagtgtagcctcaaccacttggccaggtgtcgcaaaccgtagcggaaggggcttcggctctgcaggcgcaattccaagctttccttcagcaactcaatcagccccacaacatttcgagtacagctccctcgactcgtccagaggggagtacaggtcaaggtgcacctagttggttgccgccgaaccagccgaatctgggggcttcgccatggagtcagacacctcagtacgacttcgtcaatgccgcccaggcgcaaactgttcggccgcaaggaccgacaccaggctttggaacaagccaagcaccagcccaagtcgccatgacatggtcgcagccagttttcgacccatccatggcgacccagcaagtattaccaatcgcaaccgggcagccgagcaccatggctcaaactcacgcgcaagccgtaatttcacctttcgccacgccgtacccgcagcaaggtgcagcaaacagagcggggggcgagaaggggctgccgctgagtgggggaattaagaaccgcccaattccaccccagttcaaattcccacccgtcccacgctactcgggcgaaactgacccgaaggagttcctatccatctatgagtccgcgatcgaggcggctcatggcgacgaaaataccaaggcaaaggtaattcacctcgctctggacggcatcgcccgttcttggtatttcaatctgccagccaatagcatttactcatgggagcaattgcgcgatgtttttgttcttaactttcgaggcacttatgaggagccgaagacgcagcagcatctgctcggcattcgccaaaggccgggagaatcgataagagaatacatgcgtcgcttctcgcaagcccggtgtcaagttcaagacataactgaggcgttagtcataaatgctgcttcggccggtttgctcgaaggcgaactcacaaggaaaatcgccaataaggaaccacaaacacttgagcatttgcttcgcatcattgacggttttgcaaggggtgaagaggattccaagcgacggcaagccatacaagctgagtacgataaagcttctattgccgccgcccaagctcaagcacaagttcaagttgccgaaccacctcccctcgcggttcgtcagcctcaaacggcgatccaagggcagccgccaagacaaggtcaagctcccataacctggaaaaagttcaggaccgaccgcgcgggcaaggctgtgatggccgtcgaagaagtgcaagccctccgcaaggagttcgacgcccagcaagcaagcaaccatcagccggtccgtaagaaggtccgaaaagacctttactgcgctttccatggacgctcttcgcataccacagagcaatgccgaaacatcaggcaacgtggcaacacgcaagatactagaccacagcaaggagcaaccgtcgaagcacctcgtgaagcagcccaagaacaacccccggtcgaacaacgtcaagatgcacagcgaagagtaatccaagtgattacgagggccgacccggtcggccatttgtccaaaaggcaaaaaaagatgcagatccgagcggtccacagcatcacttcgacgggggagggggcgccgcagtatatgaaccagccaatttctttcgggccagaagacgccgaagaagtcatgttcccacatcaagatccactggtaatatcagctgagatagccggctttgaagtccggcgaatcctgttcgacggagggagttcggctgatgtcatcttcgccgaggcgtatgctaagatggggttgcccacccaggctcttacaccagcaccaacgtcactccgggggttcggcggagaggcagttcaagttctcggccaggcacttctgctgatagctttcggctcgggagaaaacagacgcgaagagcaagtactgttcgatgtcgtcgacatcccgtacaactacaatgccatcctcggccgtgcgaccctgaacaagttcgaagccatttcccaccacaactatctcaaactcaagatgcccggcccagcgggagtgatagtggtcaaggggcttcagccttcgcctgcgtcgaaaggcgatcaagccgtagtcaacagggccatgcacaatgtcgaagccgaactccacagccggccaaaacacgcgccaaaacccacacctcacggcaagatagtaaaagtgcaggttgacgatgccgaccccacaaagctcgtatcgctgggagacggcatgggcaaacaagaagctgagagcatcctagcggtgctaaagaagaacattgatatcttcgcctggggccctgacgaagtggggggggggggtttcggcagacctcatcatgtatcacctagcagtcaagccggatgccaagccaagagagcagaaactgcgtaagatgtccgcagatcgtcaagaggcggcgaaagccgaagtccaaaagctgctcaaggctggggtcattcaggagatcgtccacccagaatggttggcgaatccagtactggtgcggaagtcaaacggcaaatggcgaatgtgtgtagacttcacggacctgaataaggcatgtccaaaagacgatttccctttgccgcggattgatcagctcgtggattcgacagccggctgcgaactcatgagtttcctggacgcatattccggctatcatcagatccatatgaacccaccggacatcccgaaaactgctttatcaccccgtttggcactttctgtcacctcaggatgcctttcggcttgaggaatgctggggcaaccttcgccagattggtgtacaaggtcctttgtaatcagttagggcgaaatgtggaagcttatgttgacgacattgtcgtaaaaagccgtaaggaagttttcgatcatgcgtccgatctgcaggagacttttgacaacttgcgcacagcgggcataaaattgaatcctgagaagtgcgtcttcggagttc

SEQ ID NO: 20221 - DNA, 3646 bp, Oryza sativa
aagcggccgaaagaggtctcccattcttcaagaccctccggggcgcaggaaagttcagttggacaccagaatgccaagcagcgttcgacgacctaaaacaatacttgcaaagcccaccagccctcataagcccgaatccaggaagcgaactgctgctgtacttagcagcctcaccagcggcagtaagcgccgcccttgttcaagaaacagagttcggccagaaaccagtttattttgtctccgaagcgctgcaagaggcgaagacaagatacatcgagatggaaaagcttgcttacaccttggtgatggcttcgcacaagctcaagcactacttccaggcccataaaataatggtgccttcacagtaccctttgggcgaaatactacgaggcaaggaaatctttgggaggcttagtaaatgggcagcagaactatccccgtttgatttgcatttcgttgcgcgcactgctgtcaagtctcaagtgctagccgactttgtagccgaatggaccccagtgtcaacctctgaacccgagcccgtcgagcagccctggataatgtgctccgacggttcatggtcgcacaagggagcaggcgtcgcggcaattctcatttcgccgaacggtgtaccagttcggtacgccgcaaggttgcagtttaacacaaccaacaacgcagcagaatacgaagccattcttctaggcctaagaaaggcgaaagcactgggagttcggcgcttgctaattcgaaccgattctaagttggtagcaagccatgttgacaagtcctttgaggcgaaagaagaaggaatgaaaaagtatttggaggctgtccgaaccatggaaaagtacttcaccggcataacagtcgaacacttgcccagaggccagaatcaggaagcagacgctctggcgaaatctgccgctagtggcggaccgcatttgccgggcatatttttcgaggtactgcacacaccaagcgtgtctgtggacagtctggtcttaacaattgaccaggtaaaactgggagaagacccaaatgactggcgaaccccgtttgttaaatatatcgaaactggctggcttccggatgatgaagcagaagcaaagcgcttgcaaatcagagccacgaagtataagttaatctcaggccaactttaccgttctgggatgcttcaacctctactccgttgcgtttctttcgccgaaggtgagcaaatggcgaaggagatacaccaggggctatgtggcgctcaccaagctgcaagaacggtggcctccaaggtgtttagacaaggggtttactggccaactgtgttgaaagtctgtgcagagcagattaagaagtgcgagagctgccagcgtcatggctgaagtcaaaccgcgccccactatgacttgcagcccattgcgccaatttggcccttcgccagatggggactggacatcattggcccaatcccttcggcacgaaacgggtataagttcgccattgtggctgttgaatatttctctcggtgggtcgaagccgaactccttggtgcaattacttcggcagcagtacagaagttcgtgtggaaaaacattatctgccggttcggagtaccaaaggagttcatcaccgacaacggcaagcagttcgactctgaaaagttcagacaaatgtgcgaagggcttaacctggaaataaaattcgcatcggtcgcacacccgcagtccaacggagcggccgaacgaacaaatggcaagatcctggaagcactaaagaaaaggctcgagggggcagcgaaaggcaaatggccagaagagatgctatctgttctttgggccctgcgaacgacccccacaagaccaacgaggtttagcccgttcatgctcctctatggcgacgaggcaatgaccccagcagagctaggggctaactcaccaagggtggtgttctctgggggcgaagaaggacgcgaggtgtcgctcgaactattagaaggagtaagagtcgaagcactcgagcacatgcgcaaatatgccgtaaacacttcggcaacctacaacaaaaaggttcgaccgacagatctcttgcccggtcagctcgtcctaagaaaaaaggcgaacccagtggctgtcggcaagcttgaatcgaaatgggaaggcccgtacctcatcaagcacaaatcaaggacggggtcttttcggctggcaacattggaaggcgaggggctcgaccactcctggaatgctgcctccctcaagcgcttttatgtctagaataggtggcacccaaatcgccaacttgtaaaaatgtatatagtcatgtaagccattcggcactatgtacgcctcccggcaaaaaaaaaaggaaaaaaaaagaggaaaatgaaaaaagaaaaaaaaactggatgtagggttattatccgccatggaggcccgaaccagtataaaacctctgtgtcctctaccttcttttttttattgtgtgattgataacttgtggaaaaaccccaaggcaaacgcctgatcagcgaaaaagccaggggggcgaaacgaatcgcccgaagcatcgctcgccgaacgttgaaaccacaacagcttgtttcggaaataactaaccgaacgccattacattcgatcagcatgaaagtaaaagcgtctatcgaaaacggaagacgaaagctggaaaagtcgaagcctatttcgctaatgtatgcaaaggggccgacatgttccgacccaacgaaagcacgcgaagtgacaatgcgagaatagcgaaaaggaagtaaagcacacttttattgattcaaaaaaaaaagggaggtatcgaggattacaactcaaacagtgcaatatagatcacaaataaattacatcttcgccctcgtgtcccctttctcccctgtcggctaaagaatgatcgggcgaacaaggttcgtcgtcgctaatatcatacaccactctaaggggagaagggggcgaaacgcaaattatgccataacggcgccgaaagatcgcttcctgccgatcggtcttctgatgattccgccaaaagcgaagccatgtcgtccaaacgtcttgaatgaacaagatcataatcctccagggttcgctcagggtgactccgaagccacccagcaaccttgaaaaccttatagctgtgtccatttatcagcatttcacgatacacaggccgaaacgggcatcgcatcttcggcaaatcttttaaagccacaaatttctcgttttggtttcgccaacttccagacgggggtcgaatacacagttttcggcgaataccctggcagataatgcagaaatggcaaaaaaccaatcgaatagtgagaagtaggcgaaagcataacaaggaccaacagtaaagggcgaaaggtaggtctgttatacatattttaaatgcccaacgacaacttagtctcggttacaataaaaaggttagcggcagcctgccgaatatacaacggttcgccacccctggcgaaccccaaaaaaaaactatgaaaatctaaagaaagggcggagggcctcacacctctgggtgatcctgggcatcacctccacccccttcggcctccacgtactcttcttcgcgaagctccgccgcctcagccttcgccagctgctccaaaaggcgcgcctta

SEQ ID NO: 20222 - DNA, 5441 bp, Oryza sativa
cccgtggtaaaggccgcggacacgcgcgcacagcagtcgccgtacgcggtggcacagtccgaaaccgaaccaccagcctgctaggtccattcggagaagtcaaaggcagaggcatcttcggaagggacacctcgcactttcgcgcccatatcggtaagagcaaggcgaagcgtttggcaagctgttcgcgcggactcggtagttttcaccatctcccgtgaaaaccgccgcgactccgcagcagcgcttgcctcggccttgcagacttcctgccgaagagcctccatcttcgactcggtaaggttgtagtaatccacaagcacggcggagtgggccttttctttttgcagttcggccttcaagcgttcgacttcggccctagcttcattccctttttccagttccaactggagccgcttgttttcggctttcgtctccttcagggtgttagccaggacctccatctcaagatttttgcggcctatttcgtcatccttcgcccgaagacggcttttgaacccgtcaaggcgggctcgcacggttcgctctgttgaacagtgagccgcaaggatctgggcgcaaaacaagagcggcgaagagagcaagtgtcagcaaaagcaaagataagaacagagaaaaaggaggggaaagacgtacccgaaccacaagactttttatagcggagcacccctcattgaactcattaagttcggtgaacaggctcggggtgccggcaggcatgattagattgctcaccccttccacaaaaggaaggaggtctgcccgtgtctcgaagtcgccgggggcgaagcggggcaccgcaagcgaatactctgacgcggacgtttcgccagccgctctctttcccttcgcctcagtcagcggcgatgcaattggctgacgaggaggactgccgaaaactttcgccgcggccgtcacgatcctttccgcggaggccgaagccccagcggcagtgctaccacccgctccagtgccgccaagtggaggagcgggagcggctgaaagatccaggctgcggccagcgggcgaagtcagagtcccgtcagaggactcatcgtcgctaaaaactcgagcgatatcgacaagtcctttctttttagccgccttcttgacggggcctcccttcgccgccttgccagaggagaacgcaaccagagccttcgccacgttcaagtctttttggcgaaggggggagctattcgactccaccccagtctcgttatggccaggacttggagtgggggtataaccgggagtttcggcgcgtccctcggtcacctcgaccgcggcattttcgaccgcggtctccgtctcttcttcctccccctctcccttttcgccgtcaagttcttcgccatccttgtcgtcagcgtcagaatctgatgaaacaggagccctacgcttcctaggggcaagcttaacctgaccgcgcggccgcttccgcgaaggccctgcttcgtcaccagccttatggggattcgcccgaggaggcaattcgccgttaaaaacccggttcgcccgaccagttgcctgccgtgtaagcatttggctgtactcaacgaccgatacgtcgccgatcatcttacgggcttcggcttcggcttggtcaagggttagcactgcaaaggaaaggaaaggagtcaggttaaaaggtcaagcagagagagctaaagcgcgaaagtatatggcgaaaacagcagacttactgttcattccctcagggaggaccagcttaggcaagccatcaacctcttcgctcaggttaaccgcaacctgccatgactgggagaggggaaagatgcgaagcatgcagaactcctccaccaggtcgcggcagctgaggcgggaacagactttccttagcagggcgaaccgggcctccatagcgccatccacggcgatcctgggttttcgattcggcgcaataaccctgcgccgacaccgaagagctttcgctgaatcagagccggcctcgaaggggatggtgtggtaaaaccacctcgccatccaatggcggtcccacttcgacatggcagcattcgctggccaaaggtcggaccgttcggggcgaacattgaagttcacgctcccgatcaccgtcttcttcgtcccagccggagtaatcaccgtcttggagttcacggtggcgaagaatatggcgccgaagagagcagcgctaggttcgaacccagaagtccgacaagcccaatcgaaaattgagatccgaaccagcgtcgatgggctcaattgggggagctctacctggaagaggcgaaggatctccggcaatagcacgttgcacggaaaccgtagccctgcctcaaaaaagacggcgaaaaccaccgtccgattgtccacaggcttcggcaccacagctttccccggggcgaaagcctgccccgcaatcaacgccccagagctgactagtttcgccagctcgtcgtcatccacaagggaggcccccaaaaaggtggtgttatcgtcgtcgacccggccagggtccggtccgaccgcctgaacggggtttggtttgcgaggggccatggcgaaaggcgtgtgggccgtggcgaaccaatagggtaggcgaaacacctacggattcaagaaacgctgtggaaggagataacgaaggaggagagcgcacgcagtaaaagtggcaaagtgtgacggtgaaagggaaaggggtgagaatatatagcccaccgagtcgacgtttcgcataccctccaatcacaaagagccacgtggcgcgagggtaggcgtaacggtaaaatcccatcatccgaccagcacagtaaaaagcccattaagggaaagcccaatactgttcacttcggcccggaaaaagtaatgatattttatttgcaggaacagtacgggtttcggcaggagcatcgatcgaaagggggcgccacataccataccacatggtttgcacggtctcggccgaagctccgctctcacccttgcccgcgaggggcttgttggcggatggcatgagtcccttcgaccgaatctgccgaaacccatggcgaaaaccacgagccaaggatgatgcgaggcgaagggtcgcacgagtgcacgccgaagaaggacgacttcgccatgccgaagaaggacaacttcgccaggaccggttcgccccggcatccagcccagagaaggacagcttcgccaggtccagttcgcccccgcgagggccaaagtagccttctcggcccaccaagcatagaggccatagggccggcgatcgcccgatggcccatcaagggcccatgagcccccctttacgttatgtaaccctgtaaacgtccctttcataagggcaactatgtaaattcctcagtacaacctagaccctagaagtgagaatctgtaacggggctataaatagccccctagggccatgtaatacaggggagaaaattcaagaaatcaatatacttcgtttctttccaaccactgttaagtaaccacgtctttcgacgtatgcggttgtcgtttcgacaacacagttaatagcggctaaattgtaaatgagagtaaatagctagactcttctcaaacaactatgggcatcatcttttcacttatgcttatcaggcaaaatttgaattttcaatattaaatttggagctgattttgagatttttttcatcgaagtttatttttcagcctttgcttttagatcgctaagaatacgtatataaaagttttattgataaattatttttcgtttacaaataagccgtttcgcttataccgccaataagagaaacaatggcttcgtatgtctctatatacatatataatatatatagcggcagctatagccggaaatttaaaacggcgaggaatctaatctaacggcactttcaagaataacgccatactatacatacctgagtcatctctatcttgcttgaaatagaggaatccgagcagcaatccagccaacgaactcgtcaaggcaagagcaccttttacggcgccatggccgacgccgagatccctctgcgcggagagggacgggagcgtgagccgctgcgcgcgagtgatgaaattttcgatctgagatcagggggggaaacggagagagactcacgagggtgcggagagcgcgtggcttcgctggcctagtccccgccgccgccgccgatcgccgcgcctgcgcgccgcgtgccgagagcctccggtcgaggagagatgcgagtgcgcggaggaacatgggcctcgaaatctcgatcgatcggaggagacgcctcgatttctagggttttgacggacttcgctgtgggaggagtgggaagtgcggatgcgcaacgggtcgaacggatttccgacaaaatccgatcaaattttgtcaaatcagatatttaaaatccagtttgattttcccgtcggtttttttgtaaacacctgagaagggtcgcatggcccgtgcgcacgcgcaaaattgggccagtatgggcttctacctttccttctagcgcgcgccggtgcatcttggacatccacgtcttgtgctctgccgtgccggcgacggcggcggcggcgctgccaccgtgaaccgcgatggcgggcacggcgatgaagaactccttcgcgccaacatggccgcatggctaacgaccttgtcatgagaaacaccggtctcgacctgatgatcctgttttattgtgaatatatacgccactagactattagtaaaaatgcataatttttacaggcaaaacttgacatttattagtacacatacatcaactatattatctcatattagttcttagcgtacacatgttactttggattttggagaaagatgccaagtagctttcgaatttctgtttaacaatgtccggaatgtttaaacgcgtacagttttgaaggcaaatactatgtgggaataataatatcgaacgaagcacatcccagaacatataaatcaattcttgccagtcttcagtacaataggaacagtagcagcagcctactccatatttcagaattcagacagatcctagtttctgataccgcatattgacaggaaaacatttacctctaatcacctagcaagtactatagagaaaaatgaacagaaacaaaacttgatattggacaacttttgtagacagtggctctaatcatagtagtcttcatctgtcagaagaaaaagagaatgctttcattagtaatcttaacaaaaccaccagtagtccattttaggaagagagaaggatagatctgatatgaatagaagttcaaatttaaacttacgtgcttcctcctcttggttccagtcatcatcgtcgtcatcaaactcgatattctacaggaagttaaggtattagagtgctaaagagatgataaattacaattccaaaaaaaaaaaaaaatgattcatatgtgttccaacatgt

SEQ ID NO: 20223 - DNA, 14540 bp, Oryza sativa
  unsure (1)..(14540): unsure at all n locations
agtacaaaaaaccatattaacatggtgaaaaagagaaacaaacaaaacttgcaaaaacacggaattgctttcttgttggtgcttagtgcatccatattagtatcatagtccacagcctcagaccgaaaagcagtaacatgtctaaaatgcatagatgttatcaaaaattgattttagatagatgagctgatgaaaatttgaaaaactgaaagattagggatgatgctcttgccttgtgcttctcttcaagcttctcaaaaacttcaaatgcctgatcatctgtcaaaaaaggtcagatccaagtaaggatcgacacatatatggatgaacaacatgtagcagtagcattgataattcagattttattgctgctaacagacatgacaacagaatcgtacaaccccgcaagcaatgcagtttgctaaagttcatgacagaagcaaaagggacatcattctttatgaaacaaacctgagcttctatcccaacgcagcttcttactgcttggctgtcctcgcttagaacctgaaaagaaacaaaatgtcaagagagtattctgctgcaacaacatagcagataaattttatatgtacagaaatacaaaaaaaaaaatcaagattaccttgcactagttccacagggaaatttgcaggagttagtataagatatgacgcaagagcttcacgtttggaatgtgtcttacgtttcctatcagaatacctttcaatctctttatcatcattctctgatgggatatcaacacacaaaaaaaacttatcagaaatagctctacaaaagcaagcacaaatctctacaaatgcaaggaatgaagcaaaaccagaggatgcttgattgcttggaaggaaaaaaaagaggctgaaatgttcattaatttgtaaaaatgtttcaatggagatatagatagggctaatacaaaagaagagtaggtactaaaatgatgaatttctggttaaattgagctcgcagggaagcaaggcccaaaagaatattatgatttatggattctaggccccatatcaacaccaagctgaatgcaagagaaagttctctgtgcatgtcgaagtcaaaattatgtagtccatcaaagttcaacaatatataggaaaccataacaggttccactcagtaaaacagacagtcagtccaaataagccagagctccagtaaaacacttcagtacccaattctttgacccaccacctcaaaataaacatgaattacttcttgtaacatgtgttaactatctgacctatgctacatatatagtcgatttgtattaatcgagaagcaagatatcctaatgggcaggaagaagaactaaaaaatgtcacaataagttgagccatagtagtacttttcttggggacatcctcctccaggtggtagcaagaagtcttccagaaatcctcaaatttcaaggtggactgtatcaaagccttctcctccatggtcgccctggcgcacgtcatctccggcagggtgatgtcctgaatataccgacgcccaaatccggtgaatcgccccaaaaaaaaatcacaccacgagcatggcgaaaatcgcattcagcagcaacaacgagaggagagggaaagaatgggtgcagggaagtgtggggatggcggaacggggaatgaagtggagagaaaagaaggttcaccgggaaatcctcgtggggggtgtgcttggccgggtggtcgaagccgtacccttcctccccgcctcccccggcctctcccgcggccccgggacgccatctggaggggggacggatgtcgatcgaggcggcgaacctctccgcgcggcagaagcgcggccggagaagagaacagcggcgcggcgcgaggggaagtgcggcgtcggcggcggtaccgcgcggcgtggtggtcccgggctggctgtgttagggtaggcggttgggctttttatgggcctcatggtgactattgggctttgcgagctaccaggttgcacgtcagttcggctgtagatggaataagttcgagcatgtttattttgagggactgtctgaaaatcattcgacagatttttagtagaaaatcagtcggattttcaagccaccacgacgtgcggttcaaatgaaaacatatccacgtacgtcagtcaccggacggtaatcacgtcaatgatgcttaaagaaaaggaaaaacaagcaacttacatctatttacatcaacttacatatataattttaaaacttacagtgtaaatacaccgaaattacatatgtaattttgaaacttacagtgtaaatacactaaaattacatatgtaactttgggtacttgcaatgtaaatttattttatgaaaaatataacggtatatatagtcccaaaaatatcaaatcacacctcaaacaattaagttaactatagtgcaacaaaacaacgatgagtaaaaaattccgtacatgtaaaacaaaaattacacccgcatatacttaaaattacattgtaattgtagtgcacttacgttttaatcgtggtataactatgttgtgagtgggtgtagtgtaactgcagtgaaagttttaaaaaaagttacgcatagaaagaaagtagtcgtttgctgcttgctcagttggtacgatgcatgtcgtagcatcccgacatcatgggttcgattccctgttctagcgacattttttttttcactcaatggcacatacacgtatctcaaagtaaatcatacggtcaacaaatcgactgatttttaacagaaaatctgtcgccagatatgtagcaattccgttattttgatgccaaaaaaaccttaccaaattttggctatggcatagttactaaaattttggcagggtttcttatatagttaccaaaatttgatagcaaactaaatatagccactttttgtaactttaccaaaatttagtaaggttaaaaatagcatcaaagtgaacacgcccttcattttaggtccctcaacttgccagcgaaattgatttttatatccttagaccgaaatatcagatacaacgggtcattaactgttaaaaccgtgtaatgtaggtccgacagaagtatgacatgtggttttgtccgacgtaaaaatttgacccgaattaataatgttgagtcagtgtgagcctcacatgtcaatgcctcttcacctatatctctttgttcagttgtgactgagaagcatggcggccggcgacgggtggtgaagaggacagtcgctcacgggaaaagatagctcgatggaggaaggacaccgacggtggccatcgatgacggcgatggcaaggcagactagaagagaggcaagatccgggagcatgacatcgtcctcccctcacccctcgctcccctcgcccgttcttcccccacagccgcacgggacgggagccggcctcgccgcccaccggaggcagcgtcctgtctcgagttcgctcagaagccgcttgtcctcctcctctctccacgaccccatccgcgaacgccgcctctaccgcccacatcaactcctccacccacatcgccgcagaggtgggtggtgatggtggctgttgcagagaggcgcaaagaaggctctgtagtggtgagcccttgccggaaccaggatagccacgcagacttggaatagggagacctctagtaatgttgaacccgagagcctatcggcggtggcgcgcggcgcaaattggtagcggggaagagccagtggaggaagaaatcggggcgacgaataccgaagtcaacgggtggaggtcccctccgcttgccggccatcggccatggcttgagccccacccttcctcatccccttactcctcgtctcctccttgctcacgccttttgccgcagtggctgcattcgtcggcctcgagtccttcctggcggcggtgactacccgcgacccctctgctggcaataacaccttcggcgccctccccaccccggtcctccgtcagttctcggcctcttcaccttcttcagatgatgagctttgcagccccacgagaacaggagaacaattcagattcacttcaaatggatagcatcaatttgaacaataaaggtgaacgcagtatttctgatatttgatttacttaagtcttttctaactcatgaatgatatgtataatctgtactgattagtttagaaactcaccaaaattttgatccgatttagttgatcaatttgcaaaatccaataagaaatgggatgagaaatttgattagttcgcagcaaaaaaagaatcatgagctaagtttaaaatcaaatactagcagtacgagatctaaattggaacatatagttatatcctgtttaaattcagaactagtttactaatttacatgatttcttatatgtggatacaaggttacaagtcaaattacaatacatttctgataaaaattacagaaaaaaactattgtaatttttggttgaaagcattttacctgaaattacaaattttagcagtgtacattttgtgaaaattagcaatacaatcaaaataaacttgtaatttcaaacaatgtttacagaaagaaaattataagggttgccaccaatcatagttgatagattatttagttgataaatttttggttgaaagcattttaaacacataaggtttagtatatttgaaatttgcaagttgataggtgctaattggcacactctaattagtacactagaatatagcagatcttggtgctaaaaagaaatcaaacagtttttttttttaaaaaaagtacgtttagttgaaatgccacaaaaggtaagatttgtggaaacatttggaagatttaaagttgttggaacaactaaaaaatacagttaagttgttggtaacaatatttgagtacatcttttagttttatcccaacaaatattcgattacaatcgcttaattatttgaacattacatccataaggcgtacagaaaacacaggacacgaacaagggatttggatccggtgcagttggtagtgtgactgcaacttatgcagtccactatcagctgttagatccggatccaagggctaacatgcgtccgggtactgtagataactgtagcaacattgtttagtactgcttttacattcactgtagctaaggatctagtccgttcatcaacaaaatagatggctccttttgcttgcagtagcttaacttgcagtccatatacaaactgcatgcgatcccaattcacgaagaagatatactaacagacttgccgatcgattcgatgagcatatacggttgacttgacttagcctataaccccggtggatcgaacaacgggttactacacattattggaggaaaagaaagttcaaaacggaattgaaacgacaggtgatcgcacacacatacatatatgacccaaacaggcctggtgatcatcgacgtggcaattaatcgaggaccgcttgaaggacgtcgagcaccggcgatgccagcccgccggttgctaggtcaatcgctatcatgaagcttttcttgaggagaaacttgctgacgctagtgctgcggctccgctcaacaacagcagtagtgttccgagcatcactggtagtttggttggcaccgctgctggtgttgccggtgccctggccacggctgctactgttgttctggttggtggtgctgccgctaccctgaccgacaccgcttggcgcgccagagacgcacccgatatgtagccgataagacggagacgtacaagggccacagatgtagtgccacacgggcaaacgttcagggcaagcattgcagtgccctgaagaaggtaccatgttgaggtcgtggtgtgggtgaagcgggctgcggatcgtctgagggagcaacgtgcacagggggtgcacgtcgaacttgcactggatgcagcggtacacgaaatttcctgggggacaatgctccatgcagaggtcacatacccatcctttattctcaggaggcatgcggcagagcgtgagggtgtgccacgggtgggcgaagaaggagatggtctccttgaagtagtcggcgcacgcctcatggatgtcgaagtcgcaggcgttgcagcggtagccgacgaggccggagagcttggcttcgcagatgtcgcagacatggcgcgaggcgctgctgtacggggtcttgagaaggcggtgttgtggatgggcgaagtgtgttatgtgggcatcagttgccatgtctttggctacgctcagaacgcccaatctctctcttggcctagtttttggctacagtactgtgttctactacttagtatttctatagatcgatcagactactccacggttagtgtctgcctgtctggcttcggcgtgcctctaggcgctcagcatacatttataccatcttcacaggctcacagtctactgcagtaattaatgatgtggtgttgtttgactcagtgcccatttctgtatggaaaaaagtccaaattacacccgctaaattattagacgagtgcaaattaacctcctagacacaaaaatcatacatttttcactctcaactattacaccctctaaattattggatgagtgcaaattaacctctagacacgaaaatcatacatttttcactctcaactataaatattttcatgaacgccatattaatattaatattgaatttttttattgaattaaaatccccttaacacaatccaaaatagttttggtcctatattatgacagctcaatcaataattttcataataaatcagtggaacccacctgtaagaagagatggacgggtcctaccaattttttttttaaaaaatattgactagtctatcacataagagcaaaaccaatctaaagtctaggtggtaattcttactcactcactagtttggaggtctaattcaaactttttttcctttccctaatccctagtaccaattgtttcagcgtattatatagtaatatgaccattgacaggtcgttcgtctttatgataaagagcattgcaatagaaaaaatagtcttatatataaacttcttccttataatgatttcaacattttatttaattagtcgcgagttataaaaaaaaaatcaagattcgttcataacgtggcacaatcaacatttttataagaaatttgtatgtaaccaactccactaaaaaaaattaccgcatattctctctctctctctaaacttctgtctttttgagcgggtgtgctgggagcctgggatggccaaactggagcctgcagtttcaagataagcttcgctcgtgtgatctatggtgcatgtttattatgcttttttttacaaacacacgtttactcacccttataaacacacgtataccatatttctacgtgcatatccgaaaaactggaccgacacatatttagattgatgaagttatcannnnnnnnnnnnnnnnnnnnnnnacgtcgcctatcactgaaaaaataaataaccataaatgcgagcatccgtgtcaagtctaggattttgaaatcgggtagattgattctaccaaaggaacctaactaaatgagctatgctcacttcgttaaactggccaattattttttttaacgaaccagcaccagataataccgacatattatatagagtaagagtaaaactatttacaagcatgtttctcttacgcgagttgtgctagttaattagctaggcgaaaacaagctaagggtgtgttctaaaccagggataaaaacaactcattagctgcacataaagcgagaaacgtgatttgtatataatttgagtaataattatttaaaaataaaaaatttatctatcttttttaaaataacctttatacataaattttttgtacgaagtctgtcatttaacattttgaaaaatatgctcatgaaaatcaaggaaatagccaagctgattctaacggggcagtatactacctattgagaatcatctgtgtcatgcatggagatcgtcacactggtcaataaattaacatgcatcaacatacatatagtcatcacattcccataagacaagttgtacattgatcactgtattgttgcaatatccctccacgatcaaattaaggcttactttgggcttggtcgctccaatcaattaagagattgactctgagattgatgatatacaatgttcaattgcgagattagctatcgagactaacgtatatcgatggtgatacttggaaaaagtctatcagtccggcgactataaccacccttctattacatgtgtttacacgttgtttacatcaattcgcttaattttataataactactccgtattaacaatgtgaataagtatgggtagaatataattgcatgaaggaacattaacaaatttatcataatttgtaactaagaatattatcataacaataaataatttagcatacattaccgtgacatttaccacaatctgttgaatttctaaatgttcatttgaagtcatattgtaaatatgttgtaatatgaaaagcccaacccatcttttggttgaacgaaacattgagtgcaatggctacagttatggtttttattcatcttttgtgccgctgctttgtgctccctatgtgcgcaggcgcagccataaccgccttcgctgctgcttgagctccgaccttggctgtgtttagatcgtgtaccaatttttttttaaaatatacagacacacatttgaagtattgaacgtagattaataataaaataaattacagattccgcatgtaaactgtgagacgaatttgaaaagcctaattaatctgtcattagcaaatgtttactgtagcatcatattgtcaaatcatagcgtaattagactcaaaagattcgtcttgcaatttacagtcagactgtgcaattgatttttttcgtccacatttgatgctctatacatgtgtccaaatatttgatgtgatggaaaagttggaagtttgaagaaaaaaattggaatctaaacacggcccttgttgccatctccccggctgttgcatgaccggatgaaccccttatcccctcttatattcaacagtaaacgatatactactaacacatagttaattaaagaggaatatgcaattggtatcgcacatccagtataattttaatcactaactacgatttactttaaaaacctaaccatgactaaagtaccactctagtaagaaaatgggaaattcagttgtgtggtaattgcaatgtgctcaaaatagagctaacatgttaaaagagcagaataaagtcagttcgggaggattattatttctatttctcccttcttctagctactttcttcctgtaagcagaatgaaacaattagtatttgctcctcatttttttatagtcaaactaaaaattgaaatatatcgttgtgttaaaaacaatgaaaatggctggtccaacatgatagaatatattgtgttcctataagctgcaaaaacattaacacatatctaaaaaaatgcagaacaacgcttccaatttgtaaactctaaatactacgatcattattatctgctatgattcaaacatttataatttgatcttccagtttttcagaaggtaattaatttgtcatgtctaacacttcagcaacttcttaatttccaaatacctattattagcaaggagaaagaagaacagggttacctaaaaaggattaaatataatttgaaggacagatctttgcccatctctatatagtaaacagcgtgtgtgcattcatgacaacctaaactttagtactgctatataaattggcgtaaagagattccacactgaggattaaaaataattttaaggacagaggtttgtccatctctaaatacttttaaggcaagtttatgacaattcaaagatcaattaattaatttagaccagttccaatgtcgatctatataattggcaagagatatatatgaatatagtaacacctattgctccaaacaaaaatgtgaaactctgaattaaggatattatatatctcttgcccttgactaaatcataggccacgatcagtgagctagctagtgagccagtgagcgtacacgtcgaatcattttttttttataatgaaacaaattttgacctttattttgaagaagctataaccattatgtcggatcgattagtagtgcacgtatatatgctcacctgtcaaatcttgatttggtaagtaacaaaaacacataaacataaattaatatgtcaattagcaactattcgcaataattaacctattggcttagctaggggacagaaagtggtggagctagaaaatttataaatcctggacaagcctaactaaaacggtaaaatcactaccacttatttaatgtttatatgctcatttcactatcaattgaagacacaacaattttctaacaaaaaaaacagttcaatatgcatgtaaaatttcactatagcttgaaaagcaagatgattttattataaaatagacgattcatatgcatgctagttgagtaggtcacgtcctccattacgagacaggcaaatcaacaacggtgtttaggccctaattgtatgattaatgaaaagtcagcctgctcaacttgtccggaagtcaacgaatcgatggattttaaagtagataaataactccatctcgatgggtcagcatgcgcagcccgggcaactgcccatgttggccaggtagttaattaatctgttgctggacagacaatcatcatgggcaatttggcagttgacaattaacaatgcccactagcattctactcctaattatatagcctacttgtctctcccattgcggattttgctcaaaagtactccctccgtctaaaaaaagccaaaccctgagtttccgtgccaacgtttgactgcccgtcttatttgaaatttttttataattagtattttcattgttgttagatgataaaacatgattaatactttatgcgtgacttatctttttaattttttcttaattttttcaaataagacgaacgatcaaatgttgtacacggaaaccatggtttgtctttttttggatggagggagtatgcatctatgagcaagttcaatagtatagtccaccactagctccaatttatctatagccgatctaatagccaattcatacaatagttgcttactatactattaacatatggtcccacctgtcatacacacattacatcttggagtccgtgctgtagctggctacagatctgtagcccgctgctcttctctctcatcttttatctcattaaaatatgtttataactggctagtagcccgctattgtacgtgctctaaaaagactcttcacagtagcaagctagcatagacatcttgtgtcgttcttctccaatcctaggttatacatacctttggttcgtcttcaaggctcttaattggtcgttggttccgcgcgtctttgagacaaagttaggtaaaatttttcacactttgcatccaaattagtttgtttatatagtaatgtgtcggtgatatgggaccgggagtattgcgcccggaggcttgaggcagatggaatcgcccacgtggcctggcaccttcggggacgtcgggcccgagggtgaggtgtccgccctcctcctgatttccccaagggggggtcgggttgctcctgccccggccccgagggacgaggtgccccgaccccctgtggggtttgcactatgtacataggttgggtgaacacggtagggctcacctaaccgcatttattgcggtctggtcaagcgtgtcacgctgcatgcagcgcaatgcagcgcgctcttttatccggtctgtgaccagtcacagaccggtcggatcaacggttaggtggcgactggcggtctgacgcacgcctcgccccgtcccgtcaagacgagagcctctaggcacacgtctccagccggagctagcgtgttacctcttagagatggcacgttagccctggttagatgaataccaggcttcatcccaaccattacaggcaagatgctacaaaaagaagggtgatcatgcagatcgctgaactgacgcatagaggacaagaatgaccgatctgtgaccggtctgacactggtcgcgtcagcaacagacagccacgatcccacgttgcgcctgtctccgccgggagtggaggtaggtgtgggctgtcccatcgaagtgtcattcgggcggcaaccataccaacctccgtccataaagagaagaaaagtccagtttggaagggagagggtacatgtggtatccccttaagatataaaaggaggaccatgcccacaaagagaggggactggattttcccgggagaggagagggctggttgatattttgtaacttgctcttacacagatccacaaaaaacacaggagtagggtattacgcttcccagcggcccgaacctgtatacatcgtccgtgtctcgcgtttcttcctggcacgcgatctttccacatacagagagagcttgagatctcaccctaagcccccggccgaactggcaaaggggggcctgcgcggtctcccggtgaggagccacgagctccgtcatctggcgcgccaggtagggggctcagcgtgtgttttctgagctctcatactcttccgtgtgcgccaagtttcccttgttcagcctaatggccgagcaagcaaaggcgcacgacctctctccgagtgtgagcggcgacgacggggagccaaacccgcgccatcgagctcgtactcccccaccttctccgcgccaaagtcctaagcggggggaggcgctcgagagggttgaaaaacccacagcatcaccagtcgcaggtgatgcaggagagcggcgagacggggagcgtcgcctcctcgtctacggtgacggcagcacgccccagggagcgcttcaggctgctggcgcgctcctacgtcacccgcccgtcgtccctgacccggagtctccagcccagcgatggctggacgacgtggccaacttggtcatgacggcacagcagcgcctgggtgctggtggacggtccgccaccaccaggacctccggcgccgccacctccggctctgtgtcatcaaggcgaagggcgcggcgagcggcggctgctgcacgccattcggctaccactccctcgtcggcgcctccgactcgggaggatcagcatgaagagccggatgcccgcctcgacatcgagcgccgacgtagtgatcggcgtgctccccgcgcaacggagggtgcctcttcgtccagggtgtcacctcgacatggacgtgaggatcagccctccgtgcccccggttggtggtgttggctgtagagcctttgtggcgagtcttcggaatgtccgttggcccccaaggttccggcccaccatcaccgagaagtatgatgggagcgtcaaccccaccgagtttctccaggtctatacgaccgggatcgaggccgctgggggagacgacagggtcatggcgaatttctttcccatggccctgaagggacaggcgcggggttggctaatgaacctgccgcccgcgtcggtccactcctgggaggatttgtgccagcagttcaccatgaactttcaaggcacctatccacgcccaggtgaagaagcggacttgcacgcagtacagcgaggggatgatgaatcccttcgctcgtacattcagcgtttctgccaagtccgcaatactataccttgcatccctgcacacgcggtgatctacgcgttcagggggggtgtgcggcacaaccgcatgctcgaaaagattgcctccaaagagccccagactaccgcagaactttttcagctcgcggaccgagtggctcgtaaggaggaggcctggacctggaacccctccggttccggtgtggcagcttcggccgcccccggatccgccgctcagacagggcggcgtgacaggaggaggaagaaaaggtcggtccattccggcgacgagggtcacgtcctcgccgtcgagggcgctccgcgggccacccgaaaggggaggcctgcgagcgacaaaaagaaagaggctggtactcccagcagggagcgcccagccagcaagtggtgctccgtccacaacacctccctccacgatctcgcggactgtcgcgcagtcaaaaacttggctgagcgaacgaggaagtgggaggaggacaggaggcaggaacgccgtgagggcaagtccgcggcagttccctccggtaaacggcgaagtgaggccaaacagaaggcccccgccgttgacatcgatgacggtgatgatgacctaggtttccaagaacctggggccaccattgccactgtcgacgggggagcgtgtgctcgcgtttctcgccggagtttcaaggccatgaggcgagagcttctcgccgcggcccctactcatgaggcgacgcgtcgggcgcggtggtcggaggtggccctcacctttgaccagaccgaccacccaccgtgcgttgcccggggagggcagattgcgatggtggtttctcccaccatctgcaatgtgaagttggggcgtgtcctcatagat

SEQ ID NO: 20224 - DNA, 5597 bp, Oryza sativa
  unsure (1)..(5597): unsure at all n locations
ccatgaggcgagagcttctcgccgcggcccctactcatgaggcgacgcgtcgggcgcggtggtcggaggtggccctcacctttgaccagaccgaccacccaccgtgcgttgcccggggagggcagattgcgatggtggtttctcccaccatctgcaatgtgaagttggggcgtgtcctcatagatggaggagcggctctcaacatcctttcccccgcggcctttgatgctatcaaggccccggggatggtgctccagccgtctcaaccgatcatcggtgtgacgccggggcacacatggccgttaggtcacatcgacctaccggtcacctttggtggatcagccaacttccgcacggagcgggtgaacttcgatgtggcggacctcagtctgccctacaacgcggtcctggggaggcccgcgttggtgaagtttatggcggcggtccactacgcctacctccagatgaagatgccgggccccggtggccccatctctgtccgtggcgaccttaaagtcgcgctcgcttgcatggagcagtgcgcggaccacctcgctgctgcgaccaagcccgagggtggtgacgagaggcttggcacctctgcccccaccgccccgaggcagcggattgccacatgcgacgaggtcccggtcaaggaggttgccttgggcgacggcccatccaagaccacacggatcggtggtcttctggatggcaaataggaagacgcgctcgtctccttcctgcgggcaaacgctgacgtcttcgcatggagaccagcggacatgcccggggtccccagggaggtgattgagcaccgtctcgccgtgcggccgggcgcaaggccggtccggcagaaagtgcggcggcaggccccggaacgtcaagccttcatccgcgaggaggtggcgaggcttctggaggccggattcatccgtgaagtcatccatccggagtggctggcgaacccggtggtcgttcccaaggcgaacggcaagcttcggatgtgcatcgactacaccgaccttaacaaggcatgtcctaaggatccttaccccctgcctcgcatagatcagatcgtcgactccactgcggggtgcgaccttttgtgttttctagatgcatactctggttaccatcagattcgcatggctagggaggatgaggagaaaactgcgttcattacccccgtaggaacctattgttttacatcaatgcccttcgggttaaagaatgcaggtcctacttttcaacgtactactcgaatttctttgggtagccaaataggacgtaatgttgaggcttatgtcgatgacttggttgtaaaaacgcgcaaccaagaaactttactttcagatctagcggaaacttttgagaacctccgctccgcccgcataaagctgaaccccgataagtgtgtgtttggtgtacctgcgggcaagcttctcgggttcttggtctctgcccgaggcattgaggccaaccccgagaagattcgagctatcgagcggatgcgcccccccagcaaacttagggatgtgcaatgcgtcaccggttgcatggccgccctaagtcgtttcatatcaaggctgggagagaaggcgctacccttgtttaagctcctcaagcgcacggggccgtttacttggacggaggaagctgaacatgccctcactcagttaaaggcatatctcagctctcccccggttctagtcgccccggagccaaatgagcccctgctactttacttagcggcgaccccccaagtagttagtgcagcattggttgtggagcgcgatgaagacaatcctcatttcgtgcacccccattctgtgctaacttggcccgggagcgagcggggaggagaggcccccgagtcggacggtggcctacggcccctgacgaccggagccggccctctgcccgcttgtcagacggtgctaggtgcccccgaccctcaggagggccccaaggccactgcgggaaggccgcacttaacgccctttgaccccgaggctaaccctgtgctgactcgacccgggaaagagcagggagaagaggccccccgagccgaacggaggccagaggcccctgacgaccggagttggccctttgcccgcttgtccgacgatgccaggagccccccgacccccaagacggccccgaggccactgagggaaggcccgccctttcatcctccgaccccaaggtcatcggcacaaaaaacaagtgcgccccgaaaggccacttgaacgaagaacgccccggngatacggcccctagcagagaggatcggccccaccgaagggtgcagcggcctgtctactttgntagtgaggccctccgggacgctaagacccgataccctcaggcccagaagatgctttacgctattctgatggcctcgaaggaaactgcgccattattttcaggcacatagggtcactgtggttacgtcttaccccctcggtcaaatcttgcatgatcgagagggtacagggcgggtggtaaaatgggcaatcgagctttctgaattcgatctgcactttgaaccacgccacgctatcaagagccaggccctcgccgattttgtggcagagtggaccccggctccagagaccgtctcaatccccgaggccagcacgaacccctcgcagttgcctcacaccacccactgggtaatgcagttcgatggttctctgtccctccagggtgccggtgcgggggtcacgttgacctccccgaccggagacgtccttagatatctggtccgcctcgactttcgagcgaccaataatatggcagagtacgagggactccttgccggactcagggtggcagccggactggggatccgccgtctcctagtgttaggcgattcccagctggtcgttaaccaggtctgtaaggagtaccggtgctctgacccgcaaatggacgcctatgtacgccaagtgcggcgtatggagcgccattttgacgggatagagcttcggcatgtgcccagacgggataacatgatagccgacgaactctcacggctcgcgtcctcgcgagcccagaccccaccgggcgcctttgaagaaaggcttacccagccgtcggcgcgacccgaccccttaggggagacggatgcgcctgaccggcccccgaggcccgtcggagtccaggcctcgggacccgaagggagcgctccaagctcccttagattgattgcttggatctctgagatccaaacataccttacagataagactctacctgaggaccgcgaagggagtgaacgcgtacaacgcatttccaaacgctatgtgctggtagaagggaccctctatcggcgcgcggctaacggaatcctcctgaagtgcattcctcaggaacaaggcgttgagcttcttgctgacatccatgagggcgagtgcggagcccattccgcctcgcgcaccctggttggcaaggcctttcgtcaaggattttattggccgacagctctcaatgatgcagtcgatctggtccggcgatgcagagcgtgtcagttccacgccaagcaaatccatcagccggcccaggccctgcagatcataccactgtcatggccatttgctgtctgggggcttgatatcctgggaccgttcaaacgggccccgggcaggtttgagtatctgtatgttgcgatcgacaagttcactaagtggcccgaggcttatccggttgtcaagatcgataagcactctgctcttaaattcattaagggcatcacggcccgttttggagtgcctaaccgtattattacggataatggcacccaattcactagtgaactcttcggcgactactgcgaagacatgggcatcaagctctgcttcgcctcacctgcccaccccagaagcaatggccaagtggagcgcgccaatgcagaaatcctcaaaggccttaaaaccaagaccttcaatattctcaagaagcacggcgattcatggatcgaggagttgccagcggtgctctgggcaaaccgaaccacaccaagccgagcgaccggggaaacgcctttcttcctcgtctacggcgcagaagcggttctcccatccgagctcaccctgaggtctcctcgggccaccatgtactgcgaggctgatcaagatcagcttcgtagagatgacctcgactacttggaagagcgaaggcggcgcgcggcccttcgagccgcgcgctaccagcagagcctgcggcgctaccatcagcgccacgtccgggcccgatcactctgcgtcgacgacctcgtcctacgccgcgtccaaacgcgtgctggactgagcaagctctcaccaatgtgggagggtctgtatcgagtgatcggcgtcccccggccaggctccgtacggctggccacgggcgacggcactgagctgccaaacccgtggaacatcgaacaccttcgtcgcttctacccctgaggggggggggggtcgggtgtcaggtttcgggctcgggctaaccccgcacccccctcgggtgtgcagggttagccgggggctaccacacatgcacagccttacttttcttatttcagcatttcaataaaagcagtttcaatttcctaaaggttgtgtctgtgccgtttttccttctgaagaatcttaacttgaaataaggtcactcgtgctcaaccttgccctcgggggctcggttcggtcagctaaaatcgccaagcggggcccagaaccgaaccgtgccccggggggtggtgaactccgggggggaatcggcaaaaacccacaattgggtcacccataaccctcggtccccatgttcccggcctggccagtctcgacatgtggatctccccaggcactagccccgacccgagccatttgaggatcgggacttgagcacgagcccttaaatcaagctaaaatgcaaaaggaccacggcacaaatcatcctcaactcatatgcatagaaaaataaagttaacatagaaatttttcatcatttttgattgcagattaagttgatctatacaaaaagaagaaagaaaaagaaaaaattggagattggcgggggcctgggggctcattccaatgcgcccgggtcgccggcctcgtcgccaccgtcgtccttaccgctggcgtcgccctcctcgtcggagctgggggcgaacgcgagccgaggggccgacccctcgaagctttggacgatgtggttggcggcatcccggacccgcgcacgcgcatcgtcctcggtcccgggagggaactcctccagcgccatccatggggagaagccggggtccctggcctggtaactcgctaacacgagttccaccgctccttgggcgaggtccctcgaggatgacttgatggtcttctcgagctcctcggggagttgttggacagcccaggccatcctcctaaggtgcggggcaaggccttccagattggtggagcgcgaaattgtctggcctttccagaggcccgcttcccgaccggcgcgatccagccgggagactgcatcccaaagcatgccgggccctatctcacccgacaagcggagggcctcggcttccccggtggatgagtccagggcgcgctgcatgt

SEQ ID NO: 20225 - DNA, 511 bp, Oryza sativa
cgcgcctgctcctcctgcgctgcctcgcggagggacaggctgtccgccagccgttgtgtcgcggcctcggactcctcaagagctcgctcccgctcagcaagcgcgtcctcgcggagccggagcgcggactcctcttcggcgcaggcggcctcgtgcgccgccagcgtcgcctcacggatagcggcggcggcctcgcggtccgccaagctggtctccacggcgccggcatgatcttccagcgccatggcacgggcttcaagggcctcttcgcgccgccgggacgccgcttcagcctccgttgctcgctgctctcgggcagcggcggcgtcaaggaccccctgggcggcgtcgagctttttctttagctccgcctcccagctcccgtgttgaaggcggagggagtcctgcgcctcaatcatcgcggtggtggcgatgagggcggcctctcgctcctcctccacctctcgggcgatctccgccagcgccgccttgcgggcttcaagctccgaga

SEQ ID NO: 20226 - DNA, 721 bp, Oryza sativa
  unsure (1)..(721): unsure at all n locations
ccgcnacaccataactaaggccagtgatcctatgcagtcgtctaggctcgtcgatttgtgactgataataatagacattttatgtcaatataatcagctaatattacttagatgatacccctgtaatttactacggaataaattttttaatgcattgctttgcccatatgttttaaattacatatttatcaaaatacttaacatatgtttacaattaaatagataatctgtcgtaataatttactcgacaatctgtttcaaacaaaatcttggaatattgtaaaagatgataatatatatgtttcaaacagaatcttacaatcttttctagacagacggtggccggcctaggctacaacacacggggggcggcggaccggcggtacagcttaggcaattagttagccatagtagccagtttaagcgattgaagaatgaagaccccgggcgttgacgtcacgcttatgactgcggcggcgaaagcgtcaaaagcgcggggcccgattgggtcgcacgcgtgcccggaaaaagccagcccgccacttaccctccattccgccttgccaagccacacaccacaaacgccacccggttttaattttttttcgcgcacacacgcacgcacgcatgcacctgcaactttgaacaacgcacgggactcactggtgctggtactactcgcttagccgatcgacggatcgatcgatcggaacgccgagtc

SEQ ID NO: 20227 - DNA, 583 bp, Oryza sativa
cttcggctgttccggtggttcttcaccgtgcagtcggtgtcgccgccatcggtagtcggtggctgctacttccagccacgggggccggcgctgaaccgctacatcccctgcgccctccgcaagaagtgggacgactggaagagcgattggttctacactcccctcgccgacgaagcgcgcctccgacttccgagccagcccccggcgcaggcctccagttggcgggcgccggtagaatctgggggatggctatgacgctgtcctcgaccgcctggcgggcctgcgatcccaggggctcacaggggccatggtgtatggcgactacctccgtcgtcggattgcgccgctccagcggcgcgctcggggcgcctgggagtacaccgggtccgaagactactgaggacccaccggggagtgagatgggactgggctcctgaggacttcaagatattggtccaacgggtgctgaatctcaactccgtggaggcgtctctcattccccaaggaatcctccccctctgcagcgatccagaccgcgcctccatcttgaccattatgacgggggtcggggcctcagaggagg

SEQ ID NO: 20228 - DNA, 78 bp, Oryza sativa
tggccggccgggccctgcgcgccgacggagggggatgccccggtgaggccggccagcgttcccgcggcgctcggttgc

SEQ ID NO: 20229 - DNA, 1016 bp, Oryza sativa
gtgtaccttgtgtagacgcatgctcgagaccagaagatactcccgagaatgacacaactacttttcctagtcgctagctgctgcatgaaggaaaaattaagatacaacgccatcaatattgaaatcggcatttggctcggattacatgtgccccggactgatcgatctatcatcaggtaattacttcaatcctactagagcctctgggattcaattggatgatacgtggatgcggacggaccgcaatttttttcctttctcgttaattaaagtcggaacgtccgcgtccgctccgtgaggatttgataacagacgatcgacagcctcatgctggtttatttttcttcaatgttttcaacgtaaagactttgaaaaaacgtatactacttccatatggtgtacatcaatatcatctagcacaagtgtccggatgtcgacgtagcgccctcaaacaaacaagtgagaaagataggggtgagaaatcccaagcttaagctataactattttttattacaccgaataaatagacattaaaaattttattctctatatatgacaagatctagattctagaactaggaggtggatgtgatagccaaaaataaaaaaaagagaatttatgttaccacatttaaccaatacaattagaggcatcaagtattacacatacatttaacatccatatatcaaaagaaattaaatttaaaaacatggaggttttcctttacaattttggatggattaatccattacaaattaggttttaaaggttaaaaaagttggaaacctagtgtggaaatgagtagattttaggtccgtaagaaaatcccccgaagatttgaagttcaaaacctcccccctatatttaagtcactttaggagagagaaacttcggggagaatgaacagggctcggagaggaagaagactatataggagcatcttttcaggcgggccatataagcgtcgcctgcgaagattgatcttcgcaggtggaccatataagcgtcgcctgc

SEQ ID NO: 20230 - DNA, 2460 bp, Oryza sativa
  unsure (1)..(2460): unsure at all n locations
cctatgagcatcacacttaggccctgtatagatgggactaaaacttttaagtccctatcacatcggatatttagaaattaattataaatattaaacgtagactattaataaaacccatccataatcttggactaattcgcgagacgaatctattgagcctaattaatccatgattagccatgtgatgctacagtaaacgttctctaattatggattaattaggcttaaaaaaattatctcgtgaattagctttcatttatgtaattagttttataagtagtctatatttaatactataaattagtttctaaatatagggactaaagttaagtccctggatccaaacaccacctaagccgttgtagcctatagtagaccttgtccaatggcagtgccgcagaggacgaggtcactatcacagcttccataaaccccagcaagttctacactggcacaaccaccaacccaagatcgagggcctctgcaccatgaagcgtgaccgggacgaaaagttcaccgctattgacctgagaacaaagggctcaccacaaagaacaaggtcagggacgggcgacactcttggatggcagtaggatgccatgaatgagcgatgggagaggttaggaatagggcgctgtgcatcagggatgcccgctagagcatgaggcagtcctggtggggcagcaataagcagtgagaggttgatctccgcacaatgagaggctggcccagagctggtggtgggaggatggctggatgggaacggcgacactcggggacaggcgatggagggcagggaagttgtcgggatgccgagacggtagggcggaggcggtggtgggaggatagggtgggattggttcatccattagggatgttggatcaagttggagcacccaaaacccaaataatgacagtttcttttagtaccgaagattcttattgacaatcggcaggagatgttctaagcctttgtattccgggggtaatttcgaactctaaaagtatttatattttgggatggagtatacttacttattatacttcccttattaacaggttaggtttgttgttaatggcacttgcaataagatgttttctttccttactatgaggttttacctctaacaaggtaatagattatagagataatccaagaaatgccattgacaagcgtccaaatccaaaaaatgtcatcgacaagtgtaagttcaaagaaatgctatcgtacaaattattttgtcccaaaaatgctatcactgttaggaattgacagtgttcttacggcgcggaatggacggaaccctaacgatgatggcatgtttaggacaaagtcatttgtacgaagacatttcttggaactcacacttatcgggtagcatttcttggatttggacgcttgtcaatagcatttcttatattatctctagattatatcacccattggatcaaacaccaatgaactgttcaaatatacttggagctccttaagaagtccttatattttggccccatttgatagggctccaaactccaactcctagctctaaactacaatttcagtgagagctagcttctgttagagtttggctaggtttcagctccagatctgaagataaaaaagaaaaaaaactaaaaataaagaaaacaagccgccggccgttcgctgtcccaggcgcgccgcccgtcgtcgtctcgggcgccgtcgcccgtcgccaccagacgccgctgtcgcccaccgcttcccgcagacgccgacgatgccgccgccgcccgctgacaaagatgctgccatcactcgccgcttcccgccgccgttgtcgcccactgccgtcgacgctgccgccccgctcgccgacacagatgttgccgtcgcccgccgcttcccgccgctacccgctgccgtcaccacagacgcccatcaggaagaagatgtgaggatgagaggaggtgtggaggggtagttgagtagcattttcatgtaaatagactaaaaacttaaagggtagtgggtcttttggggtggagtggagctgtggagcagcaaaaacctagctccacccccgtagttcattttctaggaatagttctgctaactccgctccagaaaacggaagatctggaccgtttggcacagctccggctctaggtaagctagagctgtgccaaacggggcctttatttagaattttcaatgttatcatttgatgatctccatggtcagggatgcttatggtacagcttcatcaagaagagccttcatggcatatgtgtctgaagggttaggcaacctacaagactggaatcaggtaatggcgtatcaaaggaagaatggatcgattttcaactcgccttctgcaactgctgctacaataatccatggccacannnnnnnnnnnnnnnnnnnnnnnnnnnnnnnnnnnnnnnnnnnnnnnnnnnnnnnnnnnnnnnnnnnnnnnn

SEQ ID NO: 20231 - DNA, 1788 bp, Oryza sativa
cagggatgcttatggtacagcttcatcaagaagagccttcatggcatatgtgtctgaagggttaggcaacctacaagactggaatcaggtaatggcgtatcaaaggaagaatggatcgattttcaactcgccttctgcaactgctgctacaataatccatggccacaactatagcggcctcgcttacttggattttgttacaagcaagtttggtggcccaggtgtgccccccccctccccccgggtactatatgtattttgcccaagcaagtgaccaagaatgtcaactagaaatatgagatgtcaaatatactaactggaaatgggtgttttccagtcccggtgatgtatccgcaaaatgcttattcacaactttgcatggtggatactcttgaaaggatgggtatctctgagagttttgcttgtgaaataagtgatatattggacatgacatacaggtaacagcaactcataaaaaaatacctaattaaaaagatataggagaggctaatgatggcaatttgatgtgcctttgtacctactactttatttctattgtattatgtttgcaggttatggatgcataatgaggaggagctaatgttggacatgagaacatgtgcaatggcatttcgcctattacgtatgcatggttatgacatcacctcaggtactgcatggagcttcaggacacttaaatttgaatgtcctagcttttgctcggttttgcagtacaaaatttcaattggaaatattaataatcatttcggaactattgagcagatggaatggctcaatttgtggaacaatccagctttgatgattcaattcatggatatctaaatgatactaaggctttgcttgagttgtacaaaagttcacaacttcgttgcttggaagatgatttgattctagaagaaattggttcttggtcagcaagagtactactggaaaaaatatcttccaaaatgatacacatatcagaattaccggaggcaagtactaaataggcaaattttgctagactacacttaaagtttatgtaatttgctggagatcattgtaaaaatgtgtcacggttgaaggaaaccctaaaaaagctagtaatttgctagaggatattttcagaccaactaaagagagcaagagtaaagatataaaatactgcttgctagtattaatgtatttggggtgatggcaaatttagagtcacatttttctaaattttctctccaacatccatgttacaagtctgtgaccattggggcattctcgtttatttgaagaatttatctatccaattaggctaaaaatgtcctctgccaaattaccaattttttagagtgttttccaaccatgacatgtttttatgatgtttatatcaacaaattacaaatactttgggtgttctgtagaaaaatttgcctactaaataacatcttagcgaacaaatgttcttgcaaaaaaacatcgcagccatgcaaaagaaggcgaatctttctcataatgccattatcatactttcgctttcgcaggtggagtatgccttgaaatgcccagtctatgccatcttggaaaggctagagcagaagaggaacatagaacaattcaagaccaaggaacaactaaaaatcgagggcttcaagctgctgaaatcaggataccggtagatatcattgttacacatcacagccgtacaatttatttctttactgttgtagttgtctaaatcgtgaacctattataacatggatcagtggcgttattccaaatgatgaaattctggct

SEQ ID NO: 20232 - DNA, 1569 bp, Oryza sativa
  unsure (1)..(1569): unsure at all n locations
nnnnnnnnnnnnnnnnnnnnnnnnnnnnnnnnnnnnnnnnnnnnnnnnnnnnnnnnnnnnnnnnnnnnnnnnactttcgctttcgcaggtggagtatgccttgaaatgcccagtctatgccatcttggaaaggctagagcagaagaggaacatagaacaattcaagaccaaggaacaactaaaaatcgagggcttcaagctgctgaaatcaggataccggtagatatcattgttacacatcacagccgtacaatttatttctttactgttgtagttgtctaaatcgtgaacctattataacatggatcagtggcgttattccaaatgatgaaattctggctttggctgttgacgaattccattcctctcaatctgtctaccaacaagaactccaagacctcaataggtgcgaaatctatctatatatgatcatatatacctatcctcgattcatccattccaataagatgtttttgatatcattcactaatattgagcatatgacagttgggtggcacataccagattggatgagctgaaatttgcaagattaatgccatcgataacctatttcagtgctgctgccgtcctgttgccttctgaatcagcccgcattgcatggacccagaactgcatcttgacgaccacagtcgatgacttctttgacggtgaaggatcaaaagaagaaatggagaacttggtcaaattaatagagaagtacaacacacctgtacactatgtcttttgtacaactaatatctatcagtcctgttgtgataatatatatcgtgctgtacaggtgggacgaccatggtgagattggcttctcctccgagtgtgtagagattctattctatgctgtttacaacacgagcaagcagattgcggaaaaggccatgccgctgcagaaacgcaatgccgtggatcatatcgccgaatcggtaaacctatctcttctacgtgtgtgagtttccacttttaaggcttctaggttttagttttccacgatataatatataatctatttgcagtggtggttcacggtgaggggcatgttgaccgaggccgaatggaggatggacaagtatgtgccaacaacagtggaggagtacatgtcagctgccgtggactcctttgctgtaggccccatcatcacctcggcggcattgttcgtcggaccagagctctcggaagaggttttcaggagcgaggagtacatccacctaatgaaccttgcgaacactatcggtcgccttctcaatgacatgcagacatacgagaaggaaatcaaaatggggaaggtcaatagcgtcatgttgcatgctctttcccacagcggcggaggccgcggctcaccggaggcatcgatggaggaggccaagagagagatgagagggtcctccagggctgtaggtttgagctcctaaggctggtgactagggatgcgggtgttgttcctccgccgtgcaggaagctcttctggctcatgagcaaggttttannnnnnnnnnnnnnnnnnnnnnnnnnnnnnnnnnnnnnnnnnnnnnnnnnnnnnnnnnnnnnnnnnnn

SEQ ID NO: 20233 - DNA, 1121 bp, Oryza sativa
cctccgccgtgcaggaagctcttctggctcatgagcaaggttttacactttgtctacatggaaaaggataggtatttcacggcagaggggatgatggcctcggcaaatgcggtgattcttgatcccctgcaagtgacacttcctccatctgattcgggaacactgtgaccacaaacaaaacctgaattgtgtactgtgttaagcagcctgcgcaggtgtttattgcccgcgtagctctcctgcaaattataactaggtcgaaataagttgcttgtaatgtctattactcaataattcttggtctagaatgcatatagtgtattcaaacatttgactttttaagtatgaaataagttgtttgtaatgtatacaactactctttcagtcctgcaaaacagagtgaagcgaataaagcatacacacatataagaggaaatacacttccagtgattcaggggaaacagattaagatcatatatgaactgcttttttcttacgaagttgtaaaacatgcagctccaaagaaatcaaaaggtacaatattcagccataccaaatataatttttcaattcgacatttgcgtgctaatatgccacgtctgaaaggaaattctaacactttacttcctccatcttcttatataataaagttagttagttaaaaaaaataaactaaccaacgtaaagtaaaagacaaattgtgttcttactcctatttatgttgcagttatgatttttttctgatttctttaggttgcatatttgaacttacttttttcaaacgaggcttcagtatgcccttgttctggatgacagtaaggtggacttcagatttgtgagataacataaaaggaaaaaaatatttacaaaatgcaaaaggacttttttaccctggcagacataacttacccacccccatacccaactagctagcccaacacaatgttcgttaagccattccgtccaaatcccgtgctaggctcaagcaatcatttggccatgcacgtggtggggaaatggagaggcggtgacaaatccacttccaagctgatcgtgcaacagctcggaaaaatcaggcaatcaaagcgccccgggcctgccgctacaagctgtcaatgcat

SEQ ID NO: 20234 - DNA, 247 bp, Oryza sativa
acccgtcatacacttttcctttctcttctcttctctcactcttcctctctctcttctctcactctctcacgattcacagcggcaggcggggcgcggcgagcggcggcgggggatgaggcggcgagcggcagcggcgacaagggatgaggccgcggcgggggatgaggcggcgagcggcaacggcggcgagggatgaggcggcgagcggcggcggaagaggcaagcggcggaggagggaggaggcggc

SEQ ID NO: 20235 - DNA, 763 bp, Oryza sativa
  unsure (1)..(763): unsure at all n locations
nnnnnnnnnnnnnnnnnnnnnnnnnnnnnnnnnnnnnnnnnnnnnnnnnnnnnnnnnnnnnnnnntaactcataaaaattggtcttgacatttttagttttaaatattaatgatgtgacggcatgaggtgtgcatttccttttgcacacagctttctaacaaaaaaaagggtaaaaaacaaagttgtattaaaccagtgatttgactttactaaaatattacttgttttccatcttagatctgagttctgaaagtaaattgccataatagagtgtaatcattcctaacactcactatggaggcttccagagaaactcatgatgagtttggtgttaaggcgtctaaaacttggctattgctcctttcatcattgttatgcatatcaaatgctgaccaacagtatttaacctaaggaaaaacttgtgttctttagaaaattttcaaatcaacggaacagatacagcctacttactagtttagttactccatttcataatgaaagagtaaacatcctgccttgtgagtttgtgttgaacaaatttgttttgatgatttgtttgagctactgagatgaaattcatctgcttttggcttataggatgctaaagagggaacaacaactggggtatctgcaaaggatagggcaaagacagtatgactcttgcatcccctgactctaagcctgaagacttcaatcggcctggtcatattttccctctgaaatacagagagggtggtgttctgaaacgagctggacatactg

SEQ ID NO: 20236 - DNA, 238 bp, Oryza sativa
ctactatagggcgaattcgagctcggtacccatctattaaaaaacggagggatgatatcctgattccgtacggtaaggttggggaatagtaaagcaagtgaagattcttgcacatcttccagaataactgcttgcatggccttggaatagcgccctccctaaggaccaacttgaacagcttcctcctagcagtgtctacgcgcaggggcggatttgccatgggggcgggggggggggg

SEQ ID NO: 20237 - DNA, 760 bp, Oryza sativa
  unsure (1)..(760): unsure at all n locations
nnnnnnnnnnnnnnnnnnnnnnnnnnnnnnnnnnnnnnnnnnnnnnnnnnnnnnnnnatccccaattccagataggtactatatctcacaaagggaaaaaaaaagagagactaggctaagcttccacgaacagcatcttgtgtgtctaccatttatggatatttcgcaccttaacacccttactcttcacgtcaaagagctccaagtatggagagcatctaccttagactttcccatcaaacactccctgaacactcggtcaccgtctccctctttaattcccaaaagttcatgcagccaccaacctcctcacctcctcatagcctatccaagaactccattaaatttagcagttggccaaggattcaggaatggtgtgtgtgtgctctggtttactgttttagcaacaagaagaatggttaattagttaagtgtcctggtgagtggcttatcgtcagagggatgacgcgaatggccaggcgcagctgaccgatcgctgtcttttggtgtgcagacccgctgtcgctggtgagggaccaccgggtgaaggcgctgctgacggccgagggcatcgccgtgcagtcgttcaacgccgacctgctgtacgagccatgggaggtggtcgacgacgacggctgcccgttcaccatgttcgcgccgttctgggacaggtgcctgtgcatgcccgacccggcggcgccgctgctgccgcccaagaggatcgcgcccggcgagctgccggcgaggaggtgcccctccg

SEQ ID NO: 20238 - DNA, 2615 bp, Oryza sativa
  unsure (1)..(2615): unsure at all n locations
nnnnnnnnnnnnnnnnnnnnnnnnnnnnnnnnnnnnnnnnnnnnnnnnnnnnnnnnnnnnnnnntcccctgttttagcaacaagaagaatggttaattagttaagtgtcctggtgagtggcttatcgtcagagggatgacgcgaatggccaggcgcagctgaccgatcgctgtcttttggtgtgcagacccgctgtcgctggtgagggaccaccgggtgaaggcgctgctgacggccgagggcatcgccgtgcagtcgttcaacgccgacctgctgtacgagccatgggaggtggtcgacgacgacggctgcccgttcaccatgttcgcgccgttctgggacaggtgcctgtgcatgcccgacccggcggcgccgctgctgccgcccaagaggatcgcgcccggcgagctgccggcgaggaggtgcccctccgacgagctggtgttcgaggacgagtccgagcgggggagcaacgcgctgctggcgagggcgtggtcgcccgggtggcagaacgccgacaaggcgctggccgcgttcctcaacgggccactcatggactactcggtgaaccggaagaaggccgacagcgccagcacgtcactgctgtcgccgtacctgcacttcggcgagctcagcgtacgcaaggtgttccaccaggtgaggatgaagcagctcatgtggagcaacgaggggaaccacgccggcgacgagagctgcgtcctcttcctccggtccatcggcctcagggagtactcgaggtacctcacgttcaaccacccgtgcagcctggagaagccactcctggcgcacctcaggttcttcccctgggtggtcgacgaggtgtacttcaaggtgtggaggcaggggaggacagggtaccctctcgtcgacgccgggatgcgcgagctctgggccaccggctggctgcacgaccggatacgcgtcgtcgtctccagcttcttcgtcaaggtgctccagcttccatggcgctgggggatgaagtacttctgggacaccctgctcgacgccgacctcgagagcgacgcgctcggctggcagtacatctccggctctctccccgatggccgtgagctcgaccgcatcgacaaccctcaggtacccaacttctgttctcctccatgagatgggaccatctttgttgccattaccatattgatctgatgcattggtgttgtgtttcgcagcttgaaggatacaagtttgatccgcacggggagtatgtccggcgatggctgccggagctggcaaggctgccgacggagtggatacaccacccatgggacgcaccggagtcggtgctccaggctgcagggattgagctaggctccaactatcctctccccatcgtggagctggacgcggcgaagaccaggctgcaggatgcactgtcagagatgtgggagctcgaggccgcgtcacgcgcagcgatggagaacggaatggaggagggcctcggcgactcctccgacgtgccgccgatcgccttcccaccggagctgcagatggaagttgaccgagcaccggcccagcctactgttcacggaccgacaacggctggccgcgacgagaggatcagatggttcccagcatgacctcctcgctggtcagagctgaaacagaactttcagcggattttgacaacagcatggacagtaggccggaggtgccgtcgcaggtgctcttccagcctcggatggaaagggaagaaacagtggacggcggcggtggcggcggaatggtcggcaggagcaacggcggcggccaccaaggccaacaccagcagcaacagcacaactttcagactacaattcaccgggcacggggcgttgcgccgtctacgtcagaggcatcaagcaactggactgggagagaaggcggcgtggtgcccgtctggtcgcctccggcagcgtcaggcccctcagatcactacgctgccgatgaagctgacattaccagtagaagttatttggacaggcatccacagtcgcatacgttgatgaactggagtcagctctcgcagtcattgtgagttcacacgcacggtaactcattgttcccagcaaactgcgtcagtattacattgaaaaatcacagcttacagagtaattgtctcagctggttattaaaagggttgaaatttaatttcaagtgcagtatctgaaatgaagcattctatacgcttactaatgctcccatttattttatgcatctgaatgtaggacaacaggctgggaagtggaaaattaatgctgattgtcagaattaatcattaggaaggtcgacattgagaagaattcatatgtaaattatcaccttttgtttgtctatagccttggtgtgcatgaatcaagtgatgnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnnn

SEQ ID NO: 20239 - DNA, 829 bp, Oryza sativa
  unsure (1)..(829): unsure at all n locations
nnnnnnnnnnnnnnnnnnnnnnnnnnnnnnnnnnnnnnnnnnnnnnnnnnnnnnnnntccccagatggtatacccgagcaatgatgagagggagtaatatagatagctgaatattgtggtgacttggtcttatcttattattattttttcaacatatataaacccatgttgcatgtaactcaaaaccatgctgtgtagtatctttacagggcagtcgtgaatgatgcttcctatgagttcagcatgctcaggaggacaattccccggagcttcacctcatgggataataccaaagcagttcagcagagcgcctcgtattcgtgtcagtataagaggtatgaggtacctcccaagtgctacaaaagatctcttaatatatggtatacctctttgctactccctccgtttataataagttttatattataagtcgcttgattttttttctagtcaaactttattaagtttgaccaagtttattgaaaaatttagcaacatctaaaatattaagttagttctattaaatctaataaaaattaatatattttgtataatgtatttgttttgggttgaaaatactactatatttttctataaatttggttaaacttaaaagaaatttgactaggaaaaaagtcaaatgacttataatataaaacggaggaagtatttgagagtacagttgtcgaagctgttatactagacagataaattttattgtctatcacaatcctttctattgcaaagagatatctcacacatttccttnnnnnnnnnnnnnnnnnnnnnnnnnnnnnnnnnnnnnnnnnnnnnnnnnnnnnnnnnnnnn

SEQ ID NO: 20240 - DNA, 10883 bp, Oryza sativa
gattaaaacaagagggagacaaatattttatcctgaagtttggatcatagggatcctactctccgttgaggatcaaaatataaaaagaaatttaaataaatctccgagtcctcttgccgctttgtatttgttgttgggggatttcccagcacacctaagcaccctgggactaattatctgtatttatctcaataaacatattagtcccttacttgttttgtcattaatcaccaaaactcacttatgaggttagatgcactttcactccctcccctcttgttttctctcttgctgttagcagcaacacgccgtcccaagaccctaggtctccgccggttgctggctcccaccccgcgctaccggcatccacctcctaccatccctcttcttcctgtccgggcatctgagtaggtgtggtggggtggataacaaggtctgttgccatggagttagccgctcctatgaggtctggccggcgccaccatgcccctagccatgtggtcctcttgctcgattcatcgaccgaatcaccgaagaagcaagcgggtgaatgagatcaaccatgccatatgtccatcctttctttcaagatgattatttctcacatgttttgtcaaccctcattttccttttttagatctggaatgtttcttggatttttgtaatactggtttaatccagcattctggccactcggtttcacatggtttgtaataattgatcattagcatgcttgatgtattaatcataccaaacgttggaggatttcttgattttctttccaatcttaatttattcaacattaaggctaggggctgacatattgcatctgctctttttttaattctggctctagctcgcaagctaaacgagctagctcgagctggtacacgagccaagccaaagcctgccttttagctcgtttggataataagctgagctgaaccagcttgttatcctaacgagctaggtcgagcagagctgacctaagctagctcgatatccacccctagaagagagcgacctattttagctttatttttttattaaattgagttgagacaatttgagatttttgtcgggagcatccaaactacgcgaatctacatgatactcatgcaacaccgattatcttttatattttcttggaaactgtctttcagaaatgctaggggactagatcccaccccgtattccatgtggtatgctccccctgttagcttggcctcctctccttgcggcgtcacttttgccaccattccctttctctcactccgaccatcgctgccaccccctgaccttgccatccagtgaagagcccccatggcagctctagtcgagactagttcttgtcagcaccaaactacactagcgatcaaaatgtatccatgtcaaccacctccttaggtcggacctctgcggcatctatctcgtacgacaccctcgttgcagcggctgatccgcctgatggcgtatacaagccactacttccacctagaggctaaacctcttcggcaaataatgaagattggacactatgaggtttgaccatccgagtccccgctgctcgactccactaacccgatgggctagattctctgcaatgcgaccacgatgtctcgtataccgatgctacgcgggccttcggcgtaggcaaggaggcttggtaccgatggttttcggcctaatatcgatgagtatcaaactggtactgataggggtaccgcatctggtatcggtaaatatcaacctacttactgtcatcctgtccgaacggaattctgtataataacagcctcaaaattgaattcctatatccacacaagctatctcatatattttttctatatttttcaatccaccattttatgcatacattttctatcatgttaatatgtctttttgtctgttttcaataacaaatgatccgagcaataagcatacccaatagtataggatgtgtttagatccaggggtgaaaatttttgcgatgtcacatcggatatacggacacacatttgaaatattaaatgtagtctaataacaaaacaaattacagaatccgctcgtaaactgcgagacgaatttattaaacctaattaatccgttattagcaaatgtttactatagcaccacattattaaatcatggagcaattagggcttaaaagattcgtctcgcaatttacacccaatccgtgtaattagttttttttgtctatatttaatactccatacatatatccaaacattcgatatggcaggatatggcaagatgaaagaacttaccagggagtctaaagaggcccatagtacacttgttattcttcccactacgatacgattgcagcagtaccagcttgatgattcctctcacgacggtcgctactagtagtactacagtatgttgttgggcattcacttaacacatttttttagataattcactttacacatgattaaactgttctctagtcctggttgcctcctaatcaccatccacgggctgacggacgtcgacctcgcctacattttctatcgaattattcccattggaggagaagagggtggccccaaccgcaatccaacggaacttttgctcctcatcagtcctcacctcaccatactcctgtttgctgtgcgactgcttcgcaaagccgcccacttgaccgcccgcgcacgacgaattgagaatgccccacacttgtacgcacacacccacaacccatcccctcgcgacgcacgcaccgccgctgcctgcctcgtgagccgtcgccccgctgaggctgacgctgacgcgtgagcccgtgccgtgccgtgtcgtgtcgcggtggccggtggggaaaggagtgtcagcgagaggagttggtgggtggggaaaggcgggtggtggcgtggcgtcgcgtgcgtgcgtgcgtgcgtgcgtgcgagcgacgacgagaggagaggagctcacaactttgactttgatcacgacggccccgcttgcgcactccaccgctgggcaccgcaccgcggaccgcgcccccaaaactcctatccgatctgcctacctcttttgccattccacccttgctctttacgctttattctttctttcctgaaagccccaaccgtcgtacgcagaattacatcctggcccagaacgtgaaaccttccaaaccagcttgtaattttagaaaatagtatatgatttgtgtatgtttatctgaaataaataaatatatatatatatataatgtgtatcaaatagaagtcgaataataggggttgctagtacgcgcatatgcgctggttgattaactagcgttgggttagccaactagcatagccgagatagtagtacactcgtgcatcattagcgctaatgatagtgtaaaatgattgtgctaattatagtttttataatcagaataaattgaaaagttttgaatatatgagttgaaagttttaaaaatttgagttgattttttttaaaaaaatagcttaaaagtttaaattgtaagttgaaagttttcaaattcgacttgaaagtattcaaaatttgagttgaaagttttcatttcgagcttaaagttttcaaaaatcgagttaaaagttttcaaattttgagttaaaagtcttcacaaactgagttgaaagtttcaaaatttgagtttaaaattttcaaatttcgagttgaaagttttattttttatagtaagttttaaatttaattggatactttcaaattttatgtctatatttttaagcttatagtgaaaaagaaaacaatcttaggcagaaaaaaaggaaagattaattaagattgtgattattgaaaattaattacgtaattgttaagttaatcacgattttttctctccgagtccaggacatgtgcgcgtgttgtcggctaaaaaaaaaaaggaaaagtcacaagaaaacataacgtatggctgtgcatgggcctaaaacgtgcgccgccaacgcgcacgcgtgaattagcttttccggaataatagacacgtagatgagaaattagacattgtgccattaccaaaattgggtttcaacgaaatgccactccgcaaaagggattcgataagatgctatcctcaacccgtggcttcacgctagattgctatatgggaccaaattgcccttggattcctccatccctatcttctatttcaactccgattacccctcgccgtcattgatggttggccattggacatcgctctcgtctcatcttctcaaattgttgtagtaggggctcgcaactgactgagaccagcaaaggggctggtagtgaggccttcgagtgcgagcgcggacaaggggagctcctgtgcagtggcgaagctcgagcacaagggccaacgccgacaagcaaaagactcagctactggttggcctacctctctccctcacagtactgctcgatgacaagaaggggaggggagatccatgcctctatggaggcggtggttcaaggcgaagcacggcggtggatctcaagctctcctcgaggaggttgctgaaggcgacgattggtcggcaacaaagctctcggtagccatggaggcagctaatggagcaacaccatgcagggaaggagccggagttggagtgaagaggagtcgcgacaactggggaaacagagctctcgcataggcggttgtactagcgagagagatcatcctcgatggtgcctccaccgccggagacctcgttgttgactgccaccctagggaagttcatcctgaggaacaacttcgctcctcgttgccgctggtgtcctcaccgccgctgctgccatgagtaccatgtcacacactgacccaacagttacatgcccaggcaagaaaggagagggtaatttggtcccatatagcattctagcgtgtagccacgggtttaggatggcattttatcgattcccttttgtggtgtggcattttatcaaattcattttgtggaatggcattttatcaaatcccttttgcggagtggcatttagaagaaacctagttttgacaatggcacaatgtctaatttcttcatgtagatagaactccgctgcgaataatatcatatcatgaaagtatatggagagatgtgtctttatgatatttccttttcgaaaaagtatgagggaaaaaagttatagccataactggatgtgcaaatgtgcaacataaaagcaaaatggtataactgaaaagccactttatttattcacattatgtagcgtcatcctttggaaaagaaaagaaaaaaaaagggggcaatggaaatacttgcaaaatttaccaattgcagggacctgcgcgcaaaaggtatcacaaacctcaaagccgtcaaacgcgtcgtgatgccaaagcgaagttagaaaaaaaaaaggttgggaaatgaagtccaccacccacctactcgccggcggcggtggcggcggctccgtcgcgccaccaacggctgccacggcgccgacgctggccatggaagtaggggatccctctggcgccctcgtcggcggggccggcggcgccggagccggaggaggagacggggatgcccgcgacgcgctcctccggttggttgctctcggcgaccgcatggccgccgtccgccgccgcatcgccgcatctatatccggagaatccgggcccctctcttcctccgacatccactccgtctcctccgagatctcctccgctgcccacctcgtcgtcctcaacgccgcctccctcctctcttccaccgtcgcctccctcccggctccacctccgcctccggctactaccgtccaggagctcccccccgtggtggtctccgtgcctcaggaacccccgcaagaagcagccaagggcgacggcgactacgacgtcgtcgagctcgacgcctccgagcttctcgcggagcacgtccacttctgcgacatctgcggcaaggggttccgccgcgacgccaacctccggatgcacatgcgcgcccacggcgaccgcttcaagaccctggacgcgctctccaggcccggccagccgaagccgcctgccggccgggaggtgcggttctcgtgcccctacgccggctgcaaccggaaccgcgcgcaccgccgcttccggccgctcaagtcggccgtgtgcgcgcgcaaccacttccggcggagccactgccccaagctctacgcctgcgagcgctgcggcggcaagaagcgcttcgccgtcctcgccgacctccggagccacctccgccactgcggcgaggaggcgcagtggcgctgctcctgcggcaccaccttctcccgcaaggacaagctgttcggccatctcgctctcttcgaaggccacacgccggcgatcgccgagccgaacaagggtgtggcgacagcggctgcagaggcatcgatttctatgatggaggaaggaggagttgaagcgaattgtgatcgagaggaggatgaggagggtggttttgatccgaagttcttccaggagtggatggaggagctcagaggtggcgctgttgcccccaattggtctgcgccgtcagaagctggacattagcagtgcagcaagagcaatttgggtaagagcttctttatcttcctgccattttgttgcatatatttaaggaaatttggttgagatactgatgataggactaattagctgatagaaaccctttcaaaggcagaaagaaggaaaatgaaaagacgaattgctacattgttctgctaatcactgaaatcatgatgtactggatgtgtcgacttgatagacaaatcatcttcttctatgcaacttaatttgagtatgttagatgttcatggaaagattgttagtcaccttaatttatagtagcgaggcctgaatgaacctagctagatgcaaggttgtaggtagagaactaaacttagtgggtgggggaaattttgtatttgtttagctggttcattcctctggttgttttaaatcctgtgtgaatagaggttcaaatacttaatcttttgccttttccttcttgaatatgggactttcaaagtattcatgctcttgtataggttaggccggaaaagggagtataactaactttatgagtgcaactttcgtaatatgctgtatggaaggtctttcaacctttgctgccatttttgtgggtttgtcctcgacaatggcatgcccatctgttttgtgttctattaattaggtgataaatactccctctgtcccatattaagttcatttttggttcagggcacatattttctctaatgtgctagtatatatactaccaatagttagggtttgtgtacgtatgaaacttcctactagcagaaaagatgatgtcgtgcatggcagtatggcacttgtcttgaatttattgggcgttcacctgttggcgagtactgataaagattcgcgtatttgttgtgtaatccttctgctgaccagtaaggcagtaatgtgatctttctccaattagtctctgttgtcgcttagcggcttagtgtctttgtttttgaacaaaaacaaccttacctattccaagtatcaaatctgggttttgtctcttttccgcaaccgcactacgaggagcacatcacagcccacttgtcctctgttttaaggtgcttcccgcctttctttatatactgcgaagctaacggttttgtggaaatattatgttttcttttcctctacatatgctttcatctcaatgattattaatggcacttattttttcttgcatatgcttttatttcccattgtgcaaagattgtgaagtatcatgcattttatttaattttactcttcaccaatgcatttgggtatttcacttggaaggaaagttttgtttgtaaatttcttatcatcttggaaatgttaagaatttcatctgtctaagagagattggtgtccttattcatcatacattggagaggaatatgggttatattgctcttgttcgtgtgttgttaattgtaggtatactgaatgagataaattccacatgatcggatgaatcatgtctgatggttttctggtacctcacaggaggtaacaggtgatccttacttttcaacaggttatgcattccaaggaccaaattagaaaaggcttaccatacagtacataaatccatactatttgcaaaactcaaatctgggaaggatattttcatgaggaataaagagatccgttgattaacttacatgtttatatagccttatccgaaagttatgtatcattttgactagattgaatccatattatttggcggctgtgactgaaaattcctttattacaaactacaatgtttgcaaattgtgatctcattatttctatcttgcaggcctatggtaggaagagatgactgagaagatgaatgaagaagggtcctgtgaagaacagaccttcccccggcttgcctctgtctctctctctctctctcttcccctggtctccccatcttttaccgctcgctgttagcctgttatgcaactctcttttacccatgacaaggatctttataacctggaaagtagtggtatctgtttccgaagcagtcgaaataccaaatgatgaaagatattaaccgttggtacatcgtgttgtatgctcattgtgtatgtcttcatgattcagctttctacggtagtgtagatacaggtttctacacgttacagtagtattaaacacaacatcagcacccaacactgtaacgaacaccatacatgtgagatcttacaattgatcgaggtgaagtcacactgaaggcttctggcatgacagtttctactggggtaggcaatatgtgagatgttttgacagttgatcacagcagtagtaaactgaatgtttttaacttctttagctaatttatcagcaactctgctgatttcccttgggttattcatgttttatcatctaataacaataaaaatacaaatcataaaaaaaatttaaataagatgaacgtttaaagttgaacaacttacgggctatggttgcgcttataacaggctggagggagtactacctttctcacgaataccatacattctgaccttggtacccagttttagacgttgggctacagcgttgtttattatttttttgataaattttttttgttgatatacaattaatataagaccacttctggccttttgataactagaatatacacaatatataattattgaaaaaaatgaaggacatgataacaggtatcatgtcagggtgagcaacaatacatcgaccatcgacatattcattcttcaccatagtaacacatggactgtaagaaagaacatccaacaacaccttataaaaatatgcatcggccatcattgccatgatcaatcagcgaaccattcactccaaagaactttttttttttgccttttataaaaggcaaatacagctattgctagcgtatccaggaataaaaaagtggggtgggggtcaaacatactggaaacaccggcataagcacatcatgtctcatacaatattataatatcataatattacattgtagtctaaagaagtttcatatggaatcagagaaatacatcctaacttcacaagacaattgattatttttcacttgtggcacagattatctttcatgcaagtatgagacaaaacaaattagtgataactaccaaataagaactttaattcttcaaaataattctgagcattacaataggatagagaatataccagtaaattgttttgagggcactaacatatactatgttttttttatctcttcaaattgttttatgattgttttttcattatcaatgctcatgaatatctccttctcaatgtcgcatatcatcaaatcattgagccattcatcccccaatttgatatgcaaatccatctttataagcgacgtggctgaaaagactctctcaactgaagccgttatgccaccggcagtatcgatgttagctcagtgagtcgataaaccaatcgctacgatctgtgcattccggatttaaccattatttcaacaacctttggaaaatctgtacatccaagaaattctgaacttctcctaacatggctgatgaagtctttaagttgacctagtaacacaaaagatcaccgacattataatcttcagcataaattccaacatgtcctacaagcttatctagttccttggattaagagaagtcattagctcgccggcgccactcacctcttgcgtagctgaacgggttcaggagctcactacctcgatgcattggctgccagggatttggggatgggtattggggaattaggtagttgggctggggggctatttgtaggcaggggcggagctaggtaggagatgtgggggtgcctaggaatctggttaagaaaattttttagttatagttcatctattttcaccatatatgcaccccctcaatccaaatttaggcacttatatcagtctaatgtagagtaaagcaagtgagtggcacccctctccatttctttctagctccgcccctggttgtaggcctgtggcctattttctaagtgagtaggttgaaagtccaatagcgtatgcctagtccaattgcattcactggtctaatttcacgattttttcaacctccaaccattcatagatttttagcatacactccctactctatcatccatggtgaaatatttagggggtgcagggtgctctataggtctggagagggtaggcacccacattgaatcggctcctacacctatctaaacctaaatatttcgtctaggagtcaaggaactagtacttgataaacaccactgaatcaaaatctcctagtggaattgctcgctctttccttgtggtcgctgttatacctcacaatctggtccgactataaaatgg

SEQ ID NO: 20241 - DNA, 2533 bp, Oryza sativa
aaaccaagtgagtggccccccttttcattttttttttacctccgcccttggttgtaggcctgtgggcctattttctaagtaagtaggtggaaagtccaataccgtatgcctagtccaattgctttcactggtctaatttcacaattttttcaacctccaaccattcatagatttttagcatacacctcctactctatcatccatggtgaaatatttaagggggtgcagggtgctctataggtctggagaaggtaggcacccacattgaatcggctcctacacctatctaaacctaaatatttcgtctaggaccaaagaactagtacttgataaacaccactgaatcaaaatctcctagtggaattgctcgctctttccttgtggtcgctgttatacctcacaatctggtccgactataaaatgtgtcaccctgcaatgatagtgccacgagaaagccaataggcacatacccaaaatcgtaagaaccatttaaaaagagtatggattgccgatgtaggcaatctcataatacgaaatcaagatgacaccccgtctactattcaatatggaaggcccctaatcagaaatgatgaagacgtcttcacggccacagagtgtcagcggtcagaccgctggggagaggacacatatgcttcgatgtcactgtcagaattaagccgattaacacagatatattggacacacatacggtccgagccaccttgtaagcttctggccctttagcgcagcttccgcgaaaaaagcacccgcgaatccaacgcaccaacagcccagttctatgattgcaagcgatccgccacaaaccggttcgtccaccgccgaccgcgctcctcgtccatcacatgcacgatgcacacccagccgctagtcacactagtcgtatcactagtcgtatttgcttgagccgatgtgtgcacacatcgatcactagttgtatttgcttgagccgatgtgcgcacacatcgatcgctttctcggcaggtttctaggcggtacgtggcgtggcgtgcgcacgtgccgcctccacctatatcgcacggcacgtcgatatgggcatgtcgagctccatcggtcgatcgatcgcctgtccacctacgatgtacggatacacgatactggtacggcgatacggatacgttgatacggcaatacgggattttttttaaaaacatcaatatgtcgatacggcgagtatatataaaaatatttttaaaaataaaatatagggaactacaaaagggtaaagcaataagattatcttaaaaaatattctatgtattgttgcctgttacagaaaatatagtaaatatagcattgtattacaaatagatcaagtatattaaagttataaatatatcataagtatagcattgggtctttaatgggctattgaacaaggaggttacactgctaggtattggagaagtatctgataagtatcgtgtgagtattagtatttattttttcttttttttcattgtttaatgactgatactcctccgataccgtatcgacagaggtaccggacgtatcgccgtatcgggtacgtatcggataccgatacggcaagaaagtgaagtataggtgcaacatagccgtccgccgtccgcccgcccgcgcgcggcgtccgcgctgaaactcatgacgctgtctctcgcgatcgacgactacggtgatgcgcgtgccccgccgtcgtcggccgcgagggcgaggctctacaggaaaaataatatgctcacgtcgtcgtggcagctagctagagctcggaggcttattaacgaggttgatcacgagcctgggaacaggcgccggataaacatccgcacacgacggccggtgtacgtaaacgtagacgtcgtcccagacacgcccagttttccctgcccaaaactcgccatggttttacctcgcttgatcggtttttgctgcaaatgaaagaccgaaacccgattagtacgtatgagtagtaagtagtacacgccagatcaatttggctgtctcacactctgattaagtatgcctctcgggtcacatggataataataagcccaccactaaaaactgtcagatatggacctgttggatgtatattagtacttgactacttgtgcaagttaattacatcgtgcttattactttctttaatcagtttgggtgtgtttattacgagtactttctttaatcagctttggtctatcatgtttgcggcttgcttggtacaggaatgatgcaaccatgaaaccggccatctcgttttaaaagtccaaatggctgacgtggatgcaactgcctcgcttcgtttcgcttttcgctgacgacttcggcgacctgttcattattcagagcccatgtttgcagttatctgagaaacaaccacgactcaaaagttattcagtgggcattagatcaagttccttaaacagttaatctgtactaaaatccaacaacaatccatccaagcaagcaaaatcgcaaggggaaaaaagaggcccaccggccatttctaaacgcg

SEQ ID NO: 20242 - DNA, 3561 bp, Oryza sativa
  unsure (1)..(3561): unsure at all n locations
tttaaaagtccaaatggctgacgtggatgcaactgcctcgcttcgtttcgcttttcgctgacgacttcggcgacctgttcattattcagagcccatgtttgcagttatctgagaaacaaccacgactcaaaagttattcagtgggcattagatcaagttccttaaacagttaatctgtactaaaatccaacaacaatccatccaagcaagcaaaatcgcaaggggaaaaaagaggtccaccggccatttctaaacgcgtatagtatcacgtctatccaaaagcatacagtgtaattataaccaaacttttagcccgtcatttggtctctctaggactctaggtaattggattggagccagggatttatatatagtcacacttcatatgacatccccatttcgatactgaaacaatgcacaccgtgacaaaaatatactcctctatttggtagtattgtttttcggctcgtgagttgtcatggccgtgccaatggtagcccgacacatcaacgtccgtgacaaataaaatatacgatgactgcttcgccactggaccgcccaaaaactgctacttgatcagggtgatgcacgaacgttggcggctttcacttgtatttggcatcatctagggctagctagcttggacatgatatgtatcaaatccaaattacctacctatacaaacggattaagctaacgactcgatggaagcaactgaaaaactcccaaaattcccattggatcgcgagcagatagatatactagtcgtaaactcgcatgggatcactcgcgacggtccagatcgaacacgctgtctctttcactcgctcacctgctccatgctcgtccagtactactgccacgattattctacactatcctggtgttatttgctaatcccgatgcgtcactgcactgaaagtctgaaaccttctaatccctctgctataaaatcgctctgctttactgctgttttctggcattgcctgtgcgccgcgctgcgctgcgtacgtgacagcagaagcgacgcgcgcgcgcgcgagcgacaccagatgttgccgtccaggccgaggtgagcgcgcgaaaccgtctctctgccgccatttttttttaactcggcgatcgagcgagcgagcattccgaactgactgactgactgggtgagatgatcgccgtgcagatccgggtcctggggaggcgggacgcggagttctccggtgtccacgccgaggtctcgccacgagcgcagcaaatccgtcgccaccatcttctcgccgtcgtctcccgaggtgcgtctcctgatcgtgcgtgaaacttgtgtttgatcggcagcggtggtgagcggtgacaggtgacgcactggctggtgcagagttacggcggcgtcgtgatggagatggaggagaagaagacnnnnnnnnnnnnnnnnnnnnnnnntgggttgcggcagagcgacggtggcgtggacaaggaagtggtgggcggcggcgcggcgtgctccgacgaccgggtgcggctgctggagcgggaggtggcgacggcgaaggcgacggagatgaatatgctggagtcgctgatacagcagacgaaggagatggagcaggcgaagatcgctctcgaggaggctaagctcgaggtcgccacgctgcggcagcagcagggacgcgcccctgccgccgagccagccgccgccgcccagtggagcgtcatggacctcatgttcggcggcgtcgacgaggagatcaacgggctgagggccaagctccgggcggccgtgcaggcggaggagaagagcaggaaggcggccgacgacctcaccgccgcgctctccgccgtcaccatggaggccaagcaggtgaaggcgtggctgtccgacgcgcaggccgagctggaggacgccaacgccgaggtcgaccggctcagggagtcgctgcacgccgccgaggcggagctgtggtcgacgaccgagcagctcgacggcctcacgtcggactggaaggaggccgccgtttcgtggcgcgccagggagaaggtgcttctcgcgcgcgtccgggcggccgaggacgaggcccacgcggccgggcaagagaacgtcgagctcgccgagctgcaccgggtggtcgacgacgagaacggcagcctgcgtcgcgctctggagcgcgccgtcgaggaggtcaacgcggcgaacgagtcgctcgagctcgccaccggcgagaactccaagctgcaggacgccgtcgcggagaaggagagcgccatggaggcactacgtcaggagaacgagagcctcaaggccagcgaggccgaggcgcgcgggcgcgccaaggagctcgacggccagctcgcggcagcacggaaggccgccgatcacggtcatggcgccggcgagctcgcggcggcggccgaccccttgtcgtcgctgcacaagtggaggggcgacatgcatggcaagctcagcgccacattcctggactccaacagggtgatggcgggcaggaaggaccggatgttcgcgtcgctcagcaacatcgccgagctcaagtcggcggcggccgcggcggccatggacgacttcgactacgagttcgaccacttcgacggcgggcagtacggcgacctggaccacgccatgaagcagaagaagaggaggtcgatcctaaggaagttcggggatttcttccggaggagaagcttgtacaagcgcaacctagcgccggtgattcactactagtagatttttactacttaggttgatctagattagatgctttaatgttttcgcgtgatgctttgtatggtacgtgtttgattgaaatgattagcaaaaaaaaaaacgcccaataaatgaagagaaacatcatcgtgtcacatgcgtggtcttcacatctccctcctgcctgctcgaaaatttgatcattgtgtatggaaaccacgcaggtttatctgaaatccgaaggaaaggataggagaatagacactgtgagaataacgtgataagttcatgtatgatattgtttgatactatatgctgtccacagaacctgctttgcactgtatagatatacatgcataattaattaacacgttaatgatcatgccaataagtcagatttcggtggtgtcagtgcatttgtaagttattactcgaaaaatttccctttggacaaggatttgtgttgggcttgtggtttccggacggacatggggacaccggcactacgactttttaaggcccagctgctgcagtacgattattctgaggaataagttcacattgggtccctctatttgtcgcccagtccaattttcatcccttgaccgcaaaaccggatatgacccgtcccccaacttacgaaaaccgggtaaacgtggtccctcgtcggttttgaaggcggttttggctgacgtggcgcctacgtggcttgtttgacttggtcttcatcccacgtggcattgacgtggcgcttgcgtggcaattatatctcggaaaaataataaaaaacgtggccccacatgtcacctgcacaaacaaaaatagttttaaaatggtggggcccacgt

SEQ ID NO: 20243 - DNA, 13896 bp, Oryza sativa
  unsure (1)..(13896): unsure at all n locations
ctgacatgtgggaccacaggggcatctccttttcttattatttttgtgtagctgacatgtaggtttcatgttttttattatttttctgagatcctattgccacgtaagcgccacgtcaatgtcacgtgggacgaggaccaagttaaagggagccacgtaggtgtcacgtcatacaaaaccggacacaatactaccaagggatctcttttgcacggttttataagttgagggacccgtcatacccggttttgcaactgagggacgaaaatcggactggacgacaaatagagggacctaatgtgaacttattccttattctgaggccaccaggcagcccatcatcttgggctccgcaggccaaattgacttctgtcgttgtccgatgcgccgccgcgcccggcctccctcaactcctcccggctgcctggcgacctcaccttccaaaacacgttcccttcttccttctcttgggcaaaacaccgctgaactcgatgccggcatattcgacaccggcaagctcaacaattgcctcctgctcggcgagcttgtctcgacgatcaggttaattatgaattgtcccttcatttcctacggatggcgatgccaccgctacctcactgtaccaccacctgccccctaccgcccactatcgttggatgaacggttggaatcagtagcatccattcaaaaacgactctcgttattaataactaacaatacttatcagtttaattattcaatatcgatatcaatacaacgctgagacaaaatataaaaatcaagttttatatatggttggaatcgataactaaatgaaatagtatcatttatatggaacgatgctcagtcgaccgtgactattttcattccctttcctaggccaacccaaccagtgcatcatttaaattagagtaaatttcactttagatcaccttttattaccgatgtttcgctttagactatttcttaaccgatgtattttggattgggtaatcttacctacgtggcactttggactaccactaacttttttatccatttacacccaacttgacatatatcaatgttatacacacaaccatagaaattcattgattagtaggagccgacatactcgaaattgttcatatgcttaagtagagagttggggtggttcaaagtacaacaaaggtaagattacctggtctaaagtgaaaacatcggttaaaggtggtacaaagcaaaacttgacaagggtgaccaaagtgaaatttaatctttaatttatagacttgacaagggttcttatatttacggctaattatttttttattggtggcgacgtactcatcgatagcatggtgacttcatcaatatgaaaatatgccaactcaattttcaaaggtactcatcaggatatgatgtacgcgtgtgttatgagagtctatgtttaagtcaatttgtaccgtgcttcagaaaagaaatgagaaaaaaaaagagctagtgagcacgagggccttctaaaattcgagatctagacctatctacttaaaacggtggataataacctagctcggctcgtttgggctcatctattatctatatatctattatatactaaaagtccataaatcttcctacaaacgctcctaaaaacgctcctaggtttataatctcaccgtcgattttcatttaaattgatgggtctgttattttagtccattagattaaatctattgctttctcttaatattcggtagatacgagtgaaaccgttcacacacaaaaaaacttacgtacttactatggaaagaaacgaaaccttcagcatacgtacgcacgtacgatggcatcgtgtgatcgcacgtacagtactgttcatttgaaaaaagtacctacttacgataaatagctatttaaaaaaagatactgttcgcttgaaaaaaaattacttccatatgcacgagtaaaaataaaagctataaaaactaaaaaaacatatgtacgtcggtacaagaaaatagacgattttttaaaatagtattttctatactatagaaataaaatttattactccacaaataataagatcatgtgacgtttctacaagcactcttacaccaccacatgcatggctctctataattttgctatcaattttcatttaaaatgatagaacattagattagcccatttcctcttaatttccagggtatacaagagaaacgatttagggaatgtttgattgaaaaaaaatacaaagaaacatacatatatacgataataaagcccaaaaaactacaaaacaaaataagactttagatactgtccctaaaaaagtacgtacggatacatgagtaaaaataaaagctataaaccctaaaaatgtatatacgtcagtaggaaaaaaaatgacggtcttttaaaaatacgattttctatactataaaaacaaaatttattactccacaaatatgatcatgtggagtttctgcaagcactcttagaatgccatgtggcactctataatttcgctatcaattttcatccaaaatgatggatccattattttagatcattaaattaactcacttcctattaatctcctacgtatataggagaaaccatttactgaatgtttgattgaaaaaaaaatacaaagaaacatacgtacatacgagaaaaaaatatttatcagagtacgtactacgataaaaaaagctataaaacaaaataaacctttagatatattgttcccttaaaaaagtacgtaatagacagtctttttaaaatatgatttgctatactataaaaataaaatttatcactccacaaatatggtcacgtggcgtttcaccaagcactcttagaatgccatgtagcactctataatttcattgtctattttcattcaaaatgatggacccattattttgaatcgttagattagcccgcttccttttaatctcctgtgtatacgagagaaaccatttaccggatgttcgattggaaaaaaaacaaagaaacatacgaacacacgacaataaagctataaagcccaaataatactaatataagttggcagaaccatcgaaaaaatatagacggttttcaaaataggattttctatacgataaaataaaatttatcactccaaaaaataaatatgcaagttaaactagatcaatataaaaaacaaattaaatgtgtttaaacgctaagcttttagattttttttaaattttatagtcaacttataatcaggtgtaatatcatagttatattatagtgctaaatacattacaacacttggagctaacatataataataagtaatatcataacacttttttaaataatttaggcggcatataataattaatgtcatgataatcttagaaataatttcacatcatattttatggtcaaatataacactaactgaaatctacatgcatggaaaatgaaacaacattatgtttttaaattatatctgatttaattttagtttgtctgagattgagattctcaaagttttttttcataactactggattggtatgctcaggcaatgatcttgctataatacgaccccttaatccaatataacggtcataaaccacagtgacgtaactataagtgcacctcaataaattagttattataaataatttcataaaataaatacaattttagaattagtaaaggtgtctcatgttataggtgacgaaaacaaacaagatgctaaaaatatagatctttgtcaaaatatacaatgatataatactctgaagattgtcacagtttgtttagctatatatatttttagtgattaacttcactcatttctaaatattacattatatttgtaccataaaaaattaagcagttttgattaacaccataaacaaaattttgtctaaacaaaacataaagaaactatattttatattttataggaagaactaaagaactatttgcatcatatccatcttctctttgttcccctagagggcaccgagcatggataccacaagtatagcatggagcacatatatggttgagttgaggcaggcccaatggaggccaccattgataatagtgctcaacttcctacttactaatggaattatctctgagggtgccgatagtgaactaggattaattaaaattgtgctccacactggtcgtgagactgtgagaggcatgactatgttgacccatgcttgaaggaatcttgatggttccacccattagaggggcatgtctatttttttaacggtgctatgctaataaccaatagaagcgttagttttagaatatttattcgtagatttagaaataagtgttgacataaacatttaggtacatagttgaaagaatgttttatgcattaatgatgtattagacttattttggtggtttagatggagttccatttattaaaatcatatctatcttttaataacaatgataatggtgataataggagagtttacacttacctggacaaaagtgaattttgtttgaatctaagagacatccttattatttatattaaagtttgcggtctatttcacaacatattgttttgttactatgaggcaagatctatgatttgttatatgtatatggtaagatatgacttaattctcttagtagtatttatataaacaataaataagatgcccgcgcatctgcgtgggcttcctttctagttatcttaatgagccaactcggattggcttattaaccttaacgagctaaaacactagctccactcgcaagttagttcattaagctcattaggctcgttaacgaggtctatctcattaatatcaacttatataaatttgaatttttaattttatcatatattaacaaaataataaccactaattaataaagaacttaataaatacattttagtttgcatgtagttaaaagactaaacactagttcttatgtgttaaaatcctagctcgatttaacttgttatgattttgagttaagagatccgaactgaattcaatgcaagctgattcgagtgacaaagcttctaagtaccaccttgacctctgtcctataataattttatttctatgatttaaatttgttctaaaatagttgtcacaatagaatatactaatgatcacattaatcacttctagttcaaatttctccctattatgatcaactactctcctactttaacttatatttcgtacatcatttaataaggagtatcatagtacttcttttcaaatattaacatatgctaaacaatctaattaaaattataactattttgagacagaagtagtaactttttttcccccacccctaccacccacacctttgagaccaaaagacagtgagagtgcttctgccagtcatccggggtactggatcgggctatacaggatttgttcaatctcaccgtcacgcgcgttgtcgagagaatttgtacttgtttatagtttcttcttcacacttatacattgagcgcatcacagcggatttgatttgcatgtactgataacgattccttcttttgatctggaatatcttttaaaaaagaacagagtatattatccaaattatataatcccatgagtgtcatgcgtgtgtggcagtaggggcacacataggccccgcacggtgctgcccaatccaatcatttgaccattcgtacagacccataccatggacatactttcctcgtaattaaaaaaaatcaattatctacgtatatagttaggattaatttttttagacgaagatagtaaatacacacgtgaggtggcggtaggtctccagcaagcaaacaacggtgagggtggactccactactccaacgtcccatccacggcgagagcgggccaacaatcagcttggtggctaacagctccaagaagaaagtggcacggctaggtgtgtgggtataagtataactatcttttcgcccttaaattaacaccatcaaactaaccgtcgaaaccagggtaaaactctgcttcgttttcaaaaaataagagaaaaatgaaaccccataaagtggaaacaaaacataagttaaggttgaaagtagtcagcatggtgtaatcgccccaaaaattaaaggacagtactgtagaacatggtttaatttttcggtttggtcgattctacacgaggtctccgatattccgaaattttgaacaaatgtcggtcaaatttgaacaaaatattactaaattcataaaaaaaattgaaaatttaaaaatttcagccaaaataatatcataccgggagggtcagaaatgactgaaatttcattccggaattttgagccctgcagcagaatccgtttccgtggacagttggtgtgcgttttccccacggagcatctgcgaaccgcgaccaacatccagcttcagcctgtcacgctgcggatgggaatggttaggttctggattgaacctaaaccatttcacgtgaccactctgatccatggttcaatagggacaacccttaatgatcccattaaataaataggttatccaatggagcaaaaggttaacctattgaacctagcagacaacatttaattcacatgttcatggggccacacatatacaacacaatatatcacagacgcaaaggcatcccagggctacatttaagatatatgcaaagcagtacatccaatggctaatttttcggcgtacggccgtgtgactcacctatttttcggccgtggccgtaccggaaattattttctccacggcggcgaacgatcctgacgtcgcgcgtgctgtcacccacacgtaaagaaacggaaccctttgagcgtcgtcgtcgtcaccggattcaggatcacacgtcgggagggagaagggtagagataggagaacgagctggaaaaggaaacggagttaaaagtgagctccgcttctcgcttgaccctcaaaaaagggtaaaaaagaagaaagcgcggatgggccccgccggctttgcaccacttcaacccggtcaaatcttatccagatccagttggagtgtaattcgtattttttttctttaattaataattacatattatgaacaaattttatatgaatgaataaaatatactataaattaaaataacttagagcaacttatataattaatgctagcatcgaaagtttttagaaaagaaatttaaaaacatggcgtgaataatacatagtaaatccataatgaaaagacgtagcatgcgaattggcgtcagctggttaggatatttgtggtggaaccttcccacctggatttaatttgtagacttgaaacgggtgtttatgtttgcggctaactattcttacaatgctagcaacgtactcatcgacaacataatgacttcatcaatctcaagatatgccacctcaatttcaaaggtgcttataaaaatgctgtgtgcaagagtgtttatgagtgtccatgtttatagtcaatttgtgatgtgcttcgaaaaagaaaactagaaaaaagagggagctagttggcaaagggccatctaaaattctaggtctagccctacctccttaaagtggtggataatgagcaagttaggctcatttgagcttattacattaacgagatagctcggatcggcttgtgaaccttaacgagctaaaacactagttctgcttgtaagctaattaggctcgttaacaagatttatttcatttataaacctttagaaatttgaatttacaatgttatcatatattaacataataatacactaactaataaagaactaaataaatacaatgagtttgtatgtagttaaaagactaaacaatactccctccgtccttaaaaaaatgaatctaaaactggatgtgatatattttagtacaacaaatctagacagatgtatatctagattcatcgtactctaactttttttcctctcacccctaccacccacaccttccagaccatagaagatagggagagtgcttatgccagtcatccgtactagatcgagctgtacggattcgttgcgctaggatgtgttatatttggtactagattggtttttgtcgaatggaggaagtaatttttttcctcacacttctacattgagcgcatcacagcggattgatttgctggtactaatcgttcctagccttgttcaacgattctttcttttgatctggaatatcttttcagaaaagaacagtatattatccgaattactccgtatctattcccatgagtgtcatgcgtgcatggcagtaggggcacacacttaggccccgcatggtgccatcatttgcccattcgcatggaccagacaaatataagtctactaattccctgacaaaattttgagtattaaatatagataaaaaaaataactaattacacagattacgtgtaaattgtgagatgaatcttttaagccgaattgtgacatgatctgacaatatggtgctacagtaaatatttgctaatattgaattaattaggctaaataaattcatctcgcagtttacaggcagattctgtaaattgttttattactagtctacgtttaatacttcaaatatgtgtccatatatcatatgtgacatgccaaaactttacacccctgaatctaaacacagcctatgtaagggcaagtgctatggtagatgtgactatcacctccaaatttatctattttattcactcatgaactaagaggcaacccatataatgtatcacctctagtacacaaataccaatatatctaatactctcacacctttcttgaaatttttgtggaggttgcctcttgatttaggggtggctcatcatctctctcctcacttcttttcaggggcggaggcagcattttagcaagagtagggctgaaccatatagctataaattttttgtgcaaattctacgtaaatttcagtgtttctccattaaaaatttttgccacgtgtggggcccaagcccaagctgccccacacatggctccgcccctgcttctcttctccacctcatcactcaatccaatgtgacacttttaaaggcaatatatggggtattatagtatttgccctaattctacctgctgaactggatcagtgacgtatgaattctcttgctataggattgagccaccatctaagggcccctttgaatcgcagggtagaaaaaacggaggaataggaaaaacacaggattctgacaggaattgaagtgtaaaacagaggattgcaaaatacaggaaaaacacaggaatgatcgtttgattggagcgcaggaaatacgtaggaattagatgagagagatagactcaaaggaaattttccaagaggttggagctcttgctaaatttcttccaaaatccacatgcagtatgccattccataggaattttataggatttggaaagcttcaatcctttgaatcaaatagccaaataggaaaattttctataggatttaaatcctatgaaatttctacataaatcctttgattcaaataggccttaaaattagagtaaaatagagagtagtaatattaatcgcagatgatctagtatttcccacggagcatctgcgaacagcgatcaacatccagcttcagcttgtgataggcccatgcagaagctgaagccgcatgctgcgcgagaaacccctcgtacgagtggacgacgtgcggccgtgtggctcactcatttttttttcgcccgcgtggccgtgccggaaatcattaatttattccacgtcggcggtctcggctgcgaacgatcctgacgtcgcgcgtgctgtcacccacacgtaaaaaaaaaaaacggaaccccctccctctggcaggaggcgtcgtcggcatcgtcgtcaccggattcggaatcacacgtcgggactcgggagacgagaagggctgtgtttagttcttctaaagttgaacgttttggttaaaattggtacgacatgattgaaaagttatgtgtatatgacagattgatgtgatgaaaaaagttaaaagtttggatctaaatacagctaagggcagagagatagaagaacgagcttgaaaaggaaacgaaattaaaagcgagctccgcttctcgcttgaccctcaaaaaaaaaaaagaagaaagcgtaggtgggccccgccggctttgcaccaggtcggctcggtcaaatctcatccagatccagtggctctcgcgcggggcatcgtcatcgctcgcggcagccgggctcttctctttttttcctttggtctttgccttgccctgattgggggagtgggggatccggtctccgagacggcgacttatcgggtgggtgccttggcgtggcgacccgtgcccgggaacgaatccaacacacttggctagctgagctttggtttgttacgtgcgtttttttggggcggctaactaatgaataatgacacgtgatgatgcactatttcaacctagtaatcattaagtacgatccgtattaaattatgaggttagtggctagtatctttgattgatccaatttgtcgctaataaagagactctatactactttgttttatctatctatatttttataaaattataatcactacacacctaaaactcaacgtgtaagcatagtactccgtccgtcccagaataaagcaacttaggactcaatgtccagatacgtagtaataggatacgaaacatgccagcttgccgcatcaacccactaagcacctaaacttcaacatacaagtatagactatagtaattaaatttataatttattacattctaaaactcaaaatacacatgctaaatcattttcaaaatatttcaatccaaattcatccgttattatacaacatttaacatatatccatttatatatcccacaacaaaacgtggggtgccatctagtttataaggattgtatgcagacatgttaggactacaaatttgtacgcaacaaagtccataatgtgcacaaataagttaatgttaatattgtatttcaaaattattaggttaagaaaatatgaaaattaagactatcaaagtatgcccgtatttgccaattcaaattttggtaacggaagaaagccaatattaaaattcgaaggaaagtaaaactttgtatttatttgtttcggatttcctaacaaaaagctaaaatcaacaaaaacgattcgataatggtttaatattagttatgcaaatgtatgcaacattagcccttaattaatgccacgtaggtgtatcgatcgctatattgccataatcttttcatccacttggtatgaatagttattgaaaagtattttagttgatagattctcttttcgttctaaaatatatactccctctatttctaaatatttgacaccgttaaccttttagcacatatttaattgttcgtcttattaaaaacttttgtgaaatatgaaaaactatatgtatacatataagtatatttaacaatgaatcaaatgataggaaaaaattaataattacttaaattttttaaataagacgaacggtcaaacatatttaaaaagtcaacggcgtcaagtatttaaaaacggagggagtagcaatttagaattggatggaagatattctagtattaagcttatgtttagatttgcattaggatatatcttatctaagcttaggttactatatatattttagaacggaggtagactacacatatcatactcatcatgttcacaaagaaatcaatgataaaatactttgatctcactaatttccactaggaacttttccttgttgtaatgcgctatgcgcacaataactttggtagtacaccaattttttaatcatgttttatttgtacatgcatgcattagcgagctttaaaatattttttctcttaaactatatccgatctacgacctgatcacatagttgtattaattataattaaatctttaaaacaatatatcatatgattatattccgatgaaataaaaacaaatatttcaaaccgttaatactcaatattttatagacgaacataatgtttaaaaaaaataaatgtttcattgactgtttattttatttcactatatatagcataatgttttattgtgatcaactaaaatatttgaccgtcttatacttaaggtttgtttagcacatctccaactccacctttcatagagctcagccaaatagtttcagttccatttaaaatagaagcaaagctaagtagggctctctcatagagtgagtggaactgggtttagtcagctccacaactccactccagatccaattcctttatttaagggcctgtttggtatagctccaactcctaaatttaactcttggagttgggcctggagtggaattgtggagctgtctaaacctagctccacaactctagttcattttgtgagagagctccacccagcttaactcccaatttaggtggagctgaaactgtttggctgaactggggtggagctggagctgaagctgtgtcaacatgccctaattttatgagttagagctctacgtgctcttattatacagccttaaaagaaaatcgaaatcgtacacttgttctgtagcggatccgggctggatggacgcaaacccaccaccaccaggactgtaccggtgtagccgttaattaattaacacacgagacgagagtacgagacgagaccgccgcgaacctgcgtgccctgtgtgcgtgtgctgnnncgcccgtggccgtgcgtttataaaattacgcgctccgcctcgccttctttttccacacccacaccaaccccagccctaatcaccaccacccccccatcccaccatcgaaccgccaccaaaaaaagccgaagctcgctcgccgccgccgccgccgccggggacttcgccggagggaggagaagccaacccgcccgcccgcgcgcgcgtacgtacgaggtgaggcattccctcccgtccctctcgcgacgtgtcgggttgggttcggcctcttgtgggtggagggctcgagatcagggagctcgtcgtccccgggtgcccccctgtttcggccgggatgttccagatcttagcgttgctgggttggaaatttttgagtggttcggggatggtgatgtgcggtttgctgatttttttggtgctctccggcgtttgattgcaggcctgctccttccgtcggaagggaagcatcgggatggcgtcgatttcgccgacgtcttcatcggtcgccgccctccgcggccacccgtgagttctctgcttcctctctctctcgctgctacgccttgattgtgcttgcccgctgcctttggagctggttacacttccggattctttccggctcgattatgccttttgctaaggcctcacttttttcttttagtgttttggttgatttgacgactggtacactagtttcatgtcagaatctgtttgaagtgaattagtaacgagcgagctgttgagcgaactacataatacagttgaaatccggtcgtaagaacctttgaggaatgactgtaaaatatactagttttactcattcctttttaatgagaatatataggggtacttaaaataagagtttatatatattaattgctgaatctgattgattctactcacttctgtttgtgtaaatgcagggtgcagttcgtgaaaggcggtgcagtctccaaggaagcaaagggatcaatttccttctcacccgttgcgaattcaaataatgccaatgtgaaatttacgggcttgagggtagcagcatcattgaaaagggatggtgcttttccaggcgacggttactcagggaatgataacacggtgttaccaaagagcacttctgttcgtggccaggactatccaactgctgactctgtactcccaacggaatccatcatcgtgccagaaatcagtaa

SEQ ID NO: 20244 - DNA, 1578 bp, Oryza sativa
taacgagcgagctgttgagcgaactacataatacagttgaaatccggtcgtaagaacctttgaggaatgactgtaaaatatactagttttactcattcctttttaatgagaatatataggggtacttaaaataagagtttatatatattaattgctgaatctgattgattctactcacttctgtttgtgtaaatgcagggtgcagttcgtgaaaggcggtgcagtctccaaggaagcaaagggatcaatttccttctcacccgttgcgaattcaaataatgccaatgtgaaatttacgggcttgagggtagcagcatcattgaaaagggatggtgcttttccaggcgacggttactcagggaatgataacacggtgttaccaaagagcacttctgttcgtggccaggactatccaactgctgactctgtactcccaacggaatccatcatcgtgccagaaatcagtaatgctggtttgaaatgtgttgcggacatgttctcagatgaggacaaagacactgaacaagatttggatagcccaactgagggcttctcgtctatttccgaggccatcaaagatattcaacaaggaaaagtcagtatatgctaaccttttactcatttcatatcttgtccgtttctgctctatggaattctcctgacaccaggttgctcttgtagcttgtgattgttgttgacgatgaatcaagagaaaatgagggagatcttataatggctgcttctttggttaccccagaggccatggcgtttgttgtaagatatggcacaggaatagtgtgtgttagcatgaaagaagaggatcttgaaagattgaaccttcctttgatggttgcaacaaaggaaaatgaggagaagctctgtactgcattcactgttacagtggtatgctgccattcttattctctttcttttgccagcactagaatagtatgttatgaatttctatggatatcaaattttgcttaactgtcaaatgcatgcatacgtatgcttattcactttaccattggtttcctctgcaaaaggccaaaatgtaactcataaaaattgttcttcacatttttagttttaaatattaatgatgtgacggcatgaggtgtgcatttccttttgcacacagctttctaacaaaaaaaagggtaaaaaacaaagttgtattaaaccagtgatttgactttactaaaatattacttgttttccatcttagatctgagttctgaaagtaaattgccataatagagtgtaatcattcctaacactcactatggaggcttccagagaaactcatgatgagtttggtgttaaggcgtctaaaacttggctattgctcctttcatcattgttatgcatatcaaatgctgaccaacagtatttaacctaaggaaaaacttgtgttctttagaaaattttcaaatcaacggaacagatacagcctacttactagtttagttactccatttcataatgaaagagtaaacatcctgccttgtgagtttgtgttgaacaaatttgttttgatgatttgtttgagctactgagatgaaattcatctgcttt

SEQ ID NO: 20245 - DNA, 3713 bp, Oryza sativa
  unsure (1)..(3713): unsure at all n locations
nnnnnnnnnnnnnnnnnnnnnnnnnnnnnnnnnnnnnnnnnnnnnnnnnnnnnnnnnnnnnnnnnnnnnnnnnnttatgcatatcaaatgctgaccaacagtatttaacctaaggaaaaacttgtgttctttagaaaattttcaaatcaacggaacagatacagcctacttactagtttagttactccatttcataatgaaagagtaaacatcctgccttgtgagtttgtgttgaacaaatttgttttgatgatttgtttgagctactgagatgaaattcatctgcttttggcttataggatgctaaagagggaacaacaactggggtatctgcaaaggatagggcaaagacagttatgactcttgcatcccctgactctaagcctgaagacttcaatcggcctggtcatattttccctctgaaatacagagagggtggtgttctgaaacgagctggacatactgaagcatctgtagatcttgctatgttagctgggttacctcctgctgcggtcttatgtgagattgtggatgaggatgggtccatggctcgcctaccaaagctgcgcgtgtttgctgaaagggagaatttgaagattgtatccattgctgacttgattaggtgagtctagtacacaaacctgagctcctaatactgcatgtgcaaccaggatatatatcaataactttatcatttaaactgttataatataggccaatttggcctattaatcatgagtagttgctatcagtgggaacatatatacgctctaacttccctgagatataaatgctattatttttctccttgaaattgtcgtgatgtcctatctattggtgtgaacacatatgtcatggaattagtaataaaagattcttcttgcaattagtattgccatcgtatctgttatcctagataataacacaaactaatctcgaattgtgttgattgtagtagcccctgggttgcaactgtgcctgccctgctatttgatattcctctatgcccttgaaatgattattgacatgccaattagtgtactgagactctgagagttcttatctttctgttctgcagatataggagaaaaagagacaggctagttgaacgttcatctgttgcacgcttacctttgagatggggtaatgtccgcgcttactgctacagatctgttattgatgggatagagcatattgcaatggtgaaagtaagttgctgaaatattataaaatacttgtgttggaattagctgctgaatcagttttttttttcttgtcataagcctgacttttaagttactcatccaatcactgacagggggagattggagatggtcaaggcgttttagtgagggtgcactccgaatgcctcacaggggacatttttggatcagcaagatgtgattgtggtgatcagcttgccatggcaatggagatgattgagaaggctggaaggggtgtactagtttatcttcgtggacatgaagggaggggtattggtctcggtcacaagctccgtgcttataacctgcaagatgacgggcgcgacactgtggaggctaatgaagacctaggactgcctgtggattcacgggaatatggcattggtgcacaggtaaggaattcatggtatcatacggcattcgaatatagggggtgtttagatccaagggtttaaagttttggtgtgtcacatcagatattatatagggtgttgcatggggtgtttgggcactaataaaaaaactaattacagaatccatcagtaaaccgcgagacgaatttattaagtctaattaatccgtcattagcaaatgtttactgtagcaccatgtagtcaaatcatggagcaattaggcttaaaagattcgtctcgcaaattagttgcaatctgtgcaattaattatttttttagcctatatttaatacttcatgcaggtattcaaatgttcaatgtgacggggtgaaaaattttggggtgggatctaaacagggccatagaaaacaaaatgtcataccctgcttatagccttgtacaccagcttaataaagaaccatgtggtttatatatctgttcatagcatatgtttcaacttgcttacgttgaggcctgaggggctgtaaaggcatatgttcagaatctgatgcatacaaccaacaagtgtagatgaaataaaaaattattcccaactgaaccaaaatatattttctactttaatggacttggccgccttgcttagcgctttcctttcttgtcatgaatttgatgctgccaacaatttcatggagacaatttaagaattaccatgcattcatttcatttgttcaatggattgacatttgtactgttgctttgtagatattacgtgatctgggggtccgttcaatgaagttgatgactaataacccagcaaagtatggtggtctcaagggttatggattgagcattgtgggcagggttcccttggtaactccaatcacctcagagaatcggagatacctggaaacaaagagaacaaagatggggcatgtatatggattggccaatggccaagctagccatcagacgggcagcaatggtgccaaaggggagcattaggccaatcggactcaggttcacattctaatccacgacaatcttatgtgatggagtttgtcaaattatgctacaacatatgttcgtggtgaaccaatttttttttagctgacagtaggttgaaagatgggcgtaataaaagtatccctttatttgttgtaatccacagccacacaactgggttattactgtaaatatatacacacacataaactgctccctagcgggtacagactccagccttacctgaattgagaagactggcgataaaaatatcgactgagatccaaggcaatactagtatgaatctaactcccaatattgaaagaatttttgttctgggaagcctttggatccttacattatttcttgcactacgcatatgctgccagagtctttgtcaagcgatctgttcttgtgtttggctgcctttttctcgctggaatatgaacatcgactattcgactgatgctagtctgagctaaaaatgttgtactgactactgctaatacatacggcccctgttattttttttattaagatactgatttcatcttagtttttattaacatgcttttcaaactatcaaacggtatatatttcatgcgaaaactttctatatagaagttacttaaaaatatcagatacatttttcaattttaaaataactaaatttcaattaatcaagtattaatattttttttacatgcccggtatttaatcatcctcttaagcaaagctaaacttaaacgggggcaataataagctctcaaagaacctcgccggataagccgtggcaaggaacataaccttgtctcggtttctttggtttgctcagtgggcgatgggaagttggtacggttctaggaggattattgcctacagggctcttcaattcggtcgctggcgcccgcggtctacgcagctgttcccgctcggttccggaacagacgaacggtagctgaggctttgcaagacaagaggtggattcgagacatctgttcggcattggggattcaggcaatcctggaatatctcaagctttgggacattctgcgattggtttagctaggtgaggaaccggacacgatctcttggcgttgggaaagctcggggt

SEQ ID NO: 20246 - DNA, 4743 bp, Oryza sativa
caccaaccctcccaagtcccaaccgagctgagctgaccgcacgaaaagccaaccgaaaacggccgggaggaagaggcaaaaacgcggcgtggtgacgccaccccgcgctccgtttttctccacgcgacacttgacttcaccgcgacacatgacttcaccgcctgacgccgcctcaccacccactcccccctaatccctccttcgcttttctacctcaacacgcctcgttcttcttcttctctctctggttttacatttttactactcctcctagcttcccttcatctctctcttgatggcgaaacccttccccgatccgccgaaaccgccggtccccgagccgccgaaaccgggctccgatggcgcctgctacgactgtccctctcctcctcctcctcctcctccccactcgcgtgaccaccgccgcgtggtgatcgcgctcgccaccaccgcgtccctgctcttcgccatcctcctcgccttctccgtctactgcttcatccgccgcaggcgccagcagcgggcgcggcgtgaggcgcttctagcacctcccccttctgatgcggctggaggaggcggcgcaccgggtgcgccggtcgccgccggcgacggggcggtgggcggcgccggggagggggagggggagggggaggtgctgcaccacgcgtggcacatccgcaccgtcgggctcgacgaggcggcgatcgagtccatcgccctcgcgcggtaccgcgccggcgccggcatgctcggcgccaccgactgccccgtctgcctcggcgagttccgcgacggcgagctcctccgcctcctccccaagtgcggccacgcgttccacgtcccctgcatcgacgcctggctccgcgcccacgtcaactgcccgctctgccgcgcccacgtcctgcaccccgccgacgccgacgccgacgccggggacggggaacgcgtcccgccacccgccggcgctaacggcggcggcggcggcggcggcggcgcagccaccgaccaagcctcgagccccaccgatcaaaccgcggaccaagaaaaccctggtcaacagcagcagggggagcagcacgagctccgggtacaaatcgatcggcgcgaccagcccagctcgccggagccgccgcgccggagtcccgacccgcgcagcgcgcagagtttccggcgagtagcctccatgggctcgcgctcgccaccggcgccatccgaggatgctcctgaagacgagcagacgacgacgcagagcagcaaagagaaacaggggagcggcggtgactctgcctgctgcggcaaggcgccgtcgggctccggccgcttgcaccacatgaggaggtctttctccggcggcggaggccggcgatctctcccctcgcggcatggccgcacttctagctcgatgctgccgttgtgatcatctcgggggtaaaaagaaatacaaaacaaaaatatttactgaaatcgattgtgaactcggtatcctgtacagttgtgaacacccaaagagagattgcatcttacatgtcagatatatgaagaaatgaaccttgagctggagttgatttttaccttatattcctactatatttttgtgttgtgttcgttgcaattgcaaagatcgtacttaaaacttgcttgttctagccttctaggatgctaattactaatcagcacatcatacgcagcataactcaggtgtgacattaattgcatctcattatttattcgtagtctcacaagtagtcctatactcttaaactgacagtagtcaatgttgacctgaacatgaggatgccaagttgcctcttagagcacccgcaatggtaaagtaatgtgttatctataaaacatgtacatctcagcaatagactagattaatagtaaaccatctcaatagtatgtctacatgggtatctatagctctctaatacattgcctcgtttttctctatagactatctccaggttagtagatagctttgctctctctcttcatttaatctcttccaaataggaaaatatgctgatatggatctcttatagagagcctatagataaccattgtgggtgcccttaggacgcgtacggaagttttgctataggggctgtttggatgctatacttttcatgccaccattcaccatactttttatgctacacttgtctaagttgtggcttataaaaagtgagccacaccttagctagcaaaattggattgtgccacactttagtgagttgatgacatgtggggctccaatagatgagaaggaatcttgccacaagtgtggctatgaaccaaacaatatgctaacttggtcaaacttacctagcatgagatgtggcaacctttggcaaactttgagagcaaaccaaacaacccctcacgcgcacaattggcagataattttgaaaggtttatgatataaaatattaaaatttgatcggttgaggtaaaaggaacgctctgctgctatgctgctagccaacaaaccgagtgtcactagaggtcgacatatatacactcaccaaaccagttcagagctattcagaaagtgatgtgtccaagtcttaagccttctaggattctaggattattcctgtttgttcttggtttgcttatgtgaagaagaagctagagagaaaaccaactaaatgtgctgctaatttgatggaccaaagagaagaaattggatcattatatatatgtcgggtgacgtcacctaccaatttgattagtttaattagcccaggatcactagcattggccgagcatctccaagagcctaaccaaatggctctccaagttaaaatttggctaacttacacaaaaaaatctactacaacaaactagccaaatacctctccaagccattaggctggctaaattccccaccagactagctaaagttggccagccaaagccagctagctatatgtgggacccacgcctgttcccaccctctctctccacgctgcagtgcggcacgcaccgtgacgagggcgccgccgccctctcgtcgctgcggccagccaccgccgccccgtcgtcgcgcggccggccaccgtcccgccgagctccgccgccgccccctctagatccgccgtcgaggtcgtcgcccgccgctgccgccgccgccgagctctgccccgagcggcgtcgaggtcgtcgtcgcgagccgccggcgtctcgcctcccgcctccccgcgtcacggcagcaccgcgcgtggccgcccgcctccttgcgtcacctcctcgcgagcggcggtggggatggggatgggcggcagcgacggatgggagagggaaggggggtttggagagaaggggagaaagatgagggagaagaaggaggtgtagaggctgacatgtggacccaattgtcatagactcagaatagagaggacgaatggagaggctgttggggtaaaagacaatttgacttgctaaattgaatggagagttggccaaatagacatttggagagtcaaatttagagagactgttgaagatgctcttaagttatcatgtctactctgatctaacaccataataaactaaacagttactaaaatgactgtgtgcaccgtagggatggtgcaaagcccagagttatactcaattacacacgtgtaggttggctttagtaggatcttatagtgagactaaagcgatatgatgttggtcttcatttatttgtgcgtgagttagtgtatttgcgactgcgtgtgtctggtgttacttgtgtagtgatgtgtgggtgtgcaccatgaaataagaaaagaattaatatgtaatctttttcgctaggctagcgataggacatcggctaaatgcattaagatttaggaatgaaattacataaagcacacgccgattctacgtacagattgtggtcacagatctacataggtttcaaaacggccgtaaacactctacaacatgcacaaacctatacacatgtatatgcaagtttaatcaaagagcggcatcggtcggtccagccaagccagccgcttgttatgccatttcatattaatctatgttatccaaaaaaaatattttttttataaccagataggtaacaataacattcaaacagcgaggggacattttcttgagggatgaaaatatatgtccatagagggcgcacatcttggctttgtcggccacagcgatccagattgtcggaacgaaattaaatagatgccccttattgctaagaacatacaaaaaaaaaaaacttgcatcgggctagtatcttcggtttccaaaggaattcgccgcaggcggccttttctttcccaatgaagaacatcttgtatgcaacttgaggagtattgcacatctgtcgtgaatttccaccatagttcaaatctctgacatattatggcacaattccacttcatatttgtcgataattttttttctaaaattttaacatgtgtaaatatagtacaatcgtagtgtaattgcattgtaatttacatataacttacaatataattttgaaccgttcgattttctttaaaattcatgcaagagaggtagaaaaaaaatcacaacacatacatgagaggagattcggtaccattattacctccgttttcacggaattagcatgtcccaaggatttctgaaagttatatacaagttacactgtaattatattacaattatactatatttacatcagtagttaaaatttgacgataaatgtataaatactcccaaataggtaat

SEQ ID NO: 20247 - DNA, 1474 bp, Oryza sativa
ccaacacccgcgggttcttgcccccccaaaccctagcaaaggcggcgcggcgtcgtcatgggcgtcgccgccgccaacgtcgccgccttcgttttgctggccatcgcgcccgtggccgccgcgccgtcgtcgccgcctcgatctggcggcgactccctgagtttctccgacgtgatcagcatctccttcttcatggccgtcttcttccccgtgttcatcgtcctcctcgcgttcgcgtgcctccgcctgttccggccgctcgacgacgacgacggcgagcccgcgctggcggacacgtcgtcgtcggagtggtcccgccgggggggagggggcggcaacagggcggggctcgacgccgcggagatcgcggcgctgccgctggtgtcgtaccgcgacgccaggcggcaccggatcggggacgcgcggggcgacccgctggagtgcgcggtgtgcctcctcgagttcgaagacgacgacgccctccgcctcctcccggcgtgcccgcacgcgttccatcccgagtgcatcggcctctggctcgagaagcacgtcacctgcccgctctgccgcgccaacgtcctcgacgcgccgccgccgccgccccctcccccgccttcgctggagcaggacacggcgtcgccgccgccggctcacgagacggtggtggtgatcggcgacgccggcgccagcgaggaggcggaagcggaagagaggatcaggatccagtgcctcgcgggggtccgtcgcgcggcggggcggcaggctctcccgcggtcgaactcgacggggcacgagcgcggcggcggcgggatggagcggttcgcgctgcggctgccggagcacgtccgcctcgagatcctcatgtcgcacaggctgaggcacgtgacgagcgcggtggcgtccgtgcgcgtcagggaggggagcgcccacgacgccggcgccgtgcggaacgccgtggcgaggctcctgtcgctgttcgtgcccggagccgggtggaagggagacgacgagggcaagtccagcaaggcggcggaagggtcgtctcgccggcggcgcgacgagtcggcgaggggaggagtcggagaagagaagaggagcgagtaattaatggcgtattttgagtatgtaattcgatgatcggaaatgtaattttgcagagagttttttcttttccctttcccctcattctttttgtgagaacattattattgaataattcaacagccaacccgtaatcacagaacttcattgcaattttgagcttaatttcctccaaaaatggttttccacaaaagaaaaataaccaaaaaaaccattcaatgtattttgtaaatataatattccattcaatgtattttgtaattataatatttttattagcactcctcaatattaccgtagaataagttcacctgacgcccctataactttaggtcgagtttgtctaaggttcacaatccgtaatactagaaat

SEQ ID NO: 20248 - DNA, 1620 bp, Oryza sativa
ccgcagcgagggaggtgccacgtgtattgggtgtacgtcgatgctgggtgaaggaacaccgggatgcaaccgacgagaatgaggtcaaatgttgacttgcgggtgtaggagtcgccacgttgctggatacagaactctgcggactcgagcagctccatgaaccatgatccgccctggcaagttgtactgccatggcgagctaccgaagtgggtgcaggatggcgacacggtgaactactcaatgatccgggcgcgcacggtcttggtgctcctgagccgcggcgaaccggtgaatgcccaaagccagcggcggtcgcgtcgccgcatccggtcctgccaccggagcacatgggcgttggaggtcgggtgcaagtgggatgggaaaggcacgctgaagttgatgcccttccacgggttggcctcgacggcgagcaccgtcgtgttgcggatcgctgggtaggtgagcagtgcgttgccccacccgtcgtctccgcgcggggcagaagtccttgacggggcgggctgccaccatgaagtgcttcacccgccgccgctcgtcctctaccgccgccggcctccccgtctcgcttaagaagagaagagaagagaatagaggagtagaaagaaaacataagagaaaagagaagaagaaaagagagaaaaaaaaaagatgtggtcatgtggatcccacattttttccttcttacttacatgtgggcttcataatttttttaatttctttttgctgactaggatgtcacatcagcgtaaccaatgatccatactgttaggacttaaattgcatagttttatatagtttagtggtgaagatttctggtatttgggacgagggatgtcatacagactcaacttgaagctgaggcaggctagtgaacttattcttattactgtttcactaactagttttgggccttttttggacttcgagtcggctctacgggctgaattagggtccggctgacccaccattggtccagcatggctaggtcgagctaggatcaggctagcccatgaatttgtccaacaggatatatataaaagttcgttagtgaacaaaaagaaacagagtatataattgttcaaaaccgagaagaaagctaaacgggtaaaaacctctttctgttcactagatttcctttcctcgttaaaatggtacacttccattgccacgcacacgggggctcctagctagcgcgtacgcgctgctagcgagcacctcccctaaggtttaggaaaaagtacgaattacctcccgaactatcacggccgtccgaattaccccctaaaccacaaaaccggacattcttcacccccaactatgcaaaccggacgaattacccccctcaacccaatccgcggtggttttggtctacgtggcgtacacgtggcagtccagtcagcaatttatttattagaaaataggtgggccccacctgtcatacacttttcctttctcttctcttctctcactcttcctctctctcttctctcactctctcacgattcacagcggcaggcggggcgcggcgagcggcggcgggggatgaggcggcgagcggcagcggcgacaagggatgaggccgcggcgggggatgaggc

SEQ ID NO: 20249 - DNA, 6290 bp, Oryza sativa
  unsure (1)..(6290): unsure at all n locations
nnnnnnnnnnnnnnnnnnnnnnnnnnnnnnnnnnnnnnnnnnnnnnnnnnnnnnnnnnnnnnnnnnnnncgccgcttcccccccgccctggacgccgccagcgccgccgcttccccaacctaccctggacaccgccgtcgccgccgccgccgctgccctagcccgccctgacgccgccgcttcccccacccaccctggacgccgccgccgcttccctggccgccctggacgccgccgtccggttccccctcctcgtctcacaccgcgcggcggcgtgcatcctccaccacgagatgacgagagagagaccgagagagattaggaagagagagatagaggaagagagatagagggggtatgacatgtgggtcccaccattttaaaaaaaataaaatgctgactggactgccacgtagaccaaaaccaccgcggattggatcgaggggggtaattcgtccggtttgcatagttgggggtgaagaatgtccggttttgtggttcaggggggtaattcggacgatcgcgatagttcggggggggggggtaattcgtactttttcgtaaggtttaactacatctattatctattaatctactagttaacacttaacactaatgatactagtagtaattaggaaagattctgaagattttttgagagatatttttagtaagaaattgaaaaaaatttaagttagatttgaaaacttttgatttaagtttcaaattttaaaaactttcaactcagattcaaaaactttcaattcgagatttgaaaactttcaactcagatttgaaaactttcaactcgagaatcgagattcgaaaactttcaagtctggatttgaaaattttgaaaacttttaacttgagatttgaaaattttcaactcgagatttgaaaactttcaactcaagattcgaaaactttcaagttcggatttgaaaattttgaaaactttcaatttgagatttgaaaattttcaactcgagatttaaaaattttcaactcgaggttcgaaaactttcaagtccagatttgaaaaatttgaaaactttcaactcagattcgaaaattttcacttgatatttgaaaatctcaaggccaaatttgaaaatttttaagtcaatatttaaaaactttcaactcaaaacatttgaaaaaacatgtgtgctaaaagattaaaaaaaaagcgcaaaaaaaaagcgaaaagaaacgccaaatgaaaaaacgcggaagaaaaaacgtaaaaaccggcgttagaaattggttagagaaaaaaaaaatctcgcgcgtgcgtgggccttgtgggccgggcgcgggcgccggcagcgatcgcgtgttagcaaaaccccacacacactacacatgcatctctcaagtgcgaacaattctagagaaaaggcagtgttagtgaagttgctcatcaattctccctttttcttcaatcccattaaaaacaattctcccttctctgcaatcccattaaaagcatctttcaagtgcgaacaattctagagaaaaggcaatattagtgaagtcgttcatcaattctcccttctctgcaatcccattaaaagtaccaaatcctgaattcctgataatacagcgaaaggagaaaggggcaagacaaagacaaagctccctgcttgatgctcacgcttatcagaatacccgagcacgaataattcctctgctagtgcagaacgaacgaatgagaacacacatccccttctcaaaaaagagagagcgatcgagagaacacacacgggatgacacatccaacaataaaacaaacgaaatttcaaatatatttgccacggtttgtacattacgtgcacgcgattactactaataagcaaaattataataatttcaaatggcaaacaacctggtgtatgtacaaggtttttcagccttcgcacgcgaacaaattaaattaattcctctacataaaaagagaaattttttttcacaaaatctcgccggctttgcacggatcagaccgcatcacggcatggcgtctccttcgcgctggtgtccgctcccacgccgccgcgcgcccacgacaccgtccttgccaggaaggacggccaccgccgcgcgccgtgccagctcccgccgccgcccctcgagctgccctcgcggctcgatcccctgatgccgaggacgaggctcgtggcgtgccggaggcgcctcgacttgagcacctcctcccggacgtgcggcggcagccgcaccgtgaacctctcgtggtcaccgccgtcgcccggccccggcgcgcgcggcgccggcagcgcgcacagcgagtgccccgtcgagttcgacctcggcatcctcgccgcccgccgcacggcgcgcagactctccagctccacggcctcctcctccctcctcctcgtctcctcttcgtcgctcgcctccgccacctcctcaacccgcaccgccgcggcctcgggcgtacgcgactcctccgccgccgccgcggccgcagcaggcgaggaggagaactccacggcaggcggcgacggcgctggctgcttctcgaggttggcgcggcacagcgggcaggtgacgtggccctcgagccaggggtcgatgcagtcggggtggaacgcgtgggagcactgcgggaggaggcggaggtcgtccccgtcgtcgaacacggtgaggcacacggcgcactccagcgcgccgccgccgccgctcctgtgcttcctgacctccgcgtacggcacgaccgggatcgccgccaccgccgccgggtcgagcccgcggcggcgccgagcagccgacgactgcccttgcccagccccagcgccagcggaggagtcgcagtcgcagcactggttgacgatgacgcatacgaagacgaggacgaagaagacgccgatgacgacggtgatgacggtggacacggcgcggttgaccgccctcgtgcccgtctgtggcggcgccggcgacgcctgcgcgttggccacgtggaaaccgccacctacgacgaggaggaggaggaggaggaggcagaggcagcgcgcgcgccgccccatctctctcggaaagggaggaggaggaaacggcggcggcggcggcaaagtgatggatggatttgcgatttgccccctttttcttcgtcggttcgtgcgctcctcagccgtggatggacggacggacggacggatgatatgctttgctttgtggtgccaggttgctagctgttgacatgttagcagcctgacggcggttgggggcgcgatggctgtgttgtgctggcgatccgcggaaagatgagacgatgccacatgccccaactgttcacgcccctgttcgtttgggggagatgggaaccaaactcctatgcacgaaaaacggagcggtccattagcacgtgattaattaagtattagctaattttttttcaaaaatagattaatatgatttttttaagcaactttcttaaagaatttttttgcaaaaaaacgtaccgtttagcagtttgaaaagcgtgcgcacggaaaacaagaaagaggagttgggaacctgcccaaacgaacagagcatattagtgatgctaccaactcctgaaccccttttgaccggcctgaataaaaaagaaatggctgtgtggtgattgactgagcactaagggcgtccataatactagctaaatgctcttgctttgttacgggtaaaaaaaatcataatactttcttaaataaataaaaacatattttttttatgaaatatgttacccatattttcgtataggggaagactcttcttaatttaattttatatgaagctatttatttagatttaaacatgtaaagttacgtatgggcatagatggctatatgccccgtggtccgacggcccgctttggcacagtttgacagttggctgctgccttggcatggtggcccggcatggcacgaagttcagggaggcgaaatagacttactttctgccatatgtatggcacgacccccaagaagagtgagggaaaatggacttattttaaccatgtataagatacggcccaaagaggagggacaaaaaatagacttactttagccatatatatatatatatatatatatatatatatatatatatatatataatatatatatgtatatatatatgtcacaacccaaagaagaggaaggcaaaatagacttatatgaaagaaagcacgatgagctgctgtgccttcaagccggctcggcacaacctggcccggcacaacctgacccttattggactgtgccgtggccgtaggtggagcacgtgggctggcgcggcctagcccgcccgttgagcgagccatatcggtccgactaatcttgggccgtgccgggccgaacggcccatttggccatctataagtaagggggtgacagattcactgtcaccatcattaaagtttctttaaaggagtagagatatatgaaatgttgatagtaaggagtgggtaagtagtataggaggtagtaaatccattaagcaatagcactgttgcgatagtactatctagtatcagaaaaaaaaatccactcctctcttatctattgtctttctaaccaactattgttcgacatgtgggttctagcttattatttatacattgcgagagttagaaacaacctataacctaattttgtaagtctcactctactacttatctggtgaagatacatggagaatgttaagggcaggtttggcttaccattcttaactgcaaaagaaaaaaaaagagctaattgtacttttgtacaccctctagctatatttttaatttggattagtaagattaccttttattacactttggaccattctaagtcagttctctagctgcatctactatctagtcttataggagtagttgctagaccccctaacttgcttgttatagctaaggatgctcattttacctttaatgttgagtgattgagttcatttaatatccttaaagctctcatgtcagtactaatcatccaacgtactgattggtcgctgtcgtttgaaaccatgtgcaatgctagtgataatacttttaggatcattcttaaagtaagaaatactatgctatcgcatatgctagtaaaatgtggactggatctcagttaaaatagtgcaacatttgaaaaaggagctccttgttgttgttttatcttttgataaagtcagttcttacttagtgcagcaaacattatagtatacattttacaagaacttctattacaaagtagtcttgaatgaaacttgagagatcttcacttgagtagtgtgtattgagagtgaagttcattcctccttttataatgtcaaatggcagctataatggcggttactagggtcggttcacccacaaatcgtcatcagcatccaatgggaagacaccatgtggaaggcggtggcaaggggtgccacccctggttcggctgaactagggcaaccgtgtcttagcccactgacttcctcccagagtatgatgagtgggcccttatgacggtgcatggtagataggcctcaattatgttggttttgcattgatttgtgggtctttcaatccgtgtactcacgtatgattgcccagagatgtatttcgtcatatgacgggtgtattttcatccaaaatcttctgcatacaaatattctaccatactcgtggaaatggttactaataaaacctaccactaagtttgctattccattttatttagttttatgtaggagttgatggtcagatttgatatataaagactgtcaacagatatatacttaaaaactttctgcaaaaattacaggggtgggatagagtatgatggagagcctagctgatggatttgcccctgccactatcttaagtgacactattttttttctcacaaattcttgggcaactgcaggatatttagacaatcttattcatacatatgcatatgcatattattctcgtgctcttgcggtcccatgtatatgaggaaaacatatactacctccgttttttaatagatgacgccgttaactttttctcacatgtttgactatttgtcttattcaaaaaatttacgtaattataatttattttgttatgagttgttttatcattcatagtactttaagtgtgatttatatcttatgcatttgcataaaatttttgaatataagacgaatggtcaaacatgtgagaaaagtcaatggcgttatctattaaaaaacggagggattatatcctgattccgtacggtaaggtatgggaatagtaaagcaagtgaagattc

SEQ ID NO: 20250 - DNA, 3638 bp, Oryza sativa
cccccctaagccccactaaatttttcacgagatgtggtggctggagcttcgtcaggttggctggagggaaggctggaggttgaagacgatgttatttcgcgatttgggcttgtttcgaagagcagcccacgaccacgagcgcagtcttcaagttttgtctagcccactccaagcaaaggcccacggtggcagattccagccggcccatttggctactccccctcccggcctcccgcctccccaattccccaatcccactggccacctcctcctctcctaaatccctaaccctaggcgaataggcgcgggcggcgggcggcggccgagcaggcggcggcggccggcgaggggccagacgggaggtgtgccaggcggtgccccggtggtccagtgcatgcccggagcaggtggcgacctccggtgagctgcaagctggcgagcgccgagcggcaagcaggcggcaccgtggcggcgtccagtgagccggcgatgggccagacaggaggcaggccaagcggaggcggtggtccagcactccagcgcctgcgccgccacgccgccgggaaggtggcgagccgctcgctagcgaggtgccgcgagggcgcaaggcgccgaggcaggcaggcagcaggtcagcggcacagtggccggcaaggcagcaacgagtcaacgacgcagtcgcagcctactgtgactgtgattgaagatttgaagttagaaatcggtaaactagtaacctctaatactaatagatagtctaaaattgtgtcttaatgaggttgtgcacttgtgcttgaaacttataattattttctatacatttttagattgtcaacatgtcaaaaagaacattgctcacgtattattttagtttaagcaacacaaatggcagtgatcctccatccagtaaagtgatcctccatccagtaatgagtgtttaagttagccaaagaaacccaagtcagggttttttcaatcggatgaaaaaatcatccaacaatttgaagatatgaaagcgcgtcagatgttagtacctcaacagaaattagtggtatgctctatgcctccattcctccctaaatctctaaattatttgaatccaaaataagtatgtttcgattattcgttaatttgcccttttctttgtataaattactactcatgaagaataatagacgattgggtgtgacacgttatctattcgatattggtttggtatggacaaaattctcgacatatcattaattcaatgtgtaccttgaactgacatttagccaatttacatgtgagacatgtttcgatttatgctggcgtaatttgttcagcccccactactattttttcctggatccgcccctgtctacgcgcttctgcgcttccattttagcctcttgtatggacatgcaaccaccactttcacgagcaagtagtgaaacaccatttgtcaatttcccgtccatcgcctccctctgcagcaaataatttgcagcaaaacttcgtcaaaattaaccgctttcaatcaaggcagcggctaattactatttataaaagtaacaggtaagtacttttttttaaaaaaataacttttatatgtaatcagtgcattagaactttagcttgttgggtccagacatgggcagggagctagataagaatgtaattttctgataaaattgcttgctgttatttataaaaaaagatgcagtttattagatgagaatgtactctatcttctaataaaattttgaaaaatatgagagaaagtacctcaatgcctcgaatgtcattcaggagacggccgcaagtgcccaccagcctaaatatttcgttgtattcttgatgtttgattatgtcgtccgtgagctttactccgataaaaaacattcccgagatcactgtagctccatgcgtgagtgaggtcacaccacactccatgtattcttcgaactttggcacatattggctcctctgccattctgcctcagtctatcatacacctcaatatatctttttttaataataaaatataatatcccggcctctactcaaaaagagttacaactaattattacaaagtagcatctcaatatatctagccactgcaatttgaacatcaacttgttaatagcaacaacattgcaacaaaagaattcaagaaatcgcacattggagactcactgtttctagcaagtacttggtaatatcatggccttgtaatgcagaagcctttgcgccaatctcgtttactgtagtatagagagcctgaaacagtagttttacatcttcagagtatagaactcttgttgatgaggcttatcccacctatgacaaccatttgcacaacgaattagctcattgattgagaaagatcagacaagatacactggatcaaggaatgaggatttgtacgtacttctccattaatgctaggaggttttcttgttcttcttttgatcctccaacatcaaagaaatcgtcaacaacagatgtcaacaaagctgttttagaccacgagatgcgagcatcggacatttcaggaggggatatggaagcagcagcagagaaatagcaatatgttagcttctggcgtgcgtattgtagctgatctagtctgttgtctttcacccacctgtccttttttttttctttttgccaatttgtctaagttaaagccatataggagaagtaataatgaataattatggtaaaacaacaaaagaagaaacataagggagcataacttgacaactgtctgaacggattaattacctacctatcaagttacttaagttcgtcctggtaattggattgagaggtgcagaagtcatcagcagccaaagccaaagttccaaactgacatttcacggttgtctaatcttcaattgtgaatggggctcaaatttaaaactgatcactatattattattttaaaatgtctgcataacttgctaaaaatcatttaagcagtgtgacgcgtgttggcacaatccccttcgtgtgtgaaaatactactccctcagtcccataatacaagggattttgatattttacttgcattgcattgtttgaccactcgtcttattaaaaaaattgtgcaaatataaaaaacaaaaagttgtgcttaaagtaatttagataataaagtaagtaaaaaaaataaataataattctaaaattttttaataataagacgaatggttaaactgtgtaagcaaaatgtcaaaatcgcttatattaagggacggagggagtactccagtagtacagtagcagaaatgaccacctaaaaagacaaattaagtagctgaaataaagtagtggcctcttttcttcaccaaggaaatttggatgatacgaagtctattaattgtcctccctcgtgcttttcccgctagaaattagcatgatcggtctaggtctcgttgatacagtggttatttgctcgtgtcacactcacacaccagcaatagccaaaagctaccagagactgggagagaagaaatgtcgtgcacgctggttgtgctttttgcctacaccagcatacagtatagaatcattttcgtaaaattaaaatttgaaaacaagtactccctccgtttcgaaatgttcgacgccgttgactttttagcacatgtttg

SEQ ID NO: 20251 - DNA, 10266 bp, Oryza sativa
  unsure (1)..(10266): unsure at all n locations
nnnnnnnnnnnnnnnnnnnnnnnnnnnnnnnnnnnnnnnnnnnnnnnnnnnnnnnnnnnnnagaaatcgctctgcctggtgtaaactattggacgatccaacctcataatgatattttcttactcactgccatgcatgcatggggttagtagcacttttttcacccatgcacatttatctctttatctttaaatgatctttactcacaagttgcatggggaactaatacgagcacatggacatgcggaggagcgcaacgaacacgtgaggggtttgggagagcgatgcggacgcgtgaggacacatgggcgtggttagtggcggcaatgagtcgttattaactcatcataatctatcccgtttagcgggataccgtggtctagtagtactcctcccttgactataattaatattccgtatccatttactcaacatcgatcaagccggcacgaaatgcatcaacatcgaacaccgaaacatacatacgcaagtctcgggcacacatgcgaatttatcagccaagatgttcccgtgtgtcatgtcactactggagaaccccacatctctcccggttcacaacccctttactcccatgtagcgaaccgggagggagaatccgggactaaagatgacgatttttagtcccggttaaaatatccgggactaaagaaccatcttgagtccaccgggtgtaaaaataaaagtgtcacgtgacgcgttttgttttgagtaaattgcatcctgggccacttttattgaccattgttgcaagttggactagaggtaggacattcttttcagtttgaaccagaaatctttgcaaaaattttcatattgaaccagtcttcttcttcctctagatctccccctcttctcttctcttccctgttttggttcgagctcaccacacttcctcaggttccatctacatgcttgacctacgtcagcgcctgagcttgagtgtgtggtagtctccgtcttgagctcaacacggcacacggcagagctccagcttgagctcaagcacatagccaatgaatcacggtggcacggtgggaaattctaacacgatatattatcactccacacttctgctccaccaactagtcaataggtcccattctagcccaagttcatccatggcagcactagcttaattggagctagggcacttaatcaacgctgcacattaaatcttgagcacgaatgaatgtggcaggggcagcgaaggctgagtagagctcgagcatgactgtactggtggagcttgagctctatctctactaaaaccaactagccaggtatgtgaatctcaaactgaaggtagagagagtgaggaagcagagttggaagaagaacactaggtcctaagtgtaacattttgtaaaaattattagcccaaagtgaaaataatagcttgttcctagtccaagctgcgaccatggtaaagaaagccggtccaatatgcaattaactcttcttctttttttcttttcttttcttttttattttttttgctactttcatattgatttcgcaccgaactcaaccacacagacaaaaacatcaatcacacagacaaaatcatcagcaaattgacatcacatattcatctgcaacttcatagaaacatctagaaatcatccacaaatttacatcccaaaatcatccacagattcaaaaaacatgtaaaaatcacctacaaatttacatcacaaaattatccccaaaatcatccccaaaatcatcgtcaagtcgtcgcctccggattgcccgctgcttgccacctctcctccgtgtgcgccaccgccggccacatcctcccggcgcgcccgcctcctcccctcccaccgccacctcctcccggttgcccaccgcatccaccgcctcgccgtcgccgctcggggccgccacctccctccaccgccgcgtgggccgtcactgccgccgctgctgctgctcgctcccgccctccacggctttggcgctccgccgcgcaccaccgtccgccgccgcctgccaccgcgtgcccaacgccaagaaagaagagaggaaggagagaaaatcgagaggagaggggaagggcgctagtaagaagcgctaagggatgagaagggataagaagcgtagggataagaagagagtggagaggcaccggttaccgaggagatagcacgaggggagatgtgcgggctgcagtttttcttttgaattttggtccaacaaccgggactaaagatagcagggggtctgatacggcctaaccaccttttgaaccatgactaaaattcataaagtatcgtgccggtttagaaccggggttaaagatctttttagttccggttcctattcgaaccggggttaatgtgatttttgtctaacctagcaaagatggtttctcaagtagtgtgttagtcccgtaaggtagaaagaacaaagacaatgcttgttttaattagtaaagctaggaaataaatatattcaacagctgcaaattaattaatacaatatattcctgcatgccctgtataaatgcggaggcccgcaggcacgaacgcggcaaccaagaacgtacaccagccagcaggaaattaaatagtcatcgaccaatggagaagctgaagagcgagctatggatgacagcggtggccacctgcatgtcgctcttgttgtacctcaccatcctgagacggcgccacgcgagcggcggcagatcactagcattgccgccggggccaacgccactcccgctcatcggcaacctactctgccttggcggcatcttccaccaaaccctcgcgaaactggcgcgcgtccatggccctgtcatgacgctgaagctaggcctcaccacggccgtggtcgtgtcgtcggccgaggccgcgagggaggcctacacgaagcacgaccagcggctcgccgcgcggccggtcccggacgccttccgcgcgaacggcttctccgagcggtccatcgtgttctcgccgagctccgatccgcagtggaagaacctgcggggcatccacgcgacgcacatcttctcccctagagccctcgcggcgctgcgcggcatccgcgagcgcaaggtgcgggatatcgtcggctacatccgcacggtcgccggggaggagatgtgtgtccgcgaggtcgtgcacaacggcgtgctcaacctcatatccacctccttcttctccatggacatggctgacgtgcgctcggagtcggcgcgcgggctacgcgggctgatagaggacatcatcgcaaccgtcgcgggccccaacgtgtccgactttttccctttcctccgccagctctacttgcagggcttgcgtcgacaaacggcagccatctaggcatcgttttcgggttgttggacgacataatcgatcgccgcatggccgaaacccgtgaccaccctgacaagcagcggcacggcgacttcctggacgcgctcatcagcctcgcctccgccggcaagatcccacgctaccacatcacgtaccttctgttcgacgtctttgcggctggcgccgacacgatgacgaccaccgtggagtgggcgatggccgagctgcttcgcaatccccgcgtgatggccaaggtgcgggcggaggtgacggacgcgctcggcggcagggagagcttcgacgagggcgacgcggcgagcctcacgtacctccagtgcgtgttcaaggaggcgatgcggctgcaccccgtgggctcgatactggtccctcacctggcggtgcaggacggcgtcgagatcggtggctacgccgtgcccaagggcaccacggtgatcttcaacgcgtgggcgatcatgcgcgacccggcggcgtgggagagccccgaccaattcctaccggagcgcttcttgcacaaggaggagtcctcatcacctccgctggaattgcgagggaaagactacgagtacatcccgttcgggtccggcaggaggttgtgccccggcctgccactggcagagcgcgccgtgcccttcatactggcgtccctgctgcacgcgttcgagtggcggcttccggacggcatgtcgcctgatgacatggacatgactgagaagtttgccactgctaacgtgcttgctacccctttgaaggctgtgccagtcgcgtcacacactagttagggtgtggaggaaagtttggttgaaattggaacgatatgatgaaaaagttggaagtttgtgtgtgtaggaaagcattgatgtgatgaaaaagttggaagtttgaagaaaaagtttgaaactaaactcggccttatacttatatatgtgtgtgtgggcgcgcgcgcgcactacgacgtaggaggcctcataagtgctccatgcctcattgtttcaggcgtctccatggttcccacctttgtatccttaaaagttataagtttatacttggaaatcaattgacaccaactttatttaattgttgtttgagttatcactataaaaaacgatttttcatgatagccaaaataggttttcacaagcggctaatggcaccaccagagatcaaagggtagtgataatatggtatttgcgctggtggttttcgtaaggtagctgcctgcgaaaatgaatttgcacaggcggctacgttgtatcatctacctgcatcaatatactggccatggctaaaaaaatttgatggagcgacggcgctccgtccacctccgtcagcacatgttgaagtttttcccaaatccacagaaattatttccaaatccatgcgttggtcccaaaatccacaaaaattattcccaaattccaaagttaacaaatcattacaatttaaatacatctcaatttacagtcacaactttccattcacaagtttccaactggagcaatccctacaaacaaacaaaccggcactacaagaatctatttaatctatgataaaaaaattcgtcatggatcactgaagattcgtcacagaaatttatctgtgacgattctacttatcgtcatctattgagcgtaatagattaaatctatcgacgttttctccaaaattgtcacggatcaacacaatctatgacgttttttaaccgtcataaaacgcttttggactcatgtagtccaccccaagcccaacctttatgatgaaattaaacgtcacagatggttgccacaaggcagccaatatggcaggtgacatggtcattgacatgtgtgtgatgacgtgtcactaataacatggcagctaatgttagcaaatatttttaaacggcccattattttttaaaacggcccattattattttgacggcccattaattttttaatggcagcccattatttttttttcagaactggcctattttaaaataggcccatttcagaaccaggcttatttcaaaactggcctattttgttaacaaactatcagatcaaagcccactaaacaagcccattaagtttgagccaagcaaattcaatccaatttctcataccatctcagattcaaaactaataacagataccatctcaggtttaactaataatagatacaatcagaatacaacagaattcaaacaattaatagttcatctcagattcaacctaataacatatagtctcagatactctgctccagaatcaaacaatagttccacagcaagcaacaaaaatttgtgtagcagaacaaagctatcaacttgtccaagttcaagaatcacacaacattcaagcatacccagttttggttcaacaaacacctgaaaacacttgcagcaccaaaaaaatcgaaggtccaggttcaggttccctccacaccggcaggacctgcaccaaaaagggttgccattgttgttctattagtttctcttgataaatcagcagttgcattagcagccgcgctagcactaggattgctagatgcacatgcactagtactgaggggtaagaaagaagtcaaaagttatggtgaaaaactattgcatgcttattctgatgctacatgtgctaagttgtagctagtaaaaatcttgcaagctgaataagacaaataattagggattcctgttcctgttcttcaacaactaggattaaattaggggtgtgcatgtacagtagaggtgtcttccaacattaatttaagttttattctacctcaatggtttagcttgggagagaaaggaaattaaaatgaagtccaattggcagtataaattggtagagtttaattcgtgtatgacaaactacatgacaactagacactagtgtattttgttcatttatatgctaaaactaagattttgctaatgaggatcttgcaaggtgaataagatactactttgagattttgagaaaaacaaagtatgcattagtattgattattcaatcctccaaggataaaataactaacagaagtagatggtcaaaattttcacttgaccaacaaatatagatagatgagataccttgaaatcatggagcaaaggtttcatccatatagaaatatcagcatttgagattatagccatgatctgttaaataaggtagactacagttagcaatgtaggtgactgtaaagggtttctacataaaaaaagaaaatgttttggagcattgacatatcctatcattggtgcttttgattaattagcttgaagaactaaaatgacaaagagacactaagcttgttttcttcatttatatgctttactaagctgtagttaattaataaggatcttgaaagctgaattagaaagtagtttgacatgacaagaaaaactatgtatgcattagtattgaatccttccaataataaataactagtacaagtagatggtcaaaatttacacttgaactatctatggagagagaatatctaaaatgggtacaaatcatttaacttagtttatggttaaatttacgcgtcaactgtatatatagatggaagatctaaaatgggtgcaaaatcagctaaaagaactaatattgtcagttttcacacatgctaaaagaaaatacatcacaaattctaaaaaaattacatcacaaatacatcacagatcaaacaacatagatccaatgaatcacaagttcttaaaaacacaaagaaatccccaaatcaagtcctccgcttgccgcgggccgccgcctcccgctcgcagcccaccgcccgccacctcccgctcgctgcacaccgcccgccgcccgccgcctcctcctaccgcgggccgccatcgcctccccagcccggcggccgccgccccttctcccgtcgactccgctgcagaagatagtgtctggttcgatccatttaagacgtgggagggagatatttagtcccggttggtgatatcaaccgggactaaagatcctcggcgccctgacatcgtctgacacaaatagaaccgggactaaaaatgattaccaaccgagacttaagatcatagagtccccatgtactgcttaaaccggtttctagtcctggtttctccagtagtggaacaaggcggcatggctgttggcccatggcacaagttaattgagtttttgctaccacgaatgatactaggcaaagaatggccaatgcaattaattcaattttttttacatcaagagaatagatcaaacagaacaaattaaagaaacagaacaaattaaagggtatatgtcataattacaccctaattacactacatttacagcctacttacataatgtaagtagggtgtaactatagtgtaattactaaagtagaattggaatgagtacccaacatcttttatattgatgtgcatgcaagttaatggttcacagtgataggttaagccttactagtggaaaaaaaattgactaatttttagtctaaaatgtgtctgacatttagatagatactcccttttaaattgatgtgcacattaatggttcactgtgataggttaagcctaactactaccgtagtggaaaaaaaaactgaataatttttagtctaaaatgtgtctgacattttactccccaaaacaatactactattcgacttcacgatccctttgccggtaccacctcgctagcgacatggtactgctcagtactaccaattctgagccgtctgatctacaccaacagacgatcgggattaatttggaacctagccctgctccatcataatagcgtatggacacaggactgatgagcatcgtctttctaccgccacccgcgcctggttgccgtcctcgatcgtctgctccgtcaaccacggaaactcttacggttggatgtacaggttccgttcaagttacatccataaatacatcacaagtatatcgttttcgtttatatatatgacagcaagtttaatcaattgtattttgggcatgtctgactgaagagctatgtttatatatcagccacactcttagctgcacctgcatgtggcaggtcaaatttgaacgaaacagacaacatacagacacagacaattaaaatgatagtagacgctgttaatgttattaaatatgtttgatcgttcgtcttattaaaaaagttaagtagttattaatttttttccagtcatttgatttattgttaaatatacttatatgtatacgtatagttttacatatttcacaaaaatttttaataaaatgaacggtcaaacatgtgctaaaaaattaacggtgtcaaatatttagaaacggagggagtaatatacaagaccggacagataaattctcccgctaccctgtacgcacgcttagaccttgtttagttcccaaaacaaaaacttttcacctattccatcgaatgtttggacacatgcatggagtattaaatgtggaaaaaaaaactaacacagtttgcgtgtaaattgcgagacgaatcttttaagcctaattgcgccatgatttaacaatgtggtgctacagtaaatatttgctaatgactgattaattaattaggcttaataaatttgtctcgcagttttctggcggaatttgtaatttgttttatcattagactatgtttaataccttaaatgtgtgtttgtatatccggtgtgataaccaaacctaaaatttttccccaactaaataaggccttataaacacaactggaactttgagcgagcgatgtttttataaaaggaactttcatgtaatttttgtactagttgagcacaaggggggtggggaactgttttttgagcaattaatctttctagatatcaaagggctcaggacaaaaccactgtataaatcggaagcatatatgcttgattcactgaaactctgaagggccgtaggggacatcagcagttgaagggctgtataaacttttggatatacgacgatacatttaacaaaatttgggtgtaatttcaaaattttaggacttatgtactgtcagtgtaatttactgattttttttttgcgttgactttggacttgtagtctttattttgttatgatatatagcaaaggaaccatctcaccagattaacaacttgtcaaaagtagggtcccgtgttacttaatcatgatgtgatgccacaaacccttcacagtactgttttgcattaatacaaacggggggatgccggtctgcctgatcaggctctcgatctcagccgcctctctggtttacagtggttgcttccctttactcaccggggagcaacatataaggaaggtgaacacactcgctagttccatgcgtgttgccctcttaatttgatgcaggcagaaagctgatcaacgataagctgctagttcttccctcttggaatctcttcctcctgccccccttggtctgctacgttttgcttctccagcgtacgtcctgcctctcgtctgtacaaggtgggtttctttctccgatgaatctataaacagacgaccccctttaaacatctgtgtccttttagtgctctacactttgcttctaacactaccgtttgtgttctcatacacagtggcgaagatcaatattaatagtaaaagaggccaaatagtcaccgctgataataatcaatacgtaaagtagggtttttattaaaaaaacttgaatttcagctcttaatttggaactagtctttatttctaaatcatttccatataaactatggacgtatgaaaacaaagtggcatttatctgtgttacttctctgatctctgtcattaatcaattttgtagaacctgtttttttgttaatgggctaatgttttctagacttgctaactgcctggccttgcccatagaatcatacagcaacaggggcttgggggggggggggg

SEQ ID NO: 20252 - DNA, 5405 bp, Oryza sativa
  unsure (1)..(5405): unsure at all n locations
nnnnnnnnnnnnnnnnnnnnnnnnnnnnnnnnnnnnnnnnnnnnnnnnnnnnnnnnnnnnnnnnnnnnnnnnttataataagttttatattataagtcgcttgattttttttctagtcaaactttattaagtttgaccaagtttattgaaaaatttagcaacatctaaaatattaagttagttctattaaatctaataaaaattaatatattttgtataatgtatttgttttgggttgaaaatactactatatttttctataaatttggttaaacttaaaagaaatttgactaggaaaaaagtcaaatgacttataatataaaacggaggaagtatttgagagtacagttgtcgaagctgttatactagacagataaattttattgtctatcacaatcctttctattgcaaagagatatctcacacatttcctttgctttccccaggagcagcaggtgttgagaagagcctgggattagggaggaatgcgggaagccagcaaggcatggtacatggcccatttttttagggagtatctaaaaaaccaccgcaagttttttaagggaaaaactttcaaatctaactatagtataattgtaatataattccactataactataatataacttgtatgtcagtattaaaataatatatgcaactttatatctaacttatatagagattataatgtagttacagtgtaactacactgtagttacaatgttactataatgtaatcacattgtagttatactacaactatactatagttgcaattgaatgttttttttttgcctaaaaatcttgcgacagttttttagcaattcctttttttattatagagtaattcattaaaagaaactcttggcctccgtactgactagtgattagccagagatgtgcacaaccaaaatactgccaaaattagtagaaaaaccacaacaacatgacaaaagatgaaaatgcattttgaaagatatatgaaaaaagaatacatgaaggccatctatgcaaatgaggcactctccaagagactgcgatagtaccctcccaaagaaaacatcatatatatgtttaccaatattgtcctatcaaaaagttaggttttcaccacaacaatttcaatacaacacctttaacaagggatagataaacgttggccaccaaggcaccaacgactgcatcctattaaagctttaaaaaaccagactcgattagttgtgactatcaacagatttagggtagatcaaacagcagcgtgctcataccatgtcgcagctgagtattataactaaacctcatgcattgctttgtgaaacatatccatggttgagtttattattccgatgggatatgcagcataagaatgaactgcatgacaagataaggaagcagcttagggatgtccaattacaaccatcttcatacgacactgcatgggtggccatggtgccagtgcagggctctcatcaaactccacgctttccgcaatctattgagtggatactgcaaaaccaatatgatgatggatcttggggtacaaacctgccaggtttggtagtcaacaaagacattcttttgtgtacattggcatgtgttgttgcactgaaaagatggaatactggccgagatcacatcagcagaggtacaaaatcaataattgcattcatgagggtgttgttttaaccttgtctagatctttgtactgtagggtgaaaccttcttatatagctacgaaaaatggttttggcaggactgaattttattggaagaaatttctcagttgccatggatgagcaaactgttgctcctgtgggtttcaacattaccttttctggcttgcttagccttgccactagaacgggtttggaattgcctgttatgcaaacggatattgatgggattattcacattcggaagatcgaattggaaaggttagtccattgcaaaatccaagtgtgaatatttgtatttatttgttatttttagctttgtatttacgtgtcaactaatattggcggtgacacagcgaggcatgtagggcgtgttcaagtagaaatacttttctaccctttctcattagcttatgaactaatttggtacactagagttcgatgaagatagctcaatctgctacctttaatagaactaggaaggtagcccgcgcacatgcgcgggcaccttacttaatgtggtgaaattttcttatgaatatttatgtatgggtgacttttaataataatgcttttattatattctaaactaaattaaatttacttattttgctttgaacgttggcaccatcgctacatataaattctaaaataaaattacttgagatcgtgcagttgtgtcgaaacaatgtatgtggttcccatgagaaatttttttatattttttgactgccctgaaagatatcttgcaccccctcccgcccacaccccccaaaatagtccaataatgtcatttattactgtagttaatttttatatctattttcattctaacaatcctcctaaaatgtttgaatttttctatttagaatgagttttaaatccaacaacattttttcaatttatttcatgtccatttttttttgagatttatgttttatgaatcatccttgatatgctttgatcttgcaaattgggatgaaaatagaagtgcatataaccttgcacagggtaaaggcatatgtttaaattttctctcgtgtattgaagtaatgatcatagattcatagtatttttagtgaattctcactaaactgaagtctcttataacaaatagaaatttctagattgttctacgttaaatgtcaagaatttacaatgtactatagcaagttttaccaaaaagaaaaacatggacaatgttaagagaaattaattaagttggtagaaagtcgttagatgtctaacaggatataagtaataggtggagatccatttgtggtttttctttgacatatagataatttcaattttaattgtcagggagataaaaaaacagagagtaaaggaatggtgcatgccacacacgggcagggagggaggaaggtttggcatgtttttctaaatgattaatctaacgacctaaatgatttgtcatatgtttaagtcgaaatcgatggttggaagttttcttttcttgtcagaatttggaggatattgtctcacttaaaagagcaatgtaacagcttaaagagtgtttataagatgtataatagacttttagcaccgcatgccgcaaaggagcgggagggagggaaggatgtttggggtgtttcttttataaaaatagatccaatgaccaaaaatagtgtgtcaatcgattcaaaataatgtgtccaatgatttaagtcaaaaccaatggttagatgtgtctttttttcaaaattcctatgattttctctaatttaagaatgtcgtgtaatggcttagaagcgtttatgcgatgttaatgggcattaacaccgcacagggagggtagggaggagagaggtttgagatgttttttatgaaaaaattctgcaaccagaaacaatgtacccattaatttaaatagaaacctatattcagatgctttcttttctttgtctgtttttctattattttccctaatttaatagtattttctctaatttaatagcaccttaggatattctaagtgacagtttgagagccgctagacctagtacgtggaggtctattgtgtgttcttttaacctgtaaagataattttgatttacgtacgtatgttcgcactggacgtggaggttccggatgtggttattttacagagatctaatgatataaagcaattaatgggtccaccgacttagataaaaattgatctgaatgtgttctttttgttttgataaaataggtctaacaggctaaaacaatgggtccactgatttaatgaaaattgatggtcgaatttcttaatttattagatcatatctataaattagatgctatgatcgatcatcttatttatcgaccaattcatgtagatgttgacagaagttacttaagtctgcacaaagttgttagatatctaacagtgtatgagtaaaaaattagggtggcatattttgattttattttcttagaggcctcaagatgaatgtgagttcagcagtaataattttgtagcgttacatcatagtctatttggatcttaattattgatttaattaaaaaatacaatggtacaaataggtcataaattgaaatataatttaaaagttacaactatttaaaagattgtttatctatttatagaactaccgaaaccaataaattaatatgaatgcatggccataaaaacattggatgtcttttaccttaactaacttaactaccataggagagagaaaaaatcaacagaagggagggagggatggctaacatgcgtgcgcacaccgaacagagaggaaggtttcggactacttttttcgaagatagatctaactaaatctttttttttagaatttctaacaatttttttattttgttagagcgccacatggcagcatatgagcgtttgtaggagtgccacgtggcggattaggagtgtttataggaagtttaatggacttttagtatataatagaagatagaggcaaaattctcatgcgtttaaaatactccctccgattcattttaccgtttgggagggctaatctcttcatggtggaaagcctagttatgggaaccaccgtaaaccgataaaaactagaaatttaccataacttgaaggttttgtttaatttttttgaagttatattagctggcttactagaccttaaacactaccgcaccctagtggtaagcctgattatcatggtaataaccggcagtaaagcaaacctgcttggtacagattaaataaagcgattatagaatacttttattttctttttatgtataacatcattgaattcccctcctgtatatttgtattcagagtccctttaatccaccccctcccaccctctctatttttttattccctaacctatcttaagcatacatctgactcacctttagtattttgttgatatcctacaaaatttaaaatttcatgcaaaaaacaacaagaagaagaagaatggggataggaagtgcaatggaactccacatatttagggaggatcagagccaagattagagatccctaatggataggggatgggttgaatacgagtttcaacagagtttgctaacatttgatatttaaagtgaagaaaatatggaagcatcattttggaatattttttatttcattttttcgcattcttaaaaactatgaattaaagtataatttattttgttgtgatttattttatcaataaatatacttcaaggatgacatatatttttacatattttacatg

SEQ ID NO: 20253 - DNA, 952 bp, Oryza sativa
  unsure (1)..(952): unsure at all n locations
ttaattagctagctagccccaactcagcccctgcattaaaaaggttgttcccgcaattaattaggccagatcggtcagtcccatcgttcggtatactcgagaaaaaacgaaacggtatatttacaagtagaaaataaccctcggtcccaaaatgtaagcatttttagctgtgaatctggatgtatggagtattttataaccatctaaactacgacaaaaaatttctaaaatcaactttaaatttaaggttaaaaatttagattttagctaacaaattaaacataaatatagcgaaaagatgggtcacacacacggcacactctccttgatgtaaaatatggcaccccgtgcccatcttattgtactcttaggcctggtttagatccaaaaaattttagccaaaaacgtcacatcaaatatttgaacacatgcatagagtattaaatgtgggaaaaaaaatcaattgcacagtttgcatgtaaattgcgagacgaatcttttgagtctaattacgccatgatttaacaatatgatgctacagtaaatatttgctaatgatgggttaattaggtttaataaattcgtcccgtagcttatatgcggaatatgtaatttgttttgttattaatgaacgtaaactaaatacaaccnnnnnnnnnnnnnnnnnnnnagctcaacgtctcaacgatgtggcatcagcgagaagctgactatccagccgggcagatcggcatagaaggagccaagaaggtgacaaaaccaggccacgtgatgatgcggcgactgatggaaagtttgcttgagctggactggggcggggcgccacggtcaatttggacgcctcgactgtggcacgaacgaaggatgcgccactccggcgggcgtgcgtctgtgagactgtgaccagtgcgcggggccaccggtcagctagcccgaaattccttccacctgc

SEQ ID NO: 20254 - DNA, 716 bp, Oryza sativa
  unsure (1)..(716): unsure at all n locations
acagatgttgccgtcgcccgccgtttcccgccgatacccgttgcggtcaccacagacgcccatcagaaagaagatgtgaggataagagaaggtgtggaggggtagttgagtagcattttcatgtaaatagactaaaaacttaaagggtagtgggtcttttggggtggagtggagctgtggagcagcaaaaacctagctccacccccgtagttcattttctaggaatagttctgctaactccgctccagaaaacggaagatatggaccgtttggcacagctccggttctaggtaagctagagctgtgccaaacggggcctttatttagaattttcaatgttatcatttgatgatctccatggtcagggatgcttatggtacagcttcatcaagaagagccttcatggcatatgtgtttgaagggttaggcaacctacaagactggaatcaggtaatggcgtatcaaaggaagaatggatcgattttcaactcgccttctgcaactgctgctacaataatccatggccacaactatagcggcctcgcttacttggattttgttacaagcaagtttggtggcccaggtgtgccccccccctccccccgggtactatatgtattttgcccaagcaagtgaccaagaatgtcaactnnnnnnnnnnnnnnnnnnnnnnnnnnnnnnnnnnnnnnnnnnnnnnnnnnnnnnnnnnnnnnnnn

SEQ ID NO: 20255 - DNA, 728 bp, Oryza sativa
  unsure (1)..(728): unsure at all n locations
nnnnnnnnnnnnnnnnnnnnnnnnnnnnnnnnnnnnnnnnnnnnnnnnnnnnnnnnnnnnnnnnnnnnnnnnattggttttgcagtatgcactgaatagattgcggaaagcgtggagtttgatgagagccctgcactggcaccatggccacccatgcagtgtcgtatgaagatggttgtaattggacatccctaagctgcttccttatcttgtcatgcagttcattcttatgctgcatatcccatcggaataataaactcaaccatggatatgtttcacaaagcaatgcatgaggtttagttataatactcagctgcgacatggtatgagcacgctgctgtttgatctaccctaaatctgttgatagtcacaactaatcgagtctggttttttaaagctttaataggatgcaatcgttggtgccttggtggccaacgtttatctatcccttgttaaaggtgttgtattgaaattgttgtggtgaaaacctaactttttgataggacaatattggtaaacatatatatgatgttttctttgggagggtactatcgcagtctcttggagagtgcctcatttgcatagatggccttcatgtattcttttttcatatatctttcaaaatgcattttcatcttttggcatgttgttggggtttttctactaattttggcagtatttttggttgggcacatttttggcttaatactagtcagtaccgaggccaa

SEQ ID NO: 20256 - DNA, 464 bp, Oryza sativa
  unsure (1)..(464): unsure at all n locations
nnnnnnnnnnnnnnnnnnnnnnnnnnnnnnnnnnnnnnnnnnnnnnnnnnnnnnnnnnnnnnagctagctcaagctagcttgcgagcccaacgttagcaaccgagcggtccatgtgcgaagcccgataagaaaaaagcaagcaaaatgcttatcctatctaccctggatggagttcgatctcttgtccggctgttcgcccgttccctagtctcgaacctcgatctactacggctcctctctaaaagcttgtagatgtcgtctatagggttgggggttgaataggtgtttgtgaaagtttcttgaatcgcaacaattaaattcaacaggaccataacttcttggcaaaatggctcggactcggaacttcctgacagcttttccgctaagcaaaaaatgctgcccggaacttccgggaaggtaagacttagcctctgaccaggggtaccgagctcgaattcgccct

SEQ ID NO: 20257 - DNA, 877 bp, Oryza sativa
tcttcaattcggtcgctggcgcccgcggtctacgcagctgttcccgctcggttccggaacagacgaacggtagctgaggctttgcaagacaagaggtggattcgagacatctgttcggcattggggattcaggcaatcctggaatatctcaagctttgggacattctgcgattggtttagctaggtgaggaaccggacacgatctcttggcgttgggaaagctcggggtcttactccgctcgcttggcgtatcgtcttttcttcgcaggaagaaccagcctcgagcacaagccaatttggaagtctctagcgcccccgcgctgttggtactttttgtggctggtcgcactgaatcgttgttggacagcggatcgtcttcggagtcgagggccgtcacacccggcttgttgccctctttgtgatcaatgcgatgagatgattgatcacttattggttgcttgctcggagtctcatcagctatggtggattgctctttcagctattggtcattctgagtgtctgcctctcaatgagcactcttttcactcctggttgtgtgacagtcgcaaaagaatggccaaggaacatcgtcgagggttcgacaccattgcaactttggtggcgtggacggtttgaaaagaaagaaacaatcgggtcttcaaccaaaagagcaggacatgagcggaaattgctagggccatgacggacgaagcagacttttggcggttggctagagccgcgatcccggccatggcgacccctatgtcgggtggaaggttgccacatttggttagaaaataaggttttttttcttcttcctccttcttgtatctggtccccttcgtgttttttgattttttcggtccgctctgtaaat

SEQ ID NO: 20258 - DNA, 8208 bp, Oryza sativa
  unsure (1)..(8208): unsure at all n locations
ttgctttagtcaattattactcaccgaatcaccgttgttagggccaaatactatcacactgtaagtcaccatctggagcatgcattgccataggattctactactagtagcaggcacacaatcaacgcaagtacgcaacgacaggccacaactatcgttacccgtcactgccgtcgctgtcccggccgaagaacagatcagaagctgctagtaaagctttatgccggcacccacgcgaaagcccacgggggcgggcatccgttcggccggggccggggcagcagctgcgcaggggcgctctgccccggattcccttcacacgcgcatccgcgcgcgaggccgcaccaccggcgcgtggctcggcaggtggaagggaattcgggctagctgagcggtggccccgcgcactggtcacagtctcacagacgcacgcccgccggagtgggcatccttcgttcgtgccacagtcgaggcgtccaaattgaccgtggcgccccgccccagtccagctcaagcaaactttccatcagtcgccgcatcatcacgtggcctggttttgtcaccttcttggctccttctatgccgatctgcccggctggatagtcagcttctcgctgatgccacatcgttgagacgttgagctnnnnnnnnnnnnnnnnnnnnggttgtatttagtttacgttcattaataacaaaacaaattacatattccgcatataagctacgggacgaatttattaaacctaattaacccatcattagcaaatatttactgtagcatcatattgttaaatcatggcgtaattagactcaaaagattcgtctcgcaatttacatgcaaactgtgcaattgattttttttcccacatttaatactctatgcatgtgttcaaatatttgatgtgacgtttttggctaaaattttttggatctaaaccaggcctaagagtacaataagatgggcacggggtgccatattttacatcaaggagagtgtgccgtgtgtgtgacccatcttttcgctatatttatgtttaatttgttagctaaaatctaaatttttaaccttaaatttaaagttgattttagaaattttttgtcgtagtttagatggttataaaatactccatacatccagattcacagctaaaaatgcttacattttgggaccgagggttattttctacttgtaaatataccgtttcgttttttctcgagtataccgaacgatgggactgaccgatctggcctaattaattgcgggaacaacctttttaatgcaggggctgagttggggctagctagctaattaagataagccctttaatttgttctctcagtgattgggaacagcattaggaaacagtaaactgctactaaaatttcctgagcatgatgggaccggtatgtgacatggccagtacaatgatcatataatccgctgagatcgatcgctggaggttctgggtctcaggtcactcagccgaaacagtggaggaatcgattcctcaggataaccccgatcggcccggaacgaaaagggttcacgccctcacgactttccatcaggaattcaggatagcaccttttcggcacacgtcgtattcttaccagttgaaatctaagcttaggcagttgttccagttccagtaggagctccactgtggacttcggacttcaagtgcggatgcggatcccgtgagaagtgaagtgtttgccgtcagataatgctccaaatatgtaatactaacacactatttatggaaaatgaaggatacaatgcatacaatcattttagtgttaaccacaacaccatgccatgccggtagacgttgacagggatcgacgattatttgaacctagctgattaccgtgcaaagctgctcggcctgcatgtcgaagaaattaaacagcaaaaacaaggaaatgaacggcaacaacaaatgggtggttgagaggcaaacaccagctgctactgtggttctaatgcgtgcagctaagctcgcaccacaccacacaaccctgtgtacgagacatcattcagtggaggtcagggaaagaacagatcgcgacactcgggttgatcagaatggaccaaaacaaagttgcagataataagaggcaaacccacgtgttggttaggtacatcttttggcttttgtaccaggggcttatcgtcgtccttacatctgggattaatttatttccaaatttagaaactagatgcccttaaattatttctttgatgtgggagtatttttccatccagggttcatttcttaattaatgcacggaattaaatagctgtgtctatccagagtatagatgtcggaagctcacttccatttgtccaaagaaaataccatattctttcttctttgaacttgtcataggtggaaaagcatttcaacttctttgttagctataagaaagagattatgaaaattctctatttctccttaaagtcgaccacctctcaaacttgcccctctaaagttgttttttttatatgccactttgtaagtaatatttatccaatgtttacccctaccactcttctaaccatagtgtccattttaccctttttcttcctctcaacctttttctcctttctttgccaaactttttcctccattattttcttcattactccctccatcccataatataaggcatacatgcaaacatgcaattaattatgatattttctccattaaattattacttttttaaatcctccactcttatgctatctaatcctattggatgcatgcattatatttattaggatgatccaaactataagatgataataattatttcttgatttttgggttaagaatggttgtgccttatattttagaatggagaaagtaattagcatcctgacattggtctcctctttccactcaaccatggccctcgtcctcccctttaatcaccctttccttgacaggtgcctactccctcctcaaatggcggtgaccctcctatttagctcgccctatttcatcttggcctaatactaacccttacattattaaaaaaggaaaaacgctggataagagagaagagctctcatatagaaaaatatcaagagaagtaaggtttaaatttgggtcatctagcccactacttgtgctagtcagaaagaacccaaaaatttctcaccctctcaccattcattgacaattctctttaaccctctttatcacacgacatcgatatatacaaaacataacgagagatttagaaacaatcatagtgcgataagacattgggtaataggaacatgaagacaaagtgaagtaagaacaacaaaactgtttaaaatcattatcctgtgctattgaatagcacaatactgataaaaactgcattcgcagcgggtgaaagagagaaaatttgtttcgttttccgctcgcacacgcttcccaaactactaaacagtgtgttttttctaaaaaaatttctatatgaaatttgcttttaaaaatcatattaatccatttttaaagtttaaaatagttaatactcaattaattatatgctaatgacttacctcattttgcatatcttctcaatcttctcttttcttctcctcttaaactcagagcgcgacaaataaaagagaaagctaggttaatatggaagtgacaaataaaagatactacatagtgttccttcctttttattgttttggttttcttttacggaattatatatccttttcaaatcacacatggtagcgccttctagaattcgatggatcagtcaccaagtgcatcgatgtaattgtcttgttggcagcaaatcaaccatcctgacggcgatggagatcgtgaaattgaaaaggaatattagcgtacgtacttagtgccgatcatttagcgtttctatcgaaagtgcggctgatcgagttcaaacatgtggtaaaccttttttcatgacaaacaaagcaataaattaaaataccacaatgtgggaggaaaagctttcttcagtgtttctcgtggtgagttaattgtgatgtttactttcgtggcgagttaactgtgacaaatgacaaggcaatgaccaatagattaacaaccaaattacaaaaatccaaccgaaaaatgacagtgacatagctaataaacgcaggcagcatgtctaattaattatccaggtggcgaactggggatcgcacattgctagctttatttctgtgtcttccgcctttttatttttcgaagagccttgacacccgtcagagttgtgttgtatttactgcttctatagtgctcaatttcaacacacaaaagtttttgcataatcaggaaaaataacatttctatatctatataggagaccaactaactgttatattttataatatatttcaagtttatcaaaatttaactaatcgtctaatcctgagatgatgtgatactctgaaatgtggatactgttttggaaaattattaaaagataaatttatacagcgccaaacggatctcctgtcgattcatacaccagtgtaattaatcaaagctgcgcattgtaatctattggatttgactcagaaaccttaccctttcatcaatggaatcgcattatagcaactaaagctagaggtatatatatatatatatatatatatatatatatatatatatatatatataatataatgccccctcacaagtaataattaaaatatttcaattaatctgcccaggttgtcggttgaaaggcaaaccttccgaatcgactgaatctgacttgctgcttaacgaactgtttaaccacatggattagtgtgataacatgggctaataagtggcgatgtactataacgcacccattctctggtctggctgattacgttgtgtaaacaaacactatttttttctaatatattgacgtgcaaatcttttgcgcgttcgtgaaaagaaaataacacacccattctcgacaggatgagcgtgagtgcagctgcgacctacccctatgcttcaatttcttttttgacagttgcataggtcccttttatctttctgaataaaatgcactgctactagttactactattaattattgctaatactttccaatacataggtgatgaagcaagcaccttggcagtgtggaacctatatgtatgtattttatttcttgctgggcaataatgttcactagtggcatgtatagcaggttttttctataatcttggatggccgttaaatggtggaattgtacatatacatgcaactgcatatggattaggaaaaagttcaaatatcctctaaactttagatgaagtccgtctagtaccttgaactttaaaaccggacattcaaccccctgaactttgacataccatccatattacctctaaggtggttttggagaatggttttgcatattttggaagcttaaacaaacaattttgaataactaatataacatatttacatatcatcagttataagtcattaatttattcttacacattgatatcatactattatcatgttgatatttatttgtgagtgagagtaaataaagagcaaaaagaagtatttaaatcaaaattttaatatgtatgtctaaagcgtataacacgtgatcaaactcatctaattatatataaattagataaaaaccattatgcaaaaccatcttagtgggttatataaattgtattgtaaagtttataaattgtattgtaaagtttaggggtggaatgtccggttttaaagttcaggttgctagatggacttccatctaaagtttaggcggttatttggattttttagtcttttttttcgaacgattaaggcctcctttaatccttataaaagtaaaaagatagaaaggctcttaatgttcttctaaagtaaagtgctaagttgtgcttattttttaagttcatgtgaacttcgacgttgaagttttaattgtagttttttttcaaaacgaaattaaccaaacaaattcaaatgttgtttatttcacacttgtttactgatagagttcaagttacccgatagaattcaagttttactatccacaagcattacatacacatggactcttttcaataggaatttagttatgttagggatttgctgatgtctgtctctttaagcactcgcaagtatgcatatgtgacgtgtgtacgtggtggtgtatatgcgtgtgcagcttccgtataatcagaaaaaagatataaatggagaatagtcgacattgttaagttcgtgggacttgacaagaccactgtagattagtcagacatgtaccaagacttgtagaaatactctctccgtacatacgtaggtttatgtcgatatttgaacattcgtattatttaaatttttttattgtgattaacatttttgttgttattagatgataaaacatgaataatactttatgcatgacttttttattttttcatgaatttttaaaataagacggacggttaaacattggacacgaaacctacgtctgcacttaaaatgaaacggatagagtaataaacacgacacatagatgtgacccagcagaatataacatggttagaattggtcaaccttagtaccattctacaatttaaaccacagagacgaatgtctggactaggcatgcaataagcataagctatgatttcgcttcaccgtatcaggtgaagaggcctcagctcaccgaccccacctgtcagtggccaaagctggagcccctcaagaatctatccatcaatcctgatttctttttcccactgagagaaaaacaaaaggagggaatattgtggggagagaagaaaggccaagaggagagggaaggggggggggggggcatgagataaatggccaataggaaaagttgagaacaaatccaaaccaaccaatcccaatatccacataccacctctccattggaccacagtttctctctccccacaaccaaaccaaaactaagaaacccctgctgctctctgcaagaactccatcaaattccccagccaaaaacactcagataattttttttattagaaaaaaagaaaggagattagccagccagtctgctgctccatctcagtgctcacgcactcactctgaggagtgaaatccaatccagcccactccggagttcctggaaaatcctcgcgaagtccaagaaaaaaaatattaccactgccatttcttggtttcttgatagcttctcctagctgctgccgcccaatcatccgagagagcgagcaagtaagaaagattgattgattgcttgattgggagtgtcctttgggcgagctgtggtgggatttagcggcatgtcagcgtcgccgtcgtcgatgagcggcgccggcgccggcgaggcgggggtgcggacggtggtgtggttcaggcgggacctgcgcgtggaggacaacccggcgctggcggcggcggcgcgggcggccggggaggtggtgccggtgtacgtgtgggcgccggaggaggacgggccgtactacccggggcgggtgtcccggtggtggctcagccagagcctcaagcacctggacgcctcgctccggcggctcggcgccagcaggctcgtcacccgccgctccgccgacgccgtcgtcgcgctcatcgagctcgtccgcagcatcggcgccacgcatctcttcttcaaccacctctacggttcgattcctatatcttcttctcgcactgcgacctcttcttggtcaattcttccttttttttttaggctctgctattatgattcagacttcagcttagagttccagttaaatttgttcgatatttttccttccctcttctcgtttaacaggatccattgatccagaattccagataggtactatatctcacaaagggaaaaaaaaagagagactaggctaagcttccacgaacagcatcttgtgtgtctaccatttatggatatttcgcaccttaacacccttactcttcacgtcaaagagctccaagtatggagagcatctaccttagactttcccatcaaacactccctgaacactcggtcaccgtctccctctttaattcccaaaagttcatgcagccaccaacctcctcacctcctcatagcctatccaagaactccattaaatttagcagttggccaaggattcaggaatggtgtgtgtgtgctctggtttactgttttagcaacaagaagaatggttaatta

SEQ ID NO: 20259 - DNA, 798 bp, Oryza sativa
  unsure (1)..(798): unsure at all n locations
nnnnnnnnnnnnnnnnnnnnnnnnnnnnnnnnnnnnnnnnnnnnnnnnnnnnnnnnnnnnnnnnntaaaaatgcttacattttgggaccgagggttattttctacttgtaaatataccgtttcgttttttctcgagtataccgaacgatgggactgaccgatctggcctaattaattgcgggaacaacctttttaatgcaggggctgagttggggctagctagctaattaagataagccctttaatttgttctctcagtgattgggaacagcattaggaaacagtaaactgctactaaaatttcctgagcatgatgggaccggtatgtgacatggccagtacaatgatcatataatccgctgagatcgatcgctggaggttctgggtctcaggtcactcagccgaaacagtggaggaatcgattcctcaggataaccccgatcggcccggaacgaaaagggttcacgccctcacgactttccatcaggaattcaggatagcaccttttcggcacacgtcgtattcttaccagttgaaatctaagcttaggcagttgttccagttccagtaggagctccactgtggacttcggacttcaagtgcggatgcggatcccgtgagaagtgaagtgtttgccgtcagataatgctccaaatatgtaatactaacacactatttatggaaaatgaaggatacaatgcatacaatcattttagtgttaaccacaacaccatgccatgccggtagacgttgacagggatcgacgattatttgaacctaggtgattaccgggcaaag

SEQ ID NO: 20260 - DNA, 854 bp, Oryza sativa
  unsure (1)..(854): unsure at all n locations
aggcttgctctcgctggttctgtgcgcgcagaaactagcgaggggaatgcagtagtgcaacgacaaaagtagagggtggagtattgtacaattgtgtctctttgatacattcaggagctaggcccttctttggttatatgtgtgcagaggtaaatgagaggatgatgaaaccgaaacacaattacttccgttgatgagcatcagttactggtaattagccaaattaacaccatcaatcaacagtaacagtcaagatttgtattgctctctaattgagtcatcaatcctctatgttaactaagttgataccccgcgcgttgatgtgggtataaaagagtaattcccagtgtgcaatattagcgtaaataatagagaatttatcttatagtaattatatatcatcacatgataggtggtggtataaaaacatattctgctactggccaaaaaaattcacaaatataaagataaagtctaaaaaaagttatgtttgcttatcaaaattctgaatgagagaaacaaaatcatataaaatactgctggaggtatagatggccataaggcccaaggcccgatggcctggcacaagcacatcacggcccgattggggtcgtgcctaggccggcctgacccgacagctgggtcgtgcctgggccgatgccttggcacggtgggccattccggcacggctcgatccaatgaggagggaagaaaaatagtttagggactaaaattagacttaatgcagccatacaattcatggcccaagagagaaggaaaccaaaaggaaaaagtannnnnnnnnnnnnnnnnnnnnnnnnnnnnnnnnnnnnnnnnnnnnnnnnnnnnnnnnn

SEQ ID NO: 20261 - DNA, 750 bp, Oryza sativa
  unsure (1)..(750): unsure at all n locations
cnnnnnnnnnnnnnnnnnnnnnnnnnnnnnnnnnnnnnnnnnnnnnnnnnacaaaagagaagagaagagctattagagccatacccgaactcttccgaaggcttccagactcctgatttatactctattcctattccaccaactagatactactaaactaaacttgagagaaatgagagcccctgagcccctgattcatatttaatacatcgtaaaatctaattcgagagccatctcgttttagcgttatcgcacgacgctgggagagtcgtcctattgcgcgcgtcatcgtggagtccatctgcgtgggcctcgcagtcacatgcgtggctttctggataaggatcgagattaaaccactccaaccgcacatcacacgtaattcttgcttcaaagagagtcagagagagagagaggatggccactggcttctgcgttggccggtggtgatggcaatgaggacggcgacgacgtatccaccaagcggagaagggcgacagtgagcacgggggtctccgtcgttgccgtcgtcaaggttgaggtaggaacgagtgggggtgatgatgatgacgagtgcgaggcggagcggtgaggcgcactgtgtaagcgatgtactcgcatctcagcatattgtaagagaggggtgaggcaaggtgaccccctctcgcctctgctctttgtactaggagctgagcttcttcaggttattgtcaatagagctcatgtcaatagagctcatgttatggttac

SEQ ID NO: 20262 - DNA, 3268 bp, Oryza sativa
gactactatagggcgaattcgagctcggtaccctaatgttctaaaattggatatcaaaatgtatctaatcgcatctgtaatggctgttggccaaccgacgactcaactcctctcacacgagcacacacacaagaatgaaaggcaaacacagtggattagagaattttggtgctgcacaccagcaaaccacaacactcaccagcacgctcctgttaatcaccacacaaaacacaagctaatacacacacattaagccatgttctggccgcactacccagccaaacactgcatggcttaaccactaatcacttccctacatgcaggccacatctcttgcatatagagcaccacactcacacgttcagttgctggtatccaatccgccgatgcatgcgtccatgcaaaacagattgtgacctcttcctgctcctgaacttgcgccatgactcaatcgaccaaacgcctggccacacacatatgcaaaactaattctaacacacacacacacgtacatacacatcatgccaccactcttggccactaccacgccgcacgatgagcatatatactactaactacagcttaacacaaccaaacactaaaacaacaagattaatttctaacaatgacaagacccagaaattttcactacgattttacatcttattttcctatgatattttggacagattgaatgcctagaaagtaggtcgttcaggtgccaagattccacccactttttcaagtgatttaatggtgtttatttcgttgctattctcttgacacatatcaagtctttgactcctaagttttaataaaataaaatctctgattcctgcttactcattgtgaaaaaattatttaatttctttgttttttggagtatttccgagcacatcaagacgcgcgccttaataacccctactcaatccgaatccaccctccagctatatatggccatttgggcggcacggcccagcacggtgctggcccatgtgctgaagcatcggcccaggcacggcccaacacgactcgggccgtgccgagccgacccgaagtcacgacagcccattgcgcttcttcataaaaaagtctaattttcatcccttatttctttgggccatgtctgaatgattgtattcagtctattttgctttggaaaaagtacaccgaaggacctcggacgaccggttttgtattgttaagggacctcgtatatctggtttgcggttcgaggatgtttttatcccaatgacaagttgagggaccttcggtgtactttttccttttgctttccttctctcttgggccatgaattgtatggctgcattaagtctaattttagtccctaaactatttttcttccctcctcattggatcgagccgtgccggaatggcccaccgtgccaaggcatcggcccaggcacgacccagctgtcgggtcaggccggcctaggcacgaccccaatcgggccgtgatgtgcttgtgccaggccatcgggccttgggccttatggccatctatacctccagcagtattttatatgattttgtttctctcattcagaattttgataagcaaacataactttttttagactttatctttatatttgtgaatttttttggccagtagcagaatatgtttttataccaccacctatcatgtgatgatatataattactataagataaattctctattatttacgctaatattgcacactgggaattactcttttatacccacatcaacgcgcggggtatcaacttagttaacatagaggattgatgactcaattagagagcaatacaaatcttgactgttactgttgattgatggtgttaatttggctaattaccagtaactgatgctcatcaacggaagtaattgtgtttcggtttcatcatcctctcatttacctctgcacacatataaccaaagaagggcctagctcctgaatgtatcaaagagacacaattgtacaatactccaccctctacttttgtcgttgcactactgcattcccctcgctagtttctgcgcgcacagaaccagcgagagcaagcctccgaaaccacgccccgctgcaacgtttgcatggacattctcactaatcgtctgcttcatcttatttctagtgttgttcacaagaacaaggactatatccacgatggcgaccgatactgggaacgtcaacaccagcaccgctgcttctggatttgggggattctcttttgggtatgtgtatctacacatggtgttaagcatgttccagatgatttagttcttgttagcacgaacatgtttagcactacatttggatcacttttatgcttaaatgtcatatttattcttttgtttttctagattaaattacgaagaaaaatgactagattttcaccagcaaataggcagcgttgccgttgatggggctggaaacccggtggatggcagtggctgcttggatcatggatttgccttgaagtggggccttcgctttccaaggcaggtggcttcagtggcaccggcggtgacggatcaaggagacaaggattcggcggcgatggctgctctccagcccggatctcttgttttgatcagtttcttttttttccttgtagttgtatcgtttggggattttgccggatgttccataaacaacattgaacagaacatcaacacactacagaaatcgacaagttgggggaggacaggctgcggcggtggctagtggtgacacacatacggatgcgagctgatgaaacgacgtcatgcttggaataggcctgaaggtgatggtgtcgaccttatgcccatgagatcctgaggactaggaggtcgtctctatctgtctgctttacttagttcagattgtactcctgttaaatgaactaggaaggtggcccgcgcgtatgcacgggcacttatattattgaaaggtaagattattgtttgttcagaaattttgtcttatagattaagggcaaactaaagtttagataatattattttataataatttaagggttctatttttcttaacgtatcttaaaaaaccattcacaaacttaagtaggagatggattaagtacttacgatttttgaatcatgtttcttttttctcgaataaataaaaaactattgctagttaattatcatataatccatctatacacataccgtgtagtacgaccacaaatgaaaaatgcgagtgcaagatactcaaaattcttttgattaaatcgtctcatcaaggcgcatgat

SEQ ID NO: 20263 - DNA, 2427 bp, Oryza sativa
gtctctatctgtctgctttacttagttcagattgtactcctgttaaatgaactaggaaggtggcccgcgcgtatgcacgggcacttatattattgaaaggtaagattattgtttgttcagaaattttgtcttatagattaagggcaaactaaagtttagataatattattttataataatttaagggttctatttttcttaacgtatcttaaaaaaccattcacaaacttaagtaggagatggattaagtacttacgatttttgaatcatgtttcttttttctcgaataaataaaaaactattgctagttaattatcatataatccatctatacacataccgtgtagtacgaccacaaatgaaaaatgcgagtgcaagatactcaaaattcttttgattaaatcgtctcatgaaggcgcatgatatagtaataaagagagggaagcatatgcatgggaaaaaaaggaagaaggagaaaaaatgaaaaagggaggggaagcgtacgtacccatgcacgtaggtccgtacctatgccgcgggaggagagatgggacctcgtactatttagtttgttctaagatcaatttaatctaacggtttgtaatattggaccaaccgatttaagtgaaaatcaagaaatagatactttgtttttttcttagaatttctaatatttgccctaatttattagagcaccacgtcgcagcttgagagcattttaaggaattttaaatgacttaacacatgtaattagaatattaactgtgcaatatatatgtatgggacatatggtaatatttgttccagtttcgtccatgtttatatacatgtagagtgaaattaattttgtggcttgcaagcctctaattaatagcaattaattttgacacctatttacaattgttcaaagtaactcttacatattcatcttacgactttaataatttatcaccatgactcgcatgaaaaaaaaaatgtagtacttaaggtttacgatagctgaaattgatgaattatataatttatgtgatatattttttttgaaaatggatgaattatataatttatgtgatatttttttgagggtataaatgaatgaattgacttctaaaaagttagaatgtttttaatttaaagaagacactatttagaaacttggaaagcatgcaaacaaaattccaaaatatggaatcgggaaaaaaagagagggccttaaactccctttatcacccttgtcgtagtaagagttctatcaatattcgtcaatattgcgctcacatttataacataatgattcatttcacctatacgaacaaatagtacaaaatctaaatatgacataacacagatacattataattattatgtaatcaactctcggtttcaacttaaacaaagctaattagtgttgagaaaagcacaatccatggtacttaattattctctcactgcatcacacatttaattttcttttcatgttattaacaaaattaatcatctccatatatgatttgatttgtggcaaagtggtagctctacagcggttgtgatcaccttatatgtctcagacactacactttgtcacacatgcgaaaggcaaaggtgcatacgtgtattgtgcagtgggcaaaaagagaatttcggacgctttatttattagcaaacaatagatccgatgattataataataagtccaccagttctagtgtaagttaaattagttaatatagattttaaattgttaatttaatgggtacacaatatagtggtgtagaccttattttgaaacagtgaataatagaccaaggtaatgaaaagtagatctgatgatttatgtaatggggccatcaatttatgtgcatgtataaattaattaatatagatattgtttatttaataggtacatatcaacataatttattttaaaatagtgcattatttgaaaggaagattctttgttatatgatggtagattctttgttttgtaaaattatgattatttaaaaaatatatccattatatatatatatatatatatatatatatatatatatatatatatatatatatgtaaaaaggaaaaaaaggaaaagaaaggaagcatacatacatgtacgtacgtatatactccacctgccacctgccaacgcgcgggaggaggataggtgggacccatgatatttagtttgttttaagatcgatttatctaacggtgtataatattggactcaccaatttaagtaaaaatcaaggggtagatgtttttttttcttagaatttctaggattttctctattttattagagcatcacttggcggcttgagtgcgtttaataggtaaatgtgtaaaatttattttaaaatagtgcaatatttgaaaggaagtttctttgttatatgatggtagattctttattttgtaaaatt

SEQ ID NO: 20264 - DNA, 2155 bp, Oryza sativa
ggggtagatgtttttttttcttaaatttctaggattttctctattttattagagcatcactgggcggcttgaatgcgtttaattaggtaatgtgtaaaatttattttaaaatagtgcaatatttgaaagagagtttctttgttatatgattggagattctttattttgtaaaattatgattatttaaaaaaatatccattatatatatatacatatatatatacatatatatatatatatgtatatatacatatatatatatatatgtatacatatatatatatatatatgtatacatatatatatatatatacatatacatatatatatatatacatatacatatatatatatatatacatatatatatatggaaaaaagaaaaaaaaggaaaaaaaaggaaaagaaaggaaggaagcatacgtacatgtacgtatgaacctgccacctgccaacgcacaggaggaggataggtgggatccatagtatttagtttgttttaagatcaattttatctaatggtgtataatataggacccaccaatttaagtgaaaatcaaggggtagattttttgcttttttcttagaatttctaggattttctctattttattagagcgccatttggcggcttaagagcgtttgtaggaagtctcatggacttttagtatataatagatagatagatagatagatagatagatagatagaagatagatagatagatagatagatagatagatagatagccagattttgtttggttactggtagtacttagtacctcgagaggtacaacaaacctcactatcacgagttgttggatcaaaccataacatggatattgtgtagctcaacgtcccaccactagacgttgttgtgtaaagtatccatggctggccggacaccctactaaatagcgtccttcctaattttctaattccctccctcgatttacttatttttattcatgcatcattgattactacaaataaaaactcagttttccttagaaattgcaagaaaaaacacaaaaatatattagagaacgactcaaaggaaaatatccattacgttatacctctttctaacttttcttcagtatctacatgaatttagtcattcctaaggaattaatttgataggatttgaaaatatccaaccctttgcttttaagtagcaaattatttttttgaatagaagggcaggatgactcactacaagaaatatgaccttctgtgatgaattcctcatgacatcggagctactcatcattagcacattccattttatgacgattagtatgagatggggtggcttagtgacgaaaaaaaggtgttcgtcgttaaataccaactagaaatcgtcattgtgacaaatattaatttgtcataaggggcaaaaagcaaacgttacggatttatatatgcatttctagaattaataaaaaaactaaaattttcctttaaaagtcatggccggaaatatttttgtaatattctatgtggtctaaattattctctaaaatttttcgtgaattttcgaagctcaataactagttttaattccccaaatttcatttaacctactaaaataaatgaaaaataaattaaaatccctctctctatccttgggcctttttcggcccatgtgtcactctatccctccctcagcccacagtctctctctccctcctcgggccggcttcaccttcccctcctcccactttgggccaccggcccagcccttttgctcctccctcgctgagaaatctattttgcctccctcctcgcaattcaaataatttttcaggtagtaaatgatttttaatgaaaaagttgtgaacaacaaagttgtataacttatcaggatctacaacttttgttttggtcattttgctatatgactttgtttcaataatttgaatttgaatttcaaattatgacaacttcaaacaatattttcaaatactaaatgatttcaactcaaaaagtcatcaacaacaaagttgtatgactcacaatatctacaacttttgttttggccattttgctatatgactttgtttcaataatttgaatttgaatttcaaattatgacaacttcaaacaacataacattgttcacaaaatttacatctggttttatgtaaatt

SEQ ID NO: 20265 - DNA, 739 bp, Oryza sativa
  unsure (1)..(739): unsure at all n locations
nnnnnnnnnnnnnnnnnnnnnnnnnnnnnnnnnnnnnnnnnnnnnnnnnnnnnnnnnnnnnnnnnntcataggtgggataagcctcatcaacaagagttctatactctgaagatgtaaaactactgtttcaggctctctatactacagtaaacgagattggcgcaaggcttctgcattacaaggccatgatattaccaagtacttgctagaaacagtgagtctccaatgtgcgatttcttgaattcttttgttgcaatgttgttgctattaacaagttgatgttcaaattgcagtggctagatatattgagatgctactttgtaataattagttgtaactctttttgagtagaggccgggatattatattttattattaaaaaaagatatattgaggtgtatgatagactgaggcagaatggcagaggagccaatatgtgccaaagttcgaagaatacatggagtgtggtgtgacctcactcacgcatggagctacagtgatctcgggaatgttttttatcggagtaaagctcacggacgacataatcaaacatcaagaatacaacgaaatatttaggctggtgggcacttgcggccgtctcctgaatgacattcgaggcattgaggtactttctctcatatttttcaaaattttattagaagatagagtacattctcatctaataaactgcatctttttttataaataacagcaagcaattttatcagaaaaatacat

SEQ ID NO: 20266 - DNA, 746 bp, Oryza sativa
  unsure (1)..(746): unsure at all n locations
nnnnnnnnnnnnnnnnnnnnnnnnnnnnnnnnnnnnnnnnnnnnnnnnnnnnnnnnnnnnnctcctactttaacttagatttggtacatcatttaataaggagtatcatagtacttcttttcaaatattaacatatgctaaacaatctaattaaaattataactattttgagacagaagtagtaactttttttcccccacccctaccacccacacctttgagaccaaaagacagtgagagtgcttctgccagtcatccggggtactggatcgggctatacaggatttgttcaatctcaccgtcacgcgcgttgtcgagagaatttgtacttggttatagtttcttcttcacacttatacattgagcgcatcacagcggatttgatttgcatgtactgataacgattccttcttttgatctggaatatcttttaaaaaagaacagagtatattatccaaattatataatcccatgagtgtcaatgccgttgggttttgggggcaataggggcacacataggccccgcacggtgctgcccaatccaatcatttgaccattcgtacagacccataccatggacatactttcctcgtaataaaaaaaatcaattatctacgtatatagttaggattaattttttagacgaagatagtaaatacacacgtgaggtggcggtaggtctcagcaagcaaacaacggtgagggtggactccactactccaacgtcccatccacggcgagagcgg

SEQ ID NO: 20267 - DNA, 284 bp, Oryza sativa
cgagcgagcgagcattccgaactgactgactgactgggtgagatgatcgccgtgcagatccgggtcctggggaggcgggacgcggagttctccggtgtccacgccgaggtctcgccacgagcgcagcaaatccgtcgccaccatcttctcgccgtcgtctcccgaggtgcgtctcctgatcgtgcgtgaaacttgtgtttgatcggcagcggtggtgagcggtgacaggtgacgcactggctggtgcagagttacggcggcgtcgtgatggagatggaggagaa

SEQ ID NO: 20268 - DNA, 625 bp, Oryza sativa
acacctgtgacgggtgacttttttctacccgtcaaaggggaccaaacagctgtgactggttttaggtttccaccgtcaccagacgtccaaaatcacccagaaaaaaaagaaatgcctcagcccaaatgtacgaaatgaagaaaaatccaattcatctcaagatgcacatgattcaacaactttgtattttaaatcaaatacatctcaacaaacaactacacatgaagcaatctgacaatatacatcacacaagtatccatgtccattttaacaaactacacatccacacaagcaacaaacatgagcaaatcaagcacaaacaacatcaagcacaaacaaatccggcggccggcggtcggtggcggaggggaaaggccgcggacgctggatccgcgtcccccgacctcgtggaggccggatatggcggtcatcggtcggcggcggaggaggcggcgtccggcagtcggggaagaggttgtggaggtggcgaaggtgtcggtggctggatccgctgtggcgtcggcggccgggaggcgagggaaggcgccggcggcagaatccggcttcccggaggccaaacttggcggcatcggcggccgggaggcgaggaaaggcgccggtggcc

SEQ ID NO: 20269 - DNA, 1066 bp, Oryza sativa
cttgcttatactcaatattatcttggagtggagctcatgatcaaccagagtgatctaaatctaatcttgtcgatgcctagcttaaaatgtgggctagaggttggacatggcaaatttgattgacatgctaccggcaagattggggttataaatgggatgggacttggccaccaaatataggtgctgcacaaatgatttatgcaaggcgcagatcaccacttttaatttgtgtgactaaattttaaattcctaaaaattccatgttaatttataattaatatagcttatgtaattacattgtttgggactaatttgatgttagcctagtcgacaactcatcatctaatttgatgtcctaaagcaaattttgtgttgcgttgtcgatcggttcgtctaatgatgattgtaagccgtacaatttactaaaagataatttatgggtcaattttttatgtataagtcattagaaatttaaaagataatgctaaaaaataaagtacaataaaaaaagacataacaacttagagcaagtataataataggttgtaggccggctaaatgctgaggtggagaagagaagagaggagaagcgggctgcaaacttacaaccggcttggacaccagaaccaagaaactctgtgagagagacaagtgggctctgtattaattataaagagctaactattacaaatcggctgtattattagccttgctcttgtaagttgcagggcaaacgatgggggaggcttaaaatttaatggtgtggacaacctttaagtaacatggtccaatttcaactacaacagtattctccctaacaactcattttaatccgatctctcctgaaacaaatcctggtgacatgagacaatccctatgcagatggtcagatttcaacttcaacagtataacccctaatatcactcgactacattttcatcctcttagaattttcaaaatgcaaaacaccgtgttagtgacatcccactatcccaatcgatcaaaaccctgcctccttaacctgctccatcagcgcaccccacacgcacttcatcctttaaaagca

SEQ ID NO: 20270 - DNA, 819 bp, Oryza sativa
  unsure (1)..(819): unsure at all n locations
nnnnnnnnnnnnnnnnnnnnnnnnnnnnnnnnnnnnnaaacgctgcttcgttttgcattctagtacccaaccctcactcccgaacacaaccgtacgtctgccaatcgtccctctatgagactagtccccactcccgtagtcctggacccggtgcggatgtgttcggcaccaacccctcactcattatttttcgcgcatgcttttcaaactgctaaacagtatttttttaaaaaaatatttatatacgaaagttacttaaaaaatcatattgatctatttttttaaaaaatagtaaatacttaattaatcatgtgctaatatatcgctccgctgtggcgaacacacccgaattcgtcgtcatcctcgacgacttcgacgacggcgacgccaaagttccttcgcctagtcgtcaaacgccaaggccaaaacttacacgccaagaagagctagcagcagatcattaaacaaaacggcacacctcaccgacaatccaatactcctacgaaataccgatgcgaggattatactagatcccaccgggcccacatgtcagcgaccctcgtgcgaccccaaaggcgaggagcggaggccgccgccctccggcggtgtgctctccccggccttgcgcgaaaagaagatggcaggattaaaatactctaggatattccagagcccccttatccagttctcgtcactggcacgtgggccccaccgtgggccccacgggaggaaaaggatgggggaccgcacgagtttttacactctcaccccgaacattacacgtaataaaattcacatataccccttgtgggggttttt

SEQ ID NO: 20271 - DNA, 4779 bp, Oryza sativa
  unsure (1)..(4779): unsure at all n locations
nnnnnnnnnnnnnnnnnnnnnnnnnnnnnnnnnnnnnnttttttttggcctgtgggaaagtaggggagtttgattactctttgttagcttagaggtctgccctggtctgatttttttttctttttttaagaatcgtcagctcgttttgatgaatgtcgattcctccgactgttgatgacgcgcgcctgcctggtgttaaactaatcaaaaaaagaaaaaaaaaagaagagccttcatctttttgcacaaaacaaaaatcatactcctacatgagttcagtttctaagatgtattctattcttttaccattctgatgggtgttgggtattggtcagaaaaaaataattcagccgtccttaataagtactcctaacaattattagtggtctggtaccatttcttaggcgtatgtttgagctgagtatatttcttgttgttttgatgcaattattcacgtacaaccgtgcttagtatgtttattgtgatttgtttcctttatggcctcacttgtatatgctcatgtgcttacttcttgactgtactcgaccacatgcaaactttctgaatgtttccaaacctcaaaacttcttgaacattcgattatctgctagtgtgaagttccctgtttgattggtgataggaatttatttgtctagtgggatcatgatcttgggattaaatattccctgggccaggggaggtagtgaggtatatggctaatctaaattctaaaacctccagctcatgggggagaggtaataatacatcttaccatttgtaggcaaactattgtcttcagcttcaaatccgtgtaactttcacatgtacaatgataatctagaatgtacttgcactttgttcaactgtggaaatgtttttactctgtaggttttactgttgttatgcctttttctaattgataggtacgatgattatgatattactgttatttgaaatgaaatcgggccaatattttgtcctagctgagataccgagatttaacatcttcagtttgtctatgctttcagagttcatgcttgctttataaacacacgagtatattttgagttccactgttggtaaaataaccaaaacttctctaggatattttgccttttaatatactattaccttatacagtttatctacattctatctaatgatatatatgaaacaagtgatgccctcgttattgtacacttcatatagaacctttttcctgaatccggtgatgcctggagaaacattgcccaaaggaagggctaaacccatctattcaattaggagcccagtaataccataggagtctgtctgagaaattaactacccccacaatgaattattgtatagaccaagtgcagaaagtcattgagccttagcatgggtttgttttcactgctcctttttattttcatattttaatgttcatctagcttcctctttcttaatcaagttgcaacagatatatttttgcatcaaggaaatatggcaactgatgaaaataattcaatcttactatcctaggctcaaattagaatagtagacatcacaaaaaataagtgattaaactaaatcctctaccatctgaatggaccctatggatcttcaactattctttcaactgacttcctataaatatgtaatgcagtttggatatgtgttatctagtccaatttaatttcttgatggtaagaatcatacattgtctttcattgttcgtgtgttttgtgttgtttgattcaaattttgttgttagcagttctcaaattatcccttttcacatatttcaggtgaagtatggtgaaactcttaagaggttcggtgggtatgtgcaaggaccacaattcagcctgaacttatccgctctccggtccaagattgcatctgcttttaagtttggttcggatgtcgacttcattctgacttacactgatgaggatggggatattgtcatgctggatgatgatgatgatctgcatgatgctgctattcatcagaaactgaaccccctcaggattaatgttcagttaaacaacagccacactgcagcacctcaggccaaacagcaggattcagataatatacctctcaggtccaccaccactgaagacccactagctcatattaaatcagttatcgatgaggttttgaagccgatatctatgaagtccatccaggagccagttcctgagacacttgcgaagctgtcccatgaagtacttgaagccgcatcaccacaattagctgagctaataaaaccttttgttaaactggttacaccaagcaacaacaacccatctaatgggcatgctgatggttcctgcagctcctcaactggtttgccccaaacacaggttgatcccaaaactaatgacgagcccaaaatagacacaagtttggggtcgcaacccttggacacgcagaactccaaatcatctggtgctagaggtcttaagactctgtcagttgaggctcctgctacatcgggtgttaaatcttctcaaggtcaacaggcatcattatacccttccattgaggagttgctgttctccccctttttaccgaactcaggtgatgacaaatctgccagcaagggaattagtgatgctcaaagcaagggaaaatctgttatgacctctgctacaccacctacccctcctgctgctcctgctttccgtccagctcctccaattccatctctgaatgattggtctcagccaccagcacgtggatcgacattttacccatctatttggcagtctgaagctgatccaaaagccaatagtgattccagatggcgtgttccattgtgcagagctggccatccattccaaccccatgctcccctgagccgtccacccccaccaatgcctgcaccaatgagctatggaccttctccacattttccttaccctggccgcctcttgtcctctggccatctgcatggagaccttggtaataacattgagaactcaccagcacgcacattccatagatggattcagtgtgatggttgtggagtgcaaccaattgttgggcctcgatacaagtctaaaacgtaagattttaattgagctattgctctatctagtttctttttcctatctcagtatttgacatccctcctcttcgcctctttgccaacagaaaagaagattatgatttgtgtgatgcctgctttcatcgcatgggcaatgaggtcgagtacaccaggattgacaagccactcttaccccagagattactgagagaccctacattggtgagtacccaatttgtaggcatgagtgcacaggcatacgcttgcacgtgtatgtttgtcgatgcattatttagcaaactcatccatcctgtactctggtttgtataaataggtttaaggacacaaaataatatattaacaattagtttgtcctataatttcttggtttcagtgtcgcaagatccattcacgggctgcgatgaagtcaaagcgggagaaacttgaaagtcgcttcattttggatgtaactgtcctggatggaacattgatggcaccttcaactccgtttactaagatttggcgtatgcataacaatgggtctatcatgtggcccttgggcacacagcttatatgggttggtggcgaccagtttgcactgcagacctatgttccattagaggtaggtactatgcatactgtgacctcttttcagtttactgttctaattgtagttatgcatactgtgacccctgttcagtttactgttttgactgtagtttagactgcatgctatttaaaatatgtaaaatcattaaacctgagtttgtgttctgtgcagattccagtggacgggtttcctgttgatcaggagattgatgttgctgttgattttgtggcacctgcaaggcctgggaggtatatatcttactggaggttagcatcaccttctggccagaaatttggtcagcgtgtttgggttcacatccaggttgtcaactctaccattccttttgtccatataggtctagaatcttgacactcatacctatctttcttaacatctaaattctgattgcatctgcaggtggaggatccttcttttgtcagtaacaacaggactgccgctataaacttgaatttgcccccagaaagcaatatcacaaacacaagtaatttgattgatgtcaatattgagcctgtggatcaagtcttcaaccaacatgtcaatagcacaaacaaggagttacttgaacatttgatacaccaccagattgacgagcccaagaatcctgagcctgctccattacctgtgcccattgtttcttccacaacatctcttcaccccatcattgatgttgatgttccctccagttcaactgctgctgcttttgtgcctgtctttgatgagcctgcgcctgaacctgctgtgactcctgtgcctccaactgttaatgtgcctgctggtaatgcacctgcgtctgttggtgcatcatcatctgatcatcatggcattgacaatctcacagaagagaaactgctgaaggaacttgaggaaatgggttttaggcaggtcgatctgaacaaggagatactcaggcagaacaagtacaacctggagcagtctgtcgatgatctctgtggcgtcagcgaatgggaccctctcctggaggagttgcaggaaatggtaagatcacatgtgccctattctggacagtgctcacagcctcacaggcacgaatgtattggcaaggttctgaagttagctgttgttcaccttttcagggcttgaagacact

SEQ ID NO: 20272 - DNA, 1833 bp, Oryza sativa
  unsure (1)..(1833): unsure at all n locations
nnnnnnnnnnnnnnnnnnnnnnnnnnnnnnnnnnnnnnnnnnnnnnnnnnnnnnnnnnnnnnnnnnnnnnnnnnnnnnncgtcctcctcctcctccgccgctgccttgtcctggccggcgccgtacctcgtgacgtcggacacccagctgcccagcgacgagacgctgcgcaccagccactccttgggcgtcgacaccctggggctctcggcgacggcgctgccccggcgctcctcctcggcgcgggcgtcgcgccaccgcctggccatgtactccttgacggcgccgacgccgccggccaccacctccttggggggcacggcgagcgggttctggtcgaggcggagccgctcgaggcgctggaggcggccgaagcagtccgggagcgcgtgtatctggttgttgctgaggtcgagctcgcgcaggccgagcaggtccccgaacgacgccgggaggtcgcgcatgtcgctgaagttgctgctgaggttgagcgactccagcgccgccagcctcccgatccccgcggggagcccccggagctggttgaagtgcgcgtccaggaggcgcagcgaccgcatctcgcacaccgacgacggcagcgaccgcagcttgttcaggtgcacccacagcttctccagcctcgccatctcctgcccgatccccgtcgggaggtacgacagcacgttgtagctcacgtccagctccaccagcgacctgtacgtttggatcattttgtgagctgaatcaccctatagcgagaattgaagtttctttaactggatctggatgccattggggagaagaagaagatgatgatgatgcgtgctttggccttggctggttgattctacctgcattttgagatgctgtcggggagagacctcagcttgttgcccgagacgtcgaggatcttgaggctggtgaggaggcctatggagtccgggagggagaccaacgcgttgtaagcgaggcgaagctcttccaggtgttcgagcccgcctatggcatctgggacattctgcaaattcaatgaaaatagctagtactaacagatggaaagaaaataaaactgaactttacagtgttttctagctttgtgggactgtagcctgtaaaccagaaattcttgaatggaccacatcaccacattcagttttactagcatattgcgcaatttcgtagttggaagaaaatgatttcttttttataccatatttgactcctctatgctcataattcattcgtgttcaataatcatgatatcaaaaataaacatgcgtgatcttaaaaaaaaaatgcaaaaacaattctcataaacctaactcataagtggattgctttcagtgacaattttaattaaccagcattgcgttctacccgtcatccattatttttggggcatgcacatctgcaatgtcttatacgatctgcatttctggactgaaaaactacccgagaaatgcaaaacataacaaatctccctatcacccgaattccccggatcggacgaacagttcttctaatttctaaatctgaaacgacgtgaactcgtgatccgcgaacgcaaccgcgcaacgcaatgcaggttttgcaggttggcgatcgataaccacagaaaatgacagaaacaaatcagcaattaataataccttgagctgatttcgcgagacgtcgaggacgaggaggccgcggatccggccgagctgctcgggcaggtggcggagctgccggtcggcgaggaggaggcgctccaccgccttcccttcctccgcgtcccggagcacccgcaccacctcgtcgtccaccaccccggccttctcctccccgccaccg

SEQ ID NO: 20273 - DNA, 2012 bp, Oryza sativa
  unsure (1)..(2012): unsure at all n locations
tgacgcccctcacgagtggagagtaaccgcatgagcagtcaaagcatacacagcaacaatatgctgctgcagtgtccctttctgccattgccaccatgatgggcaagcaccaagcagctgctatcctccatattcacatcctcaccgagctcccatcgccgccggaaaggatcctttgacttaactgttgtgcagttaagtcagaggatctgcttccatcgccggcgcctagcgaaagagatggggaaagagacatatggagatgtgaggaataagatgagattaatatgacatgcgggctctacatgctaactcagctagtcagccacgattaacctaccatgttagcaaaaacttttttaagatgaaaaagatgttataccagttttacggttggagacaatttaatcaggaaccaaagatgaaggagtccaaataaaactattccgagagaaattgctccagtctccatgtccatgggccggcccatcctagcagcgcatgaattgttgcctcgcatcgcattcgatcgagaaagaatttttcagagccgcaagagagggggagacgaaggttggagctccccgtgcttgtcgcttcacgttgttttcgcctgttcaagagagtgttttttttttcactgcatccttatccataaacgtcttatccagaaagatagaaacccgtggttaatctcaagttttgtttctacaaacaaatcttaagttttacgatgatctatattatatcacttcatactgtgatgatggtgtagtttttctaactccactttaggctggcagagtaaattgatttaggcattttagttcacctatattagtgctgcatgcgtactgctggactactggagtgcaaaattgccataaattttgccaagtatgcctgatgtttgtcataactcataaatacacctccaacttttattagtaaaaacataatatattgcccggccgtctcttataaaccaatgcatagaaaaaaatcaaatgttatgtgaaaaaaactactactccctttaatcattaatatatactgttgatactgtatgtcgtttgtcaaattgaaactaatgttaagaacgtcatacattaattatcgaagatagtattgcacacatacaggatgtatatcaaaatttaataataagtgggctacgagtaacagcccgtacgcgcacgtgtggtgtgtgtgcatgtgcgtataaggcatgcttaatttatgtacaaacctatttttatacctcgaggaaaaatgggaaaaaaaacacctgtcggccggaagataaaaattccacctataaacccccctcggccgttcccacctctccccttctttttcgccacccgatccggcaacaacaacgtacgtaacctcctctctctctctctctctctctccccttccagccgcgcgcgcgcacgcacgccgccgtcgtgacgtcgccgtcgcggtcgccgccatggatccgacgccgcagtcgcacccgatcctggcgtacgtgctgtcgcggctcccgtcgctgctgccggtgtcgccgtcgctgtccaccccgcgcgcgcgggacatcgagcagccgtccccgcgggcgccgtcgggcgccgcggagttcgacctcgtcagccgcatgccggggctccgccacccgtccgtcctctccgccatgacgcgcgccgtcgccgacgtctcctcggcgcgcgacgcgctccgcctcctcggcccccgccccgaccacgagctcgtcgactccgcccgcgccttcctccgctcccacgccgccgaagaggccgaagaggaggaggaggacgagaaggtggcgaagagccgggaggtggtgcggctggacgaggcgcacgagtcgtacggtggcttgctgcgggaggcggaggagaggctggatcgcgtgtaccggacggcgatgagagggagggacatgcaggtggnnnnnnnnnnnnnnnnnnnnnnnnnnnnnnnnnnnnnnnnnnnnnnnnnnn

SEQ ID NO: 20274 - DNA, 1520 bp, Oryza sativa
  unsure (1)..(1520): unsure at all n locations
gcggtcgctgcgcatcctgaacgagcattcaaccagctccgggggctccccgcggggatcgggaggctggcggcgctggagtcgctcaacctcagcagcaacttcagcgacatgcgcgacctcccggcgtcgttcggggacctgctcggcctgcgcgagctcgacctcagcaacaaccagatacacgcgctcccggactgcttcggccgcctccagcgcctcgagcggctccgcctcgaccagaacccgctcgccgtgccccccaaggaggtggtggccggcggcgtcggcgccgtcaaggagtacatggccaggcggtggcgcgacgcccgcgccgaggaggagcgccggggcagcgccgtcgccgagagccccagggtgtcgacgcccaaggagtggctggtgcgcagcgtctcgtcgctgggcagctgggtgtccgacgtcacgaggtacggcgccggccaggacaaggcagcggcggaggaggaggaggacgcctacctccagcagaatctgtgatcggagattacagcatttgcttgctccggtgctttcatccgtatgtacagaagaactactgcagaccgtcgccgcgtcgttcgtttcgcatcagccgtgtgtttgtgtgtgtttaccttcgctgattccttaccatttaccatttttgttgttgttgttttaaccgttttgctgtttaaaacttttaaacccaggttactggaccacagtgcctgtgtgtttgttatatttaccttgctgattcctaacatttttttggaggttttcgtttaaccattttgtgactttgtttgatgaagtgcagtcaatcgagaggccatgaattccgatacggtcaagctcaccatttttgttgttgtttaaccattttcttaagacaccaacgctgctttagttaaataaaagggctctggtattccccaaaaaaaaagaaagggctctcccaaaacgcaaagagagcatagatattcatcacgacagtcaacagcaccagcaaagcaacaaattcttactagtagattggagcaaagccggacaatctcaggtcattcattccaacagcaccaacagggcaaccaatagaacatcgggagaaaaaaagaatgaacgagatcatacaaacatcgattaacatacgcaacatagatcttattaatccatcaagttccagtcacagcagtagataagaggcatagagcagctaagcccatagtaattacacgcagtttacctggcaaggtaaccgctttttaagaggcgcgcacgcgcacttaacacatatctccgcgacaaatataccagtcgcacaacaccacacacagttcataagcaagcaggccctgagactgtagcagcagccccggcggccggcgctagccttacacctcgtcacattatttacgcatatacacacatagttaggttatagatagggatggnnnnnnnnnnnnnnnnnnnnnnnnnnnnnnnnnnnnnnnnnnnnnnnnnnnnnnnnnnnnnnn

SEQ ID NO: 20275 - DNA, 716 bp, Oryza sativa
  unsure (1)..(716): unsure at all n locations
actatagggcgaattcgagctcggtaccctggtccatcaaattcggtatccgccgccccaatctcttcctccactggctcctccggtcttcctcacgcaccgatttgtgtcgccaccgccggccaactctcagttcatcgtcttggctacggctggcgtggccgaggaagaggaggagacgacgaagccggcagtggcctcactgagactcggcgacgtctagggcagcgcctaacggtggctggagtgcgtgacggcgatggagcgagcgtggcgctcgagcggcacggggatgggaaagagcaggtcttggggattctctttatataggccggaggggagaaggtcgaccgcacggacggaaaacggcgccggcgacggtggagctccctattgaagacaccggtttaagaaatcgattgagggcgatttagtgcgggattaagcgggatttgttggggaaattgatgcccactacacaaggaaccgatttttctaattaatttagaggagaaacgatagggcagggagatcaatggaggcggcagtgcttgagttttacgggagagatgaacagacgacggacagaggtggaagaagctcctggcgagcggggcccacctgccagcgaacggaagagaaatagaggggaggannnnnnnnnnnnnnnnnnnnnnnnnnnnnnnnnnnnnnnnnnnnnnnnnnnnnnnnnnnnn

SEQ ID NO: 20276 - DNA, 1830 bp, Oryza sativa
  unsure (1)..(1830): unsure at all n locations
ggtacccnnnnnnnnnnnnnnnnnnnnnnnnnnnnnnnnnnnnnnnnnnnnnnnnnnnnnnnnnnnnnnnnnnnnnntctcactgagagcagggcagaaaatgtctgggacacatcgcaacacgtgttctgccggaatactctacatagtgccagatctctgcgccccttagctgctcttccaggacgcttaccttcagatgagaaggcagggaatcgtccaccaggcgaaacacatacacctttctgttctcctgtgatgccagacaataatgattttagtcatagaagtatgactaccatggttttcatttgcagaggctcaaacaataattaaacatgcctaaattcattaacataaactactccattcgatctcaagccacaatgttcataaaaaactatagatttcactcaagtaccaccttggtgtccaggtaccattgctcatcctactcctagcaggatgcaatttgaagaaactgtgatattttcccctagtaaaggctggtaatgactgataacatccatcagaagtacaaacaaaaattcctaagcagtaattcctaaaatgcaaacaggcggcgtttaccatacaccaaattccacgcagcttaactcaatctacgagcccacagggacctacgctactgtctctgggtagaaaagaaacacacacccaatttcaacgaccaagcacagaacgcatcaaggatccactcaagggcaccacgaaccgtccaagtaacaaacaaacacatacagctaacgaccaacaaaagctacagataaaactaagcaagaacagcaccgagatcggaagaagagtcgcggtggggtggcgattgtcccgtaccagctgacgcggctggcgagcagacgaggagcagcagcaccaggacagggagaagggcgagagcacgacccgtacgcgacggcgcggtggggctcatcggcggcgacctccccggcggcggccgcggccggccgtcgtgcggcggcgtcagggccgggatgggatggggagaaaaaaaaaacaaaacaaaattccgcagcccactactcgtggattcggcttgcggcgtcaatccgggccggaaaaagtcaacaagccaaccgtgccgcatctcccgagccaccacagccgttcgatctagcgttgcgattcgggcagttccgaccggcatgggccgcgttgctggtcctggacaagttaatgggctggtcgcagcgggaggcccacctgagcgacacagagatatgagtaggctgtagggacccggacctccctaccacgcctcgtctgctttggagaaatttggatatatgctattgtcaaaagtgagtttgaatgttttaaaatatgcatcatgttgattccttacctattactttagtgattgtgtgaatttagacaaatataaagtaaatttttaatctaaaaaattaatcgaatggtagttttttttagcttttaaaataggatcaaatacgcaactgatgtttttttttttcaattgatataaattttgctggtactgttgctggccgcagagtgaattgctacttgggccgcaatgtagaattgctacttgggccgtcctaccaagtaggcaagcacactgctcgggaggtcgggattttcttttcttttttttttttccgtcgcttcttcgcgccgcctcccctcgacgccggcgccgccgctctcgtgagccaccgccaccgccggcgccgccgctctcgtgagccaccgccaccgccggcgccgccgagcctcctcctccggcaagacgtctcatccaggcctctgcctccccctcagacgccg

SEQ ID NO: 20277 - DNA, 9692 bp, Oryza sativa
  unsure (1)..(9692): unsure at all n locations
cctagggttgcgttaagtcggtgacacatgggacctcactcctggtttgcttgcagcggcggattgctagctccttggatggcagttctagcttgtagttcttatttgacgaaatcgtgatcttgtgaatattaacatggaacagttgtagctcgtagttcttctttgatgaatcttgatctggtgagtatcaacatggaaggagtggaagctaggtcgctcgctgctcactctacacagcagcatgttttctgatgttttacatttgctgaatactgtcaacataattgaacttttactttgtcattacttggtatatccacagtttgtctcgtcttccacctccggccaccggatttagtgccggtcatggttatagcttgattttgagtcctagggtgtgtgtgatcggtgattcgccaccagcggccatggggtggaggggcgagcaacgggcgtagcaagccgaagagccacacttgtaggagggggcagggggacggagccgtgggtggccggcgaactgaattgctagagctaggcacatcgtcctcaagggcgcgtctcggcacaaggcgcaggtacaatcctctaatgtcatcttcccgtagattctcactcttcaagtctcagttccttggttgtcactggaaaatcatactacgaaaatggaatccactgttgtgtttgtttggtggcatgcatatgtagatcaatatagcaagttcaatcgatgtaggctcgtctgggacactcgaaatgaaatgattttgcagaattcattttgaaaattctcttttcgaagcgagtcataaagaggaatatgcatgttttccccccttttctccctcttttttcgtgatcaggttagtggagagacccccctctgcattgttcaagacttcagactcgctactaaagtgtgcacacccattgcagctttcagggcttcaccactgcataaattctcaacatatgcttgtgttttttttactgtcaagtgtcaacgtctgtgccttttccctgactggtctcatgaatttcccaaatactagaacagtacaggatcatgtcttcaaagagaggaggaggtggccgccgtggtcgtggctgtggccgtgggagaagtgctttggctgaaaatgacatggactttcatgaaacctccacaccttcttccccaagtactacttctgataaagaggacaatgttgagtttactccgcagcaaagcccactaccttgtcttgtaagcccatcagtagagcatgtatccaacacattactcaatccaaagatcaaccaccgatcggacgcaatcttcggtgatcaggttaatctaagagcaattaagttttgtcatagttgcatgagtaacaagttcttgtaggaagaataaactttgcagtctgactgaggtcaatgtttttttgcaggctgtggaacagttgaagttgcgacatcacaaacctttaaaatttcatgagagataccgtccttatttgagggatgctggcttgcttgggctctcacaaatttgccagaagatgcctcagttggacaaggcattgatcactgcccttgttgagcgttggagaccagaaactcatagtttccacctggcttctggggagatgacagttacactacaagatgtctcaatgttgttagctcttcctatcgatggccgtccagtttgttctaccactgatcatgattatgcgcagatggtcattgattgtctaggtcatgatccaagaggaccatcaatgcctggaaaatcttttctgcactacaaatggctaaagaagcatttctatgaattaccagaagggacagatgatcagactgtggagaggcatgttcgagcatatatcctgagccttctatgtggggtgctatttccagatggaacaggacggatgagtctgatatatcttccactgattgctgatctttctcttgttgggacatacagctggggatctgcagtgctggccttcctataccgttctctttgttctgttgcttcctcccacaatatcaagaacattggtggttcattgcttctcttgcagctttggagctgggagcgctcccatgttggcagaccgttggtccggtctcccgtgtgcccagagacagacattccacaggatgtgctcccagttggctttcgttgggtaggtgctcgcacacaaagtgagaatgctacacgctgtcttaagcagtacagggatgaactgaatctgcagcgagcagatcaggtgaagtgggagccgtacttgcacattgagtctgcaagcttgccactgctttgtacaaaaaatgctgacttgtggcttacacaagctccactaataaattttccaatagtcgagatgtatttgcctgagcgagtgatgcggcaatttgggcttcgccaatccattccaccaccttttcggcctacactacaggcgctgcatcgtattagtcgacgtggcagagaacgtgagaactgggaagagacacatcatgagtacattcaggaatgggaagcccgccgacagcgcatatttccagagtcagagcagtatgacccgtcttcttatgaggagtacctgcattggtacacaggggctacacggcggtatcttgtaccatcaatcagtgatgatgtggaagcaggatcttcattacagcctgatgactccattaatcttcattatcaagccaaggctcctatgatccgcaaagcagtaagccatattatctattcagttcctacgatcagtttctaaagttaattggacctaaatttgtttcagatacacgtgctgtcttttgcaagacttcaaatagtttttacaagcagtccatgcataatttaactaatatatttaacttgaaggctgctgattgttgtaggttgataaactgcatggtatggtaaagaaggccaagatagccatggcgtccacagctgatacaaccacacaagccttggtctttgagtttctgcatggctttcaagatgttcttcacgaccttggcgagatcaaggaaaatggtggttcagctactagtccacatgttgaatcagctgccactcaagacatgcctctacttttgctagaaactgaacagaacattgtggatgccgatcaagaagctcaacaccaggaagaggaagagcttcacatggtggatgatgcaacaatgacccttgagcctatggatgaggagaacaatgatttcaacaatgtcatctgtccatgtccttcactggagttggaggaacattgtcacttagctacaccagccatcgatgagtgtaatacagccactcctgctccagactctgtaattccacagcagaacactgattttgatcaagatggacatctggaaaatcctaatgaaatggaccagattgaactgatggtggaacctatatgtgtggatcacaatgattccgacaatgtgctctcatccagcccgtcagctcaggcactggaggagaattgtgaagtagcaaaggcagtcaatggaaatgtcgatccaaccacccaagttactggctcatctaccccacaacaggacacagatgtcaaactagttgctgaacaggaaaacccaggcacaacagagggcaactaactataatggtgtcccctcatctgcagaggagacaggcgattctgatttcacccctcatcatgtcacctttgtatagtgactagttatgtttgccatgttgatttttttgacattagaagttcttttttttgtatttatattcattgatggtagtattctgcttcatctccaatgtaatatgggaatggatatattaagccctagtgtatactgtatactacctccatcccaaaatgtagttacctagtactcaactggacacctcctagtactataaaactggacaggggtgtccaatttcgtactaggtagcaaaattttgggatggaggtagtaatggttttccttagaagatgcttaactttataattgatgagcatattagtgatagtgacagttagatggatgatgctgcatctactactggccaatatgatcagcaagataaagattggagctgcttcatatctccacttcatcaaatttatagaaggtaaatgattctttattatctagtatgaaggtgtacactgaacttgttgctgcactgtctttagtgttagctaatataacttttgcgcttttattagctgtgcccttctcatatacctatggactactgagtcagcagtaaccatttatagtacttgtgtgtcatactgatttaaatgaactgtgcaggtatttgttacggtaaagtgctttagagctattcatggtagataggtcaaatttcttcgatttcgaggtacatccttgatgatactctagtttgcgttgttggaatcatatagcacactacagctgcctaaatattttaaagatgcatatgatttttatctaggatacagaaagcatgtaaacatgcttatttatcgggcaaccattcatacaaaacctccttatttgaacaacattttcctagctacccaggttggtgttcttctgcaaagttcaatgttgaaatctgctcttactggaagttttaatcaattgcatttttatttgagacctgagtaaatatgtaagaagttgcaattgacagagtgctgggctagatgggaggttgatatgcaatcaaccaccttttcagcccaacatgttaagtgtattcaagatttaagtagatctgtccttttgtgcagattagcaattttgactacctgatggaactgaacactcttgctgggcgcagttacaacgacattgcacatgcatgtttgcttcataactctcattttctgatctaataaatctactactgtgtttaaatgatcactagtaatttatgcaataccctgtttttccatggatattagcagattaccactccaaaacattttggatctggaagatctgtctggcgtccgcatactgagatcttccaaaagtggattctgtacctcattccctgctgccaatttggacctcttctgtgcattttttttcttttccattcatttactctggggatgatatcttgttcaataactgctgatagtgatacttcaaaattttcaatgcagccggttggcgctctgaatcctgcatgactggagaaaccccaagaacattactctagtttcaacgacccaatcatcccaaaatttcacctaccgttcacattgctcctgtcctggcatggtaccttttcttagattatgcatgttttgtgtcagcattttgcttgtgtgttgccccttttgtttggagttagattaatttattgtcatcccatttgattaatcggttctctactgttcatcaatgacaatcccttcaggtgttatcgtgctattggttgttgacataagcatctactgcaggtgttatattatcttgtcaggatagagccttttacggccctttctattcagcagcaatgtggcaggtttggtcaatatgatcacacgttttcttgtatcaacagaacatggaacagtgtccttgaagacatgaataatgtaaaaaagttagtgagttttgttaaaaactgtgccctcaattcactgtggtatattgtgcattgcttagcacggaagtctaatcagaatctttggtggaacctaattatggtgattatttctgtagattccagagatattttaccttactgagttacactaatgtgaatttggttgacttagggtcaactcaactttctggaaagctatgtaagttatttcattctgtattacaggctccgtggaattgcctccttggtctcaaccctgttgatttcatatgtaaacacaggaaagctcttgagagtgatcatgtctccgctcatttgcatgaatggatcgacctaatatttgggtatgttatttatgtgttgttcctttttgttgcctcctatgaacaaaatgacgtttccccatgctgatattttgttatcaatgtacttctcttctcagttttgctttggctaacactcacctcataatgaatcgacgagcttgcgtggcttgatttgttaaaaaaatgattttaaaagtgaactcgactcaactctctaagactcgagttggccacgttcgtttcagtttaagattattgcaatctagattattgagccaaattactataaactagattataataaacctacatagagtaagttgttagatgtttatttctttggattattagttatttgttagttgttagccacctaataatctaaaaaaagcatcttatagtggattattagattatagtaatctggcttataggttgtaataatatatcataataagctatttgtttgtttcaacttacttctaataactcaaattataataattttaagctaaatcaaacaaagccttagtccattaaactcatcgaggacacttgctatccgtacgagacatgtgcggggtggctgcgcgctacgccctctcgtgcaggaggccgtggcgctgagcctagcaaaactgcagccactacaagcatgtcggaggaatcccgtcaggagacggccgactctctatcgccatatttccatttgatatgcatctgacaccgatacgacatcagcttgacttcggtgccgccaacccaaggagcaccctattaggcagtagcagtgtaagccccatgccacgtagaacaaatacacatagaatccactcctctcatgcaagttacttcacgggattcccaagccaaccacttttttacctttcccctttcccggtgcttctctctcccattttccccttttactggtgttgagccgaagcggagaggaggcggcgtcgtcaggctcgtccttgcttcaagcggtggtgacgacggcgccacggatctggagcggcggcggcggcggcggcggcggcgcggatctggagtggagcgacgtgggaggacgacgccaccgccgctcgagatccgcaacccgggcgatggccggcggtgttgtcaacgggttgacgatggcgtcgtcacgggctgacggaaggaaggccgcgtcgtcagcggcggcggtgacgtggtcgtggcgtgccccggtggcgactccaccagctgcacgagctcccccggtcggtgcccctcctctccattcatgncggcanccgattactctctcctcaaccctcagtggcaccggcgccaacaccgtctcgcgcgcggagaagcctagaagnccggcggtcgaggagctcccccggcgacgcggcgatgagcatcgagcggagcagcgggcgggccttctcgacacggagcagcgacagcgtcctctggcatcttcagcaagcgccgagcggagcagcaaggggccatctcgacgcagagcggtggcggtccggaactccctcgttccgagcggtgacggtgacggccgcatcagcgccgccggattttctcaggtgggggacttggatgaggcttcaccagcttgggagaacaacggcggccacactagtcggcgctacaacatctcccaactcttctcctcaccgagtcctcaccaagtgggtcctgtgccagagttttttgcgcgaggtgttcgttcctttggctgtgtttagattcaaagtttgtatctaaactttaaacttcagtcctttttcatcatattaacttgtcatatacccataactttttagtcatatcatttttaatttcaaccaaaatctaaactttgtgctaaactaaacacagcctttgttgagatacggagaacccaacgtagctatagaccccactgctttttccatcacgtagacgaattcacgcgctacgtaggagcactatcagcgtaggtgtttctcaggcatcctttcccctaggctgtcagggagaccgcagagggtatgcaagaagtgtctgacttggtgggcactattatgtcctttgttaatacgaggagaagagagtgttattgattgtgttaaacatatctagtagaccactctaaaactataattttggagataaattattaagctaaaattatatactcttctaaaaaagatagagtaatcaacaaagacatggagtattttaaaaaagagcattgtcgccgttaattacggtcatgatccgcttcaagaggagagggtccaagagtgtcccagccttggcccatcttatcccttatttacagctactccaggaccagcagaggatcaggagaggagacacgtatgtacacatatctacacgtgggccccacgcagatgagctgccacgtactccactccatgctcgatttgaatccattctccaaagaaagggatttaattaatcaaccagtacattttcattggcgagtgaataataaattattattattatatgatgaatcaagcatcttgatcttccccaaatcgtcgtgcttgatatcttctgcttttcgtttcatttgtgctaattaatctacgtgcgcgcgcgcgtacggctgggctgatcgatgattcgatcgatcagtacgcgaagccaccggcgccggtttgctcgcgcggtacggccgcccgccgccggccggcgcgcaccgcggcgcagttgccgccggcggcggcggcgtcctcgtccatgaagatctgcttgcaccggcaatccacgctgcagaacgctctgtcccctctgcatatatatagccatatacatcaatattcagcagtaatataatactccgtcctaaaatataagaaattttgaagaggcgagacgtatctggtactgtgaatctaaccagtaagtttatctaaattcatagtattaaaatatgtccttcaaaatctattatagtactatggaatggacagagtaatcaacagaagagacagcttagatgcatgccatggatggagacggacggacctgtacatgtagatgtccttgccgtcggcgagctccctgcggcagaggaagcagcgctgcaagaaggagctcatcgtcgccgtcgtcgcagtcgccggagaggaggaggacatcgtctctgggtggctatggagggtggccttgctgatgatttggggaggcctcatgttggggtggtgatcgttcttgtgtgtctcaagaaggacactcaggccggccatggaagaacacacaccaacttaaaaccaaagacgatgaaaattaatagtcaaaatctctgtgtgtgtgtgtgtgtggttgagctcttgtgctctcctatggcatcaagctcttcttttgtttttttgttggggatttttcttctccctggagaggggtggtgtgtgcttttaaaggatgaagtgcgtgtggggtgcgctgatggagcaggttaaggaggcagggttttgatcgattgggatagtgggatgtcactaacacggtgttttgcattttgaaaattctaagaggatgaaaatgtagtcgagtgatattaggggttatactgttgaagttgaaatctgaccatctgcatagggattgtctcatgtcaccaggatttgtttcaggagagatcggattaaaatgagttgttagggagaatactgttgtagttgaaattggaccatgttacttaaaggttgnnnnnnnnnnnnnnnnnnnnnnnnnnnnnnnnnnnn

SEQ ID NO: 20278 - DNA, 9144 bp, Oryza sativa
  unsure (1)..(9144): unsure at all n locations
nnnnnnnnnnnnnnnnnnnnnnnnnnnnnnnnnnnnnnnnnnnnnnnnnnnnnnnnnnnnnnnnacaaaatttgctttaggacatcaaattaaatgatgagttgtcggactagggctaacatcaaattagtcccaaacaatgtaattacataagctatattaattataaattaacatggaatttttaggaatttaaaatttagtcacacaaattaaaagtggtgatctgcgccttgcataaatcatttgtgcagcacctatatttggtggccaagtcccatcccatttataaccccaatcttgccggtagcatgtcaatcaaatttgccatgtccaacctctagcccacattttaagctaggcatcgacaagattagatttagatcactctggttgatcatgagctccactccaagataatattgagtataagcaagtaagcgccactcttttttatctccacagtggagtccattgagtccatgctcacttaattaacttcccagttgctgaagcatttccgcaagtactccagtgtatagcactctaattggagcatggccatgaccatgctgatctagcagaaagaaagatcaatggaggaattgaagaggcttcactaggcaaagagtccatcaaccagcagcacagtggcccaggcaagcctggctcctttcactctcctccctccacgtgtactggggaggactccattgtcgcttgcagcgtgcagatccactgtgccctcatgtgctgtggccttaattggtccgctctgctcagagccggtacgatagcaggccagatataaacatattttaaaaaaaagaaaggaaaagagagaagagcagcagattatagatctatagctagctgtagcacggactccaagatgtaatatgtgtatgacatgtgggactaggtattaatagtatagtaagaaactattatataaattggctattatattggctatagatgatttagagccagtagtgggctatactattcaacttgctcttattgaggcatccctaccacgtccgatggtcatcttctccgcctgttcaatttcgtcgtttggtgatgtttgtttttatttgggtcataaggagtacgagtgctacagcgcatcagtacccttgtggtgtaccactgtactccttggtaccttctaaacaaggttcattgaacttgaaaccatatggttaggttataaaatttttagtgaagtgctcagtttatgacactttggtaaaggggaactcaatgtgacgcgccgcgaagccttccacatattttactcgataaaataaatttctacaacgtgatgacgcggggcatatttttaaagtagttttgatacattaatattctattatcaaccatagaaaatagataaccctataattaacagaaatcatcgacatacataacacataacttgagaaagatcacaacatatgaggcttgaccatgttatggggacaaataaatatctccgaatggatactattagcgggtgtgtatgtataccagacgcacgaagaaagccaagaaaagaggggcaaagagcagcaagcaggacagcacacagatggggctacggagttgggtggtcggaggattcaggtgcaggaggtagtgacctccagcccgctgaaagcaaagatacgtacggaccagtcagagtaggctataagccggctaaatgttgagatggagaagaaaacagaggagagagaaaaaaaacggtctgttaaattacgagacaatctgtgagaaagacaaatggatgagctaactattctatggataagctaaaaaaaggctacaaaaaactttatagccaacggctcggctatatttttagccttgctctcatggcgccgtttgtttgtgcactttgtcctacgtggcgttgtcacccatgcctcctcagcccattggctttggccgctgccttggcactggcagtggctgctgccttctgttggcttcagctgatctgggctgtgttggcaacttggctggctggcactagcttgttgcaaggtagaggagatcaggttgcatctatacttctcgtgccatgaaactagcagctctagctacaagtttcagggttttgtttggaagcataatgtcacactagtcttatgctcggtggagagtttattaggctacctgaggtcttagagtgtgttctaaaatgattttgagattagctacttttcttattcttcgtaaacgtatttttcgaaccgctaaacgatatgtttcatacaaaatttttggacacaaaaatttattaaaataaatttattttttgaatttataataatttaaactgattaatcatgcattaaaggcttgcctcgtttcgcatccccctaaaaagctcagcccaactagctggttagaaaaaatgtggcttgcttcctgtaacacctggcagccacaaccagcacttgtgagcgtaaccttaattagtttttcttaataagggatacaagtttacaccctctgggacaaatatattttatattatttctataaaaattagttccgttcatatgaaatttctctaaaacttctccattcagaaggagatattagttttcatggaccaggaaatcttcccccatgtaactacttgttttttttcctttgcttctacaaggtagaagtgatgtactatgttatccagctgtgtgccacctattcacttgacacttcttatcaactattcttcgcttatgggagacaaacactacctcttatcgattagacacgaccaagaataggagtcattacgtgacaaaattatagggtgatgtgtcactgtagcattaatatggctaatacttgcctactttgatgaaagtaacaactagttcctctgattgggggctattagactagggtccactgaattatgtttgcgctgtgtcatgattctataataatttgtcgttcaattaattatatcctttgatattcggacatagctacggggacacacgatgatttgtaaattatcggatggcgtttcatccaatgtacaaaaatattatatatgttttaccgctcaatgaaaaaaattccagtaaaaatgtatccgatttttcaatatttgataaaaaaaactgtttcaccacttagagaaaaatgtttcaaccagatacaacattcaaacaaactagttgcaacacccaagaatcgaagtgtgcaacatacaatcgaaatagagtgaaacttcaagtacaccaatgtgcaacatgaaaaacaataggtcgcaacacccccccgaaaaaaaaactccaaaaagaaaaaaaaatgcctacctcctacattcttctaccccaaccaatggatttgcctcccttgctgcaagagcttctgattttctatcatgggagccctaccgctgccttgccaactccttcgaatacagtcatcatcgcctacggcctagcgctgtcctgtcaaactttcctccatggaggggaccagtagcggagatgaggaagaggaaaaggatggaggccagggtcccaccacaacaatgtcagagctctcgccgaagattttggctatagtggtagacgaccctgcgcctgtatattaggctaacgaaaaatggcgagagagagagataggggaggggcaaaggggcttgatgcgttcaatggaaagagggaggggaagagagagagaaggggtggcggggcctgacatagagtgtgtttgatatttctttgtcatcggacgtcttacgcgtttttaatatccatcggtatttatttataacaaacttgcaaagaaaatttgctataaccacaatgaaaaaaaaaggtatgcttcactggatagggtccaattctcggttcccatgatcacacatacatgcaaggagaagccatgaatttactaaacatagggcaatctttaaactttctatgaatttttgaaataatttacaagggaataaggagacaagcctgggacacaagcctaattatcttaggcttgtctatgcccctgcatacttgtatatgtttttttatataattctagcaagatcataaaattattattggtgctcatctctttgaacatatgttttataatggaaactttattaaactcaaccaattatggttacataaaggtgatacaaccgtaataagagcacttcaacttcagcataattggacatatattaaggggcacattcatagtgcataatcacaaaaaaatgaaataaaaatatagtaaatatctatactattttaaatgatgttagtggtggtggccgagattatctacaacaccataaacagacacgtgggactacaagcataaggtccctacaaaacgtgaatggccctagaattgcttattatagaaatagtaaagggttatacacaaaaccttcaagttcaccttccacacatagatgaatccaatcttgtattgttcaaccgtatagcttgtgaaaatagacaagggtaaaaagaggtggtctagcaacatatttcagtatggctaccttcggagatgacactatgtgcttaatcgactaacaatgctataaacttgtagtttttgcttttactttcatctcttaaaacatttgttacaggtacacgggtcgtcagctagtttgttgcaaaacaaattaaggtgaaacctcaatattatagaccacccagcataccttaatgccttaaaatttccaattgaagatccgaatacatagtatagctacattaaaatttgtttaaaagagatagggttttttacctataaattattttttcttcattgtttttctacggcttatcagccatgacttaaacaaacagagccgataatgcacaccatctccggtcacaaataggtcatgttttgaaccaccacacactcaccaggacactagtttaattacaaactatttaagtataaaactatgaaaaatataacagttatagttttgaagcaatttatgatcaatacaaatccatctttatcattttaaaaagttaaatccaaacattcaactattgcttcctgagttccgactcgtctcacatccaatatctggataggttggtgatgtaccctacatgtatgtatcatctttttcaacacatcgtcctcaagagtactgacagtgcaatcatggattgacactagtaccaagtaacttttactcaaggccctgtttagccgaggttccgccacctacaactttagattaaatgaactaggagctgaaagttgtgaaacttagcttttccatattatcacaagagactttttccggtacttgaaaatcacgttaaccgttgattaggtacaatccaatggtttacgatacaaggtgcccatagaaaggtacttaaaaaaggtgggccaggtacaaaaatagagattaagtgggagggtatataggtaattttgtcccttggtattatatcaatctaacagatatgaaaaggaaatgactataacatatataagttcttcgattcttctcgaatttgtttcattacgaagtttctaatatggattacatgaaattgtgaacaattacggatttattttgttatgaaaattgatctacacagaacggggaatgtcatattatttgaagttttggtagctcattcatggattaattaagacgtggtcgacaccggcatgctcaggtcgtccgaaagatagagaagaaaaatgccttcaaaagactagcagatgtgatactgtgaatgaccatagatttatgtaatattcctatctcctaataagtaactattataatgtccctgcaaaaaaaaagtaataatgtaagcaacaacagcgagagatgagaattagtgagcaaaagtaatacaagagcaacagtcaatagagtaggggctagcggcaaacaatcaggaagaagttagaagttgttaggactagaaaaaattactaaattacccatcgtcgtgttttttctatttctaaattcacatttagcaatcaacggttgatattcaatagtttgaaaggtacgctgagtacctcccaagcaccttaaaagatctcttatcacaaactagttattcattagttacttcttagaatatctagttcctttaaacagagcctcaaataaactctaaaatgttatatatctcttgtattgtagagcatttttaggagaacattttcttctacttcgatgtaaatatttctttgatgaaaaaaaattcttttaacagtattaacatcaacatgtgaattagttcctcgcacaaaatcttaattacactaaaaaccatccaactaaatatacttacacaacacgatattacggacttaaaccaaacgagtatcctcaataaaaaaccagacgaacagtcatcacgagaacggattgggatcctctgctttcaaagacaccgtacttttatcactgataagtgggtccatggtttattaggtgcacgtgtcagtgataaagacacctacctttgaaggtagaggagcatgatcccacgagaacaagttcaaaggaaaatcctgggtctgcggctggagccaatttgcgtgcttttatttggcaggttgcttcgcaccagctgcagcactacgccacaaagaactgaacaagggcatcacatcacaaagtggtgctcacctttgtgctgtgcttctctttctgtccttccttttggtagcctgtttaggcgatctgttggcctcgtaacgttctgtttgatctatatgattgagtgaaattttaccacagatcatctagtcgattatatatatactggcactgccaacaaatttagatacgtagtcaaaaggacggaggtagtctaaactaaaaatcttgaaataaacttagcaaatattttaaaacaaacggtctaagcaatacagtaaaataaagtttcttaaggaaatgtatttttcgaaaggtagagtaaataatctgcttcaataatctaataatttagtgaataggctaaaaagaacatagccttagctagagtgattcctccaagtccatagagggttcgaactcggtgacagaactaggaggagggttacggagtctaaatggcacataagggttatttggttgttagtatgggactgcctggctcgtgttgttagcgaccatttttaccaaaaaaaaaaaagagatgtaggtgcatgaacaatataccgctatggtaactggctctagcttgccgcatcagtgaggcggctccgcggctccacatcaccctctatcgtgcatatgtaaattaaaatgaaacaagggttgatataaaaatgtaagggacggaaatatataatatttataggtcccattaaaaatagcatgtactgtgaagagagtagtggcttcaaagtgtcttcatcctatgaagtggtaacaattaattttgggctggcttggtagttggtcaaaaacatttgcagatataaaatgatggtaacacgaaaaggatgcaaaggtaagtttatgcttgctaggtatagtgcggcacaaatcggatatgatgcagcgctaccttgatgcaaagcacacaccacgtacctgactacctggcctaccccaattggaataaagtaatggtagccgtctgcccctgtggaggaatacagcacacagaagggataaagcaaaagaaaataaatataatcaacatcagatatattatacctgaaaaaaaaaggtaagccagagaaaacccaacacaatcagtgagaaggcgactgaatgagagtaaatacgttcttcattgagcatgatgatgatgatagcattcatctagtgaccacaaaccataactagcctaaggtgaacaagccaatgccatttaaaaggtccatatctggatgatatgcacctaaataccaataaacagtacaccactaacggtgatggattgccacttaaggatatttctaagtactccctccgttccatttaaaatgcatttatagatttctgtgttcaacgtttaaccgttcatcttatttaaaaaaattaaaaaaaataattagtactattcatattttattatctaataacaataaaaaaatattaattataaaaaatcaaataaaatggacggtcagacgatatggaacctattactacacttaatataggacgagagagtagatggttaattaatatcccattgctgctttccccaattgcaatgcttcatccaataggcaatcccaggctttcccagccatcgtttcatggccgatacaactttctatccttctttatgctaaaagccttgcaaagttgcaatcttctagcaactcggccatgattagccaccaccaggaactactttctaaagcagagcaaatttgtgcttaagtagttctgtttactgcatacatataaaaatttaaagaaccaaaaacagaggataaataccactgtaaaagttgtatttgggtgattgcacttgattcgagcaaaaatgaagacgcataagtgctcaatcatcttgagcaattttgtttatattaataactggataaacaatcgcaataagcatcttaagcaacatacgattttttttatctacttattttcttgagaagctagctcttattttttaagaattacatattcggggacatgtagccagatggtttgtcgactgggcagctgggggaaatgcccagtcaagttgccgacccactggcaagaaaatggactgaacattttgctaagattcagacagggaaaaaaaacatatactggttcattaccatgatcttacacaaaatctgaaccagcttatcttcattacaaacttttttttaacgactcgcacgagacagtgcgaagttctattgatagagcagaaaaaaaattataagattacaaccctgagaggtcgtaaccaagataaaggaaaaaaaaattataccacccacacaccgacagcgccaacacacataatcgcgagaaggctaataccggaccgaccgccgctagacgaacaacggaacacaaacgggaacgcccaaaaaacgcccttacaaccaacacaaagcccaactctatctagagcgtgattgccctaatcgttcgagtgg

SEQ ID NO: 20279 - DNA, 1426 bp, Oryza sativa
  unsure (1)..(1426): unsure at all n locations
nnnnnnnnnnnnnnnnnnnnnnnnnnnnnnnttgcgatccccagcaactcggccatgattagccaccaccaggaactactttctaaagcagagcaaatttgtgcttaagtagttctgtttactgcatacatataaaaatttaaagaaccaaaaacagaggataaataccactgtaaaagttgtatttgggtgattgcacttgattcgagcaaaaatgaagacgcataagtgctcaatcatcttgagcaattttgtttatattaataactggataaacaatcgcaataagcatcttaagcaacatacgattttttttatctacttattttcttgagaagctagctcttattttttaagaattacatattcggggacatgtagccagatggtttgtcgactgggcagctgggggaaatgcccagtcaagttgccgacccactggcaagaaaatggactgaacattttgctaagattcagacagggaaaaaaaacatatactggttcattaccatgatcttacacaaaatctgaaccagcttatcttcattacaaacttttttttaacgactcgcacgagacagtgcgaagttctattgatagagcagaaaaaaaattataagattacaaccctgagaggtcgtaaccaagataaaggaaaaaaaaattataccacccacacaccgacagcgccaacacacataatcgcgagaaggctaataccggaccgaccgccgctagacgaacaacggaacacaaacgggaacgcccaaaaaaacgcccttacaaccaacacaaagcccaactctatctagagcgtgattgccctaatcgttcgagtggtttcggtaaggggatgcctgaacgacgtctccaaggagagaagtagcggaaaactgctgccgccgtccgtcaggggctcaaaagtgccaagactggactttcaccaggcaaccacccttgagggatgagatggcacgacaacgccctcgggagggggaatgaaccatcgttgtcggtccggccaaagccgggctgggttttcaccggctgctcatcacttgcgagtccacggctgacacatcgatgctccaccatcgctcaacctctgccgacatgtgggaccactgcaccgacaccccctgccagccagccttcgtgtgccgaagaccgcgccacacccactggcagctcctcctcgcaccgtggtcgccacctttaccgtcggccgcgcctcatcacgccacgccggcctcctccaccaccggacgcgcctctcgcgccagtccggcctccctccatcggttgcgcctctcgcgccaagccggcctcctcgccactgaccacgcctctcgcgccttgccggccactactgccatcggctgtgcctctctgcgccaagccggcctccgacccctccaatcgctgc

SEQ ID NO: 20280 - DNA, 7737 bp, Oryza sativa
cctccaccactatcaccgtcgcccgcgcctttgctgccgacgccgcgcctcgccaccttcgccggcgtcggcatcgcaccaacgccgcgcccgtgtggccatggccctgatccggcggtggcgacgccggatccagccgcgggagtgccagatccatcggtggcggcgccggatccgccgccacaacgtctcgccgctgcgcagccttcccgacggtccgcgccgccccttcgcgtagagacagccgtgccgccggggataggagcctcgccgccgccatcccggcaggccgcgcggtttccggcaacacgcttcggtggcggcaaggtggggaaggggagtgaagtgtgacggcggccgggggctagggttcgccccggttgcccgcgcgaggacgacagggcgctcgtctaccaaaaatactttttacaaacttataactgaccagcagaaatattgagctatatataccagcaaagcaatcatacattcgcacagcacgagagccacagcaaagaaatcgtaacaccacaagttcgcttgctaaaacaccacaccacagtaggaagctgcagcacatcacagctttgaaatcagctcagcctgaatatccttctgcgactaaacatcaggcccaggaggcacatcgatggcaggcgagcagttgaagagtccatcaggctggacaaccaaaccaatatatatagcttccattttcagatgagttgtaaagtcgtaatgttatctgaagcaattaggacaagaatactatcttttcgcagcaaaaaaccatctaagtaatataaagaacaatggagaaagaaacgaaggccaaagtgataccattagcatgaagctgatgcgttccactggcatgacaggccagtcttccagcctagggatatgggtaatcccgaaaacgtacctgtagttgcatatgacatgtttttatttcagatatgccataattaagctagaaaatcagatgaacatggaagatcgacagcaattgttagaaggtgacaacttaccagagaactaagttggtctcctctagggacctatccttttttacccatgttgctaaaccttcgttaatccgtgggttctgattaggaaattctcctccagggaacatctcatcgtttttgaacgatgtaacccaaaggttatgctttaaaaatccagctcttctcaggaatttcgctcaggcagggccagtggaagacagcttgaaccaggtacgagcttgtaccctgttggttgtccagtacgatttacagtccttgtgttcctaacctgaacaaacatgcgtccagcagtgtcagtcacacagaaagtttgagtttgcacgacgatacaatgtttctcacacaaatccttacaatccaatggcgtgcagatgaagggtcacagtcacgcattgcctgtagttcagatttcaaattttttttcttcagcgtaaaatgcattattatgcacattatttgggcctgcactttcaactttgacgtttacctctaccacctggaatggaaaaggaggcagcagtatcacatcttactatataataatgcaaagaaatggaggacttcatgaaatcgtggactagaataaactaacatacttctcagaaaagtaaaggaagcttagctgtttatacataatatagacgggtaatagtaagacgaaaataaacaaagtacaaaggcatggaacaatatcgtactagaagcagccagtgcaggtggacaagtaagtcggcaatattttgaagtcaaaattacagtaaaatagaagcccacacaacatggttgataagcagcctacctgattgtaggcctcatttggtttgcagtcaaccgccatgtccatacgggcaacaaaaaaatgttggtgaactggtgcatacaaactaggggcaatagtagtaccatatttcctttgctccccgggcatgagagctcctaggctaagaattccagtaagctttacttctgcttctatcttgccatcctgcaaccaacaaaaaaacatatcaggaactagagttcctttcgaaagtataattgtgtctgtagacattccactgaaaaggtgaactactcacctgataaaaatgccaatagaacccgtattcataattagcaatagtgcatacaaatgacacagtaagcctccttgaccgtctaacttcagctaatcctgttctccaatcttgatgtttccagaggatcccatggtcttcttcatggaagcaaacaacattctcaatggtctccacaccaccagtaaaatttgtaaaatgtgcatcaaaatattttataagacccaagcagtcacatccctacagtataacaaacaaaattaagttttttcaaaaacaaacaaaattaagtcaaatcagcatttaggtgcaaccatacgaaaaattctgggcatcagcttttaggtgcaacatgaagcattactaagcctaaagaacacaatttcaattacttttaaagaatatgaaatgagaaattcttggaagacaataaagaaaaataataagcaaatggaagaagttcaagtaaattactcttctgtattaattcaaacaaatcaggttgatttgaaattttatcgtaaggctgcgtttgttctagcatttggattgggattttcagcggcacgagaagcaagacaagccgcaaatgatcaaccgaatattaattattacaaacttaaaaattggatttatttattttttaaaagatacttttttatatacctttttttgaaaaaaagaatatcattaagcagttcgggaaatgtgctcacgtagaacaagaaagttgccggtccaatgcaccttagactcagcctagtatattaactgaggtactacttgacagattaattcttgtttttactatatgcttttaacatctatttttggaataacagttggctgccttaggatataagccactagtagttttccttaggatgtatgccactcctagtttttcttagaatgtaagccactcctagtttcttaggatgtaagccactagcctataccttatggtgtaagccactagcctatatatatgtatccaaccagccatagttgattgagtggagaatagaaattaaactagtcccaaaacctgtattccttttgctaacaattggtatcagagcaaggtttatctgagttccatcgattccccatccaaaatgtctctccactccattcgttccccctctctctcgtcccatgcctcaagcacttccagtggacgaggcagcaggcggtcggcggctgacgctgagggcgacggcgatgcgactgctgctgcgcgggtcgcgcaggaggcgcaagcggctgcgcgggaagcacgcgcggcgtgtgaggaagcggaggcgcggctgcaggcagccacaagggcggcgcgtctcgcggcggcagaagctgaagcagcgcgcaccgcggaggcagccaggcaggctgcagctgctgctgctgttttgcgagctgaggaggaggaggagtggcgtgacctggagcgggcagacgcggcccgcgtgcgacgcgacgcggaccgggatcgacacgcaggtcgacgcgaccgcgacttcagcccccatcgcggaggagcagatctccaccgcggtgaggaggagcggcgcgatccatggcgcgatcctcggatagaccgcgccctggaggcccagcgactccgggagcaggcagcggcgattgaggcacaactggacttcgaccgggagcagggtggacgggacgttggcgcacggagccctcgcaggcagcgcgcctccccttccccggacaggcgccgtggtcgccgtggaccctccggctctcctcccgttgtgcagaccgtcgtcaaggatgttggcggcgcatggcccatgctcaccaagactaactacgtcgagtgggcgatggtgatgaaggtgaaattgcaggcgcgccacatgtgggacgcggtctggtacggcgacgtcgactacggggaagattggcgggcgctggaggcgctccttgcggctgttccgacggagatgcagtcctccattgtgaacaagcggatcgccaaggacgcctgggatgccatcgcttcggcacgcatcggcagcgaccgcgcccgcaggtccacgcttcagaagctgcgtcaggattgggagaacctggccttcaaagccgggtgaggacatcgacgacttcgttctccgcttcaactccttgcagcagcggttggcgcagctcgtcgacaccaccatcgacaaggagagagccgtggagaagctcattcgcgtcgtccccgagaagtacacgcagctggctctgtcgatcgagacgctgctggacttcaccgagctcacgatcgaagaggtgacgggtcgcctcaaggccgtcgacaaccgcaagcagctacctccctcagagccgatcaccattggtggcaagcttttcttcaccaaggagcagtggctcgcccgccagcaggagcagaagaagggggaggccacaggctcttcggcttcaggatcgtcgagtagccgcaagcgtcgaccacgcaagtgggagaaggcgcgtagtggcactcttggcggcgccgatggcgagcgcaagggcagccgcgacaacacctgccacaactgcgggaagaccggccactgggccaaggactgccggcaggcgacgcacggcggtcaagcacacgtcgctcaagcgctggagggtgacgaggtggctctgtttttcgtacacagaagcatcgagccgcacttcactcccgcacaggacgctaccacgcccctccaactcgacgagccgcgggcccacgtcttcctcagcaacggatcctgcggcgacaagatcgacggatggtgcctcgacaccggtgccactcaccacatgaccgggcggcgggaattcttctccgagcttgactccagcgttcaaggctccgtcaagtttagggacgcctccgccgtggagatcaagggcgtcggctccatcctcttcaccgccaagaccggcgagcaccggctgctcaccggtgtctactacatccccgcgctgaggaactccaccatcagtttgggacaactggatgagaacggctcgcgcgtggagatagaggacggggtcttgcgggtttgggatcgccatcgtcgccttcttgtcaaggtgaacaggggcgccaactgcctctatgttctccatgtacaggtggcgtagcccgtctgccttgcagacggccgcgacgatgatgcatggcggtggcacgagcgctttgggcacctcaacttcgaggccctgaagcagctcggcaacaaggagatggtgcagggcatgccgcgagtcgagcacgtggagcagttttgcaacacctgcatcctcaccaagcagcggcgactcccctttccccgccaagcaagtttccgcgccaaggagaagctggagctcgtgcacggcgacctctgcggccccgtgactccggccacacctggaggccggcgcttctttctgctgctcgttgacgacgtgtcctgctacatgtgggtggtcctgctcgactccaaggcagcggctgcagacaccatcaagcgccatcaagttgctgcggagaaggaatgcggccgcaagcttcgggtgctacgcaccgacaacggtggcgagttcacggcggctgagttcgcggcgtactgcgctgacgagggatccaacgccacttctccgtgccatacaccccgcagcagaacagcgttgtggagcgccgcaaccagacagtggtggccactgcccgcgccctcctcaagcaaagagggatgccagcaatctactggggggaggcggtgatgactgccgtccatctcctcaaccgctcgcccaccaaggcccttgacggcaagacgccgtacgaggcctggcatgggcgcaagccggtggtgagccacctccgcatctttggctgtctcgccttcgccaaggagctcaaccacatcgggaagctcgacgaccggagctcgccgggagtcttcatcggctatgcggagggcgtcaaggcctaccgcatcctcgaccctgcgacgcagcgcgtccgcatttctcgggacgtcgtgttcgacgaagggcgaggttgggcttgggacaaggcggtggacgacggctcgacttcgacgctcagagacttcgtcgtcgactacgtccactttgggggagccagaggagctagcagctcatcttcaccgagctcatccacctcggcacccggctcgccatcagctccggcgagtcctccaccacctacaccaccagcgactcctccatcaccggctacgccccgctctcctacaccggcgcccacaccaccggtggagttcgccactccgttgtccaacgacgaggatcgtgttgatgcgtaccacgacgacgagcctctgcgctaccgcaccgtggacagcatcttcagtgatcagcctgtccttggactggtgacgcgcgacttcgaggccgagctgcacctagcgcatgaggacggcgagccctgctccttcgcagaggcgaatggagatgtggcatggcgcactgcaatgcagcacgagatgaacgcggtcgagcggaaccggacgtgggtgctgcagatcttctgccggccaccgcgccatcacccttaagtgggtctacaagctcaagaaggatgaggccggggcagtgatcaagcgcaaggcgcgtctggtggcgcgcggcttcgttcagcaggagggagtcgactttgacgacgccttcgcgcccgttgcgcgaatggagtctgttcgtctcctcctcgcgctggcggcccaggaaggatggcgtgtgcaccacatggatgtcaagaccgccttcctcaacggagacctgaaggaggaggtctacgtccactagccgccgggattcgtcatccccggcaaggagaacaaggttctccgcctgcgcaaggccctctacggcttgcggcaggcgccccgagcttggaacgccaagctggactccactctcaagcaactggggttccagcagagctctcacgaagctattgtctaccggcggggcaaggacaacaatgccctgttggtaggcgtctacgtcaacgacttggtgatcaccggcaccaaggaggctgaggtggaggcgttcaaggaggagatgaaggcgacttttcagatgagcgatttgggccttctctctttctacctggggatcgaggttcaccaggacagctctgacatctcccttcgccagactgcctacgccaagcgcatcgtcgagttgggcgggctcaccggctgcaacccagcctacactcccatggaggaaaggttgaagctgagccgcgacaacacggctgaggaggtcgatgccacgcagtaccggcgtattgtgggcagccttcgctacctcgtccacacgcggccagacttggcatttgctgttggctatgtcagccggttcatgcagcgaccgacgacagagcaccagcaggctgtcaagaggatcctccgttacgtcgagggcaccaccgactacggcttgcactacccgaggtgtcccggtgcgcagcacttcatcgggtacagcgacagcgacctcgccggtgacagcgacacgagcaagagcaccagtggcacgctgttcttcctcggcaagtgcctgatcagctagcagtcggtcaagcaaca

SEQ ID NO: 20281 - DNA, 3099 bp, Oryza sativa
ggggagcatcaaggccagctacattaacacccaggatcagctcgccgatcttctcaccaagtccctcgggcgggtcaagttccaggagtttcgcgccaggattggaatggttcaaattccccaaaaggcgccacacaagacttagggggagaatgacagattaagtcttgtttttactatatgcttttaacatctatttttggaataatagttggctgccttaggatataagccactagtagttttccttaggatgtaagccactcctagttttccttaggatgtaagccactcctaatttcttaggatgtaagccactagcctataccttatggtgtaagccactagcctatatatatgtatccaaccagccatagttgattgagtggagaatagaaattaaattagccccaaaacctgtgttccttttgctaacactactaacagggaacaacaaaaataacctttttaagagagtgtgcgttctttccaagcccatcttctccagcatcaaatgcattcttccgataatgtggttcatttggatctccataaggaacaaccatctcaacgaaactcagcctgtgagcgataggtcgacgcccacggtttccatcaacatatgcaacagaatgaataactaaaccttctttgggagtaaagccaatacggaagttccactgttcaatagaaataacaggtgagattttttgagtcagttttatctaatagtagctcaagtgctcaacaattgaaacaagaaacagaagataaccagttaaccttctgccattccacaaagtaaccgttaacacgaaaactggggccatcaggttgattgatgataagagtcttcaaatcacttctatcaacaccacctcgtgtttcccctggagtatagtttctcaaatgatctggtggaggaagagggacaaacttcctatcttcaaactctatcacggtattattctgcacatcaatgacgatatggatcccttccacaggtcgcgcataaccattctccatagggctatcactttcagttctacagaagatcagaggtttggcaattcttcgattgggagcatcagcatcactgtaatatcctgcacacctatattcaactagaacaggtcatgtttcaaggttctattgtttcgcaacaagaatcggaggaggacgagaagaaggatgtagggaaatccttttgtttagtcagcatgctagatcaattagtgagtgactggatcgatacaactaaaaaaactgtttacaagtttctttacaaatcaaagacatggagaaagacggtagaagtgcagttggctaaaggaagaattatttggtgagtgaatctttcttttcaatgagggaaggattctacgtcagtaagacaatgacagcaaaccccgaatgttttataaagcgtttattaactacagaaattaaccagaccaagcttaccatggatctaccatgacaagatccatgtcatcaactcctctttttttcattgcttcaatgaaaggggggtgacttttcacagtagcttcacattcagcatattccatggcatcctgtaatacacacaagcactacaagataaatctagtaattgacctaatataagtattcactaagtgcttaactatcaaagtaagcatcaaactaagtttctgtgattccgctgattgttttaggccctgtttctttcagcttgggattattataatctagattattgagttagattactataagctagattgttataatctgtagtagaataagcggttagttgtttctttcatagattattagagcctagattattgggtttgcaagtctaaagagggagtggggtggcatggtgggtaatttttcacccaataatctggaaaagctcacctaaatgagtttatcagattataataagctgggctccagattataataagctacttcaataagttgtctgtttctttcagcttactcccaataatctggattataataatcctaagctgaaagaaacagggccttagtggcaaataccacagcacaccagcaataatttagaaccacatgctcattagaaaataaatttggctacatataatctcattaagtgttaaatagtttgaataaaatggtcaaaatcaagaaaattgtgcccaataaatctatagaaagtggaaatatatcattgcaggctgaacatttggaacaacctctgatgatatgagcttgcctctctaatgtccacccctagtagcagcatgcacttcggagagctctacaatccaaatactagtctcatttgtcattttgttgtagacaacaagcctggccctcctagctggcagcctggttggaatgataggagtatttttggttctgggaagcagtgaaggttggaatggtgggaaaaagtatgcatcagctaatgccacgacagttttttctggttccagaagcacaacttcgacaaaacgcatgctgtctcgaacctataatttcgggagtgacttaattatatatttggaacatgagtacataattttgtatgaaaggtagtagatggacagagacctcaggagttcttccagaagctctgacagttgctacagccacagaaatttcagcagcagatagtgggtctaaggggtggcttttctgtgtcctcgtcatgatccggattcctgaaatgtttctcccgcataacgtcaagtcattgtgatatagcatagctatgtactgatgcttaaattgaacagaaaatattaaactatccaaatacacaaattgtggcaggcaaagggaatatcatagaaaacatttgactctttttttttcttttgcaatttaattacagagtaagggacacaaagtttgtatctgtaaaagatagctacacacttacgcagatatttctcaattatgcatgtgcccaccagataaattgcatatggaaccattaaaaggcccttttgattatattgatcaagcatttccattctaaatggcagaatggcatcgttctgttagctaacacaagataatatttcagaccttttattgggtgggggagcatcgatt

SEQ ID NO: 20282 - DNA, 7433 bp, Oryza sativa
  unsure (1)..(7433): unsure at all n locations
annnnnnnnnnnnnnnnnnnnnnnnnnnnnnnnnnnnnnnnnnnnnnnnnnnnnnnnnctaacacaagataatatttcagaccttttatttggtgggggagcatcgattcactcgttcgacaaacacaacgctaagatcaaacacaaaattcctaacacaatgacactctggctcgtagaaactttccaaaaaaaaaaagcacacaaccaaaacaccttaggcaaacattttccctacgctccaatctgatctctcatcgtggtcactcacacctgaagcagttcataaacggaacgccaccgaccaggcgctaacattttccgcagacaagcccaatccagcaaaggggggcacccgaagagagagggagttcaaggagagtgagtacctttagacgaggcgatggcggtggcgggcggcggcaccacagtttcggcctcctcgatcacgccggcggcggcggcgatcgcggcgccgccgcagcacccctccgcggcgcccatcggagagggtccgaaccgcgcgcgcgcgaggcgaggcgagaggcgagcggagaggaggaggggtttggggggtttttgttttgtttggttggtatttcgctcagtctcttattttattactccttccgttttaaaatataattatttttagttttcgatatggttttcgaaatattaatttgatctataatatctataaaagtaaaatattttaaataaaaatagttatagttcgtttaatgataaagatagtaatatcaaatttacatgattaattttttttaagtttttgttgctaatagttaaatttaaaaagtttgacttggcgctatactaaaaatgcttatattttggaacggatggagtattagacaatggtggctgactgagtgttaaattaacgaaaaaaattggttgactggactattcgtcatgtaattaacatgatcacttcatgtgtggctactgttcactcctccggtacgatatccgcgtcatataggccgagtttagtttcaaactttttcttcaaactttcaattttttcatcacatcaaaactttcctacacacacaaactttcaacttttccatcacatcgtttcaatttcaatcaaacttttaattttgacgtgaactaaacacacccggggttaacatgtgaattgaattagggtctcatgttttctagaagaatgttctacaccttctattcatgtatgattgacctatttgagtctaacgcagtgaccaagaaaaacgcaactcaatacacgggacattggtgcataggggaatccacaagtagttgcatttgtacgggagacgtggctgcatatgattggaatgggtgaacattcgattcacaagacctactgcgtgcatgcatgactaaaacaaagcaacgacagcatccaaacccaagaatgtgtggcaaaagaaaaagatgatgatcaaaatagaaaactttttcagagctaatatgtctattaaacacaaatgaagagaatattagatagcaaaactttatcaaatagttactagattattaaacttttccattcctattaaagtctattcaaaatgaataaaaattctgctcataagcttttctacatgaataaaaaatatatttacaaactttctacaggagaaaaatctttatacacaaactttctacaatagttaaagatagtttacctagcaaatctattttataattaaaggaatagaaaaaggaaataactgaaattcggaattaaaaataaggaatattagaagaggagtatagagtccatatagaaatacaattaggaaataactgaaattcggaattaaaaataaggaatattagaagtagagtatagagtctatatagaaacacaattaagaaaaaaatataaattcagaactaaaaaataaggaatattagaagtagagtatagagtccatataggaatttaaaacttactaaaatttagaataaatataataaaattaaaagtagtgtttagagtccgtataaaaatacaatttacaaataactaaaattcaaaattaagaaaaacatgggaataagagtttaaggtcaatataggaatataaatataggaatacaatttagaagtaattgaaattcgaaattaaaaattaaagaatatagaaagatgagtttagagtccacatagaaatacaattagaaataataaaaattcagaaataaaaataaataatattggaagaagagcatagagtctatataaaaatacaatctatagaaaattcggaattttaaaaaaagaaatattaaaagacgagtctagagtccatataggaatatacataatttacaaataactaaaatttgatattaaaaataattaataactaacacgtatataaaatataatttgaaaattcagaaataaaaataaataatattggaagaagagtataaagtctatatagaaatacaatttacagaaaaatcggaagtaaaaaaaaagaaatattaaaagacgagtctagagtccatataggaatatatataatttataaataactaaaatttgatattaaaaagtaattaataactaacacgtatataaagtataatatgaatattacacattagtagttttttaaagttattgcaaaatttaaaattatgttgtcattttaatatatttgaacaatataatgagaaaacatatatgctattatatgagagaaaatataatgatgctagccgcgcaatctgcgcgggccaccatactagtttctatgaaagtaaacgacttttcaccatataaaatctaaattgtataactttatgttaataaactttcatcacgaataaaaactttatattcaaaaactttgtacaagaataaaatgatacttgaattttcaaaaatatcttaaaactaattcttgaattaaataataaaaaagtatatgtattcttgtcttaaggtgatccaaactagtaattgagccaactcagccaaacaagctacgacacataaacgtgtaggctctcaactcctgacaagatatgttgcacgtaaaatgttaggatagtcggaaaagcaaatacggttgtaacgaaaagagaaaggatgtcatatacgcgcggtaagcttgtgtgcgtttgttcgcataacaatcttctcagtcttagctagctagtttgaggtaaaattgacggtttccatgtaaatctacggtacaatgttgccctgcttttgtcatcatggttgctgtaacacgtaatgagtcacagaatttctaacctaatactcccttcgttccaaaatataagaacctagagtagtcttcattctgagtttcattctgagttgtattcattcgaagtagtcttctaccctactgtaaaagcataccccctcgcatagaccgcgacacagttgccaatccacatgtttaattactataattactaatataaaacctaaatgaaatgtataatacatatttgagtaaatttcataaaacctcacatattatggttcaagctacacaaaccacatggattttgatatgtgacatataaccccagatattatgatcctaaagttttacaaaaccatactattgatcattgatcattttgattttgatctactatacttttgagttctacaatcacatctcaaatttataaatattttatccatcatataaatattactttttttgaaattttcaaataggaatatatcaaaatagttaacgatgtagttttgtgaagctttagtacaaaatacctgggtttatatgccacatgtcaaaatccctgtgattttgtgtaacttggaccataataataggtggaatttatgaaatttactctacatattttgaactattttaagacaactctaaccatatcactttcaaatattcagttgaaatattcaaagagaacttaagtgtcaaagtttaataacgttaattacacacatttcgaaacaccactttctgaccagaggaaatagttatttagagaaggctttgttactttctaaggcaaattacatgacgtctagttaagtatacatgatgtacaaagattacacatacaacggccgtttaaacattggtgaaatcgcttgattggatgagccacacaaacaattcacaatgtccgggtactttgcttttccaaatcagccggccataggaaggatcaatgtctgcaaaggaaaggacaattgagtgatttgagtccgagtgtaggacttggaatggtcggctacacaaggcccaggtgatagagttgcgagcacaggctgatcccaagggcctcaggcccatgaaatgaccaccacagtccacatacagcgaatactgatctgttttcaaaacgctttcattggctatttgcgttaccttccaaaacaaggagtacctatgcatctttcgaaagatttctatgatcatatcatataaatttttaatctttggattaaaatccaatagacatagtaaaaggcaaaaagcaactaagaaacaccataatagatactaaattaccatatctttaagaaaaagaccaaatccaatataaatttcaaaacttacatgcgaagattcaaaaattacactgtaagtttcataaattacactataatttacaagaaaatacactgtaaatttgagtgagaaaatcgagtgagagataaagaaaaaatctttcaagtgagatatagcaaaatcgcagaacaattcgagtccaagattattattcattaaatggacttcactgagtcatttcttgtgaagggatttcactatgttattttgatcataaatctagagttaccacttttactccccataatttgattagactttcaaggaaatattgtacgtcaaaatttgatatctcaaaatcaaaccgataaataaacatggtttgcttaaaatataacaccacatttttcacgtaatttcaatcatttttttcctatgttattgcgctctctcccctatatatataagtatgcttctatctctcctgtttgcggccgtcgaacttgcaaatggctcagtggtgccctgcaatttggtcgagttacaaatctccatttggagctacaagtatactactactcagtatctttgtttttaagttatcgtacaaattcagaagcaacaccaaactgaaatcacaggaagattcttatacctaactacagattcgaaagtgaagtcggcaaaaggagaatcagccataagaaatcttgaaactgtgcacgctttaaagacacaatacttcatccacaacacacgacttgcagggaaaaaaaaaatgtcgacctgagccctggccaactcgatgagcagaaaatgtgtctagtgcggtgtctgctaaatgataaattgtggccaatctctagtgatcgtagaagacaagatcaagtattccatacctgataaattgtggccaatctctagtgatcgtagaagacaagatcaagtattccatacctgatacagggacaaagacgctgattattcttctcttcagcatccggcctggagcacacaagttgattttctgttctgtggtccttggccagcagcgctccaatcgctactgccaaacgggaaccaccggtccatctcaccaacaaaaagaaacacgaagcaaacgcataagcatgcttacaatcttattcttggaccacagctgcgttcacttgttaaacatttattagtcgaacaagaggaaatatgcataccctgatacccatgagaagccagaccagtgttgacttcctctgcaattaaatagatttctgagcatggaaaatcttgattactaacaccgactgtatatctgaagagtcaccgtttgtgtgtcataagaacagtacgtttttctgtcataagaacagtacatataacatgagaacttcacatgtaactgtattagtttcatttatctgcacagtagatggcatcagctttagaaccacagacgcaagtatcttcagaagccttccatattaaactgatgcaagatgttaatgtcatgctaaatattgcactggagaatcaaaacaacagaaacagacaacagttagatctttaaaaaagacgatggagggaagggtggccctgatggtaacgcagactgaaaacagtcaagtggtcagctgcaaccccaggttatggattaggctggaatcttgctcgtatccccttccaccactcattccaagccaccactcgttcatctcagcccgagctgggccaccacagaaagcaagccctttcctccatccacaaaacaatgctcacttcattccacaaacacctatggccaccgcttctcattcaccttcctcctctcctcccccttaatctcatctttttcttctcggtgcttctctgctcaaacctgtactttgcttctgccactccatgtctcaatcttcccctttcttctccgttgcccgagcacatgctggagcaggagggcgagctgcggctgccgctctcctgctccgtcaccctgttgctcagctgccacctcggattcatggcctgaggtactacccttcagccattgtgtcacctgccaagacactgaactcacacctgagccttccccatgccacaatatcctcctttgccaatgctgataatggctccagcgggcaagcagatgccacagagtctgaggaggagcagaacggggaatctgaactgtcggagatggccaaggcattccatatatcgccccggatggcaatgtcaatctcagtggtgattgcatttgcagcgctcactgtgccactggcgatgcagtcagtggtcttccatgggacgaacaaaatgaaggcactggcatatctgacactgctttcagggttctacatggcatggaacattggggcaaatgatgtggccaatgccatggggacgtcagtagggtctggtgctttgacactccggcaagcagtgcttactgcggcggtgctagagttctctggtgcattccttatgggcacccatgtcaccagcaccatgcagaagggcatcctagtcgcatctgtcttccaaggaaaggactctctgctcttcgctggattgttgtcatccctcgctgctgctggaacatggttgcaggtaatattccaattagatcaccttatcagttaccgcccttttgagctttgctggaatggtgacgatcagaggatgcaatcatgtagtgccattagcagtacataattactgagacttctgcaagtttcagtatatgaaacaaatatttaagacattccatcagcgacacattcatgatgcaagaatagcatgatctacctagcaaggcaaaatcaatagacctttgcacttgaagatgctaggttgggtaccgagctcgacttcgcc

SEQ ID NO: 20283 - DNA, 3104 bp, Oryza sativa
taggttaagccccagaaataaatgatagcagtaagttgtagcagctttattatattcagtgaaacctactgcatgagaaccttctatgagttgattgtactatattacacaatttcctttgaggtataaactccacaatacggtaaacaacttccatggtaggaagtgaaaactgaaaagggaaaggaacttaacagcatagctttaaacttgttgaagtcttttaacgtaaggattttaatccaattatatgcagtttcaggatgttgtgtaacatccatccgtgaatgttgtgcagctcacttgcaattaccagagtttgatgtctatcttatcaacaatcccaactagcagaagtacagaagcaacaaaatgagacaattaaagacaatgctcactagaaatatagcaacttttacaagggatagactaatggaatcttgaatcattagacaactaggcatgcacaattttgatgaagacatttttggtgggactctaattgcgggagaatgtttcatctgcttaatcattggaattaagatattttcatgattgcgggaaaatttaaatgcatacatcatgcctcaaagaaatatttaacataaaattaaatgcctctgccaaagatccaattgtgtgctcccttttacggttatctgagcatagcatattaacatttctcagagtcaatatgaattaacgcttgctatttctaggttgcttcctcctacggctggcctgtttcaactacacattgtattgtcggggccatggttggttttgggatagtatttggaggcgtaaatgcagtgttctggagctccttggcaagagtatcttcatcatgggtcatttcaccattgatgggtgctgcagtctcatttattgtttacaagggtatacgaagggtaagcactagactaactttacttgcagcatgctagacagcatttttaatttaagagttacttagttaggcagtcaccttattgaacacacatcataaatagaggacataggactgttcaagacaagacaataagttaattctctgcttaccctatttcatttcagttcgtatatagtgcaccaaatccaggtcaggctgcagctgctgctgcaccaattgcagtttttactggtgttactgcaatatcatttgccgcttttcctctcagcaagactttttcaatcgctatcctgcaagcattagcatgtggcgcaataggagccgtaatcgttaacagagtgatccaaaaacagcttggtgacctactgtcctcagaagcagaaaagatagcatctgctgataaggcaaatgctcagcaagttggatttctttcggacatagctggaccaacaggagctcaattgcagattgtatatggtgtatttggatacatgcaggtcttgtcagcatgcttcatgtcatttgctcatggaggcaatgatgtctccaatgccataggccccctggcggcagctttgtccattcttcaaggtgtagcaagcagtgctgagatagtcatacctactgaagtccttgcttggggaggttttggaattgttgcagggcttacaatgtggggttacagggtcatagcaacaattggcaagaaaatcaccgaactaacaccaactagaggttttgcagcagagtttgcagcagcttctgtagtattgtttgcatcaaaacttggattgccaatatctgctacacatacacttgttggtgcagtgatgggagtgggatttgcaagagggctcaatagggtcagagcagagacagtgcgtgaaattgtggcctcctggttagtcacaattccagttggtgctgtgttatctatcttctacacattgctcttcacaaagattggcatactttatgtgagtgattgtgaaatgtaattagtgttttgagaggtgtacagcccattgcacttcataaaaatttccgcaatggcaaagagataggctgactccaaaaagtttcgaccataaaatttttcaggattggccagagtaaataatcatttctttggcaacaaaacacatgattaggtaaaaagcttttacagccagttacaatgttacatactccagcttgttcgtccgtttatctctaatgtactgccttgtatcttttgttttatatcacaaggtggaccataataatttcttgtagagatacaattatacataatagacaacaatggttcttctatccttgcagttatgttacatcaaggacatggttctttaatagccactgaaaattaataatgtttttgtggtatggtgcaagataatagcaagttcactgctagcaagaattcagaaaaatccttttgcattaagaaattaaactaacaaataaataaagcataatttctgaggtgattagtgccaaaaacactcgcacattgcgcaacttgtactaagattcagcaagaaacaaggaactttgtgctttgttgtttaagtagacatatttatcaccgtaaatagaggcatggatcttcagggaaaaaatacagagaaaaggtaatcaacactaaaagtaacaggtttatccatttatgcatgagcaggacagacctatgatcataataatttttccttttaacaggactctaatgtagtgtacagtaccttttttacaaatcatccatgaattcaagcattgattaaagcatcattatgcaacttctatagatacttgatcagctcggtcctcaggttttggatgatccgtaacacaaaaccaccggtttggggggtttgcgttccggatgccccaaaatacaaggttttgtgaaatttactctttgggaaaaaaagagtataaaaaggagagcacttacacaaggctacgggcacttgcacacagttaggaaactaatactagattcttaaattgagacacgcaaatgcaccaacaagctattccgatacatgttattcaagcaataagggaagcattaagatttttccaagaaaaaaactactaggtaaactgaacacatagagatagatcagattggggatagcaagctgtagcacgcacgcaataaatatgggaggggtaaagagctcgaatt

SEQ ID NO: 20284 - DNA, 205 bp, Oryza sativa
cttttcgattcgaactcgctgggaaacgcgccgcgccgccgcgacgtcgtggggttccatttctacccgcttcctccccctcctcctcctcagcccgtctccgtgggccggggatcagcgggccggcccaaggttagcccaccagagctaacagtgaaaattggaacaagtctattttatgcctccctcatatgtcggtcctgat

SEQ ID NO: 20285 - DNA, 624 bp, Oryza sativa
  unsure (1)..(624): unsure at all n locations
actatagggcgaattcgagctcggtaccccgaatcttttaagcctaattgctccatgatttgacaatgtggtgctacattaaatatttgctaatgacggattaattaagcttaataattcgtctcgcggtaccgacggattctgtaattagtttttctattagtacccaaacaccccatgcgacaccctatataatacccgatgtgacacgtcaaaactttacacccctggctctagacacccccttacttattttcctatgaaattgagccatagaaatataattctatagaaaaattcttaagagtcccattggttgccctaataagccaaagccaaagttaaaatttaaattttgagatttgctctggtccaacaataccagtacctcacggtaccaaatcatttctaatcgttggatctagctgggcaggatgggcattgttagatataacgatcggaaacgatttggtaccataagataccgatacctcgaggtacattttattggactggagaaaatctcttgaattttcaaacttaatttgaaaggcaattttaagatattttcaatatagtnnnnnnnnnnnnnnnnnnnnnnnnnnnnnnnnnnnnnnnnnnnnn

SEQ ID NO: 20286 - DNA, 1234 bp, Oryza sativa
  unsure (1)..(1234): unsure at all n locations
nnnnnnnnnnnnnnnnnnnnnnnnnnnnnnnnnnnnnnnnnnnnnnnnnnnnnnnnnnnnnnncccagggaatatttaatcccaagatcatgatcccactagacaaataaattcctatcaccaatcaaacaggaacttcacactagcagataatcgaatgttcaagaagttttgaggtttggaaacattcagaaagtttgcatgtggtcgagtacagtcaagaagtaagcacatgagcatatacaagtgaggccataaaggaaacaaatcacaataaacatactaagcacggttgtacgtgaataattgcatcaaaacaacaagaaatatactcagctcaaacatacgcctaagaaatggtaccagaccactaataattgttaggagtacttattaaggacggctgaattatttttttctgaccaatacccaacacccatcagaatggtaaaagaatagaatacatcttagaaactgaactcatgtaggagtatgatttttgttttgtgcaaaaagatgaaggctcttcttttttttttctttttttgattagtttaacaccaggcaggcgcgcgtcatcaacagtcggaggaatcgacattcatcaaaacgagctgacgattcttaaaaaaagaaaaaaaaatcagaccagggcagacctctaagctaacaaagagtaatcaaactcccctaatttctcacaggccaaaaaaaaactaactagcgtacacaaatcccgcaacaccacacatttcgtcaatcaaaccctacgaaaacgataagtacgcaagccccccacgcttcccccaaacccccaccaggagcgattcccctttccccttccccttccccctccgccatcccctccccctaatcacaaaacaaaaccacagctcaatcctgaaaaatagacgatcatctcaccttgaggacgacgtcccactcgtcgggacgcgacgcgagcccctcgtacatcggcgagctccggccggacatcgcgggggtgcgggcgtgcggcgggagggcggaaacccctcaaaccctcaggacgcggcgtcgatcgatcgcgcggaagagcaacaacaatcccccaacagaagaccaaaccctagatcgatcgaagagagcggagccgaggaggaggggaagagagctgcgtagccgtgagccgcagcggcggaagagagcggtggtgcgagagagagagagagaggaggagaggagagagtggcgg

SEQ ID NO: 20287 - DNA, 1971 bp, Oryza sativa
  unsure (1)..(1971): unsure at all n locations
nnnnnnnnnnnnnnnnnnnnnnnnnnnnnnnnnnnnnnnnnnnnnnnnnnnnnnnnnnctgattttaagatttggcatcgaaatttatttttatatatgtatatatatatatataagttttattcacaagttactttttatttgtaaatacgacggttcggctccgtgtcggaatactacaactatagaagcctctcttcatctctctctgtctgaatacagatcagagccgtcagagcatgcgtccagtactctcctctccggccatgcatgccgtgacaacaagaaggctccaaaacacagccttccctcctagtatagctcctactagctccatttaatatcggaccggtggacagtagcttactgctcgatcagaggcatgcacagtgtgtgagtgagatgaggtgcatggccgtgccatatcctatagtaggactaccttccaaaataagtgcagccatagatattagtatttagcgctttgaccatccgtcttatttaaaaaatttatagaaaatatttaaaaaattagtcacacataaaatactatttatgttttatcatctaataacaataaaaatattaatcgtaattttttttaaataagacgaatggtcaaacgttgaatataaataatactaaaactatacttattttgagaaggagagagcagtacgagtaatacgcatgctgtcatgcaatgcatgcatgcgaatatatgcaacgcaaccgctctcgcccgctgatccgctacccgctgcatgctacatgcggctgggctggcgtggtggccggccagcgtactgtgtactgtaccatgatttcgacgtacgtccgtggcgccgtgtttgcatccgtggatgcttgcatggcctgccgcgcgtgcagccatgcaagcgaagcgagagcaaaagaaagaaagcgcatgcatgcgtgtatccgtgcatgcgtctgatggtcgctggccggagttgggcatgcacgcgcctagcttaagcttagctgacggatacagggctatgaccatgcagatcgatgcaggcggcacgtctcgatccggcgcgacacgatctgatccttccccggccgcttgggagtacgtaaacgtacgtacggttcgtgccgatcgacggggtgtgtgggcgtgggtgcatgtttggaggcatcctcttgtcctacctacttaccccgaccgagtacaaattaatgtatacatgcatgtgaggtgttcttgaggctttcttaaaattttattgaaatttcataaaactatacatactttgcacaatttatcaaactacagatttaaaaacttattttataaaactacagatttaatatcttcatttatcataaaaccacaggtttaatgtcttcattaccacaaaactacaggtttagcattgttaaatctgtagttttatgataatggagacactaaatttgtagttttgtgataaatgaagacactaaaatctgtagttctgtgataaacgaatacactaaatctgtagttttgtgaaacaagtttttaaatctgtagttttgtgataaattgtataaaatatctgtagttttgtgataaatggacatactaaatatgtagttttgtgaaacaagatcttaaatctatagttttgtgataaattatgcaaaatgcctatagttttgtgaattttacacaattttatttgatcgatctgcaccgttggatgcgaatcagatgcctcgtatttagcttctctgaatgaactgcgcggcacatttctctctaagctcagtcattaagggcaccagtcgtccattatctagctaggatagttttaacactcgcgcgccaatggacggctggatcttgatcaacagctaaaacatgggactaatgttatatgataaattgataattcaggttattgttaaatagctaacggtgtgctcaacttatatgcgatatgcacatgtaataca

SEQ ID NO: 20288 - DNA, 3104 bp, Oryza sativa
catgtaatacacttttggtacaacaatttcgtttgcaacttgcaactctaacaaatatgctgactaaccgccactgccttttcaccccatccggacatgcatgatgacgcccacttttatactgtctgtatatatagtaccagtcacacccatgtcattgcgacggtacattaggtggtgtatggatccataagtcctggggacttatttcagtcctagaactaatcactttagtccatggctgttttgttatagagactaaaagggactaaagttcattaaatacgctgcacaatgaccatgttacccctaaaatcatacaaagagaaatgcaccatacccatgcatgagggcagcaggtggaaaagagctactttagtcccaataagctactcccttagggacttatactaaagcactttagtccctcctgtttgggactctacagatttaaagggacttaaagtggagggacttcttttttagacctaaaaaaacagggccttagtaaactgtgcgggggatccgcgcactaaccgtgcgtggctacttttattcaccgtgtggaggagataagcaataacgagtttctatagcctaaggtatacgtatagaacacaccacgagcacacaactagtaacaaccctttgaaaggattaccatagaaattctgaatgatttaatttcctaaggaaattttcctatgaaatactttgattcataggaaagtataaggttcttatcggttgctcatatttcctactaattaagtcaaaatgacttattagaaaataaaaaaacatctttttgtaaaaaatttttatgcatgttcttagcgacttaaaaactaatgctaaaagaaactatattgaaaatatcttaaaattgcctttcaaattaagtttgaaaattcaagagattttctccagtccaataaaatgtacctcgaggtatcggtatcttatggtaccaaatcgtttccgatcgttatatctaacaatgcccatcctgcccagctagatccaacgattagaaatgatttggtaccgtgaggtactggtattgttggaccagagcaaatctcaaaatttaaattttaactttggctttggcttattagggcaaccaatgggactcttaagaatttttctatagaattatatttctatggctcaatttcataggaaaataagtaagggggtgtctagagccaggggtgtaaagttttgacgtgtcacatcgggtattatatagggtgtcgcatggggtgtttgggtactaatagaaaaactaattacagaatccgtcggtaaaccgcgagacgaatttattaagcttaattaatccgtcattagcaaatatttaatgtagcaccacattgtcaaatcatggagcaattaggcttaaaagattcgtctcgcaaattagtcgcaatctgtaaaattagttatttttttagcctatctttaatacttcatatatatgttcaaatgtttgatgtgacagggtgaaaaaatttgggtgggatctaaacaggccctaagaggtctaatctcttggaaatttttctttcctttttttgtttcctatggtgctatcaaagggaccctcttcatattttctatgttttctatttcaatttttgtgttttatctattgctgtgttttctctatcatgtgttttaaaagagctctaaaataccggtgacgcaaatgaaatctaagatttttttattttttttctggttagtgtaatccgatacaggacattgaggggagcctaccgggagatcggtgaagtacgagaaatcataacggaacgtgcgtgcgtgcccgcctatccccgccgaccctgcatatctccgcgcgcgcatgcaccgggtccggcgcgaggcacggtctggtccgcccactccgggtccgggatcggagacggacggacgggagagagagacgcccacgcggccgtgtaccgtactgcgtgggcgcggttctccgcgcgcgaatgctacgtgcgctggattcgatttgacgcgcggccatggatggtggtgggggagaggggatcggatctctgctagctccgcggggcacccagggggggaaggcaatttaaccggagcccgctttttgtctcctgtggatcgttcgaccgcgccggggcgcgggcgggcgttgcgctgcgctgcttgcgtcgtctcgttcgtacaagtacgggacgacgtcctatcgatcgctttggtcagatcgttccggtatggcccgtagattgggcaagtcgaacagtgctccctaacatactgtatatagggctgtgtttagatccaaacttctaacttttttcatcatattaacatgtcatacatatacaattttttagtcacatcgtattaattttaacctaaacttccaactttggaaggaactaaacacagcctagtccgggtttagtttcccctattcccaacttttcatcacatcatatcacatcaaaaactttccatcacacataaatttctaactttttttcaaactttcaactttcttcaaacttccaacttttttcagaaactaaacacacccatagttatgctcattgtggctccaatgcttagggtgtgttcggatgccccttttcccaacccctctccctcgttttccgtgcgcacgtttctaaaactgctaaatggtgtgtttttataaatgtttctatacgaaagttgcttaaaaaaatcaaattaatccatttttgaaaaaaaatagctaatacttaattaatcacgcgctaatggatcattccattttctgtgtggaggtttctggttgggaaccaggtacaacgaacacacccttatccctattgattcaaagaaaattcatcagaattttagagtctttcattactatagtaatttttttaaatatctcccttcgaatcaaagaaatgaatcttatggaatggctaatgccatgcaaattttggaggaaactaacatgagattctacctcacggaaactttcctttgaatctttatctctcctctaatttcggggttttttgcgggtccaatcaaacagttattcatgtgtttttcctatgttt

SEQ ID NO: 20289 - DNA, 3632 bp, Oryza sativa
  unsure (1)..(3632): unsure at all n locations
nnnnnnnnnnnnnnnnnnnnnnnnnnnnnnnnnnnnnnnnnnnnnnnnnnnnnnnnncgtgcgcacgtttctaaaactgctaaatggtgtgtttttataaatgtttctatacgaaagttgcttaaaaaaatcaaattaatccatttttgaaaaaaaatagctaatacttaattaatcacgcgctaatggatcattccattttctgtgtggaggtttctggttgggaaccaggtacaacgaacacacccttatccctattgattcaaagaaaattcatcagaattttagagtctttcattactatagtaatttttttaaatatctcccttcgaatcaaagaaatgaatcttatggaatggctaatgccatgcaaattttggaggaaactaacatgagattctacctcacggaaactttcctttgaatctttatctctcctctaatttctgtgtttttttgcggtccaatcaaacagttattcatgtgtttttcctatgttttacaaccctctgttttatacttacattcatgtaacatactaaatttttcagggtaaaatttttgcgaaaatatctaaagtcgatgttcttcgttctttcgaattggagcctcccaatccttatattccttttgtttcctctaagtttccaccttccgcttaactttatttagtttccctctccaaaccaaatccgagatatcccaaagaaaattcccaaaatcatcagaagagctcgtgtttattttaagttaaaccggagtaatcatgcaaatattctaaaacccccaatctcatcgattcctattcaaaaatatcctaccaaaattctattaaaaatctctccaaaaattcaaatagatcactgtgtttcttctcgggccgagttcctagcaatccagcccatattctggatttcctttgcccatttccctctgtttgggccgtgctggcccacgactgctgttggcccagccgaggcagccgccgcacgcgccgtcctgcgccctgctcgtgttcgcacgcgctagtcgcgtgcggcctcgctcctgcctgcgctgctcatgtgccgccccgagctcggcacacgcccgctcgagccgcctccaaaacagccacgcagttgctcgttgccatccctcccttgtttcccctcctcctccagaccttctctccttcaaagtgaacgagccgaagtccgctattcctctgtagacatcaagtgctaatctcgttttcatccccaaatttcttctgccagagccaaggccggctgtgcagccgtttcgccgtcgtcgacctttttccgccgcaccatagcaccagcaggaccacctctcactggtgagaattttccccaaccttctttccttgcttctatcgggttcctatcgtgctcctgtccgccaccatggctaccaccgtgctcagtttttccggcgcttcatctctatcaactaaccacaaaaatggaaccttctcatccgggaacgcgttttgacgcgctcaccaggccacgttcgccaccggagctcgccacccaatcttctctctcctctagcggctggaatcctatagttcgcgttccggccagcatgaacatcctctcagagaaccagcaacagcttcgagttcgtagcacctggggacgaaattacctcaagacgttcttactgttccgccacaataaccgtcatccaacttttctctttttatctctctctctctctgtgttcgtggttcacagaggaagaagaacagtactagattcaatactgttccaccatggtccagcctgcccacaccacctgagccaacctagggtagttgtcaaccaaaaganaaccgattcatatcaattcttccatcagttcacccccagattcaaaccaaatcaattctagtatctgtaacaacaataatcccaaagtgcaaccactactacacatgccatgaatcataacctaaggataaatctttttttcatccaactcaaattaactctcgatttaacattttcttttgttcgggctctgattcacaatatttattttatcgtttatttgtagtatttttgttataggcttatttggtcgtttcttcgtgtgcatacgctagatcgcgttgaagatcccaccggactcgcaggaactgaagtggacctagaaggctacgttgaagctcccgaaggccacatttcacgaggcaagccatagttccaatctttgatcatattgaaaccttgtagagaaccacttagttattttctgcattgagtatttataaaattattttgcatatgaattatttttgaataaacttgttagtttagttattacccattattacattgttattattggccaaatccatgaattgctatatcacgtcctttgataacctaggtgtagatttatatacttcacaataatattctagtggataagactacccaatatctatactcatatacatggtttacccgtcgtcacgtggtggcgtgtcgggtgatataaaatgtgttatttgatatgagtcactcgcctggagtgatatggaagattaattccgggtgaagatggatgttgtggtgtgtgaggccgtgcatatctgtagtacttattttggggaaggtgtatatttacccttgaagtatgcacgggcctgtgttagttttggtggctttcccggatataaggactccccccttatgccatggaaaatgatgtaatttgcgcctatccataggattgagtaatcagacttagcgtagtacattgtcccactatatgaaagactgtagggtggctctatgagcaggtttggggtggacatgtggaaggggctttggccaggttgacatgatccacaacggtggaacccgtgaaagcagcaccgtctagccttgcttaggcctagcaagtgcccgactgctaggacggatcaatatcccactgggcagtaactagtagtaagtgggattctcaaacggctatgttgtcctcagcctagctagctgttgacatcaggtgggtaaagctgggcagtctctacagagatgagtcttaaatcattcgaatgtgccgtgcttccggttaagaagctatgtcattgggtgattcctatttatcatggtatgagtagattttaaattaaaatatggaatatgacgaagatgaggatgaatggtgattaatattgctaccattttaaaatgatgatttataattgtttgcgaataaaatgtttgataaagtagggaaaaactatttataataggcttgttatggaacctccttgatgaactatattctttgtacgccttgcatatattctatttgtattattatggatgtggcttgttgggtacctcgttactcacctcttgcataaaatgtggttcagacgatcagttcttccctgagaaggcgcagaaaggggaagaattctatggtgctgtcgagtttttgttctaggttgatctgctctcaggcgttgcctgtggtgtttttatcctattttgtgtttgagtcttttgtttgtagggagtgtgtttggcctgtcggcccctaaaacctgtcttagttatcttttatgtaataatttctgtaaaaacttgggtatatgtatcgaa

SEQ ID NO: 20290 - DNA, 780 bp, Oryza sativa
  unsure (1)..(780): unsure at all n locations
nnnnnnnnnnnnnnnnnnnnnnnnnnnnnnnnnnnnnnnnnnnntctggccaatgcgacatttgctctcgatatcctgcatgatactaaaagaaaacaaagtgaaatctcagccatatatcaggtggtatgaaccataggggcaattattgctgcaatgcaaaaagtccctgcatatcgatcgctgcaatacattttcctcccacaaaatacacaaaaataattattcaaataagaaagaaacaactaacagcatgaggtttgtgtagatagaactgtagaggtacaaacaataaggcactgactgaagagttgatgaggtaagatatgaaaaagtcaccacccagagttcaaaatttgttgcccatactcttcaaagataaaattcatctagcaaacaataagattaccaaaatggatgaaaagtgcatagcataccacatcaaaaagatcaggctcatttgtgaagtagtcaaatgcatcttgtccactgaaaagaaaaaaaaacaatgtttgagtaaaagtgtgaatattgcaaaaatgaagctctgattagtgatttctacatttccagtttccaagggtaaagtcgaagccacattaggaactccaatttagaatattctgagtcatacgtgagagggcaatccatgtttttcaggcataccggttgatatgaccaataattaacagtaccgggtcagacaaagcatgaaggttaagattgatgcatgtcactatctcttagcatgattaaagatagcagtattttgtacaaaat

SEQ ID NO: 20291 - DNA, 1057 bp, Oryza sativa
  unsure (1)..(1057): unsure at all n locations
nnnnnnnnnnnnnnnnnnnnnnnnnnnnnnnnnnnnnnctacgtgatatgatatcaagcaaacacaaagacaagaattataccggttcaggcccctaatcaagtaatagtcttaggtggtgtttgaatctcctgaagataaagattaaatgcttcacacaaaatgagatagtaataacgtgcgattaattgagttttaattactaaaaacatgcaaaatgaactaatatgatattttagagtaactttcatatagaaagtttttgcacgaaacataccgtttagcagtttgaaaagcgtgccacgaatatctaaaattttatcctctacttatagaagaaatgaacataccctagtccagtttatataggattgatatgaaaaaaccacaaagtacaatgggaacaaatgaatttggcgataccgatgggatagtagtcgatggattcgacgagacctcatggtgacttggcttcacgtgctatgagattcgatgccttcgaatctcatacatggcttcgtagactatgatgggtgtgttggcggtgagattcgatgccttgaacccctcccagggggtgccttttgtaccgtaggtcatcttgatctccaagtagaactcagaaacatcagatcgacatcagaccccgtacaatatggtaaggaccctatccctaccgagtaggactttgtcagtctctcgactcgtaaggatattttccttaatatctgatgaattttcttagagcatacggaaacaacccgtatacgtgaaggtataccgtattcatatattccataagtcctaagataggaggtatgccttatccataatcatgacagtagcccccaacttcaacctaaatgaactcgtgttgtcatctgcgacttcacctgttagcgtttgccgtactcatttagtcgatcccgtatactttgaaaaatcatattaatctattttttaaatttattttagctaatacttaattaatcatgtgctaaacgctgcttcgttttgcattctagtacccaaccctcactcccgaacacaaccgtac

SEQ ID NO: 20292 - DNA, 1329 bp, Oryza sativa
  unsure (1)..(1329): unsure at all n locations
aaaggcgacaaccgttggggaaaatggcgcttgcgagaacaaggattgtcgcgttggtgctgggagaaaggcatcagccgttgaggaagacaacgcttgcgagaacaaggagaaaaggaggaagatgatggtagcgaaggcaacatcgccctcgtcccttgattgtccaaagctgggtatcctcattgagcccttcttcatccctctctcttcttcctcctggatttggtcgagcttggggtcgtggttattgctaccgtggatggtgaggacgtgctcgacctcgatgctcgttggctggttggcgcatccacactcgcggactatcacagctggtatggctcgacgccctccacttgctccattgagtgagtggatcttgctcgttggcaacagcttccgtggatccggaaaatattgcggtaaatgtcttcctcgttgccgatttacgacagctaacatcggctcgctgtttatatttttttgggaattgctaaaaagttgtcacaagtttttttggcaaaaaaaaacttttaaatgttactgtagtatagttgtagtataactacaatgtaactacactatagttacattgtacataatagtgtaactgtactgtagtaatctctatataagtgatataaagttgcatatagtattttaatacttatatacaagttacaatattgttacggtatagttatagtggaattatattatagttagatttaaaagttgttcctttaaaaaacttgtggcagttttttggatactatttttttcttatccattgtttcctcagcatgcaatctttttcaccagttcttttcgtgttatcgtgtgatttttttcaaccgagtttagaatgctctggattttttcctttgttttatctagactcttcacacacgttcaaaatgaacgtgctcttctggacacgtggcacattttgatgatatgtgaacttggtttttggtttggccacgtggcccaatgatttggtagagtttgcaccctgcaaccagtattttagatttgtgtgcacgcatgttatagtaataatagtatatatagctctatcctattatataattaaaattagcataaatggaaaaaaacagtttgctcgtccacttgtatccctaaccacgtagtgtttgagagcccggcagggtttcccaaaccaccggggtcaggtgaccgcgctctagcgtaagcacggttatcgtgtggtatccgtggcaaaccgtatgcaaccgtataaaatttnnnnnnnnnnnnnnnnnnnnnnnnnnnnnnnnnnnnnnnnnnnnnnnnnnnnnnnnnnnn

SEQ ID NO: 20293 - DNA, 687 bp, Oryza sativa
  unsure (1)..(687): unsure at all n locations
atcaagaaaattgtgcccaataaatctatagaaagtggaaatatatcattgcaggctgaacatttggaacacctctgatgatatgagcttgcctctctaatgtccacccctagtagcagcatgcacttcggagagctctacaatccaaatactagtctcatttgtcattttgttgtagacaacaagcctggccctcctagctggcagcctggttggaatgataggagtatttttggttctgggaagcagtgaaggttggaatggtgggaaaaagtatgcatcagctaatgccacgacagttttttctggttccagaagcacaacttcgacaaaacgcatgctgtctcgaacctataatttcgggagtgacttaattatatatttggaacatgagtacataattttgtatgaaaggtagtagatggacagagacctcaggagttcttccagaagctctgacagttgctacagccacagaaatttcagcagcagatagtgggtctaaggggtggcttttctgtgtcctcgtcatgatccggattcctgaaatgtttctcccgcataacgtcaagtcattgtgatatagcatagctatgtactgatgcttaaattgaacagaaaatattaaactatccaaatacacaaattgnnnnnnnnnnnnnnnnnnnnnnnnnnnnnnnnnnnnnn

SEQ ID NO: 20294 - DNA, 1038 bp, Oryza sativa
ttattacctcattggacaaacatacacaaacaatatagattgcctgctcccctgcactcgtcttccattacacccacaattagtgctatttgtggtatttaggcttagttcccataaatagactagcccataatagcatcacatgcagacacaacaggacacaggaaaagaggaacaagccattgacactgctaccttttgacttaacttccaaacatcaccaattcaccataacttaataagattgaatgtaaaaagaagagctcattcctgcccttgaaaaatgcacattgcttgtgcaatatgaagcttaactttacataataggtcagacagccagagtagattatattctcaattctcatcctatgttactaatgagaacattttatttgtcttgaatcttcaagtgactttggctggtggggtaaatccacaaagaatgtttaatgtaatattaaaataaaaaaaacattagttttttggcaaacagctgtgtgaaattcaaattattattagaagttgatacaagatgacatatgagtacccactgaagaaattgattatgcacaggaatggaccatgcccccaacacccaagggacacacacacaaaaagaagtcctgcaactgtctgacctcatggtgtatatgaactaatgaatagttattattccggattgcagaaatccaccatgtaaatgcccatgaagcaaccaggtttccaaatagcaatcttaccaggtttaagatcacgatgaatgatcgcgtgcgcatgcaaacattccatggctcgagcaatatccaacgcaaatccaacagctacacgaggctccaggctcctaggccgaaggccaaccaagtacttgcgcaaagagccccccactagtagctcagttaccaccaccatgacaggctcaaggcaagccccgataaactgaacaacaagcgagtacattttcaacattcaaaagcatccacaactgccactccaagaaaagaaatgataagagtcaacaaaaagatcaagaccttgaca

SEQ ID NO: 20295 - DNA, 596 bp, Oryza sativa
  unsure (1)..(596): unsure at all n locations
nnnnnnnnnnnnnnnnnnnnnnnnnnnnnnnnnnnnnnnnnnnnnnnnnnnnnnnnnnnnnnnnnnnnnnnnntgattcatggcgcctttctccgaataattacagtatcagtaggagagccaattccctgtactcccactaaccaccacccccctgcaggtatgagtagctagctagctagctcttgatttatggagcacggagtatagcgagcagctagcgccttgccgtttgcatcggccatcccgatcgatctatcgcaagtttcttctgctactcgttctgaaaaggaaccatgtaggcgtagttttcgggcattgggatcggatacaccatcagattgaatctgataattttgtagagtgctactcatatctcaaccgatagatcaagaattaggagaaataatactcactcactttctcctccacttcaaaatataaccatatctcactacaccagatcctcacatctctgacgggatacctgtgacgggcaaacgaaatggtcactgatgaccgtcacctctgacgggtcatacgggatgccgtcatcggtgaggcatccagctacgacccgtcacaggtaactagtc

SEQ ID NO: 20296 - DNA, 3044 bp, Oryza sativa
  unsure (1)..(3044): unsure at all n locations
nnnnnnnnnnnnnnnnnnnnnnnnnnnnnnnnnnnnnnnnnnnnnnnnnnnnnnnnnnnnnnttcccctccgccaccgaccgccggccgccggatttgtttgtgcttgatgttgtttgtgcttgatttgctcatgtttgttgcttgtgtggatgtgtagtttgttaaaatggacatggatacttgtgtgatgtatattgtcagattgcttcatgtgtagttgtttgttgagatgtatttgatttaaaatacaaagttgttgtatcatgtgcatcttgagatgtatttgatttttcttcatttcgtacatttgggctgaggcatttcttttttttctgggtgatttttgacgtctgtgacgggtgagaactaaaaccagtcacagctgttttgtcacctttgacgggttgcaaagagtcacccgtcacaggtgtgagtcacctgtgacggctatattttttagcccgtcaaaggttttaattaccagtgacgggctttcacccgtcaaaggtgaggtgtagtcatcagtgaccacttgtctctgaccagaaccaaatccgtcaaaggtgagggttagagtccgtcacagatgactggatccggcctagtgtctaacatttaaattttattctaaaatatctaatttatttcaccattactcctatctcaatcaatcacaaccaactttcatttaatttctcaacttcatctcaaattgagattcagcgcggttgcacaaaagcaactgcatgcaattacaaccattcaagacctaacacagacgcaaacaattgctacaacaggatattcacaatggcactctttgctactattgaccatatgtgttgctactatgactgcagtcataatagggatggcaaacgggcgcgacgggcacgggtagtgcctacctatacccgtgcggccgtgcccgtgatattatttgtacccgtgggtatgcccgttactacatgacgggcaatgattgttgcccatgcctatcgtccgcgtgcgccttgtgcccgcgggcgtgcccgtttacgggcaatgattgttgcccatgcccatcgcccgcgtgcgccttgtgcctgcgggcgtgcccgtttacccgccacaaaaaaagcagtggaaaaaaagtctacaagcttctaagttcaaatttgtcggtgacatgggaccggggatatcttgactagaggtttggggcagctgcggtcacccacgtggcctgaccccctcaggggggggtcgggcccgatggtgatgaggccgcccctccctctatctccccgaggggtcgggccgctcccgtttcgaccccccgagggctggggcgccccgaccccctgagggtttggcgccacgtgtgtgggttaggtgagcacagcggcgctcacctaaccgcgtttattgcgggttggacgagcgcctcatgccgcatttaatgcagcatagcgcatgcttatccggtccgtgatcggtcgcagtgtgtgaccggtcacagaccggtcagatcgcgggttagggggcaacaggcggcctgacacacgcctcgccccgtcccgtcggaatgatgagagcctccaggcactcgtccctagccggagccggcgtgggaactcctggagttggcacgtcagccccggccagatacattccaggcttcatcgcaaccattgcaaggaagtcattgtatgaagaagggcagacgtgtagcatgctaaactgacacgtggtggacaagaatgaccggtctgtgactggtctgacgccggtcgcgtcatcagcaaacaaccgtgcttccacgttgcacctgcttccggcggagtggaggttggtatgacccatcccatcggagggtcattcggacagcagccattgcaaatctccgcccattaatgaggaaggacagggttatcccggtgtcagacgatggtacaagccaagttttggtcaaagtaggatgggtccccacccaaaagaagggtaggtagaaatggtgtatgtggtatccccttgagatataaaaggaggaccatgcctaccaagagagaggagggagaaaaagaggagagaggaccggagctggtagacggagaaaagaggagggagaggggctctagagtttgaactctcttgctctccagctctttgtaactccttcatacacagatccaccagaacacaggagtagggtattacgcttctcagcggcccgaacatgtctacatcgctcgtgtcttgcgcatttgctctctcgcgaaccattccacagatcaagggcttagaacctcacttagcgcccccggccgaaccggcaaaggggggcccgcgcggtctcccggtgaggagccccacgctccgtcaaaatcgaacttaaaacatcaaatattctccgcctcggtgtggtgtctctcctctggcagcgatagaggaagggggagagaaataataagggaaataaaagggaaaccgtagaaaacaaagaacgtggcttctacatgtaagttagatttcgcgggtaaatgggcaaagcgggcatgggcagtgattacccatacccatgcccatttacccatcgggtatatcttttgatccaataagaaacccatgggtataaaatggagaacaaacccaactctaatagggtttttacccacgggtaaacgggcaaacggacacaattgtcatccctagtcataatagcaaatacatcggatctggattgactcacaaccaccactaattttattttagctctctccttagggtgtgttcaggtcctttaggaggaggggttaggaccctttcttttcgacacgcgaaacgaagcacgcattagtacatgattaattaagtattaaatatattttttaaaaaaatattaatatgattcttttaaaatcatttttttctatggagatttgtttttaaagttacattccgtttagctgttttgaaatcgcccatgttgaacacgagggatgtgaagctgggaacctcaaacaaacgatcgaattaagccctcgtttgttaaggttaacc

SEQ ID NO: 20297 - DNA, 1089 bp, Oryza sativa
caacacgctcctcctccacaacctcctcatgagctcctccccccacggctgcctcccctgcaccacgccggccacggccacggccacgcccattcccattcccactcccacagccgcgcacacaaccccagtactcgcccacccacctccgcgccgccgccgcctccacctgccgccgcctcatccgccacgaccgcgccggccaccacgacaggcgccgcagcgacgtccgcgccgggagcggacgacgacgcgtggggcttcctcctgcgacgtgagccgccggaggcggggctcctgcaagacgtcctgcacgggttctacccgaccaggcggccgcacgacgacgcggggccggcgccgaagctggagcggccgtacgaggcgacgtcgtcgtaccgcgtgtcctccccctggggcgccgtcgaggactgcgacgacggcgacggcgacggcgacgacgactaccgcgggttcccgatgatgccgcaggggctcctcgaggacgtgatccagtgcccgccctacatggaggtcttggcggcgccgtcggccgccgtcggccgcgtcagccgcaggggctgagccgaaccggcgacgtcgagatctccgccgcgcgcagccgctcatggcgcgcgtgcatgcatgcgtcaatgcgggcgcattttgcttcgctatcctttgttactatctgcatcttctctaatcttgctgagattacggtggtgttctgtgtactagtttaacttgggatgattgatatcttggctagtactaattccatgcatggccttcttgaaacttgatcttgttgaaaaaatgaatcttgatcttattgaacaattaattcaatcttaatgaaaaaaaatctcgctcattagcatgcatgcatcaacagctagtttgctcatgcacagggagatttttcacaaccagtttgttgtttgcatagtgccatagttcgattaaaaccttttcaactttcagctcttttttgctaaaaaaaattcagctctgatatgatcgaaagctctttaatgccctgcacgtaaaagcagggatgggttatactaattgatggcccttatt

SEQ ID NO: 20298 - DNA, 8308 bp, Oryza sativa
  unsure (1)..(8308): unsure at all n locations
nnnnnnnnnnnnnnnnnnnnnnnnnnnnnnnnnnnnnnnnnnnnnnnnnnnnnnnnnnnnnnnnatcataaaaatgttgtgaaacatggggcattgttatagtcaaatctatatcagcacttttactttgaagcgcattatacagtcctactatgccacatccatccatcagtgagctcggcttcttaccaaacgacaagcagcagttgtaactttatatgcacgagttaaatgtaagttgtactcccttggttggacgagttatatctcggttggagtaccaactaaactgaggacacccacaatggttatttataggctctctataagagatccatgcccgcatattttcttacttggaagagattaaatgaagagagagagagagcaaagctatctactaacctggagatagtctatagagaaaaacgaggcaatgtattagagagctatagatacccatgtagatatactactattgaggtggtttactattaatctagtctattgctgagatgtacatgttttatagatagcaccttactttaccattgtgggttctctgagggtgtgtttagttcacgccaaacggaaaagttgaaagtttttgtgtgtagaaaagtttggtgggaactaaacttggcctgaacacaaaaaacgattcaaaggtaaatagtgacataacgaataaaaagagatttttgtaaaaccatctattattccagtatggaactaaggccttgtttagttactaattttttttcttaaaaacatgacatagaatctttgaatacatgtatggggcattaaatatagataaaaagaaaaaaaattaattgtacattttgcattaaaaagtgagacgaatcgtttgagcttaattagtccatgattagttataagtgctacagtaacccacatgtgctaatgatggattaattaggcttaataaatttatctcgcggttttcagacaagttatgtaattagtttttttcattcgtgtccgaaaaccccttccgatatccggtcaaacgtccgatgtgacaacaaaaatttcttttcgtgaactaaatggggcctaatatttcagtcacaacttaatgctttagattatcttcgtgacgcgacaaggttgcaattgcaagtactagccactaatagtgacatttcaatcagttgtaactttatatgcacgagttaaatgtaagttgtactcccttggttggacgagttatatctcggttggagtaccagctaaactgagggtgtgtttagttcacgtcaaacggaaaagctgaaagtttatatgtgtagaaaagtttagatgtgatggaaaagttgaaagtttaaaaaaaaaacttaggaactaaacttggcctgaacacaaaaaccgattcaaaggtaaatagtgacataacgaataaaaagagaattttgtaaaaccatctattattcgagtatgaaactaaggccttatttagttcctaaatttttttttcttaaaaacatgacatagtaatcccatggcatttcttgactctctacgcaaacgtgcgtagtcattgtgtttcttatgccatgtcttctttcatcttatcgtgcaagcctagtatggtggtgtttaaatctcctggagatgaaaatgaggataaagatttaagtgtttcacataaaatgatgtgataataatgtgtaactatttgggttttaattattacaaacttaaaaaatatattaatctgatattttagaacaacttttatataaaaagttttcacacgaaacacaccgcttagcagtttgaaaagtgtgtcacgagtatctaaattttcatccacctattacagaagaaactaacgggacaaaccatactcgctctttcagtccgctccttacatggctttgactctagcaagtgaccatgttatgttgcctttttccacattttcatcaagttgcaaagccagtgccgccgtcaaggccggtgaggcggtgactaatagcgtttgttagttactgactattttttcatacgtcgacaacaatcaacagagcaatagtggatacaaagctagagatggagctcgagcagttgcctgatccacctgagaggtgaacccgccatcgtttctgcctatgtggtggctcactatagaattggatgcaatcccatactttgcagcgggatatctagttaagaatggttgctaaacatatggcaaactaaatgtggtagaaattttagagattaaaaggtgggttgaaaagaaaatgaggtgggagtctatttgggcctatcttctagtttaggcctcactagttgttcctgtagacctaataatctaacagttgatgtttgagggacacattgatcaagcgactaaaatatgttgatgctgtggttcaacatggacaaaccaacaatatgaataatttctatgcttaagttcgatgatcggcctgctaatagttgtagccaaaatcggcttgagctggcccagttgggctagactagtagttcggccatgtttaggtctaaagtttttttttaaaatttttaattttccatcacatcaaatctttcatacacatatgatttttcagtcacatcgttccaatttcaaccaaattttcaaacttcagcgtgaactaaacttcgttgagcaattgagctcgatggaatggaatcgaagaacacgcacgcacgcgattctcgcagtacggccgcggggccccggcccggcgtctggttcattctctgcgcgtgcgcgcaaggatagagaggcgatatgtgtgatcgagctgagcagagtcgtcgcagtctgcatgcggccggtgataaatttcttgttcccttggtgcatgcgtgctgcatcttgcatgctgcgggcgcggattccggagttggtgcttcgctagctagccaaatctcccgtcacccctggcccaaatcaagcggttcaattgtcaattgccctgtcgaccaatccgtcgccaggaagacgtgagcaccggtggttaacagtgcaaagccggcgccaaacgataggtgcagacgtgcagcggagtactcctatctcggatgtcgttgttgtcgcggcggtgagccggcggcaacgcaggatgtgagggtaattaagaccgaacggttctgttgctgggagaggggagagagagagagagagagagggatagtatagcacgtctggattcgcgcgagagttcataacgctgtgcaggggcgcctggaacactgcatgtgtggcgctttccatcgacgatcttcgatggcgtattgtgcgggtatgatgggtatgatgggttgctgtgggttcaagtgaaaaaaccttgcttggccttatagcaagctgtgcgcaccggcgccggagaggtgtatgatcgacgagctcaccgaagaatggcacgtacataaacaagttcaaaccccccttgtaagcttgttgtacacttgtttgtactactattccactccagatacgtatagtacgtattattgtagattccagtacacgtattagtacgtattattgtacgcgcagcgtctcccgagtactaatacccagctaagagcaagtttaatagtatagctgactactggctccaaatgaactatagtctattttatagccaattcagggcctcattgtttgccgtatggcttataagccaaagccaaaatttgaattttaaaacttgatttttaatttgattttgatgctttttcagcacatattttcttagctttggcttttcaatcactacgaacatatatacaaaagttttactggcatatcattttataatcgcttataataagtcattgtcaaccgatggggacctcatacaatagttatctatatacatatactacacaattcgtatctggtcccacatgtcatacacacatgtatcttagagtccgtgctgtagctggctataaatctgtagcccgctgctcttctcttttatcttttatattctcaaaatatatttatagttggctacctgctctaacgggttgaccgccacttttgttgcaccacgcgctatcctacaggacttgcattgcaaaagtcatatcccgattcgtgaagatcttctagtactactactactccagtggtacggtgtagtaacagaaaaaagttcccatcggccatcgctgctacagcctacagcctcctccagctacagacctacagtacagtaggagtactacggtacagcagcggctcctctctcccccgtgccacgcgcatgcacgcatgactgcgcccacacacacacacacacacacaggtcctcacccatcttgtcatccccggcccgccggctggccacactgtgcgcgccactgtactgtccgcgggaagagcatgcgtgcagccgtactggttggttcccagctgctgcatgcatgccgtcgtgacgcgaaaaagggctccttgtcgcgggccgggctccgcgggcgcgcgcacgcacgcacgcacgttctcctctgcccccgcggccgacgacggcacggcaggctgcacagcgaatccaggcggtggcgcggcagcaggcgctggctactagtaccacccggcacccggccctgcccgccgcgcgcatcccgacgttcgtgtaccgtacgtgcgcattccgctagctgcgcttccggtcgtcgtgccgccccccgcgattgctcgataggaaaacctgtgaatccggccacaacggaggtcggggggtgatctctgttgtgatcatgtcagctgggttgctgatggtccagttcttcacacacacatacacaaataaataatattatatacgtacagaatataattttttttagttgttaagaaagttgatagaattatatgagagaagattataattagatgagaaatgaaggtaggtagaaaaaatgaattgtgtagggttgtgattgattatgaagagaatgttggtaaaaaagttgttatattttttaataaatcttgaaggttaaaagctgttatattttgggacagagatggtactactgaatttgaagttctttgtctctgtcccgtgtaacccagccgtggctgaatatatgcatgcattgtgttctgaaaatcatacgtgccaaggaacacagacgctgccgggctcacaggatctcactgcaccatagcagcaagaatttgatatctcaaatcatggcagagtttgtttggcgctggcagtgcaaagaaaacaaatgcgctgtgccaaagtcagagtccataaattcccaagatatgcatgcatggaccgtgtagtttttttccttttcgcattttgaccgtgtagctcatgcttgggttgctctagcaattttgtgcagggtggtgtccgaacagggaagagaacagagtaggacaaataaactaatcaggcccggccaggccatggaatagaagctggtcagaatagctcgttgggcagggcaggatgcagcagaatgattgcagctggagtatccagaagatgtccccctctgctctcaaaaaggctcctttcttgtgtgtgccttcatcaatgtccatgcttatggctccagtgcacttcattggccaagatttcttcgctatagctgctctcagtaggggtgggcagaataagaccgaaccaaaaaactgaaccaaaaagaccgagatcgagaccgaaaagaccgagaccgagaaattcggttagtgattcggtgccagccatctaaagaccgatttttttcggttaattcggtcatatgcttcagttaaccgaattacccgagaaaatcgaaatttggcccaacaggtgtagtaggcccaataagcccactaaatagaacaaaccctagagggactcagggtggagcagccgagactagagctgctcactgcctccgtgcctcgtatccatcgcgccgccccagcccccccacgcctctgccttcacctgcatcgcgccacctccgccgtccgcctccagcgccggcgccacctccgcctcggcgccgcctccgcatccactctccagtcagcccacctccaccttggcacctccatcccgccggcaagcaaatccaccaagtcgtcggcttctaaacctaaacctacatgatcttcaccaagttgaacacttttaactatttcccatcttctctgtcaatatttctgaattgtaatcaagttttgttttggttgcttgttttaaaatgtgtttcaggttgctgaaaagtggaggaagaagactaagatgggtacatgtcaagcctaaaacttatttactagttggctgttgctactgcttgatctgtgatgtaatgttatcaacctataacttgtactgtggcagtcgtgactcgtaacttgtgaggttcagacttgagacctatcctgtgataatttggtgcttgatgttgcctattttttggtatttttgtgatatatatgtctgtgaaaaaaagtctaaaaagagggaaaatgttgtcaaaatttttcattcccctcaaatttcggtctgaccgagatcgaaaagaccgagaccgaatttgccggtcataagttttttttatgaaattcggtccggactttccaaagacggaattacccaaataaccgaagaccgagaccgaatttttcagtctgaccgaatgcccacccctagctcccagcgcacacacacatacacagagtgtgtgtgccgtgcgtgtgtgttgtgggcatggcaatggcatgggtgtgactgggttggagtttacgagcaaacacaagacattcaattgcctgcagctgcagcagtgttctagggtttggaaaccaaggacccttgtcacatggtcctgtccctcctatactgtccctataccactcctctgcctacgggtctcactcctgaccctgctggttgtaccaccattgccatactgcttgcagacgtgtactcgatccgtcaggacaaacatactcctacatacagtagttacagtagccgtatgtgtgtgtgcgtacaataccaccagtagtagtacatcagttataactagaaaatcagcgcgccagttggcgcgcatgatttatagcccgtatatattatttttgtgttattaattagcacattgttcataaaaaatatagaaatcaatttaatttctttgaaactcatgcaaaaatcatagttgaatggaattttctgagttccagtttaacataacagatcatattgttgagaaaatcatcaaattttctctttttttccacccatgctattgtttcttcctttgtttttctaaaattataattaagttattaactaattataaaattggtgttggtattttttaaaaaaaacaaagtgtttcacccctcacattatttctacaatattttaacaaatatacatatcatcacattatttctacaatattttaacaaatatacatatcatttttataatatttaacatatacttatcaatatgctccacattaaaaacgggtatcatttgtttattttatgataagtaccgataaaacttcacgtttcattattttctattctttttactcttagtttacttgttgaacaaaatatattaaaaattgtttagtgatcccgtagcaaagcatggagaatcacctagcaatagaaagtggaagggccttgaatcttcgatgattcgtccccttcaccgctcatcgccatcgcggccccgggtcgttggatcctggcattggaactttatttgctgcgttggtgctgggagaaaggcgatggccattagggaagacgacacttgcgagaacaaggattgtcgcgtcggtgctgggagaaaggcgatggccattggggaagacgacacttgcgagaacaaggattgccgtgtcaatgctgggagaaaggcgacaaccgttggggaaaatggcgcttgcgagaacaaggattgtcgcgttggtgctgggagaaaggcatcagccgttgaggaagacaacgcttgcgagaacaaggagaaaaggaggaagatgatggtagcgaaggcaacatcgccctcgtcccttgattgtccaaagctgggtatcctcattgagcccttcttcatccctctctcttcttcctcctggatttggtcgagcttggggtcgtggttattgctaccgtggatggtgaggacgtgctcgacctcgatgctcgttggctggttggcgcatccacactcgcggactatcacannnnnnnnnnnnnnnnnnnnnnnnnnnnnnnnnnnnnnnnnnnnnnnnnnnnnnnnnnnnnnnn

SEQ ID NO: 20299 - DNA, 11091 bp, Oryza sativa
  unsure (1)..(11091): unsure at all n locations
cgtatgaagccgtataaaatttatcaaaatttcgaagtatattttaaatttatttgaatttaaagaggttatcgtagtttttcttttacagtacactcgcggagtcgcggtaagcgcggtaactctagagcccggcggcggtactgttttgctagcgtaagtaaagggacaacgagaaacaactccgacgcgcccattgtatatttacgtatatcacatgcggtacaagtagctgcacgtatttggggggtacgtatggcagtactgttctccagcacatttgtcgtatgccagttgacatgtctctcagagacaaattaaggagggtcgtagctagccagacacagccacaggcgcggtgtattgcatggtgcagcttttctttttgtggaaaaataggggggtcgtagtgcatcatgccatattgccatgcatcggatgaattgaagatgatggggacgaaaatgcgtgttacatgatgcggcccttgtcgtctcctgcgatcttcatagctagagaatcataactccaagtctccaacgagttgtagctgctaacgatcgagtggtacgaacgaaaaaaaacgatccgccaaaaaaaaaaaacccaacgttgcgtaatgtgattaaacaaaaaaggaatttcagaaaacattgggcctgttcggtaggccaactgctgcggctgcgcacagtgagtgcgacactgttcatgccgactgcgccgcagccgcagccagggcagccggacaggcccattatttgaccgaaattagatcgtataaaaaaaattctaggagagaggttacaggaaatgaaaaactgacagaaattgctgggggatccaactgctgatcacctaagataggaaatggaaaacagtagtagtattgtattgtggacggacaacgactactgaaagtctataactatgaggccagcagtaaactaactctatgaacagtaaaatcataccgtgtgaggggaacagtatttgggagaacttaatttgggccgttacatgtgtaatcggatggtaaaggaagagcctaacgcaactcttgtgaaaacggcacagttgaagccgaatgttatagagagagcacatggcctcgtagaactaacggcccaggatccggtccatgtgggccatttacagattgttgggccttttgagcattaatagatgggctttgagttgtaccagattgggctaaaaacatggggaaaaagtccactttgactcccttaaatatacaccgaatctaattcgtacccatcaaccagaaaaccggttaggacgactcccccaattactaaaaccggtacaaattgactccctaagtggttttagagggtggttttgctgacgtggcatgctgacttggtctgttgtgctgacgtgtcagcccagtcaccaaaatacacatgaggcccacatgtaagtgataggagaaaatataaaaagcgtagggcctacttgtcagccatcttctccctctctattttttcccccaaatcccccaaaaagaaacagtagagcaagcggtcgaggaagccgagtgcgtagttgttgtgcgggcactgcactacacgttgtcgtaggtgtagacgagggtgtggttgttgctgctcagcatcagctctggctcgctcctctcttggtactgtgccgccgcgtcgccggacccggacggccccgctagcggcctcgcgcctggcggcgataggtccggcaagcacttcgccgaccgcttgctcccgaaccgccccggcgctgccgctgctgccggcttgagcgtgcccccgccgcggatgagccggtggattccgaggtccgccaatagcggctccatgtcggcgtcgagcaggatattgctcggccggacgttgccgcacgaacttcttgtcgtggaggaaggccagccctctcgccatgccgcgggcgatgcgtcgtcgctgccgatcctgcgcaccgccagcacggcgccgtcgtccaataccgccatgtacatgatgctgctgcccgccgcgcctaggatgtacgccgacgccttcagtagcgtctccatctccagctccacgtcgccgtccaccgtcaccagcaccgcgccgccgccgccaccgtccttggccttcttgccgccacgtcgtccgtcttggcggcgacgacgccctccttggcggcgaaggacgccgacgtgtcagtcacctcctccgtgtcgtcgctctcgtctctggcactgaactggcgccgcgcacggcaagaattataccatttctcccctcgtcgagtgtacaagaactcctcggcgtgtcgagggacaactccggcgccctcccgatgaccttgaccttggccggcgccggtagccgcatccagcacccgaacttcccaccgctgccgccgccgccactaccggcggcggcggagtgttaacaacatcgcatcaacacggaggtggagctgtaccgccacggcagccgcacccggcacccgatcttcccaccgctgccgccgccgtcacctcactgtaggatacgcgacaggagcgaccgcggcgactggcagctctcgatgccgccgcttcgcccggccttcgcgccggccttctccacccaccgccgcccacggcttcacggcttcgtgcactcccttggcgccttccactccgctccctcgccgccctctgctccgccatccgtgccctcggcaagctctccgcgctactcgccgacgggaagagaaagagagaaataagggagagggagggaggcagaaaggttggaaagaaaatgacatgtggaccccacaagtcagtggatcctattataatttttgtgtgtgagtgacaaattggtcccacatatatatttttaaatctaatcttacatcagtgccacgtcaacgccatgtgggacgaagaccaagtcaacaacgccacgtcagcaaaaccgcccttgaaaccgccgagggagtctatttgtaccggttttagtaattgggggagtcatcctaaccggttttctggttgagaggtacgaattagattcggtatacatttaagggtgtcaaagtggactttttccaaaacatggcactcagtccccttccgtgggctaccacaatgcacccgcagctaattaaaggaataagttcactttgtgacccttaaaagtgatcgaaatctaatccgtaaccctaaaccacaaaaccagatatttcgacccccaaactctcaaaaccggtgcaatttgactccctcgacggttttggaaggcggtttcgctgacgtggcgcctacgtggcagtattgactcggtctcctttttcacgtggtgttgacgtggcgtttaggtggcattagaaataaaaaatatgtgtgaaacccatttgtcatttatcaaaagtatggatgggcacactgacatgtagggcccactagctagctcgatcaatataaagagcaaatcatgcattcatcaaatcacatcagattaccacactaatcacgattagtgtaacaatactcacgtacatacactatacaccatgtcgccgcaggccaaatcccaaaggcaaactgcttctcttggtggtcatctccttcctctccgtgttgccatggcacacgctagcaagcggcagcggcaagcccctcgtcactgccatcaccaaggacggcgccaccaagctctacaccatcgccgtcaaggatggccaccccctcgccctcgacctctccggcgagctcgtctggtcgacctgcgatgcctcccactccaccgtcctcccctatgagcgcgagtgcgtggaaatcatcctctcttcatctttatggggcccacataaagcaaggagacggggaggaggaggaagggcggggtcgagccatgggtggtccatcaaattcggtatccgccgccccaatctcttcctccactggctcctccggtcttcctcacgcaccgatttgtgtcgccaccgccggccaactctcgagttcatcgtcttggctacggctggcgtggccgaggaagaggaggagacgacgaagccggcagtggcctcactgagactcggcgacgtctagggcagcgcctaacggtggctggagtgcgtgacggcgatggagcgagcgtggcgctcgagcggcacggggatgggaaagagcaggtcttggggattctctttatataggccggaggggagaaggtcgaccgcacggacggaaaacggcgccggcgacggtggagctccctattgaagacaccggtttaagaaatcgattgagggcgatttagtgcgggattaagcgggatttgttggggaaattgatgcccactacacaaggaaccgatttttctaattaatttagaggagaaacgatagggcagggagatcaatggaggcggcagtgcttgagttttacgggagagatgaacagacgacggacagaggtgggggaagctcctggcgagcggggcccacctgccagcgaacggaagagaaatagaggggaggatgaggagagaatgattttatgtgggccccacatatcagtgggtcccacccatacttttggtgaatgacaattgggtcccacacatattttttatttttaatgccacctaagcgctacgtcaacgtcacgtggaaaggagaccgagtcaatactgccacgtaggcgccacggcagcgaaaccgctctccaaaaccgccgagggagtcaaattgcaccggttttaagagttagggggtcgagatatccggttttatggtttagggtcatagattagatttcgatcaatattgagggtcacaaagtgaacttattccgttatagagagagcacatggcctcgtagaactaacggcccaggatccggtccatgtgggccatctactagattgttgggccctttgagcattaatagatgggctttgagttgtaccagattgggctgaaaacatagcactcagtccccttccgtgggctaccacaatacacccgcagctaattaaaggctgtaatggaccaaatgtccaatggagaccatgtcttgagctgggcctcatccagtcatcctggaccatttcaaccatagcaaagccctactcacagaaggtttttggttttccttatctctcgtgcctttgaatagtcccgatgcatttggattatctatagtgaatttgctgcagaaaagaggtgattgctttgataagatcacagaggctaataatttactattatattcattctagaatataagcatcgttttgctatatacctagatatttcttcataataaatagccagaagcgattatattttggaatggagagaatcacctaaacgtctgcaacggtgcaaaaagaattccgagtcaaagattctttagataaaccacctatactttaatactagtattacttatttgttcagtttagccttcgttaaaaaaaagctgcagttagccatggtttaggagaatacactgaagaaattaaggatgaaattaaggaggcagcagactggcccagctctttacgtactgcaagggcatgttcaccattcaagtgagcaagacatgctatttggcagatatgaatatatgaagcatatcttcagagagctgctagtattattttggtttcatgatagagtagtgcttctactatcattgctcctgaatggatggcaataaaaactgaacaggcagagtacaactaggttggctttgtgttgttttattaatcaccggattatttatttattttacacaagtgacctttttctccttttaatacaatagacttattattgttgtgtactatggctctgcaacgtcgcacaggacttggatcagactatgtaaccagggcatttatataacgtcagtcgtcagacatggccagcttcactattgctttcctcttgattatgtggcgccctacgcaattagatggagattttgaatttataatgccatgaaaagaaatgaaatgcaaatgtttagttgcacaaaagatagggaaaagaaagcctcaaacaaaaagaaaaggaaatggttgccctgcctttgtagagaagtagattgcaatgatgaacccttgaactccaaagcaagatttcaggtgccattcgcataaactaaaccggcttgagagatgttgagctcagcgtagggaatcagtattataaccaatgatggtctgcagccacactatcatggaagattaatactagattaacatgagggacagaattgacgaccttcaggtgttccattcaatcgtatcactcaagttttcctttcttaattatccacccataatcttcgtgtttgctcgccagatttgcagacagggcgtggcaagctctgataaaactaatgtgtttcagctcattaaccgatgagtttgtccagttaatggctataggaaattaaccatgcgtttctgaacctttgaacagctaggtcaaaccctcggactagtagtagagctcaagccatggagcagtttttaacatggacatttcgttagttatgggagtgcgagctctgaattttcctgaaacggaagaatcttgctgcctctatgtcagaaattcagaaagaggaaaaatcacaagtggcgggcaggcgcttgatccgatacaatggttatggaaataaacgggcagcctcaataattagcttgagccatgactaattgtatatacaatataaccaaacttctaacctgcattttaattcttttttcgaaacaacctgcattccaaatcttcatatttggtagtactagtcatttccaagggcggtatagaaattactagtactttggactcgtctaaccaaccaaacaacaaaaccatacaatttcactcctatgaaaaggcgatctatcttagtataaacacaatattttcttagataatgaaataaacctgatatcaagtgcagatgttcacatgttattttcatttaaacttccatatgggaaaaaaaagggaaaaatatacatttctcttaattaaagtagaacttttatggtcgcagacagtgcgacctttttcctttcgactggagttcagacccaccatttaatttactaattgctgcgtctttaattaagtggtgacaagaattggatagaaaaatttatccagaggtgctccacatccactccatttgatttaacaaacgctaagtagctaacctacctatgtcgcgcctaaccgtagctgctaatgaaaacacgaccaaacgcaaacgtagctaattaatctagctataggttatctgagtaattaacacaatcaatcaatcaatttaatgttggacataaattccttgtgaacaaactgctaaccccactttttgcatacacttgatgacttaattaagattataatggtaaattcagtttcccgtcggaggacgacggcgtctcccgttggcgttggtggccctaggggctgcggtggctctcatcggcaccggcagccctagggactgcgacggaagacgatggcggtttccgtcggcgccggcggcactaggggttgcggcagcccaggacggcggtggctcccgtcggtgccggtggccctagaggctgcggcggaggacggcggcagcttccgttggcgttggtggccctaggggcggtggtggctctcgtcggcgccggcaaccctaggggctacggtggcccaggacggcggcggctctaggggttgcggtggctcaagacggtggcggtctgagcactttggatagtagatccttaggaatccggtaaagtggaagccgatcccgtcggttcgtgtctagttggctagttccgactatacgacgaatgatggtggttgagagtgggcttataagcggcgtgtgacgtcagctgcatgcctgaaactgactgaagatgaccccaatggaggttttcatcaacggtgcactaggggcgacagcgactagtagactttcactcgtcaaatctagctgttttaggagaatatggaagcagaaaagcaggatgtgctgaagtcgtttggttttcttttctattttggttgtgttcttttccttgttgagacgtgagtctaagtactattgtatccttttggctgtgtatatccttcgtggatatagaggccagattaatgaaaatccattattaaaaaaaatggtaaattcagttattgaccactgtatgacaatgatatttccaaaagaaaattatcagggccttcttagaatgcaagatgtttttttctcgattcagaatagaattaaactgatcgatgtgaaagtaactttggcctgcattagaagagaacatttaactagtgatccaaccgagtcctgtatctaggagcccatcatgctcatctgatccccagcaaaagcttgcaagcctcctactcaactctgagcccctccctcctgacttttgcatgccactctggtccctgtttcacatgtccccttccaattcaagtcccaaatcctaatcaatacccttgctagcactcatcagagttcatcaatgacagtctggtatatgaatagtttgaattgcaaattcccactccctcgcccttgaatcccagaaaaaaaaacacctcatgttagtgtactaaattagtgaaattcttggcctttcaaaaaaaaaaaacattgttagcaaggctagggagttgccgctgatctctatctctccgagcatgtgttagtggacgcttttcacggatgtgagtgtggtgttgcatgtcgtacacgtaatcggaaaaaacattttgaatacttccattatccaaaaaaaaagattttttttcttttttgcatcttccttgtttggcccttgcttctctctctctctctctcctccccaaccacttgggcatcatgatataagtagagccaccaagaaaccatttccaagggctcacagaaagtcaggggcctagccagccagccaagccagtggttataaccaacctcccagtgaaactttcagaccctcccgttttagcaagtgagagaagccctgcgactctcgctcgctcgctcgcccaagatgaagtttatgaaacttggcacccggcctgacaccttcttctccaacgaatccgtgaggtgtttttttcttgagaaatcctgatttgtggaatcaatcaatcaatcaatcttggcatggtttcagactttcagttcctgggattcttgcctgtcgtctgaggtgattgaatcgtggttgcctgatttttgtgggtgtttgttgtgatgttcacaggtctgtctgcacagaggtcgccactgacctgcaaatcttggtgggtgactgcttgtatcagcttcacaaggtaatgggacatgaaagattgttgttgttttttgtttcgctgtggttctagaacggatcttttctgcaacttttgtgataattagatcgtgaattttaggggaattttggatttggttgcatgtttggattgttttgatatcgaaggatttgttgatgatgtttgtttggaatttgtttttgacagtttcctctgctgtcgaaatgcctgcttctgcaagcgctgtgcgccgagtccggatgcggcggcaatggcggcgacgtgatcgagctcccggggttcccgggcggcgtcgaggcgttcgacgcgtgcgccaagttctgctacggcatcaccgtcacggtgagcgcgcggaacctcgtcccgctccgctgcgccgcggcgcacctcggcatgtcggaggccgccgaccgcggcaacctcgccgccaagctcgacgcgttcctcgcctcctgcctcctccggcgatggaaggacgcgctcgccgtgctcaactcgacgcgccactgcgcgccgctctgcgaggacatcggcctcacctcccggtgcgtggacgccgtcgcggcgctcatcgcgagccccgccgccctcccggcgcactcctcgtcggcgtcgccgtggtgggcgcacgacgtcgccgagctcggggttgacctgttctggcgcatcatggtggccgtcaaggccaccggcgccgtccacgagaagaccgtcggcgacgcgctcaaggcgtacgcgcgccggtggctgcccaacgtcgccaaggacgggatcgtcgtcggcgccgaccagccgttcgacggggtcggcaatggcggcgacggcggcaatgccagcgtcaagcagatcgccacgaggcaccgcctcctcctcgggtaccgagaagatcgtgagcctgatcccggcggagagggacgccgtctcctgcagcttcctcctcaagctcctcaaggcggcgaacatcctcagcgcgtccgccacgtccagggcggagctggtgcggagggtggcgtggcagctcgaggaggccaccgtcggcgatctcctgatcccgtcgctgtcgtgcgtgtccgagacgctgtacgacgtggacgccgtggcggccatcctcgacgagttcgccctgcgccacgccgccgcgccgccgccgccggtggcgctggcagtgagccccgacgacgacgacgacagcccggcgcgttccggcgggcaccggcgctcgcggtcggccgagagcgtcgggttcgacggcgccgcgcggcggtcgtcgtcggccgcgcccgtgtcgcccgacgcgctcgtcagggtgggcaggctggtcgacggcttcttgatcgaggttgccagggaccccaacatgccgctcgacaagttgctcgccatggccgaggccgtcccggacaccgcccgccccgagcacgacggcctctacaaagtcgtcgacacttacctcaaggtgagaatatatttgaataccacaaacattacaaaattctactaatatttaacttgatatcaatcttgttctggttttggatttgaatttgtggttaacttttgtttttgtttttgtttttgggtgacaggtgcactcggagatgagcaagagcgcgaggaagcggctgtgcagggtgatcaactgcaggaagctgtcggacaaggcgtgcgcgcannnnnnnnnnnnnnnnnnnnnnnnnnnnnnnnnnnnnnnnn

SEQ ID NO: 20300 - DNA, 3020 bp, Oryza sativa
  unsure (1)..(3020): unsure at all n locations
nnnnnnnnnnnnnnnnnnnnnnnnnnnnnnnnnnnnnnnnnnnnnnnnnnnnnnnnnnagaatatatttgaataccacaaacattacaaaattctactaatatttaacttgatatcaatcttgttctggttttggatttgaatttgtggttaacttttgtttttgtttttgtttttgggtgacaggtgcactcggagatgagcaagagcgcgaggaagcggctgtgcagggtgatcaactgcaggaagctgtcggacaaggcgtgcgcgcacgcggcgcagaacgagctcctcccgctgcgggtggtggtgcaggtgctcttcttcgagcacgcgcgggcggcggcgatggcgggcggcgcgcacgccgcggccgagctgccgggcagcatcagggcgctgctgcagtccaagtcgtccgggtcggatcaggaggacgacgcggcggaccgcgtggacgagcagcggctgcgcgcgctcgccgcaggcgcgtcccccggggacgactggagcgtggagggcctgcggcgcgcggcgtccaagatcgccacgctgcggatgaagctggaggaggacgacgaccacgacggcggcggcggcgacgacgaggagttcgcgcgcaggcagcaggccgggctggcgcgcagcgcatcgctgcggttcagggcgttctgcgccatcccggcggcgaggccgaagcggatgctcagcaagctgtggccgctggccagaggcgtcaccaccgagcggcattagcgtcgcaaccagtagccattactactaggttttttgtacttcttcttcttgggtgtcttgcttgcattgcttgcccaaggcctgagaatgcaggtttctttgcttgtctcttcttcttgtttctccttttcaattacagtgtcaaggccaagtgtaccttccaggcttccatgtagttgtaatcttttctctctctccgttttttttttgggtgaggcatgtagttgtaagcttaattattaaaaataaataggaactgcacagtttatatacttatgtaaggagtaaggtgaatggatggagtgcaatttacttcatgcacatttcctcaataattttgctgaacatgctgatgcagggaactcatatatcaacgataatcgacattgtattcgcttcgtatctatattcaatgatattcgtttcgtttccattattatagtctaggtttctgtatttgtttatgattccggtatatatgaaaacaaatgtggtagaccgtagaactactgttcattcatatatgagtcgttttcacccctagttagaactattggccaccccaatttcctcttttatagagtatattatttgtgcgaacaaattgttcatgaaaaattatatattaacaaacaagacttttgtgattcaaaggcaccatattttgtagtgttaataaggtaaaaaaataatactaaaaataattgtaccttatggtgtgttcttaaggaccgtaaaaccacttgacaaaatgattttgcaagtatactcgctccattctaaaatataggaatttccaagtgtttagcaaaaattaaggtatagacaaaagattatcttgtagtcactttagtggttaaattttaaactttgagttgacaatatttttctttccaagcatctcattggttgaaaatgtatatatttgtgttcactgaaatcagcatctcttatgacaatagtgcacatcatagttttcatggtacaaatagcaaaagaggccatcaccatgcactatatatatctccctttctttaatgcgcgatcgagaagcaggcctatgattgttatccacttggcttgagaaaaattgcatcctgaagagacccaagagggagagagaaagagagagagaggaacaaagaagcatggaaaatccaggagggaatcaaatgcaccgcggatattattatttcatcttctttttacctgaaagatcccctttgttaggtcttcgcgtgtgtgtaggaggggtatatatgccccggccgcggcatgatgatttggtgatgagacctcgagctcgaaatgttgttgggtcagcaaccactataaacaagaacaggtcagcatgggcagccttttctagccaccctatgatcctttaacttgttgttgctcatcactagcatgcatgggggcaggctcatccacccctggcccccaatgttgcttcaaaggatgtgtcatgtcctagaggaaaatttttcaccagaatatatatacacctcagcaaaacaatcttgtgagatcctatattgctatcatgctagtatggtttatcttttgccccttgaatggtggatgactctctctatgcactactagaaaaagtatttttcccaggcgggggaaatgggtcttcccaggcggacgctggctccgcctatacctcacaatcttcgcaggcaggccggcggtccgcctagtaagaccattatcgtaggcgaactggagctagaggtgccgcctaggaaaatagattcagtgcgccagaaaaaatgtgattgatctgcctgcgaaaataggtacaaaatttttttaaaaaaatgctacaataataatttgtgataaataattttccaaataattaattaattgatgcataaaaaatattagtaactaaaaaacatttgatattaacaaatatacatatattgcataagtgaaaagtgtcgtcaaaatgttacaatatttataacattgtcacttcgaatacactatctaattatattatggcaccgcgttgttccactcccaagattcttgtattcttatcttgtagccaggatgctctctgggtcgaagaactatcctttgatatgacagcactcacggtggatgaagtgacagagatcgcgctgcacatttgtaatgcatgtatcgtcaaagcttgtttgatattctattctaggcagctgcatnnnnnnnnnnnnnnnnnnnnnnnnnnnnnnnnnnnnnnnnnnnnnnnnnnnnnnnnnnnnn

SEQ ID NO: 20301 - DNA, 1779 bp, Oryza sativa
  unsure (1)..(1779): unsure at all n locations
ccccctataaacaagaacaggtcagcatgggcagccttttctagccaccctatgatcctttaacttgttgttgctcatcactagcatgcatgggggcaggctcatccacccctggcccccaatgttgcttcaaaggatgtgtcatgtcctagaggaaaatttttcaccagaatatatatacacctcagcaaaacaatcttgtgagatcctatattgctatcatgctagtatggtttatcttttgccccttgaatggtggatgactctctctatgcactactagaaaaagtatttttcccaggcggggggcaaaacaatcttgtgagatcctatattgctatcatgctagtatggtttatcttttgccccttgaatggtggatgactctatctatgcactactagaaaaagtatttttcccaggcggtggaaatgggtcttcccaggcggacgctggctccgcctatacctcacaatcttcgcaggcaggccggcggtccgcctagtaagaccattatcgtaggcgaactggagctagaggtgccgcctaggaaaatagattcagtgcgccagaaaaaatgtgattgatctgcctgcgaaaataggtacaaaatttttttaaaaaaatgctacaataataatttgtgataaataattttccaaataattaattaattgatgcataaaaaatattagtaactaaaaaacatttgatattaacaaatatacatatattgcataagtgaaaagtgtcgtcaaaatgttacaatatttataacattgtcacttcgaatacactatctaattatattatggcaccgcgttgttccactcccaagattcttgtattcttatcttgtagccaggatgctctctgggtcgaagaactatcctttgatatgacagcactcacggtggatgaagtgacagagatcgcgctgcacatttgtaatgcatgtatcgtcaaagcttgtttgatattctattctaggcagctgcatgcatgaaagaaccacaatatatatattagtaggttctaaatgtgcatttctccaatgcacttatacgttgagtcgagagatttacatcctctgcgttaaccctttatttcccattaaccctgaggaattcgcatgcgtaatacctgcagaggaccgtgcctctagattgcttgtgacacttaatgacatatcatagaaggaaaaagttaaattttgtaattagtaaaacaattggagtacatttactgtgtggactattatatatatatatatatgtattagcagcttctctcttgtttgaatctgctctccacccttcttcttgtagtagttgttcgaactgtatgaattttttaccgtttcgtattaaggaggagatttaattgtaaaacattaataatagaaatgcaagagtatcagaatcacttataatgtgattctgatactcttgcatttcgtgcgaaactttctatatgaaagttgctctaaaatatcatattaatctattttttaagtttgtaataattaaaagagtaaattgtattggtggtacacaaacttattaagtgggtgcaatttagtatatgaacttgtaaaatgctcgttttggtacacaaacttatctaatccgtgtgaactaggttcaacatggcttgccaaggttaattccacctaggtgatgttaattaggatatggcgtgcatacgtatagtgagtatgcataaaacatnnnnnnnnnnnnnnnnnnnnnnnnnnnnnnnnnnnnnnnnnnnnnnnnn

SEQ ID NO: 20302 - DNA, 1764 bp, Oryza sativa
  unsure (1)..(1764): unsure at all n locations
nnnnnnnnnnnnnnnnnnnnnnnnnnnnnnnnnnnnnnnnnnnnnnnnnnnnnnnnnnnnnnnnnttttaatatctttctctgcaatcactatatatatatgtgtgtgtgtgtgtgtttacgtagcatcctaatcagcacataaatcaacaaaattagtcatgtaatgtccttttgaccttatttcgcacgcacaagataaattcatgtaccaaaacgagcattttacaagttcatacactagattgcacccacctgacaagttattgtattgccgatgcaatttactctaattaaaactcaatcaatcatacgttaataacatctcgttttttataaaaaacttaatcttcatgttaaaagagaaaagaacaccaccggtgttaacttactaggatcatttggatgatctatcgacagccggcggacagggcatgcggccaacaaatgcgcacgcacgctccgtccgctataggacgcccagatcgatcgacagtcgacagggaggacaggcagcaactagcagctgcaacctatccctccggttacgacgagctgagaaagccagccaaccacagccagccacacacatgctgacatgcatgcgccatcaccacacgctaataatcaaccaatcgatcgatcgatcgattcggccgtttcccttgttgcgacgctcgatcgcactcaccttccagctcccggtgaaacgtgcgatcgagagggatagtatagtagttgttgcagtacgcggctgggctggctgttgctcatcagctcgatcgatcgtgcagatcaggagaagtacgtacgcgtcgcgcgctgtggatggatggatcgatcggaatcattgtgcgtgcgggttggcatatggcatgggatgcagggcagcagggttgggatttttaggaccaccggcaatgcagcgatcgatcgacacatcgtcggcgttttgcggaaatgcagacgagccgtacgtaacgtggtggctggctgcctggctctctggcccctggccctgccctagccgtgggggtgatgttcagcgttgcactttttcaacttctactttcacgtctcttacgtacgtgtatgtttctaaattactaaacaatgagtaattttttttaaaaaaaattgtttttataatcaagttgtttaatttataaaattgtattatctttttaaagtttttttaagttaatacttaactaatcaatacgcttaaatccgtatgtaaaattttcgaagggaatatagatactgtttacacatttggccggcctttgcatggcgcacagttgaagaatgacaagagaaaataagatgaagagagagatcaacgggactacatatcccaccgtctacaataataatatcttaatttgaataggaatttttttcacctgagcttatttatctatacacaaatggaggggagctgccatatctaaagtagtgaaaaaactaattttccttaaataaaataataaggcacgtcatctactaaacatggactgtccaatttctattccgaaaactttaggccgtcagatattgtgattggcgaaatatttttttattctttctctagaaatttctttgacaataatgtctttctacgttcatgaggtaaaaaaaagagcgggactcttctcgttaactagataaattaattgaccatagattatatcgacctccatattaaatcaatcgcacaattgaaaatagcattgcgtttcatctgttttatgttcaacagatg

SEQ ID NO: 20303 - DNA, 6003 bp, Oryza sativa
  unsure (1)..(6003): unsure at all n locations
nnnnnnnnnnnnnnnnnnnnnnnnnnnnnnnnnnnnnntaaatccgtatgtaaaattttcgaagggaatatagatactgtttacacatttggccggcctttgcatggcgcacagttgaagaatgacaagagaaaataagatgaagagagagatcaacgggactacatatcccaccgtctacaataataatatcttaatttgaataggaatttttttcacctgagcttatttatctatacacaaatggaggggagctgccatatctaaagtagtgaaaaaactaattttccttaaataaaataataaggcacgtcatctactaaacatggactgtccaatttctattccgaaaactttaggccgtcagatattgtgattggcgaaatatttttttattctttctctagaaatttctttgacaataatgtctttctacgttcatgaggtaaaaaaaagagcgggactcttctcgttaactagataaattaattgaccatagattatatcgacctccatattaaatcaatcgcacaattgaaaatagcattgcgtttcatctgttttatgttcaacagatggtactcataaattcacatggtacacacgtaacagtgacatatatatgggcgtacttatattatatccatgtggctgctgagatttctcgctttaccccgacctggtgacgtgctgatgatggcattaatcagcggccaggccgacaaataacgtggatgtcgatgtacaaattaatcactccacatcatcgccacatcaactgggaagttaatcaaatgacctcataatttgtcttgccttgctgcacaggggacacgctgcgagcaacgccacaatctcacacaaggcaaagggagacgcagatcgacaacctgattaaccctgatgcacaagtgtgcacaggcaacatggcacatttgcaaccaaccaaaaaaaagtcatcatcgcatcgactagaagcatcaatgctactactacatgcttagactaggtacaatagcgctataaatatattttaaagagataaaagaaaagagagaagagtagcacgctataaatctgtagctagctgcagcatggactccaacatgtaatgtgtgtatgatagatgggactaggtattacacagtatagtaaacaactattatatgaattggctattacattagtatagttatagatgatttggagttagtagttggctatactattaaacttgctgagtaggtaattaatcaatcaatctctctcacacacactctctctctctctccatgtactacatgatgcagagacagcatagctgcaaaggcataaatctccagaattgggttcaggaccacacatgcatgattaagcggcatcattgagggcctctggcgatttgtttatggatcttttttgtggttaattattctggagatgttagcaagatcctaggcaataacccaacacaaagccctcgtcacaggttgttttccaggctcgtttgtacttgtatctgtttgcttcttcagttagttatagtttaattatccgtgaaagcgcaaaagtacagtcctagtgcatgtgcacaagaaagaaaaattgtgtactagtgtacgtacgtgcaactagatacgaccagataaattaattttgcaaaattaaaaaaaacaaagagaaataaatcggcaatagatataaaacggtggtcacaagcattgaagtgaggccaacctgcattgcgctagtacaaattcaagggctaagctagctagatatcccaagcttccagcatggcaagtcaaaaaaaatgccaaaaaattgtcggagcttaagtttaatccaagcttttaagaagggacgaaacataattaggtggcataattgcattttgtatcaccctaacttaattcccctgaggttaactattgtggggttgcaaggaagatgcctggcaaaattaaaccttgacaggttgttttcctggaccatagctgttatctgtgaaaagcacaaaggacaagagtgtgcatgtgcacatacatatctggtgtacgtgcgagactaggcatgaccacaccaacatttatgtcacttttaagaatatatctataattatctatatgtgctttacatggttttatacaatgatacttaaaccaagtactcatctgatgtggaacgacaaagggtgccagcatgcgtgtctttaacaagttcatgcacacaaaaaaaaaaaaagtcttagccacccccctcacagtaagatgcgtttggtttcctacaaagggtcaagtcaagtctggcttgtatcattcgacctggtttagatgagtctctttgagatgtgtaaggacgtattcaatctgctactaagggtgtgttgagaatcccctttcccaactcacacctctctttttccacgcgcactcttttcaaactactaaacggtgtgttttttacaaaaagtttctatgtgaaagttgcttacaaaaatcatattgatccatttttttaaaaaaaataactaatacttaattaatcacgtactaatgaattactctgtttttcgtgcggagagtttagttccaaactccccccagcagcgaacaacacagacgctaggagaagaaaacctttatttttctccaagccggctcttcgcttggtggcacactacacccaccaccacttaggcaagtcaaggcatagttaggggtgaagacatgcataaaacagctaaggcattaattaaaataaaaatactatttaattttaaaaatattcactcttctatttattagctcatccctacacacgagaatttcttggctcttcccttggttttttagggtaccaaacatacaggggcgaagctagcatcaaaataagagggtgcgctaccattgagaatctagaaattttcagtgcaacactgtatattttagtctttttaagtgagaaattaggaatttgggggttcatgtgtaccctcaaacactataaaacttcgtcactgtaaacatgggctttcttactaaaagactctattacctgtacagttaaaatgcccccactaacattattacacagagtctcatttcctgcgcaaaatcgcaaaggaaaaggaaaaggaaaaggaaaaaccaaaattggaccttgggtccgatcggtagacgctggtgaggtggagccatctgggtcatgatatatacgtctgcacgcacgtacgcttagctccaccatcctccatccaagctggttgccctgtccctgtttgggctccctagctccacgagatattgtagagagtacatggatccaaagctatctcctgcacttatggtagaacacatgccactttggctcgttggctgcatcatggcacagggccttgcgatcgcagccatgagccatcgattagggtatatcttctctgttaatttgccccttgctagaatcgatcaaatcgatactattcgtcgaccggagaggcggcgacacgatcgaattgtccctctcctcgtcttatcctggatgagcaccggcctcgatcaactataattttgtggagccactcatagtttgttttggtgacagtagcgatgattatttgtggagacactcattgtttgttttggtggtagtggcgatgattatcttttttcttattttttttggtgaagggtatttttactcggactttacatctaacaggatatatgccatcaaactgtatgatcgaatagaaatagctaagccaaccagagggaggtgaatggttggtatacccaaaaaccaaaacttttagcggaattaaaagttaccctaaatttcgacgaaacacagtccgaccgaagtagacgcgctggtctgaccgcctggaagccgtcggtctgaccgggcttgatcctccggtcaaactgccgagatcaactgccgtcgcctgaaaccgccgccggtctgaccacccgtgatccaccggtctgaccgctggtgtctcgccggttagactgccgaacccgagcaaacacaaatcgaagaactcttgatgtagatgacaactttattacttctctctgtgtttacaaagtgcaacaacagcactcctcacgaaaatctcgactaaactcgaaaccctaactcaactatcaactcaatgctctcaaaagcgatatggggatgcctcacgctccctctctatttatacatgaggtagatagtctaaagccatgaaccaaactcatacaggaagtcctaatctacctaggaaatcttcccgtacaagaaacaaattttacaaactccaaacataccaaatttggactccttccaaattcgactccgcatctcgtacgcacacaatatctccatcatatggcatggaatcttcaccaaccacgtgcattgaactctagcctaagtatcccgcatgatatctgtccgtccggacattgccttatctccaagtcgactcccgatccattaccggcactactctcccgaggcatcaagtcacctacacatgaatcaaacaaagaaaccatattccgagaccaagctatctccaacttagctcattgtcagcaaacaatagtattacatacgtatagtatccatctagaagccataaacatgaaacatccacggatatccaaacaaaaaacccgaaaccgaaaccgacacagagtcggccggtctaaccgctcgatacacatcggtctgaccaacaacccatgtccggtctgaccggacccaaatctctagcagcacctatttaacacctgcaaatccaatcatctccaaaaccacttcgccaataatctccaaatatcaaaaccaataattacagatgccaattgttcatcacagaataagaatcataaacactttgattttacacaaacaacttgatatgaaattcgttcctataaagatttaaacttaaaatcttggagcgctactcatgtcactgtaaccactgggctacatgccttttgcgatgattatctatctgatctgattggatgatgtagaactggagattacgtgtcgtgtgataacgctgcattatatgtatcatttcgtgccagttgcgaaacagtgatgctgagaccgatatggcagcaagagtagcagatgccggcgtgatgcaatggaagcaagcaatatatcattatctcaacaacagcaacaaaagaacagaaagaaagtagacaatagaaatatatcttttagataatgaggtagacaacacatacgctactgtttagttggaaactgatttcttggttagttaatttgtgatttgctgattacagagacgttgtaaaagcagatcgaaatgacgggagcaccggagcaaagagcaggcattcaccggtttttcttacatcagtctccaataatgatagtttttgcagactcactctcttttctccttgctaaaacctaaaagctttgaactttagaaaaggaccagacaaacccaagtacgaataacattttcctgaaagcactaaagcactcccactaatatgattatctgaatcggatttaagataacttaataaaattagtagtactatcacattaattttaaggtttggaggttgcttcagggtgagatcaaccgcatttctaacttgtaacatgacgagctacgtaatggaagtggttgtgtgatcgactaacgacagaggccaaactaaggcacataattttataattatctagaaaacctacaggatgatattagaggtttcttcctagcacgacttcttgtagctagaacttagggtaattttctcattcttaaaaaggtatcaggaggtgtcatattttctatgataaaatttggtacctttagatactacatcctccgtttcaggttataaaactttttagcattgcccatattcatatagatgttaataagtctaggcaacatctatatgaatgtggacaatactagggtacagagctcgaattcgccctata

SEQ ID NO: 20304 - DNA, 706 bp, Oryza sativa
gaaaaagatagacttcaataatttttttaagaagttgaagctcttactaagtttcatctaaaatctatattaagtgagccatttcacaagaattttataggatttgaaaatatccaatcttttttattaaatgattaaataggagttttctatagaatttaaattatataaaattcctatatatattttttatccaaggactcttatagtgcacactgcttggcatgattggctaggcctggcagcgagccgctcttaaatctctattatggcagccaaaaacagttaaatttgctcttaagcatcgagtgacaaattttacaatagttgaataaatccgaaacctccattttttttcctcaatcgatgtaccatatctaattatatgttaccattgtaactactggaagtattatgtaggagtatactgaatacaattgtttctactggcaatagaattctaatggctccggttgtttttactaccagtaataccgataaaattgttctcgatgactctgctagctgtacatgcagtggagaattcgccgctcccaaagaccccaatagtagcagtggacgatttgccagtactccacagtacatgtcctactatagcaatggggccaagacatcagacacagttctattcccctgcctgctttcctgtaaaaaaacattagtatgacatgacgggctatagcag

SEQ ID NO: 20305 - DNA, 718 bp, Oryza sativa
  unsure (1)..(718): unsure at all n locations
nnnnnnnnnnnnnnnnnnnnnnnnnnnnnnnnnnnnnnnnnnnnnnnnnnnnnnnnnnnnnnnnnntgtgtcaattttacgtgttatttttactaataacatataaaacccccgcgggagtggggtttcatctggtattcttaaacattcaattcgttatttaccgctcttgttataagcgtgaattgttttgaacttctcgattgtttcctaataaatacaaatcgttgtacaacttccggacatattctttttcatctttcttttacccctcccgtaaataaataaatgactacttttgaatgcagtaaaaatgaagggtatcaaaagttagtcttgaactgttctatgcatgtggagtaagtctaaaacttacttgtgcagttatattagaggggattatggttctgatgaccatggactgttattcctgccgagcatcctcggcctgaactttgcccccgatacagactcagcaccaaactatcaacattgcaagcaagagaacaagggaaagatacagagaaggaacagagcctatagaagtatagcacccccttgatttccagcacaggagaaaactgatgaatgcggattattactatacgatgagcgggcgcagtttagacattgaataacttgtccaccgaaaatatacgacagaactattttcatcactgatagcaggagtcaaaagcttactcgatttatcctgccg

SEQ ID NO: 20306 - DNA, 501 bp, Oryza sativa
  unsure (1)..(501): unsure at all n locations
nnnnnnnnnnnnnnnnnnnnnnnnnnnnnnnnnnnnnnnnnnnnnnnnnnnnnnnnnnnnnnnnnnnnnnnnnnnnnnncgtctgttggtgcatcatcatctgatcatcatggcattgacaatctcacagaagagaaactgctgaaggaacttgaggaaatgggttttaggcaggtcgatctgaacaaggagatactcaggcagaacaagtacaacctggagcagtctgtcgatgatctctgtggcgtcagcgaatgggaccctctcctggaggagttgcaggaaatggtaagatcacatgtgccctattctggacagtgctcacagcctcacaggcacgaatgtattggcaaggttctgaagttagctgttgtttcaccttttcagggctttgaggacactgagataaacaaggagatgctcgagaagaacggaggaagcatcaagcgggctgtgatggacctcatcgctaggggtaccgagctcgaattcgcctatagt

SEQ ID NO: 20307 - DNA, 972 bp, Oryza sativa
gaaaatatggtattcaagcaaatagcattgacaaaccactcttccacacattagactgaagtatcagtaattataccttgaaagcagcagcataagcagcttgcaggttagacatgccctcaaagggcagtctattgtgaaggagttcccataacacaattgcaaagctataaacgtctactttatgattgtaatgcttcttttctccatgcctcaatgtcactgtgctgtacaactgtggatatatttcaggattagcaaatattgacaaaaaagaattatattgacaaatatgaactgcagtaacagaaacctctggagccatccaacggtatgttcctgtctctgcagtcatcatctctgttaatgtctcttctcttgctaaaccaaggtcaacaagcttgactgttctctggtctgcggtcaacagcaagttctctgtacgtacagaaggacaaaacaatggctcatgataaaccttatttgtacaaatatttctggcttgattttttttcaaaaaaatagctctgaaaagaaaatactgaaaaaaaacaccaaatagtattaggtaaatttacagtagagaaatatagtactgttttttgaataacagagctatgcattgattcgtgaactagaatcagtagtactccactggcatccgatgttcagctcattaatatttcctggcattttatcgaaagaggaaataatagcagtccttttctagttgctggttcacttttgcactaggtacacccgtcctgaatgttttgctacttgatacactatacagtataaacttagcatgcttagagattctattatatcttaaaccgaaaaacaataataaaccatttgggagaaccacctctttccaaaaggaaccgcccttggaaggtggctatcagaaggtcagaactgaagctacctttttaagatgcccgccccccaggggcccctctaatggat

SEQ ID NO: 20308 - DNA, 1901 bp, Oryza sativa
tgtcccccttgtgcacaatcttgatggcaacatttttggttcttgtacctggcaatcccagcatcaatcaaaaattaatttagaagcaaaactttcacacagatcatcaaattatagatgacagtgcaaaaatatgagacttacttcccctcgtagacctttgcatgtgcaccttcgccaatccgtggcccaacaaagagaagctttgggtcgatgagccacttggggtcgatctggagaccttcgcccgcatagaactcactcccagattccatccccgtcgaaatggatccactttgggtcccgtggggtcacacgaccccactaatcgcttaaatagaagaacagcttttagggaaaacttggaagttggtgtaaaagcatagcatatggcacgcgtacagcgcatcaaaagacattaaggttattaagaaactcaacttttagaaagtttttgcaagtcgatagaaaagtatatcataaacacaagtaaagtacctcacttcattggacgtaggaggaaactagaaggatctaacgtgttcaagcaaattctacttccagaaagtattgtaaagtatgttgtatatatcatgaatactgattgaatgttccagaaagtgacagtgtgacatttctatataaactataacgtaaaactggggtagaaataaaccatgaacaagtgctgagcatgatacttgacataggtaaaaactatgaggaacccacatgtattcaccaattaaactttttggaagtatttgaaagttggactggtacatcacgaagacacgttggtcacttacaaatgcacggttataataaacaagaagaaaccctcgaattggacaaattcacattcctaaagaattagaagttaatttgtacaaaaatacaagcgtatagcacagtggcgtagatgtatatatatactacaatgatccatggcattcgaccatttctactcaaggtacatgagccacactaaatcactaattccctcttaagcttacaacagagccaactaaaacctttgatcagagcaacaaaatgtgcataaatatccagcattaaacttccaacctaatgccccacgaacaaaaaaacaaaatggttcaataaaatggtattccatgtgctttgcaaacatagtgagctacttgggggccgcattgggaaacaaaatcacaaagaatttgaaaactaagccacgatttgtcatctctctaccaaactctcaccaaaaaaaaaaaagaaacagccacaccgcattgtatcatgacaagatcaccatccccgtactaactcactcgtgaccttgctcgagcccagcctagccccgcacgatccctgacacaaaaagaaagggagaaaaaacaaaaaatcgagccaccttttaacggcggcttctaccataagcacagccacagagcagtcaaaagcctaaacagcacgcttaaaagcctaagcccatttctcccccacgcgtcgcgcagccaatagcggcggcggcggccgcagcacagcacagcaaagccgagctcgccgctggcgcgcgcggggggcagagcaatctagcggaatcccggcgggatcaggcgggaatcagtagggagcgggcgggggtggggagcagagcttgcttaccacgaagccccggatctccaatagccgcagcagcgcccgcgctctccccctcgtcgcctcttcaccaccgcccgcatcagcagcagcagcgcggcgccgaccgccgcatcgggtggagagggtggggaagaagaagaagaggaagaagctgcgtgcgacgcgcgggcgggcgcgcggtggccgaggcggcagcagcagcagcaacgcggtgagagacgatggggatgtggagagagagagagagagagaga

SEQ ID NO: 20309 - DNA, 5788 bp, Oryza sativa
  unsure (1)..(5788): unsure at all n locations
nnnnnnnnnnnnnnnnnnnnnnnnnnnnnnnnnnnnnnnnnnnnnnnnnnnnnnnnnnnnnnnnnnnnnnnnntttgtatgtttttaaagctttcaaatagtgtatttcatactttctccatcccatattaagttcatctctagctccttccttttatcccaaaaatacgttcattttttaaagtaatcattacatcagaaattgtgaaagtatggaataattgtattggaagatgataaagtgagaaatagttgcattatgatttaataaaataaaagcattgtagtctctcttttttttaattagtatgtgtgggatgtgtgaaaaataaacttatttttagaacaaaggtagtacaaaaatatttctatatgattttttaaaaatagttttctaaagcaattttttaactacttataactagttaattcattcgttcaaaccctaaattttaaggatttatcctcttgtcccacatgcctgtaatcttagatgatctcacgtgtcagcgctataggagtataaatcctcaattttcaatctagggagaggatatgaccaaatctctccaaataattgtcaaaatgataccttttgcttacgatttaagcatggcacgccaaagtctaatcgaatcaaatttcgcccccacactcacggagatgctactggaagtctgcaactgaaaacaacatgcgcaacgcaaccacacgcacggagagtcggagacgtaaagacgactttgacccacccaggaaaaggaacaaaatttctaccagaaagtggcaggcagtcaggcaaatcggtcgcggtcgtaatccatggcggtagcgatggtcactcgttaataccgatccaagcctgcgttctacaagtcaaaaaggcaggaagaaaaatgtccagaagcaatgtagacaaccacgttgttaagctaggagatttacaggttacagttactagcaacaaaatggcacattggtgcattcgtaagttgctaatcttacttgctagtttagtttgagtacaaggctcacgcaggatatgcatcagattcagaattatactctgccctgtgagcatacctcattcgacaggccactagatgactaggcctttgtctggtgaggtccaacgcataattgcataaagaaaatcacgcgacaacaaaaagagaaagtaacggaaacagataagcctgagataagggaacatagagtacatcaacaacttaatttaagagaaccttggaagaggtctagtacaattacagttatcaatggatgagatcatcgccgtttgtacaagcaaggtttcaactgaggccaatcgatgtttttgaccaccttactcttttcctgcaaagacgtgaaaccacagcattcaatgccagactatagctgaacaataatctctcaatgatcaaagtatagagtaattttcaagtgcaattaaggtacggcagtggcataactgacctttttccggaaatggaacagaatgaacattttgtttttcgcatcctacagaaaggaaccaattgccaatttaggaaacatgatgacactgttctcttttcgcacagaacagtcttgtgtcaatacagaacaattttcatatcacaaaataagtaccacacatgaaaaggatacacaaaatgggaatccgtcatgtgggtacatcaaaggaaacatttcagataccatcaccacaaagagagaatgggcacaaagaacatattagtttctgaagtacatggtaaggatgcgatgtttgaaaatatgacctattgttcggtaactactgcactaaaagcaacatcatcatggctttgaacatttagtgatgcccagagatagtaataaattaaatagtaataaatatatcatcgagcgatagtatagattaaatagtaacaaatatatcagcacaaaccagtggaccagaatggcctcagtttctgaccatattaaatggtcaattatgaaatgggataaatataataatcacccaatcctatcaagctaattttcagcccaacatccaagaagtcagagattttttttcttgagatatacaagtcgttattccatcagttcgctaatagatgatatgtcctttttcacatatgcgcttcaggagtttagcctttggtttggacatcagtaaacatcgccatattatgttataatccttcattccttctaggacttcactatataaaattaactcattgtaactaagaggttgtttggtttgttaccattttcggccataataaattttggctttgggaaaccaaatattacctcatatatcctccataccaaaatttggtaattctagaaacttcctaactcaacatcatgtcaaaagtttaggcaaggcatcaaaccaaacacaccatatatacctctatcttaactgattttggcaccgctaaagctggtatggttacaaacggcaacaaaccaaacagccccaaagtccacttgagaaaaaggtagaagaaaccgtaagtataccttcgaaacaagggaaaacccaagcttgctgatggcctcacaaaatttatcaggatcagcacctgcagtgtttgggtctagcctactcctcacttcagcaataagaagccaaccactgcataaacaaatgtatcaatagtaaaaaaggaagcacatactttgtcatagaagtgtagcagctaatcattaggggcaaaccttggtttgagaactcggtttgcttcctctatataactcggatagtttgttcccattaaagacagacaaaaaattgccacatctacagaggatgactccaatggagtctacagaaataacaaagcctttagtttaagtaacaactcaattaaaaaaaacagatattttagtgtttatttcgtatagttgttttacatatgttgcacataatggaaatcatgaaaaatgtttagaatgtcccaagagctatgtttaaaatggcccaaagctagtgatttatttccttcttgtgacatattaaagaattatcagaaattgtttttggttgataatgcacctccattgtaagaatagcaactggccagctgcttttacctttggccctcatacacatacttacattacttgtaattcatgcatgagtgtactgagtatttgagtatcgaccataatggcttctatttttaacacaggaacaacatgttaacatcagaaaaattcaatgctaaaagagtattgaccatgtaatgacttggaatcatgaaagataaattgtggaacccacactaagaaatcaaggtgcacaagaatataaccaatatttggaggattaaagttgggtcattttgtaatgacacatagtgtagttgtgaagcttagtaagaatcatggaaaaagagcatacatggctgacaaggaattgccagaatttcccctgaagctaaactggaaatgaaccaagaaacactttgttcatttatgctaacacacataaacaacatgccaacacgttaaagcaccaaagaggtacaaccatacaagatatggttaaatgcttacatgagccatatcacaggcaatgactgaagggtcctctgaaacaagatcgatggagaaaaccttgttcttcacatttttagaaactgctgcattgcctagacaagatgtcaattgtattaccatgattatgccagggaaataaaaaggaaaacattgtgaaaaggtgtcggcatattgagagtaaatgtttagcattcttaccacagccaaaatctgcaactgtccaagatgcactatgactcttcaaccaattgattataacatttactggttgctctggccaatgcgacatttgctctcgatatcctgcatgatactaaaagaaaacaaagtgaaatctcagccatatatcaggtggtatgaaccataggggcaattattgctgcaatgcaaaaagtccctgcatatcgatcgctgcaatacattttcctcccacaaaatacacaaaaataattattcaaataagaaagaaacaactaacagcatgaggtttgtgtagatagaactgtagaggtacaaacaataaggcactgactgaagagttgatgaggtaagatatgaaaaagtcaccacccagagttcaaaatttgttgcccatactcttcaaagataaaattcatctagcaaacaataagattaccaaaatggatgaaaagtgcatagcataccacatcaaaaagatcaggctcatttgtgaagtagtcaaatgcatcttgtccactgaaaagaaaaaaaaacaatgtttgagtaaaagtgtgaatattgcaaaaatgaagctctgattagtgatttctacatttccagtttccaagggtaaagtcgaagccacattaggaactccaatttagaatattctgagtcatacgtgagagggcaatccatgtttttcaggcataccggttgatatgaccaataattaacagtaccgggtcagacaaagcatgaaggttaagattgatgcatgtcactatctcttagcatgattaaagatagcagtattttgtacaaaatgtaagctacaaactgtgtggatatttcaacatacgaaatttggagtatcgtcatgttcttacacttcattattggttgaagactgttcaatacagtattgataatgtaaagcattcaataatagcagcacatcattagcataaaagtagtgttatctggagaagaattcgaacctgcaagtgtatagtttctcatttaacattctgaaatgaccaccagataaccttgcacgcatctagagtgcacatcataaaaaaaacatatcaactaattagctcagagaaaaaaaattcaaagaataaacagaaggtaaaataagtaaaacattcatataataagtcatgagttatctccaaactgcaggctagttcattaattttgttttttaagcaaaagttattaaattattaaggagcagcaaataaaagcctaacgtgaatactgtgttgcctaaagaaaatgtgaatactgtgcaaattcagagcaatgtatcacattcaaccatgcataagagcatacgaagcactactgaattactgaggtttggcacttctactgtcgctactaaagaataacagaggaggcaccctatgctttgacttcacccacactgagagatcatccagattcactaaataacccatcaaccctagtcaaaatttattcccgataccaccccgaacattttgtacttccaccgactcctgctactggcacggcatatactcctgctcctacctaccaatacacgcctaggcctcgcaaacctctgctccggagagccgattaccttgtcgaggaggctcgcgggcttcggcttgctgccccgtcccttgggcgcggcgtcgtccccgcgctgccgcttcgcaggaggggagggcggggacgccgacgccgccgcccccgaagaggacgaagcctggtgctttcggcggttccggccgcctcctcggcggcgccgcttgcggccgccggctgccgccgccgccgcctcctgcagaggctccatcggggagggaggcggcacgaggggggagggagttcggggtttcgtgccgctgttctgggttgcggcgactacagtgcagcgagagagagtggtggacggaagcgggccagggtgaatatgtatatatttcggcccaatagctttcttgggtctggctaggaaaaagtacaccgaacgtccatcaacttgtcatcgagttacaaaatc

SEQ ID NO: 20310 - DNA, 891 bp, Oryza sativa
  unsure (1)..(891): unsure at all n locations
tcctcccaccggctaagtcaaagaagggacagagagatgaggaagggagagaagaggggaaaagagagagaggaggctggcgtggtagcctgacatgtgggccccacatgggttacacgctgactcagccgccacgtaggataaaatcgggtcaaaaccaccgaaaggcttattatgaccggttttgattagttaagggacgccggatatctggttttacggttgggggacgattttgtaactcgataacaagttgagggaccttcggtgtactttttcggtctggctatatgtaagaggcccaagagagcgtgaggtttgagtgtgctgaactaaggcccggtttgataagtctgaattgatggaagaatatctgattttctgataacaatcgaggcagcaaacgaatgagttattacagagataaaaatgtttgtcgatacccgtagactggatgattggggtattagggttcgttggtacgagtatctacgtgatatgatatcaagcaaacacaaagacaagaattataccggttcaggcccctaatcaagtaatagtcttaggtggtgtttgaatctcctgaagataaagattaaatgcttcacacaaaatgagatagtaataacgtgcgattaattgagttttaattactaaaaacatgcaaaatgaactaatatgatattttagagtaactttcatatagaaagtttttgcacgaaacataccgtttagcagtttgaaaagcgtgccacgaatatctaaaattttatcctctacttatagaagaaatgaacataccctagtccagtttatataggattgatatgaaaaaaccacaaagtacaatgggnnnnnnnnnnnnnnnnnnnnnnnnnnnnnnnnnnnnnn

SEQ ID NO: 20311 - DNA, 674 bp, Oryza sativa
  unsure (1)..(674): unsure at all n locations
nnnnnnnnnnnnnnnnnnnnnnnnnnnnnnnnnnnnnncaagttgcaacagatatatttttgcatcaaggaaatatggcaactgatgaaaataattcaatcttactatcctaggctcaaattagaatagtagacatcacaaaaaataagtgattaaactaaatcctctaccatctgaatggaccctatggatcttcaactattctttcaactgacttcctataaatatgtaatgcagtttggatatgtgttatctagtccaatttaatttcttgatggtaagaatcatacattgtctttcattgttcgtgtgttttgtgttgtttgattcaaattttgttgttagcagttctcaaattatcccttttcacatatttcaggtgaagtatggtgaaactcttaagaggttcggtgggtatgtgcaaggaccacaattcagcctgaacttatccgctctccggtccaagattgcatctgcttttaagtttggttcggatgtcgacttcattctgacttacactgatgaggatggggatattgtcatgctggatgatgatgatgatctgcatgatgctgctattcatcagaaactgaaccccctcaggattaatgttcagttaaacaacagccacactgcagcacctcaggccaaacagcaggattcagataatatac

SEQ ID NO: 20312 - DNA, 489 bp, Oryza sativa
  unsure (1)..(489): unsure at all n locations
annnnnnnnnnnnnnnnnnnnnnnnnnnnnnnnnnnnnnnnnnnnnnnnnnnnnnnnnnnnngttgacgtggcgtttaggtggcattataaataaaaaatatgtgtgaaacccatttgtcatttatcaaaagtatggatgggcacactgacatgtagggcccactagctagctcgatcaatataaagagcaaatcatgcattcatcaaatcacatcagattaccacactaatcacgattagtgtaacaatactcacgtacatacactatacaccatgtcgccgcaggccaaatcccaaaggcaaactgcttctcttggtggtcatctccttcctctccgtgttgccatggcacacgctagcaagcggcagcggcaagcccctcgtcactgccatcaccaaagacggcgccaccaagctctacaccatcgccgtcaaggatggccaccccctcgccctcgacctatccggcaagctcgtctggtcgacct

SEQ ID NO: 20313 - DNA, 610 bp, Oryza sativa
  unsure (1)..(610): unsure at all n locations
actatagggcgaattcgagctcggtaccccttctccagcctcgccatctcctgcccgatccccgtcgggaggtacgacagcacgttgtagctcacgtccagctccaccagcgacctgtacgtttggatcattttgtgatgatcaccattagcgagaattgaagtttctttaactggatctggatgccattggggagaagaagaagatgatgatgatgcgtgctttggccttggctggttgattctacctgcattttgagatgctgtcggggagagacctcagcttgttgcccgagacgtcgaggatcttgaggctggtgaggaggcctatggagtccgggagggagaccaacgcgttggaagcgaggcgaagctcttccaggtgttcgagcccgcctatggcatctgggacattctgcaaattcaatgaaaatagctagtactaacagatggaaagaaaataaaactgaactttacagtgttttctagctttgtgggactgtagcctgtaaaccagaaattcttgaatggaccacannnnnnnnnnnnnnnnnnnnnnnnnnnnnnnnnnnnnnnnnnnnnnnnnnnnnnnnnnnnnnnnnnnnnnnnnn

SEQ ID NO: 20314 - DNA, 935 bp, Oryza sativa
ggtttcctgcaagtttggttgtcagtattatttctgcactgggtgcacatcaatgcaagagagatcgttatatgatttgtacctggaagacttcttgatctttggcacaggacaactggatgttttcttccttggagtagcctgctttggcagtttcttggttgcctctcggtctccaggctttctagcagtatcgctttcgtcatcacttgacaccaacttccttttgcgtaaatctggctggtcagtattatttctgcactgggtgcacatcaatgcaagagagatcgttatatgatttgtacctggaagacttcctgatctttggcacaggacaactggatgttttcttccttggagtagcctgctttggcagtttcttggttgcctctcggtctccaggctttctagcagtatcgctttcgtcgtcacttgacaccaacttccttttgcgtaaatctggctggattggaagtatttggccgggcttcagaacgggtcttgggacccccgctcccttgaccggtttggcggtggggtgatcggcattggacgactggggggtccgatttcatcaaagcaaattcctggtcgtaatatcattcattgttaattgattcaacaaaaagacaagactatattctgtgaaaagttgaaatgtttgattacatatcggtggaggaggattgaaagcattgaatggcatgactagcagcaagtgcgaatagctgacgacgatagcattcgagaagatcttgtacatcctttccttcataatcttaaagttaagagagtctggatcttcacgatttggatcatggttgccgtcaaactcaaaagctgtgcgggacctctctttgattggagctaatcggctttttatgaagtgccaagtgatctgttctccctgcaaaccttgctctttcagctttatc

SEQ ID NO: 20315 - DNA, 5990 bp, Oryza sativa
  unsure (1)..(5990): unsure at all n locations
nnnnnnnnnnnnnnnnnnnnnnnnnnnnnnnnnnnnnnctttggaattattatgctgcaaataaaaaggtgcccgacagaaaggtgttataccatttttgtcagctttattaggctgcaaaagttgtttgggttgatttgagatgactggtttattaatagtcattctcttagcatgttatatgcacattttggttatgatgagggccatagcctaggctattagactcgttgattaccatgattttttatcatatttgatgggttgtctttagagtttttactcggattcctgtcaaatatgtctatttgaggaccttttgagtgtttatcactcgggccttttcatatttttttctcgatgtattgcagctaagaagcagacggctgggtgttttactgactaccacacatgctttgctatataatgtttggttgtaaaaccactcggttcttgactacatgtttagtttttcaactaaccacatagtcgggggctacacctaattaggtgcatctactcgatgcaccatgttttcttttcgcccttcacagtctttgattttagcactcggcaggctggagcaggttgaattgaagcactcggattattgttttttgttctgagatggctatttcgtcgactgcaaaggtctcgggggttactgtagagattatggataccctatatctacatggcggtcatattccagctgggtacatgataccgaataaagacagaataccttcatgaggactcgggttagattctaaacttgtatgtcaaggaaatacccgagatcctagtcggttacgattgtattttatctgtaattccatgttcttttaggatatggactgtattttgtaaagcggaccccctcccctatataaggaggggtccggatgcctctcggggcacggttttttgacctagattatacaatcaataatatactcggcggaatcatccccggacaggagtagggtattacttcttgaataaaaaggcctgaacctgtataaaattcttcgtctccaaacccatccacttttctagcttgatagccacctctttttagtatagccgaaatcttgtttcgacaaaacaaaacacttagggcccctttgaatcacagggtagaaaaaacggaggaataggaaaaacataggattctgacaggaattgaagtgtaaaatagaggattgcaaaacacaggaaaaacataggaatggtcgtttgattggagcgcaggaaaaacacaggaatcgaatgagagagatagactaaaaggaaattttccaagaggttggagctcttgctaaatttcctccaaaatccacatgcaatgtgccattccataggaatttcataggatttggaaagcttcaatcctttgaatcaaagggccaaataggaaaatttcctataggatttaaatcctataaaattcctacataaattctttgattcaaagaggcccttaataacatcatccctttaaattcccaatctctcctaaaaactcccttcaaccaaacgagccgtatgagaatcaagggagtacttaacaagacagaggtggaccacgacggtgcagaggttcgtctaggcaggcaaacccaaaccaaagagcagcagccagccactgccagtgccacagctgctctccctgctgcagtgcactgcatcagctgcgcgcaaatataatctttaggggaagaaagaaaaaagaaaaggtggtgatcgatgaagaagaggaagagaggggccgggggaccaacaaaggcgttgaacgaaaaaggaggttggagaccaggccattcggacgacgaccaacaggcgcacgcacgctcacgttagacgtagaccaacgccaagcagacgcagaagctttgctcctttcaccgcagtaaaaagcagtactacctgtactacctggaattcttcgccacttgacccgggttaaaatcgaacctcctgtttcattctcaggcctggtttagataaaaaaaaatttaactaaaaacatcacatcaaatgtctggatatatgtataaagctttaaatgtgataaaaaaatcaattacccagtttgcatgtaaattgcgagacgaatcttttaagcctaattacccccatgatttgccaatgtggtgatatagtaaacatttgctaatgacggattaattagacttaatagattcgtcttgcagttcacaagcggaatctgtaatttgttttgttattagtctatgtttaatacttcaaatgtgtgtccgtatatgtcaatttttttttgccaaaacaactaaacacggcctcactccatctttaaatagctcatattagataaatgtgtgtccacgttcatagataatactagttgttatattttagaacggaaataataatagagttaacatgtatagtagataagttataaagttatctctatttttcttctcctctctatatctctcgcctatacatttaatatattcatgttgaagtatgtgaatagtcagctcttccatcaaagccaagtacaagttaaataatagagccttcaatttttcttcttcctctctccttttctcacttatgtatttagtgtatttatccaggagcacgtgttaagtgaactctcatttatttttttaactctctcctccacataagtatagttgacttatactcactattatccttactctaacccttttcaatttttgacttatgcttgctattatccttactctaaccctttttcaatttttaaattccttcttctccacataattttacagttggcttatagctacgctactatatactcctttcatcttattttaagtacagtcgtgggttttcatgtctaacgtttgaccgtccatcttatttaaatatttatgatttgttttttttaaagtcacacataaaatactatttatgttttatcatatgtcataataaaaatattaatcataaatatatttaaataaggtggacgatcaacattacatagaaacccacaactatacttaaaatgggacggagggagtgttaaactcggagcaagtttaatagtatagccaactactaactctaaattatctatagtcaatttaatagtcaattcatataatagttacctataaataaaaactacactattaatatctggtcacatctgtcatacacacattgtgtcttaaagtccgtactacagttggctataaatctgtagccacatgcttctctctctttttttatcatctcgatatacttttaaagctgatttataggctgctagtttacctgctcttggctctgttcgcaagagggtgttcccaactctcccctctcgttttttacgcgcacgctttttaaattgttaaacgatgtgttttttttaaaaaaaacaatctatacgaaagttgattaaaaaatcatattgatctattttttaaaaaaacactaaaacttaattaattacgtgataatgaaccgcttgttttcggtatggagggaatgagttccaaagcaccggaaacgaacgcaccctactctgtgtgagagagagagatggcatcatggtcttctcatctgggtattactcggcagccttgtgctacgcgcacgtacgttaaaaaacacacacacagacacagataccgtagctctcgtgggtctccgggtctcgatgcactgctcccagctgctgcaaaaggagcgccatggccggcccagctagctcctaccctactcctgctcctacgtagcatctacgcctcgccgtggggcgggggggccccccaaaagggcagtgtgggtcaaagcgccgccggccggccaccgcgccgaggagagggagagaaggaggtctcgaggcaggcgtgcagttgcagcgaaagagtaggtagcgtaatagttgccgtcacctgagtagcattttgaaattttaagtttaaatttttatgaaagtaaattttacattgggttgtttgaaaggtcaagttctcaattttaagagcccctttgaaacaaaggaaaaactataggaattctatagaattttatcctatagagtcttttgaatctaaggattatttcctactaatccctttaaaattactatggaattaaccttgctagaacaattttagaggaaaataacatgaggtctcacctcatgattttctctacgtgtgtctaaaattccagtatttttcctgtatgttaatcaaacgatggtttgaagactttcccgtgtttgaaaatcccataggaatccaataatcatgacattctattcctatgttttgttctattcctgtgttttctcaatcctgtattttaaaggggtcctaaaagcttacatatattcaattggatgtaaatgataggcaaaaaaaaatactccatccgtttcgaaatatttgacgccattgactttttagcaaatgtttgaccgttcgtcttattcaaaaaatttaagtaattattaattcttttcctatcatttgattcattgttaaatatattttcatgtagacatataattttacatattttacaaaagtttttgaataagacgaacggtcaaacatgtgctaaaaagtcaacggtgtcaaacattacggagggagtatatcattctctaataaagatcatggaaaagagtactgccactactatactccagtgttgtcacccgtgcatttcgataggacgacactgcgtgcgttcgctttttggtttggttaatttgctttttgactcgaattatgttcattcaattcgttccgaaaaaaggaatcactcgagtagtgcacatgaagtaaagggccttctgtttttcgtacgtccacaggtcgatcggttgaagcaaaaaggagggtttgaaacttagattaaaggtgtggagtcatgatccgagatctgtttgggtggacgaaattcagatatcacggcaacctttaggaatgcgaacgaaaccggatgaaaactttaatactctagacaattttgctgcttctattttgtaattgctactagagttttatcgtcaaaatacttgtgacataacactattcctacgtacttcctccatctcatattataaatcatttgactttttataattaaacttttaaagtttgactaagtttatagaaaaatatagtagtattttcaacacaaaacaaacatattatcaaaatatattactttaatattttatatattgttaatttttttgtaaatctagtcaaatttaacaaagtttgattaggaaaaaaatcaaacgacttataatatgaaatggggatgtattaattaccagggaaagaacaaaagtatgatggtggacccaaccaggattaaacccctgtgatagtaagtgtatgtgcactttttgttaggatttctatgagaggatttacgactgtggtctccatgtcttaaaacttgtgttggggcatgtacaaacgtgtgatgtttggtgtatggccgctaaatggtggtgggttgtggttggtattaatggcgaggacaattgaccataaaagttttattcataaattatttttcgtttgcaactatgccgtttgacttattccacacataaattatttttcgtttgcaaatatgccgtttgccttattccacaaataagcgaaacaatagggtgggaagaagggagaggatggcgataaggcgcggcaatggcggccagggaaggagggataaataattagaacaattactccaagtctaaaagagctatagaaatctcagagcaaatcactgttcccccctgaaaaccactgttccacccattggataaacaggcgaaatagcggacaaaatcactactagctgttccaaaatgactgaacctgtggctaaaaactgcacccaaattaagacaatgtagtttccatgggaccaactagctgacaacagcaagtgttaagcctagagac

SEQ ID NO: 20316 - DNA, 3281 bp, Oryza sativa
ttggacctttgtggtagtagttcttgcttgaattgtgcttctgttcgttctagaagagggtctgagttgttctagaaggcattgatcatttggtgatcaggttaactattggtagctttattattctaatgtaaaagtttggtatcatttagcgagtccaaactttcgatgtgactgggtgaaaaaattgatctaaacaagtccagaatcagtatgtcaaccgcctattgaattgcattgctatgctaaacaaaatgaaactttagcatttacatacgtacgtgcctccttagtttattatccatgttgatcgtccttttttttttatgtcactgtaattttgtaggggacttttccggcaaaaattttgtagggggctgattgttcatttgtatctatgcatatcataggagtgagaggttgttccaacaagaattgagaagagtaaacaaatggttatatttttttttgtctaaatattgtgagaaaacgagtatagttcatctttctggtcccttgatgaacagagaactctaatgttggcaaagtttaacttcaacatttcttgatcaatctagcgactttgcttgttggcaaagtttagtaggccataaaaagtttgttgatgatcatgtgctctacgacaatattactatggctagtggatataatcatttgtcgtactatagcgggttaagagctcgacaacaaaataactttaaccaaatattgaatcgctcgtcacattttcatttctagagctccacgacaataatactttaaccaaattccaaaaatgcttagcacaatttaggcaaactagctggacaattgacgaggatatatttttatcagaaacttgatttattggcgcaaatacaactttaatattttcttggccacacaccattgattttttttttggtaataaagtgccacatgaccttattactttgaacttgtcacacacttgagtcttccaaacattaaacgataataatactttgaaccgagcgctacagtttttaatttcatggaacaagtgttacttcaatattttcttgatcaaattaactagctagaggcgcctctctttggcaaagttcagtgtgccataaaaaatgtttcttagtgatccagtgttctattccaatataattttggcccgttgctaaaattatttcatgatcccacaacgaaattgccggtcgctaatttttttaatagtagatattaaaagctccacacaataatattgctttagccagtttctagaagtacatgatattatcagtctagctagaggcttaaatgatttatcgctctatagcaaatttcaagagctctatatataatattacttcagcgctttagccagaggctagaaccattggtcacattatggtagatttcaaggcctcaataacaatattactttagtcggtttctagaggtacatgtaaatattactctaacgagagactagaatcatttatcgcactattaaaaaatttcaagagctccacagcaatattattttagtcgatttttagagctacacaataatattactatagctagaggctagaatcatttgtcgcactataacaaatttcaagagctccacaacaatgttattttagtcattttttagagctacacaaaaatattactatagccagaggttagaatcatttttcacactatagcagacttcaagagctccacaataatataactttagtcagtttttagagctacacgacaatatcactctagccagaggctagattttttactatagcagatttcaaggcctccacaacaatattactttaatctgtttctataagtacatgataatatcactctagccggaggctagaatcatttatcgcacattagcatatttcaagatcacatccacaacaaaaattcatttgtcgccctacaacagaattcaagagctccatgacaaattactttaatcaaatgccaaaaatcgctcttcacagttcggtcggttcgtagagctccatgacaagatttactttaatctgacaccaaaaatgctcaccacatattaggtaggattaccgacaaacacattgtgttttcccaatgcatccatgacttaattccgtgacacaaatgcaactcaaatgtttttcttgaccacaaactatcaaaaaaaaaaggtttagagctgcacgacaatattactctagccaaaggctagaatcgtttgtcgcattatagcagatttcaagcgctcaacaacaatgtaactttggtcagtttttagtgctacacgatgatatcactactctagctagaggctagaatcatttatcgcactacagcagatttcaagacctccacaacaatatcactttaggatgtgttctggagaaggggttgggaacctctcccacgtgcatgaaaaatagatagcttattaacatatgattaattaaatgttaagtaaataatgttaaaaaagaataaataagatttttacacaactttctatagttttttgttcaagaaacacaatgtttagcagtttagaaagagtagcgcgcgtagaaaacgagggagtgggaaataagaacattgacttctgaatgcatcctttagtctatttctagaggtacgcgacaatatcactctagctgaaggccataatcatttgtcgtactatagcatatttcaatatctcctcaacaatatcactttaatcgactagaatcatttgtcgcactatagtagatttcaagagcttcacaacaatacgaacattagtcggtttctagagacacacgaaaatattactatgctctaacaggaggataaaaatcatttgtcgcactataccagatttcaagaactccatgcaaaatcactctaaccaaacgctagaaatcgctcgtcacacatcagtcccggttcctaaagctacgcaacattattactttaatccggtacaaaaatactccctcacactaaccaaacgtgctccatatcaagcccccaaaccacgaacggccaagacaacgggatggtttgtaactcctgagctggtaagtgagtttgtcgggcaaagaattgacaaccttcacatgttcgcacaattttgtcggcgtcagaaacagctgtgggccagaaaaaaccctgcgataagccttgccaacaatggttcgtgcagcagcgtgattaccgcagatgcctgaatgaatgtcttttagcaattgtcttccctcttccaaagatacacagcg

SEQ ID NO: 20317 - DNA, 6958 bp, Oryza sativa
  unsure (1)..(6958): unsure at all n locations
nnnnnnnnnnnnnnnnnnnnnnnnnnnnnnnnnnnnnnnnnggtcgcccaagctggacaccatccaagaagtcgtcgccgccgccgccggtgacaccgccaccgccgtcgtcaccgccaccaccaccagaagatcctccaaaggtcgaggcctccccttcctcggcaggctcggcagccgccgccggcgagaggccgccgccgccaccaccaccaccaccctcgtctgcggcaatggcggcgcggtggcgtgctccggctaggctaaaatcaattaattagtctccgggagggtaattaacgggggtgattaagattaagctcgatccgagttcagtttaggcgatgatgattcagctgcagcttcgactgcagctgtgtccgcatttgtaattacagaaaagttttggtgctaatttgtacatggtttttcgttgcattctgatcagaaaaaagaaaagaagaaaaaaaaaagcaaggctgcgtggtggcaggcaaaatttcaactcacttttgctttccccttttttcagtttctggtttgtttaaactttaaactgcttcctccccacatttcacatcctgtgtgcgcgcccatcgagtccagcaatacagtggtatccaaatttccaaaactgattacaaacaattttgtaggcatgaataccataattttcatagcaaattcaaattccacttggcataaaccattcaaaaatatttggatcgttcagtgcacacactcactcacaccgagatctctgcagctaaaccgcacgtagcacaagccttggtcaaactgcaaatgctgtgcataattcaaggcacgcacgcacgcacgaattttcaggtgccgttttacccaagcaaagtcagacggaataaatcgaattcgaatacaaatccagtcaaaaatgctcatcatgacggtcgttaggccaaaaagaaaagaaaaaagtacgtagaaaaaaaaaagtccaaatcactatggcgtatattacgcgttatgccgttattaaccggtgttccaagcggatcaaaacagtgaaagattcgaatatgcctctacgcattacgtcatcttgttcctgattagtgctaagtatctttgttagctaaggtaattagtagtaacttttgacagttgttgttaagtcagtaattatttcggtcagttactgtacactgaaacgcatgtgtggcatgtgacgcgtgcgtttgtttccatgagagatgtcgagatgggagcagtttgaccggggtcaaaattaaaaggcaagattgaattgaaaagagaaaaagaaaattaaaagaaagaggagagcacgttctccgaggttaaaaaaagattgagaaattgggggcattatacttccagctcactgatcctagctcccggctccgattcagatccaaatccggcgcgctaatcacacactctaattaagcactaatccactttgattagggcttatctaatggcagtagccggtcaaagccgtgacactatcatgatcccctttgcttttattttgattagaatttggtgtgtgtgtgtgagagagatgagaatgccggcaggtgggtcccagtccacagcctgtcaatgttgagactaatggagtaagtgtgagctagagagggcctattgctatattttgttatgcaatgacaattggatctagggcccaccgccggtgagttttgatatgaaactttgtgaaattagaggaggtgctatatattaatattggtatagtattagtttttattttcgtcggagctggttaacattgtgggtagtctcatgcgatcgtattaatttcatgtgaattttcaagacgccgaggctctttgctctattttgatattctttttatctgtttattatgatggcagagttgtaatctcccgtgtcatttaatataatatgtccggtttcaataacgagtattgactaatatttacacgtggcgacttgagtgtggtggtgtttgtttgacgggaaaaaaccgggaatcatgtgcactaattgagtgtgctaataagctggtcaaagttggtactctagatgcagggtaagacttctcctttgcttgccttgaactccttcattattatcagtaggaaattgagcaagtagctactattgctagcggtgggacattagctaagttatgagctagccatcgatggcaggtgggctcagggtgtaaaatgtaattaaggtcttgtttaaaggaattgtagatcacacgaagtagatggtaagtagccaactgataagaaaaaaaaaagggttttgaagaacttatggttttttttcttctatataatcgttcatttctagatttttcaaccattagattttacgacctaaagtaaaatttaggcaatatgagagaattgggattcaatggatgtagctattaaaaactcctaaacatgtcctatataaggatcagattgaaaaaaaattgacatttttcataaaaaaatatgagcatgttgaaaattgaatacgaaactttaggattaaaaccacaccccctttatcactgtactatggggcatcttctcatagcacttcatatatatgtcggtgtgagagtgttaatcaattaacacaagcatcacagatttcgtttgaacacagtacctaactgtacacgtggcagtatcactactcaaaattaagatgggaattaaaataaaacaattaagcatgtgggctctagactatataatggcctgtttttgcttagaaaggtagcaatgcaagcagtgctactcgcttagatgtcagcacacacacagttttgacctgatggtcaaagatggggccttggatccgggcttccagccaccattatctgctccatcacccacatttttttaattttaattaattaattaattaagtgtaggttatagtgtactcctactaacgtcagaggagagtatcaacttgtgcaatatacaacagctagcacatcgtctaattagctgtactatccgcatagtcaatcagtagaaaggccatgctggagtattatatacagatctgtgatattatcttggtagccagtatgtaattatatgagatctctatgtatatatagactaaagagacactcatatgcatgatttcttacatgatgtgcaaacaaaaaaccaggtgaagcttatatgattaagctagctaggtagatctactttgcttggattttttatttaggagtattgcttgttgagttgtggagtataaaactacaccaattttgaaatttaatatataacttcaaaattactaacttggttttctttccttaatttataatcactcaggtttgctttggagtttggaccactaattaaaggtagaaatgtaaagaccttatcctgaaattatttttcgttgcattggttacgtatactccctccttttctttctataaggtgtattataaaatcgaaatatcattaaaaatataattctattggaacaatttttacataccaaatatatatattcatagtttgagtaattagttttgaatttgtaactttataatattccttatataaaaatagttggagtatataacttgtacttacagtaattaatgccagcggaatagtaagaaaaatatgctcctacagtgtatgctagtcatcatatcagaacaggataagataaaatgccagctgacaagattttgctggtatatccatccttcacaggagtattttactacacacgtactgtgatgttactctcaggttaaggtaattaatccagtgccagggtaattaaccaaggatgaaggggacaatgcaaggtgtggattgcttgccacgtgtaccgcattcatggtcaatggtgggaaagggtttaactggggacaaggtagcggtcagaacggggtttgtcccagagaggataggcgaccaatcagcgagcaacacgtatacgtttatctctctacctttcccttcttggtttcgggctaattaacggaagaggaatgcaggatttaacatgtgcacgttcagatagtcaaagtcaattactcccttcattctaaaggcacgactgctttttctttttaggttgttttataatacaagatgtatagatacatgtaattaactaacgcatctctctcctaaattcgttatttagagtcttgatccttaagatctataatcagggccgttggtaagtgtgtccaccgaatatagcccctacaaattaagaccttatttttattctttttaatatattgtaatgtgttccaaagagatatcccgtattatagtagtcattaattcattcattcgtaccacccttgagaaaattatgataaactatttggttcatttctgcacccttgagaaacttatgataaaccatttggttcatttctgcaccagagaaaccatcctgatttggtttagactcgtgacgacgatgtttaaaatgccccctgtgaggttgaaagttgaaactctggtctctgcctctctggagaagagacaaccagcggtaagccggaggagcgcactgctgatgctgcgagattagacaacagattgatggatatgcatccatccattcatccatcggtggagtttgtgcgcgtgcgcttacacgaatagactggatattagtacgacacgacacatggaccgtgccattgttttgcactccatggataggtacgatacttctcgattactgccccgtcataaaatagttgtttgaatttttttagtcaaaattcttttaagtttgatctaatttatagagaaaattatacgacaccgtcaaactagttttattaaatttaatattaaatatattttgatataatgtttgttttgtatttaaagtattactatagctataaacttgctcaaacttataaaaaatttaacaaagaaaaaaaaatcaaacaacttaggacataaaacaaaaaacaaagaaagtagcaataaaagatcatatatgatatattttagtcatggaaatctgaacaggaatcgctcgcgcgcgtgtgcgtacaatgctatgatagtgataggcgtgcgtgctctccttcagctcctgctccccacatggccatggtggtggatgatgctccttcagctccagcaaccactactcaccaccagtggcctagatgcagctacaaactgcgcccgtgctgtgccatcgtttgaccgagaccgaccaaattttttgtcaactagtaaaaagcataaccacgagctccagttaattaactggtctactcctcctgcacttcctaccgatcgagtaattgtcgattactagtgctgtcatcccttaactgatgactaactaagcaagatgattaaacaacgtgtacgtggtgacttcgttaatatcaagatatgtcggtctaatcttctggagatgtttataggggtaggatttacgtgtttgtgttcacaaggacgatgagtgtgaccgtgttattagcgtctacatttacactgtgtttttttttttaaaaaagtcaatgtgtctgttgctcacgccattgcaccgttttgggctgctccatggcctcggttggattctacattgaaggaggaggaggaggccttcaagtgttgagcccaaaggggatcagcaagagtcgaccttttggcatgcaatattgggcctaatttaccagataaggtcgtcactcccttagttgataaagtccgcttgagatacctcgctgtgggtcaactttcattagcatcaatcgtaaaatatggtacaaagccacccactactctcaaaaccagtgttaatcatgtccctcgataatttggacagtgattttgttctttatcctacgtgacatactccatccgtctttaaaatatttgacgccgttaacttttttaaacatgttataccattcgttttattcaaaaacttttgtgaaatatgtaaaactgtatgtacagaaaaaagtcaacgagtattaactaggggtgtgtttggttcacggtcatgtatggataggatatggccatccatattttgttggatatagcgatccaattttttgtttggtttgtatggatatgacaatccaattttttgtttggtttgtatggatatgacgatccaatttcttatttgattggagggatatagcatggatgggaaaagccaaaagttaatgggacccatttgtcatatatatattttttaacaaaatataatcatccgagatcttattttaaagatttaattataaaaaatataatggtgtaatcaaatcataaattagataaacggtttaggagaaaaaattatttggagcttgcttaacaggaaatcaaaccaaccacagccaatcggaatagaacacatcacccaatccaaaactggatggcttcatccagccaaatcagccggatgcactcatccagcatattgagagaatattccctattccaggctaccccatctacccggccctccaaccaaacactacaaaaactcgagcggccatctcccatccacatccaggctcatctatccaaccaaacacaccctaggtctttgtggctacctggtgcttacagagctactgtcaaggaaaaaaaagggtgggacctatgtagggccttgaccaattcaacccagggcagcaaggccaggagttttgggcctctaatgggccacttggttccatcctctgccgaggttcacctagtcagacatagcggcctaatatagaggagtaattttcaggttcctctgctggttagggtgtgttcggagagaagattgtagaaataagttcaccggaggtcccttgacttaagggcgagatttttctaaaaggccttgtttggttacacccggatttaatccgggctagtaatgataagtgtagtaagaaatttatgatagatacaatgat

SEQ ID NO: 20318 - DNA, 1186 bp, Oryza sativa
  unsure (1)..(1186): unsure at all n locations
nnnnnnnnnnnnnnnnnnnnnnnnnnnnnnnnnnnnnnnnnnnnnnnnnnnnnnnnnctgaagaagagaagagagaaaagagaagaggagaagaaaaaaaaattacagctgacatatgggtcccacgtacttttttaatttttttgttgattaggatgccacgtcagcgaaaccactcatatatattgccacatgaccttgagtgcacggtttgtataagtttaggggtatacatttctcgctatcaagttgagagtcctccgttgaacttattccaagatcatgtagtaagcaacacaactggttagggaataaacacacgtgaaaaaagagagagtagaagttaggtcatctaattgtcttaaacagtttagcaacgaggacgcacagtctagtagtttgaatagaaattaagactataaccttaaaaactagatttatttggcttttttacagaaaattttatataataatcttgtttttgaaaaaaaaaaatcatctacccatacacagcattacaataagcccatatgcagcagctccgtcgaaaggatgatgacttttcctttacacaagaagagatttttacagcttaacatggagaagaagaaaaaaatccagaaacaaactaaacattcacaattgatcttgctcaaaacaacccgacatgctcacaaatccacaagatcaattcattgttcccgtcctggcgattaaagcattcacagttaatttacagatcgaatccaactctttccttttcttttgatgaaaagcagaattcaattcaacttgtgaatttgtgatatacgcaaagctcaaatcaatttagcagaattcatcatctacaagtagcgagtcccgggttgggggtacaagctgtacggcgctcccgccgcttcttgatccggcaaccacgccgccggcggggggtagcacggcgcgccgggcggcggcggacgcggcgacatgtacgacggcagcgcacggtccaccgagcgatcgcagcatggcgccgatcttggcagtggtggtggatactgcgatgaggctgactccggcggcggcggtggcgggtaggtgctcgtcggagaggggaaactgggcgccgggtagcctgccggcggtggcgggtagaagttgctcggtggtggcggcgggtagccggcgatgtactgcgacggag

SEQ ID NO: 20319 - DNA, 5790 bp, Oryza sativa
  unsure (1)..(5790): unsure at all n locations
ggggctcacacctggtagctcacgtgcctcggtgccgtccccgcgccgttgccgacggcgacggcgaagtctgtcagcggcactgacaccttgccgacgagcttgctcccgagcagcggcacctgctgccttcacctcgaactgcagcataccatccgcggcggcggtgaggtcgaaggctaagacggcggcgtcccagtccgggttctccccgccgtcggggtcgccgctcgtcttctcccggcggccggcgagcgacacggcggcgtagagcggcggcttctggaaggggacgaacgccttgacgcccctgcaggagatggacctgatggtgacccgccggccgccgccggcggtcgacatggcctccgagaaaaatctttcttggaaagaattgggattttgagcttggagatggatcgatttgtggctgatgggatcttggtggctaaagatttgaccttgtgctcttttgtttatttggatgatattggatctaggtgcaatcaatcaattggggagcagatagtatatgctgttactgtgttctttggctgcctgatttttaactgttcctaatatttttttttactttcatttctggatgcaataaacaggaggcaagtgtgtttgtgtgtgtgatatatatttgcatttgtaattatataaaaaagcactcaaaatgctgcagtctctctcaaagaaatcaagttcgttcagtactattttagaccccacaaagcaagaaaaattgtctgataatgcagttggttgtctaattttcttcttgctttagtcattgcaccacctgtctctttcttcttttccccaattccacactcatttgatatttggtagccgtactatgttgtgactgtgagaggccaccatacatacactatattaaagcaacatttgccaataagagtagaagctgttttaccaggaaattggataagctgaaacccatctaaccatttgtgatagcacaaagccataaactgatgtgtacaggcccatagatcacaaaacccaatgtagcacaaacccaatccaacacaagaaaaaaaaaacaacgaaaaatttcgtaccaatgcttaacgctttggagcacatggacaaaatattcataatcaagagatgaacacgtccaaccatgctgttgcatcctatgaattagtacaatggcaaactaagtgaaagacattacactacttgattatgagagcactgaagggatatcttcaaggacaaggttatttcatctatcttaccaaactttatatatatatatatatatatatatatatatatatatatatatatatatatatatatatatatatgaaaatgggtctatacacctggaagtatacacctggaagtatgtacacctgctcttatccaccgtcgatctgtgattagcttcgatggatcctgatatcggattaacgagcggacccgtttaactttttaactagaaaaaaaattacgtaccccttaatcacagaaaccggaatgacatgagctcgcataattcctcggtcccaccagtgcatcggatacgaaaatcaggtcactgggagagaccgcgatataccagaactcggagaaggcggcggcgattcatcgtcgattccgcgacagcagcgagattcatcgtcgatccatggctgcgttgcaggtgacggcgtgatccatcggcgtggcgacctgcacgcgcggcgcggcggcggtgtcgaccgatcggcaacatcgtgcggcggaattgcaggtcatcgtcctccaaggcaacggcgcgacgggacgggactagtcgacggtgcgatgcagcaatagttgaactaacccaggcggcatcaatcactcgtcgatctcccgcaaagccttttcgaaagcgacaatgcatgtggttagtactacttaattatttcttatgtcgtgtatatcatatcaatcttatcttctttgcccaggcagtcgtatggtgcatatgcacacctcggagaggctagtgacgctagtcgtcgctagagtccgcaatatggtgtgcttgcacttgctccgatcgaacaatcgggatcccagacgatggctgtgccgatctcctgaaatccatgacgattggttcttgctttttagtacatatatatgtttttgatgcgaacggccgactgaggaaatgatgctgaaatcctgacagtaatgaaaccatcttcgttttctttcgtttttgaaacattcagttcatcctctttattggcagaatagatcgatcgaggatatttgcagtatatgcaatgcaatgaccatatcgtgcatgtatgtagctccataataattaattatgcacccacgcatttcaggtttagatatatactactggtctatttcagtatatagcttatgaaaaaaaaagaatcggtattcggaagatcagtgcctactaattatagttcaatgtgatatgtgtgtttttctgccatgacaagtacatactgctagtaaataaaaaaaagacactcactagaacggataccctcatctcaatcgggcacagcgtccgtcacaggctagaagtcactgatgtgaagagttatctcaatcgggcaaacagccgtcacgaatgaatatatctcaatcgggccctaagtaaagcccgtcaccgatagctttgacccagacgaccagtcaaactatagcccgttacagatgacctatctctatcaggccacaactagcgcccgtcacagatgactactaacctttatcgggcctaaactagagcccatcacagatgatactcatctcaatcgagcctaaactatagcccgtcatagatgactgatgacctcaatcgggcctaaattagagcccgtcacagatgactgctgacctcaatcgggcctaaactagagcccgtcacagatgactagtgacctcaatcgggcctaaactagagcccgtcacagatgatctcatctcaatcgggcatttagttatggcccgtcacagatgactataatccacaaaaaaaataaattttgttttttggctagcctcaggcctttgctagccatgcccgctgcaaagatgacagaaacaaacgcagatatccaatatccccaactccccagcatcacccattcatacatatgcattcacatacacagacatcaacatatttcacacaaccacacattcacagccatctcatatttcacatccattcacatatttcacatccattcaaatatttatcatatttcacctgcaaaaccgagttaattggatcaaatatttatttagcaagtcttaacataaacatatgaaatatatacataaatataagcatcacagttacatcaccacagttgcataataagtgttcatcattgcctaaacatagaagttcaacattattcatcattttagtttaagcctaaacattcctttgggattaattatttcgcggaggatgaagctggctatctcctcgcgaacctcctcaaagctggtagtcagagacttggttattgtgccctacattgtcataattccagattagttgatcgatcatatataagtactaaaatgtagttagtctatcacaattgagaccaccgacctcaaactcagccaaagtcttcaccttttctctatacagaagtcgcatattgtggcacacatggaatccgcactggtcacctatttgttgcttcaccgagaagtcttttttgtggatgagggtgtcatgtcctgtcttcctgaggcctcctctttgcacgtattgggcccacgcttcatctatcgctagttgaattggggtccaatcatatgcgttcttatcaattctggagttcaggtaatgacatgtactccatttaggtgttatgaccagaatgatccaatgggcactgcggcattaatatagtgaaagttaattaagtactcaaggaatgtgtcatgctgttgtgtatatttagttaacacacttactattgattataggcacacataatgtacttcttgtctcggcgggaccacaaggtgtcgtagatgtagttgaccattccttgacggttattctggagatttgtgatagtgaccacttgtggatcaaggaaggcaacttccggtgcatgcttctgacaccattgccaacttaacctacacacaggatcaacgatcttgtaagcaagttaaaccgattgttattaccagaatgagttgggcgacaatacttacaaggagtagcacttaaggaggcttgtgtccaccactcagagcctgtagaggtcgaaaagatccttgaagtcgaccacgatataatttgttggaccaaggaaaggctttccatcgtgctgtccaaggatattggtagctttacttggcttcctggcgttagatttctccatgtagtataagtgaaggtccttgcaagcggtgcccattgcggcaagcacgtcatctccaaccaatggcatgcctagttggaactcctgtggagtgacgtatttcttcttgacctctttgcccttagtctcttcctggcccttgcccagatctagctttcttggagctagaagcgaggcctgcacctttcctccccttcctctcccctttgcttcgggtttatcgagagtaattctctgaggggaagagtgtgccttcctgctcttcttcatcggtgggggttcatgaatcgccttgctgtcggcctccgttcggtcctccccgaaatccgtgtcgtactgcaactgcacatcgtaagattgtgcatgacgatcttgagcaggaggggctgaaggagcagaggcgggtctctttggtggacgaccgcctggtgcagtggttggcctcgctgtaaccctgatctcaatgaggtccttaggccattggatgaaggtaccacgggcatttcctagtgagaggacctcgtcgttcggtggatacttcagagggaacagctcgtattcaggcttcaccgagtcgacttgaacttttgcacagtcggccctgagttgcgctccatgcactcttgtctctggggtcggcttgtacgcaagtccctcggctgctggaacagtgaagatcggcatcaccctaactgtgagggtgcagctcgttggttcctgcgatagattaatcaatttttttagaatattatatatcatatggattcgttacgtctttcatgtattgagtaagttcacggttaccgttatgtggtcgatggcgctgtcgaccgatgttggattttccgccaactcagttgatgcgcaactgctgcgtttttcggtgggacttcctaactctttgtgcgcagcagtagcggcagcctgggggatctgttgctcttctcggatctcttacctaatcttggccctcatcgactcgagcttttcgtcgaattcagatgtcagctcagctcgtatcgactcccggatcttggcttcaaggcgtgcatctttcttcgccttgttggaagtccgcttcttgtactgccacgcgtagtctggaaatccatacttccagggaacagaagacccaacgccccgtgtccgtccacggtgttccttgttgcccaacgctttcgtgaggaggtcgtcctcgcgtctttgagagcaggcctcttgcgaggcttgttgctcggcaaccaactccttctgcattacaatttagtggggtcaaataaactgcacgatgggaaacaatgcgaacatctagtnnnnnnnnnnnnnnnnnnnnnnnnnnnnnnnnnnnnnnnnnnnnnnnnnnnnnnnnnnt

SEQ ID NO: 20320 - DNA, 2783 bp, Oryza sativa
agggcgaattcgagctcggtacccatgggaaacaatgcgaacatctagtttgattagacacttactatagcttcgtatactcgttgatcttctacatttggcatgaagattgtgccatcatcatgtttctggtacctagccctggcccagttcctagcccgagggtgtgggatatcgccaaacacgagcggtgtaccacgattccttcgctttttcatcctcacgctgccattcctcttccttaccggcatatccggcggtaccaagccggtgcggatgctggttcctagtctggagcaagcgatatgcctcgcttctagctctggactcgggggtcgacttcttcgcatggaattccgaccagacctgttccgtgatccaaggaaatttctctcttggatctggatttgccgggttgtagacgaactcgccgactagcttagtcttgaagttcttccaagcagtgcccataaccttgaaagcagcccgcctgagacggtccttatgctccgcaggataatcaaagctctccttgaacgttagccaagcaatgttcttctctacggccggcacgagcttgaagtcgtcttgcagaataatgaatttctgcctccctatgaccccgcagatagacctaaatcggctcaatattttccttggagatgtcggcaaccctacggcgtttaccgctgtatgcggaaccgttccttaagaattttgttccctgtcctaggagtacgtgcccttgaggacccactagttgtcgtcgacattggttcgccttgctgagacattgtctacttttttccaaaaaaacaaaaaaaaacacaattgagtgctacaatctattacaatgaattgaatgtcacttataaaaataaatgaaatatataaataaactaaattgcgcatatcacaacgatagaatgaattgaatggcacatataaataaattaaacatatcatcaaatcctaaaatcataaattcacctcataccatctattcatccacatatcatgcatctatcactaaattgattaatgcaccacattccatctattcatcatcatgtcatcaatcaaaaaatcatccgtttaccatatatcatcaatccctaaaatcatctatcactaaaatcatctatcactaaattcattaatgaaccacattccatctattcatcatcatgtcatcaatcactaaaatcattcgttcaccacatatcatcaatccctaaaatcatctatcactaaaatcatctatcactaaattcattaatgcaccacattccatctattcatcatcaagtcatcaatcactaaaatcatctatcactaaattcatcccaacatccacatttcatcccaacatccacattttcattatcaaacacatgcaggtagcagagggaggcgcgatggaggactcacatgaggtcggccggggggggggggctcggtggtggcggcggcgggctcggtggagggcgtcgccggtcggtggaggtggcggcgggctcggtgcaggcggcgggctcggtgaaggaggagttcacggcggcggcgccggtcggtgtagacgccgatcggggaggtcggcgtcgggcgggcggcgtcgggcgtcggtgaggagtaggtgacgacgatgaggaaggacgtcgccggcctcggtgggggctgctgttcgtgtcggtgaaaaggcaagcggcgacgacgaggaaggccgacgtcggtcggtgtaaaggctcggtggcggtggcggcgggctcggtggaggcagcgggctcggtggcggtggtggcgggctcggtggaagcggcgggctcggtggcggtggcgccgggctcgtcggcggtggcggcgggctcggtggcggtgacggcggtctcggtggtggtggcggcgagggaggacgacggcggtgaaggaggagttggcggcggcgctagggttctaaggaggcgggaaactgtagcgggacttagaaaaattttcgatccgatctgagaaaccctagttatattagagtgatgagtcatctcaatcgggctttgccgtagagcccgtcacagatgactcatcggtgacaggctccatactaatgcccgattgagatgacattcaggcccgtcacggatgactcatctgtgacaggccctaagataatgcccgatagagatagattaatctctatcgggcttgaactaaggcccgtcaccgatgactatttttccatttcccagataagtctttatatttgtgagtacaaaatatatagctgctgtataataattcattttattagtcataacacattttcggatagtaaatgatttcaaatcgaaatatggtcaacaacaaaattgatcctctcatcaagatctacaacttttattttggtcatttatctatataactttgtttctaacagcttaaaattggttttgacaatatgacaaatataaacagcatttgtaaatattacatgactttaaatgggaaagccatagacagctaacttgtacagctaatcaagatctacaacatttattttggtcacttcttcatccgacaaagtgatagtaccaatgtttacaaaattgacatatctgtgttgatatttataaaccagatgagagaaatatgatttttgtgaataatataactatcactttgtcagatgaagaagtaaccaaaataaaagttgtagatcttgatgagaggatcaactttgctgttgaccatatttccatttgaaatcatttagtatttacaaatgatgc

SEQ ID NO: 20321 - DNA, 4541 bp, Oryza sativa
gcttgcatctataaccttctgtccaattgcattgaagaaggcgcacagacattggatcgtgtgacgcactttcggtggtagagtgcctctgatagcaactggcaagatttgtgtgattagcatgtggcaatcgtgagacttcattccaacaagttttagatcgttcaatttaacatacttacttatcctcgctgaatagcccgatggaactttaatatccttcaagcatgataacattgcgatcttctcatccttcgacagtgtgtggcaggctggagggaggtacactttacctgtctctgcatctcgtatgggctggagttcgctacgaatattcatgtcctgtagatcaaggcgcgcgttcaacccgtcctttgtcttcccgggaatattcaacatcaggccaaccaaactctcacacacattcttttctacatgcatgagatcaatgcaatgacggacatcaagatctttccagtaaggtagccgccaaaatatggattttttcttccacatacccttctcctttgtcttgctacgttttcttttcttcccaaactcattgcttatgtccttgaccatattgtggacctcatctccggacaaatctttgggagcaggctgaagttctctcttaccattaaaaattttcttctttcttctaaatgtgtgacgtagcgggagccacctccggtgactcatgtataccatctttcgtgatttcttcagccaccggcttcgtgtatgttccttgcaatcggagcatgccttctttccttttatagtttgtccggaaagattaccgagtgcagggtagtcattaatggtgcagaacaatagaactcttagcttgaagttctcctgaccatatgcatcccaagtttccacaccttctttccaaagaatctccagatcgtcgataacaggctccaggaatacatcgatatcattgccgggttgccttggaccttggattaacaagcacaacataatatatttccgtttaaagcataaccatcgtgggaggttatagttcgcaataagaactggccaagtgctgtgagtactactcatgtcattgaaaggattcatgccatccgtacaaagacatatcctcatgtttctagggtcggcagcaaagtctttgtgttttcgatctatattcctccattcaatcgaatccgctgggtgtctaagcataccatcattccttctttccgtggcgtgccaacgtactaacttcgcttcgttcgggttggcaaagattctcttgaaatgatcaataataggtagataccacacaacctttgcaggaccacccctctttgacttatttccttcgtcagcacttttctttcgcttgtaacgagaagccttgcagacaggacaagcatccaagtccgcatattgcttgtggtacaatatgcagtcgttgggacaagcgtgaattctacgaacctctaaccccagtggacacagaacctgctttgcttcgtatgtcgtctcgggcaatgtgttctcaacaggaagcatagccttcaaaattcctaaaagatctgtgaaactcttgtctgtccatccactacttgccttcagcttcattaggtccaaggtaactgacaacttagtgtgttttgctttgcatccagcgtacaaaggcgtctcggaatcacttaccaacctgctgaatttcattccatctctctcattttgggctaggtcctcaacgtcacgtaacatgtcttgtagtagatcgtgatccacatcaaccatttcaccgcccaatggagaaggtataaacatgtcatgctcattttcatcttcctaattatgcgcaccacttctgtctgctgctgctccacttcctgattcttgctctccatgcttcacccaacatgtatagccctccatgaatcctcgttgtatcagatgaccgtgtacgtcctctccgctatcaaacatattctcgttcttgcaatctgcacatggacaacacatgtaatcactgtttcttcttatccgatcctcctccgcggcgttcataaaatttattacgccctttcggtactccgtagaatgacgtttcaaatttttggcatacatccaacttcgatcaattgctacaaaaaaaaacaaattagaggcacatattataagatcagtattgcaaaagtaagacgtgatgaaattgctcaattaatgatttatattactcacttgattgatccattttgatcacttttgggaatttaatttctgttttccttggaaaaaggacaaaaaatcgccccctacagcctcccaccaaaatagtgaacagtgggatacagttacactaggtggtggggggtatttatactgtgcaacaaatatctgtaacggccctaaaacaatcaaccgtgacgggcatacaagttatctctatcgggccttaataaaagaccgtcaaaaaagagtgtcatctgtgacgggcaataaacttatctcaatcgggcctctagttggagcccgtcacagatgaccctcatctgtgacgggcttcttttagggcccgattgagatatggaaccctcatctcaatcgggcctcaactatagcccgtcacagataagtgtcatccgtgacgggctttagttttgtgccgatataccatggctgtgcgaccatatctcaatcgggcgaaactttggcccgattgagattacttccttgtgacggcccgcaaattccagtcttgttatgggccgtcacagatggaaggatctgtattagtgactcctatatactactgctactatactaaacagtatatacctattgactaaataaaaaacggtatatactccctagccgatcaatttattatatattggatacttggaaaaacagttcataatccttaaccgatcgatttaatacaataatagatacttgaaaaatatagtatatactggataaaaaaatcagtatatacagataaaaacagtacatactgctagtaaattaaaaaacagttcatacctagtaaataaaaagaggtatatactactgttactatactaaacagtatatacctactgactaaataaaaaacggtacatacttcctaacctatcaatatattatatattagatacttgaaaaaacagtacataatccttaactaattgatttaatataatattggatacttgaaaattttagtatatactggattaaaaaatcagtatatactggaaaaacaatcagtacatgcatactccttataccagtatatataccattcttaagaaaaagtagtacatacttctacaagaaagtatatacttctaaaaaaagaaaaataataaaagtagtataaacttctacaagaaaaagtatatcattccctagctaaagatattatacatatagtggttacaaagcagtatttatacgtactactactatgtaaacacaactactggagtacgtagtatacaatgctactgctattaaaaaattagtacgtatacactagtactaatccacgtgtttggatcagttctgtgcatttaaaatttgtaatgcatgcactcgatcagttagttgtgcattaaaactaaagaaaagaaaatgcattgttttaaaacagatcagattcaccatggccctattagatgctattggatcatccattaacaaaggggagtatatacacttgggtgtacagaagagtcgtcctatatatatatatatatatatatatatatatatatatatatatatatatatataaaacacaactcttctctttccatctgtgtttccaactcttatcttcacaaacctccaccacttattatcaattatgccagaagtaccccccccaaaaaatgccagaagtacactattaccacttatcacccatacgttttgaaacaaccacaacgttaatcaaatagggatatgttaatgagacatctctgggggaacagggaatttaagatcaacatgggagcgtggagtaggttgggtccaaaagggggaactccaacatattcagcatggctttcaagggggacatgattagaaatccaaatacccaatagttgcaagtctgaaattgattgatactttattcaatggttcttatttctagtgtttgcacacgatagtatgcaacaccttattactagagtacatgtaaccaacgtttgatcaacaacaaccacaagaagagagttggaagttgacaggggccatgttgcacatgtatggcatctgcatcgccatgttcatcatcatctgctgctgcccgagtccagcacaaataacttgttgcatgctctgcatcatctggtaactggtgtcacagttgcactgaggcatcatgccttgcagctgcatgcaacattgctgctgcaggggagccattggctgtgatatgaacatggctgtggagctacccatgcccaacgtttgcatcatgtactgcctatacggatccgtggtgcccatggctaatgttgctgggaaatactgcatagtggtgattgcag

SEQ ID NO: 20322 - DNA, 1173 bp, Oryza sativa
  unsure (1)..(1173): unsure at all n locations
nnnnnnnnnnnnnnnnnnnnnnnnnnnnnnnnnnnnnccaacatattcagcatggctttcaagggggacatgattagaaatccaaatacccaatagttgcaagtctgaaattgattgatactttattcaatggttcttatttctagtgtttgcacacgatagtatgcaacaccttattactagagtacatgtaaccaacgtttgatcaacaacaaccacaagaagagagttggaagttgacaggggccatgttgcacatgtatggcatctgcatcgccatgttcatcatcatctgctgctgcccgagtccagcacaaataacttgttgcatgctctgcatcatctggtaactggtgtcacagttgcactgaggcatcatgccttgcagctgcatgcaacattgctgctgcaggggagccattggctgtgatatgaacatggctgtggagctacccatgcccaacgtttgcatcatgtactgcctatacggatccgtggtgcccatggctaatgttgctgggaaatactgcatagtggtgattgcagtagtggcacttgcagaaagagcaattaaggcaaacagggcaaatatcttggtggtgtatgctgccattgctgattctacagtactagtgttaaacaagatcctagatggtgtagacaatattgttgagggtgatggaatgatggttgcctttgcctaggggcctatttatacatgctagtagctatagctgtgtaagcttggaaaaaaattggcctttgcaaaaccacctagtggaggccacataagctagaaatcatgaaacatgagaattatttggacatttatccaaccaatactttggaatatctaaacaaagatagttttgccaatgctttggtgcatggaaagaaaatatgttgataaggctgtgccagattgctttggcattttgcaaagttaagttagcagttttgtaaattatgagctaggtaaagaatcttttagaactgaatttgtatgggacttgtagaatgtgttacacaagtcacaacttacacagataacaattaagagtatgagtcattgccatatgtgggtgattgagaagagtcgacttggaggcatgcaaatgtactttaatagcatacatacatatgcagtttggcatgtatttggagttttgttaa

SEQ ID NO: 20323 - DNA, 1243 bp, Oryza sativa
ccgatcctatcggagttccagcgtctcgtcacgagggaaggtgtcaggtgttggcacaatcggaaggaaaagaattaggcccgatcaagcgtcgaacgcgcaggctcattacgctgagctccaacatatggcagaacttgacccatactttgacgagcacttagcgaaaatccgagatgagaacttggggcgatctgatgcatggattaacagacaacataattctcggttcaacgaatgatacaagaatcgtgtgacaatgtccacggatgtcccaaatgagatagtacagttgctggggatgggaccgtcttggaccatagacacatgggaaggataccatatctatggatacacattttataccgtcaaacaagatgacaaaagcacagtgcaaaacagcggcgtccgtatagatgcattccaggatcaagttgggtcaaacacatactacggccgcattaaagagatctggaagctaaactacgtcaagttcacggtttctttgttccgctgccgttaggtgaatctacgcactggtgtcaaagccgacaaggaaggtttcactttagtagatctatctaaggtgggatacgccgatgaaccatttgtacttgcgaaacaggtcgagcagatattctacataaaagacccttcaaacaagaagatgcacatcgtgagggatggaaagcgccgaattgtaggagttgacaacgccgtcgatgaagaagaatacaaccataatcttcatgtaagacctcacattgaccttgacgatgatccccaagagcctgtggcatatgctcgttcagatcataccgaaggcataaccttgtgactgatgcatttgtacttatctattgtaatgaatgaagtattttgttttattgcaaagacttgatatgtgtagtcattaatatggctaattttgttttattacaaatgaccaaaataaaagttgtagatcgtgatgagaggatcaactttgttgttaaccatatttcaatttgaaatcatttagtatttacaaatgctattaattagatttgtcatattgtcgaaatcaatttcaagctgttgggaaaaaaattatatagaataatgaccaaaataaaattattagatcttgaaaggctctacaactttgttgttgaccatatttccatttgaaatcttttactatccgaaaatgtattatgactaataaaatgaattattacacagttgctatatattttacact

SEQ ID NO: 20324 - DNA, 856 bp, Oryza sativa
  unsure (1)..(856): unsure at all n locations
acgcaccttagattatcatctcgatcttctcgtcgacggacagatcggtacgatcggttgatgtaggagaggtcaggaggaggcggccgaaccagcggcggcggaatcaaaaacttcatggttgcccttgccgccggcggaagtgtacggcggcggcggcggactccggcgatggcggcggcgtgagggctacgttatttatcgattgcaaagccattttataggtggattagagagtaatgggctaagccaattcatgactagcccagaaatttattttgtcgatttatcatatatttattatttaccttttattaaaaaaatgtttttcatagagatgcacatgcttctgtattgatatcttctaagattaacatacatgcatctgatccagttttaatatcctgtgtggaattgttgattattccacgaaatatattaatttctcaaaagcagtacattttcatctgtgtgtagccatccccttaatttgtttgtgcaaaatgcgaggatgcttgtttctgcaatagggtaggaagattgtcaagagtggtgtagtaggggaagaataattaatcttctattgtgatcactgtgtctagagcaattggatgatttatattgtttgaatatatagtacctttcacaattgtttggagattatgtttcttcttttattaatttttcttacgtcgagaaaaataaaacaatggcctatgatttgaatgatgaaactgcatccccagagaaaagcaacatgttgccaccatgtgctttttggtggtaaacatgaatctatctgannnnnnnnnnnnnnnnnnnnnnnnnnnnnnnnnnnnnnnnnnnnnnnnnnnnn

SEQ ID NO: 20325 - DNA, 880 bp, Oryza sativa
agaaactttaattagctatgctttgcaagatacatgaaaaatatcagtaggtttttcaatggctctgtcacatgtatggttccaagttcactgcaactgcaagtgatttgatctgtgcagctatcaaatgtttcttaagcatgatttctcttttttgttgactttgtttagctagagagttcctcatttagctgttgcatagattctgctggttgattataaggtcagggtataaggcatgatggataaaatgagctagggattttgttgctgaacagtcataagacatgatggataaacattttttgctggttagcagcttgtgatactgttatctcataagtcatatcttaactagtgagtttcacatttcgctgttgtgtagattctggatagactaagattctgttaaataaatctgggtatttattggttgtgaagcaacttttacgttttgtacgatacattagtaggtttttagctgaaacaaaaggcatgtttatttatgctccaatacggcgtccagtcccccgccgccaccgcctccgtcgaaccgtcgctggcacagggaggactccgcggcggactccgagaacgccgctgccttctccctccctcgtgcagttcttgccgtccccaccgattcgccaccgcgacgcagtccactccgctggtcacgatctccgttgccgtcgcgatgcaagtctcccctctaaaggtacacatgatccactccagcgccactcctcaatcagtcgccctgctgccaaaaacatttagctgctattcagtttcacaacagaaaatgttcacctctttattaatacatttagttgttttttgggatcaaactaaaaaattactccgtggcatgaggcat

SEQ ID NO: 20326 - DNA, 8549 bp, Oryza sativa
ccaggtactatcgctatctacaattgcacatacgtgtattatccggattttttttcttctccaaaaccaacacaatgcccttagatattagttctccagatccaacaaatttgtgctgctcttgtatagctggatttgggacttcatttgatttggggttgatatgcggttatgttttttaaatttgagtgggaatttttgttttggtttaatcagaggatggaggataatatgatgtacccaatcaaggaccaagaaaccatgctgtgagttggccaatctctgttctcctgcaattacattttcctttttgcagtagatcttgcttccaattgattttgcagggcagtaccaatggacatgaacaggcagcagcaggatacagtttgctccaaggaaattttgcagcaccaaatcagtattatactggctagcatctcttgtttatttgcattctgatgtttttttttatcctgtgggacagattgatctgggctacgatcgaatgccacaatatatgtcaggcatgtaacacaggggagtgcagaaatcctgttattttcactcaatctggtaatctgctctaattcttttgctattctttgccttggccatgtactggattgaaattgaagatatttatttgagcatatatattatttttgttcagggttacaggattgaaattcaagtatacaagattgcatataactgaaggattggagtggtcaatgtctagcattcaagcgtgcaagacctactgagctgtgtcaccattgcattgcatctgatctaagttggcgctcttggtttaaattgttgagtggtgtcaatgctaaacttttatgccgaataagagttaagaatcttttaccaactttttacgctggggcacttcttggatgccctaatcttatattcgtttagtgccttgaatgaaaactagagcaatgctaggcttagtttgttgcgtgatgtagtagatggagatgtgtttatagcacggaaataataaaatcattttccatatgttctctattaaggaaatattaattctactatttatatattttgcctatatttatattcctgaatatataatttataatttaagggcaatggtaagttatatatgatatatgtatctctataccacccatcagtcatcatgtatacttagatacacatatttgatccgcattactaaccattaccgtagcgttagcacgggcaaattacttgttaaataagacaagtctatgttgatccaactagtggaaatcaaacatgcaaacctttgcactcctctcatcctggaacactaaccgtacttattttcctgatgcaactaattgcaattataagttatatataacccacgaattacattgctaccggcacgatggctgaatattgttgcaagtttgcaaccacagagcaaagatccccaagcaaacaaatccaaatccgacgaactactcgagcacgatatgaaagccttttggctgtccaagcggggttacggaggacggcgagcggcgctgggcggaggaaaagggagagagatagttgcagtggcgtcgccggcggtgggtcgggaggaagagaaaggcgaggccggtgttgggggggcgggggggggtgacgaaacgggtttggcaccggcactgtgcgggttgattttgttttgaatattaatgactttaggatccatacttattataaattatctagttctaaaataaatgtttgaaattcatttttaatagttaatttatagttaattcattcgtttgcatcttcgaatagttttttcgcgaacgcatcttccaatagttattacaaattcacttagcaaataaataaataaataaataaacagactacacagatgaataatataagtagttagcagacgatatatgcccttccctctacttctctcttccacattgaatcttacatggtgttcacaagaggtcagtacagttcgcaattttaccatgcaaatttgtacagtttaacaaaaacaagacttcatcttcattcttataaatgcatatccagtttatctgcattatggtacaggaatcccactttgttgcactaaactaaactatcatcatcatctggttggacaaaaaaacatgtcgaacaaaatatgtcaattcactggctaacactttctttatcaaacaccatgatttatggtaattaaatgggtcagtgcatgacatcacatatatacatgcagtcgaaaaaaatatatggagactttgggggttctgttaaaaatcctgtaagatatttgaaggcaacttattatgtcaggaagaattttaaccgagtttttcaaggcttccagtttgtttgaactgtcatgctgagtccaagttgatggatttactatcaatcagccattgctatctaacataattttcactagctcttcattccaccaactatcttcctgcaaaagccgggatgagatttcagatatgaaaagagtcattaaaaaggtaaaaacaagattatcatgaagtactgaagtactcaaatgttaccagttcgtgtataggttagtccatcaatgccaacaccttgctgttcgtataacaagaacagccataacaatcaagaactatccgttgctgactatcaagatagccgagactgccttctcacaaattgtatcatgttctcacgtataagctgcgggcaaaaccttcatttttcacaaacaagttctagtacttcacaagtgctggtattacagcatagcagtctgctaagcaatgaaaaagccaattcagagtagagtgtccggcagattgacaagtagttcaccctacaaaaattgtaatttttgaaaataaaattaaatattcacagtatggcccaaagtgaaactttaaatgacagaaaaggctggaaaacccccaaatttcggcctttttttttccccccaatattcatgcttgtatatcctaaaaaaacatgttcaatgtgatctttgtgatgcatttcacaataaaaaacagtactacatgtagtaataaggatgtaagttattatcggtggataaaaaaggacgtgatggtagacaaatctatagttagcttcaagatcactaattaagcagcaaattgctttgccatctaatcaggcttttggaaaatatttgcaaaatatcttttaacaattttgttttcaccaggaaactatggggatactctgatatttaccttaatttcctttccagtgaatgataaggaatttcgatgagtctccaaagacattgcttctctcatgagccgaaataccttcttgttcatgtttgttttcatgatgatcattttgccagatgaatatatcctactgataccaagatctgctgccatccgtcttacatagagctttttcaatagcaactgcaaggaggagaaaggaagacataacgaagtaatcaaacttcaccatcaccaactatggtcacattggcatgatgaaaatctcagaaacagcaaacctccatatcacgaggctcctttccatattgtcgacgaagatcttctgtgaattgtattaaggtccataggtctttctctgcagcttttgcagcttcgttaagcaattccaccggattttcaaggtaacttatgtattcagaggagagacgtgaagaaatgtttatatccagctgtccaaagacacaaagtttgtgaatgaaatcaaaagggcaggttacccagatgaaattattcgtcattgcatgaaaaagctacagcagcaaagacaataaattttgtgcccacctgaacatctttgtaagggacgggaataagacaaaactgatcaacctaaaaagatagaaaatagtcttgtcagaatgatcacagtaaataattaataacgccatgcaacaattcagaaggttatttggctcattaaaggatgtacaaaattaaaaacagaagaactgtatgattgtaccaaatagttggaatattgaaatagtagtatgtggaccaaatgggtaaggactacctgaaattgcctataaaatatcttcgcatgaaacaaagatgataacaatatgcatgccatgaatgagaagcattctcaaataaaacaaatgaggcagtaaaaaaactgggtctagaaggggattacataacaataatcactacttcaagtggcaaacaagaaaaaattgttcaaaacagagttcttttctttaccaagaactagccatcttaaaggcagcaacaaagtagtgaatagatgaatactccctccgtcccataatatagcaacctaggaccggatgtgacacttcatagtacaacgaatttagacaggaagcatgtccggattcgttgtactatgaagtgtcttgtccggtactaggttgctatattataggatggagggagtaaaagatatgtatgatacaaaataaaggatataagaatacaggtgcaggaacaaaaaaaggaagtgaatagttgaataaaagaaaaataatatcatgagcagatatgcgtgattgatgtgtatacctttgacaagctatcaaaaagcatatcaaagaatagatcaatgccaacatttgcaacatctccagattgttgctcaccaaacaagcttccgaaccccctgatacccatatccttctctgcaacatggaaaccttgaccaagatctgaatgctcctcaatagctccaagtctatcctgcagatggagatattgaactacagatgaagaatgacacaacacaatacagattctgaactcatttaacaaaagatatttcaagggataattgccttattgtcatacaaaagaccccttattttttctgtaagatgccctatagaaatgtatcagaaaatcaaacatcaggtgctgtggaagtagtaaaagctacaatttagttcacttcattttgccatggcataaggctagtcatacaagtggtggtcaggactgagggctcaggaagcatcaatacactgaaacctagtaagcataacatacattccaaagtgccaataatagaaatactgcttattaggtgccaccaagactggttaactgatcttatgtacaacaaactatcattaaaggaaatttaggttatatttctgactgggcttccatatttagtattattgcaaatatgctttcagtaacagtcatcagatgatttggatgctgtgacaagaaaatgaatataaataataaaattaggggcactatggtagagctaaccgttgcaatctttgagagcaaagacttatcagtgtagaagaggtatgcgaaaccttctgtgccggatcttcctactctacctcgcaactgtgaaggaaaaacaaaggggtgaacttgtaaaattaggaagatgcattagaaacaacacggataactagggcacatattacttttaagtacgataacagtctcacagaaggctaaacagaggcacaggacagctcatactttttcagttcttcgtagcttattttgtatttataaatgagaaaactccagtaagatgctcaaaaactatttgccaatgggcatagttcaacaatcaatcaaatttatgtgctcacatattatcaaatataaatgctaaataactatgccataatgaggtgcttctagtttgtttgctggacaggtgttttgctgtaccccttcttggattgttgttgttgttttatcactctcttatcaatgaaataagagccttttgcctttgtttaaaacaaaatgccataaaggaaaaggaaagcatatcagaaaaacaaagccacctgatatagctgtgcaagcccaaatagttcagcatactgaactaccatcgtgttggcatttggaatatctattccactttcaatgatgtgtgtgcagaccagaattttgacttctccacaagcaaatttttccatagcaagttgtatgttctttgaaactttctgcgggaaaaagaattggcaagaaatttgattatgacaaaagcaccattcgactatgcaaatagaacataaatcttgattgttaacctaacattattccatatataataactagcaacttaagatatagacttgactgaaattgaaggttgtaagctttacagaaaataaatagtcattgacaatcaaaatcaaaacgaactatcgaagaacaaggtcatcgacaaggcccatatagagtttcctgttaaattagtttgaacactaatcagccatgcaaggaaatcctaacaatgataagagagtttcattggtagaaatccacatgttggactttggctttaacacaatcaagggtatacaaataaaaatagcctacaataaataatagtgaaatagcatactaaacacatctgaaagtttagtcaataaacctttccatgagcaacagccattggaacatctggaagagaatccttgagaaattgcagcacatcatctattgctgtcgcatgatgaaataaattattaaacataaatgcagatttgcaatctaaattattgaatgactttgcatgatattgcagcttctatatggacagtatagattgttagtgaacgcatccagcaataggctaattgttagaacaatctgcaatcgcaagtccaacttgctgagtactaaactgagattgggaatattgagaaaaaaattgttttcaggttcatgcatcacaagtatatgctgtgaacaataagtcatctgaagataacaaagtttccaccttttattcgaggaacaacatagaaaacttgaccaccacgtgccaactcaaacttaatagctgatagagccctttctttgctaaatcctgacacgtaggtccttacagcaactctttctggaggcggcgtagacattaaactgaaatcataatacatatgcttgtgtcatggaaaaaaatgaaaacaattccgagattaaatgcatccaaggtattggagttatgaagaatgaattaaatatagagtcagcagaatagcgctatgatcacattaaatgcacgaattatctcaagaaaacagtagtaactattgcaaatgtaataaaatggctcaagtgaatcccctaaaaaaactctagtgattactcgtaaccattgtccacaaattatctcaagaaaacagtggtaataaaattagcaatatctcgtaataaattgtggacaatggttacgagtaataaattagcaatatctcgtccaatatctcgtccaacagaaaacagaagaaaaaaatagtattgttgccatcttacctggcatcacggaaacctgtcaacgcgagatacaaagtacgtggaatgggtgttgcagacagtgtgagaacatcaatagaagccttgtatgatgcaatcttctccttttgttggacaccaaacttctgttgaaacatagagtttgtgaatatatataaaataaaataaaatgcatggctgattttggttgcgagatatttagtcaaaatttatggaacactagagttaagttttcagataaccattcctgacctttagaaaaataacaaaaagtaaacataaaacaatctagtattttttttgtcgaatataatctacaacaaaaaggctttcccttgctatatatatttcttgtagaaaaccttaatatgattaacttgttcttttcatttctggaaaatactacccatattaccatcattgatgttatcaataacagaaaactatacccaaaaaaatcaaacagagtaaacatttatatttacaaattacaaagagaacctgttcttcatccaccactaggagaccaagattgttatatgccatacgttctgtaagaacagcatgagttccaacaataatatgcaaatcaccattccttatctttgttattagctcatctttttcttctttggtctgtaaagcagaaatgtaccccaagtcatgcagaagataagagacgcaaattccatcactttaacagacaaaatttaaagaaatactaatgccttcctatctgagaacctacatgcccacatatgagcactatcactacaaaaattgctgaccagtaagtacaagaatcccttattgaatgtcagaagaaaaggttcgggaaagacaaaagggacttccttaaaaatatatatttgaacagtacttaataacattcagtgaaacatcaaaaggtagaaaacagggtattattaccgattgttgtacaatcggtaatatatataccttttttttctaacaacaacaaaaggcacatcaactttttttcctaatatgggataagatcataagagcagcacactttctagggtcaggactaatacagtaataccttgtagttaagcaattaatgaatataaaatgatttcacagtaacacaaaaatattactactaacacaataatgcttggttgttaatcaattgaggcatacaaaaaatattgcttggaaatgaaaaacacaatgaattgcctggtggggtaactttgagttgtgccatgctatacctga

SEQ ID NO: 20327 - DNA, 2190 bp, Oryza sativa
  unsure (1)..(2190): unsure at all n locations
agttaagttttcagataaccattcctgacctttagaaaaataacaaaaagtaaacataaaacaatctagtattttttttgtcgaatatattctacaacaaaaaggctttcccttgctatatatatttcttgtagaaaaccttaatatgattaacttgttcttttcatttctggaaaatactacccatattaccatcattgatgttatcaataacagaaaactatacccaaaaaaatcaaacagagtaaacatttatatttacaaattacaaagagaacctgttcttcatccaccactaggagaccaagattgttatatgccatacgttctgtaagaacagcatgagttccgaaacccccanaaattaatattgcaaattccaccatttccttaatctttgttattagctcatcttttttttctttggtctgtaaagcagaaatgtaccccaagtcatgcagaagataagagacgcaaattccatcactttaacagacaaatttaaagaaatactaatgccttcctatctgagaacctacatgcccacatatgagcactatcactacaaaaattgctgaccagtaagtacaagaatcccttattgaatgtcagaagaaaaggttcggggaagacaaaagggacttccttaaaaatatatatttgaacagtacttaataacattcagtgaaacatcaaaaggtagaaaacagggtattattaccgattgttgtacaatcggtaatatatataccttttttttctaacaacaacaaaaggcacatcaactttttttcctaatatgggataagatcataagagcagcacactttctagggtcaggactaatacagtaataccttgtagttaagcaattaatgaatataaaatgatttcacagtaacacaaaaatattactactaacacaataatgcttggttgttaatcaattgaggcatacaaaaaatattgcttggaaatgaaaaacacaatgaattgcctggtggggtaactttgagttgtgccatgctatacctgagcaccactaaacatggcaaccttaatatcaggataattggagaaacgctcagacattacatcataatgttgcttggctagtattacagttggagcaagaaccatagcttgaaatccagcagatataacaatgaatatagcacgcattgcaacttcagttttaccaaacccaacatctccacaaatcaatctgtccattggggtttccctttcagtcagatctttgtcaacatctataaaagcctgtcattaacacgaactgcattaaatccattgatgttgattcaatcctatgtattagtaaagtagtgcatggattacttaatcaactagactcatcagtttgccaataagtcttgcacaaggaaagaatagcagcagcttctctttctaaaaaacgacatcagaatttccaggtgaacaaaagaaagaacaacagtatttgattaagagccgacctggttttggtctggagtgggctcatagggaaattcagcagtaaactgatccattcccacaggcttcgggtaaggaggccttttctgcctcatcctttgtaaatacaactccatcaaattgactaccattttctgaacagcaagcttccctttcagtcttctcttctcccacgtggaaggatcgttcagtttgctcaaattccgtggtctctgcttctcgtgaggtctgcaggaaacatcaatctggataaatggtcaacgtgaatttttactttccaccagaattgaagggacaggcccacaataaaacatttataccaaacatcaagtccggaaatagcaatttttacaatgtttatataagtagtaatgaatttttcttgttccttaaatggaggctggaacgtgcagaaaacatgaaagttcttgcagccattcagagcaggaatcaattttggcaaaatgcaattattatgtcaaaattcgcatagctagctactcaggcatacaggttgtatctgtagagcatgcgggcggcctggtcgacggcgagcttggccatggcgtcggcgtactgtatgaagacgtagtcgagaccgccctcggcgctgatgcagacgaacttgccgacgccgacctttttgtgcacgacgtactccccggccttcagcttccgcgggtacacccggtgacccaa

SEQ ID NO: 20328 - DNA, 1457 bp, Oryza sativa
aggggtttaagccggcgggcgagtggataattttggtggtggctttgcgtggaccgggtgcacggtcggagagaagatattttgctcccgggccttggaccgttgggtggacacggcaagcttgctgacatgtggaccccactctttcctcatgggccaggcgcattaacgattgggccggccttgttgggctagcaaacagaggtagactaccggattgggcccaaattacgaagcggattcttaaaaaaaaacaagggctttaatgccatttctaaccttaccatttttgttatcaaaattgtgtaaaaacgccaaaattttggctacattgccaaaatttggcaacaaagtgaattttggtagcatatatgttgccaacaaagtgaacacatccaaaatagctatattgccaaaatttagcaacattgccaatcttaccaaaattttagcaataccaaaatttggtaaggtttatttttacatcaaagtgaaaaggctccaaatttcttccgttgattttcagtgaaaggattccctacagaaattctgaaattattttttgagatgctaacttggtagttatttttggaagtaaagtaaggcctttgatgccattttccaccttaccaaactttgataaaattgtaaaaaagtgactccatttagtttcctaccaaatttaagtaactataccaaaattttaaaatgctaaaatttgataattttttttttcatcaaagctggattgacatatgtacaagcagttccccaacacacacatcgacttcataaaagtacagccggtttgaaagactaaaacaaagcaaccagtaattaagcaaataaaactaattaaagcaaggagaacccagattaacccactactaattaactgcaattatatcacacgcttcagcttcaagcagcggcggcgggcttggtcttcttccccaacacctcgaggatcccctccctgccctgctcgatgccggggggctcgacgccggcgtccttgagggtgacggccttcctggccgggtactcggcgacggggtcggcggcgacgccggcgcggagcgaggcgtcgtcctgcacgtgcgccaccttgcggaacagcgacccgccgacgaaccgctccgcctcgtcgagcgccatgtccggcgccgccacctcgggcaccgtctcccgcttcttcttgtcgagccgcacgttgggcgcgtgcgccagctgctgcctcgccgtcgccaggcccagcgacaccgacaccgcgatcatccccatcgccacgtacaccggcacgtagtcccccgccggcttcttcgccgccgtcgccgctgcggcggagagtgagcgggagcggccggggacggacaccgccgcggcggcggcgcggaggagggaggagactcgcgaagccatcatggtgggagctaggcagctagcaagtgatcgag

SEQ ID NO: 20329 - DNA, 2126 bp, Oryza sativa
  unsure (1)..(2126): unsure at all n locations
caaatattaatattgtagtctaatgtggtttcctcttccttaatttgacaatctggaaggttatttttcctattctaattcaatgtgtttcttatttataccatttttgaagtagctgatggacttgtgtttgtattttagttaacaggaacggaatgatcctgttgtgaagttctacaattccggaatccagggcgtgaatgaagttcttcgctttcacttcaacgtgaatgaagagatcggtttattaaggataggggaaatgatacgtttttttccattaatcctcaaattaaatgtggactatttagtacaatatttttctcaaaatgaagaaaaataaagagcaaatattgaaacttgagctgataaactgaaaaaaaaacatcaattaagtaaaaagccatcttattcagcttgaaaaatatcgcgattatctgaagatcacataaatgaatagccgaatcaatccgtgaatacttttttaggtgaaatgcatatcataatttatgtttcatttagggaaaaaaactgattaaagagtagtcaaacagaaaaaacctctcagattaattaagttatgcagtcaatgaaccattttaagtaatcaagtcccgagtatttgttgccttcatccaactattctgctcattgacatgaaagggcaatagctcagtaattagcaagcacatgtccagccatcagctgttgcaacctaaataatacagctggtgactaatcaagtgaaatacattccactaattccacctgaagaaaattctcaactgggggatctgccatgtgactatggaaaaggaggaggggagaggaaaaggcaagatgagatacaatagctgatttcacatcatccggtctaattgagtaactgattttaaggagagggaagacttgaactcacaactttaaccacacaatcttgctcacctttgacaatccttagttccttacaaggactttgcaatcatcatatggtagtgatatagtactaagcattgcaagacttggaacatgaggtgttgctgtatttacaagggatcagggattcgaactcgagacctatagatacttttgcgagattttagacaatgcttgctgcttccaattgcctgcacattgtttcctcaaatttcagaattcgatgcgatgttttgttgcctgacgcgtcctcagtctgtcatgcaattgaacgaccgctcctgctgctctactgttaaataaaactcgtccaaggaccaaacccatgaatgaatctgaatacctgatgctaatcttttttatatcactatggtctttttcttttgtcgtcaccatttaacagatgtagtaatatatagtttccacagtacgattaaattaaatggagtcgctgtagacttcactatgaacttattctgatactaaatgtagatcttggctcagtgcacggtcaactgaattcccagctctttctaaggagaaaggagatgctaaggatttcagaggaaaaaaaaccagcttacttgagagaaggtaaagataggagggttcaaaattttggaccggaatttcagaaatttttgaaatttcagatctatcagacccacctgatacgaaattattttggccaatgttttgggttttctcaaacttttgtgaatttggcaaaagttagtcgaatttggacaaatcttgttaaaaaaatttaaattattttggatcgagatttctaaatttcggctatatcagtacctccgatagaactactgaattgaaaaattgaaccctgatgggacaaaatgacacatatgagtatatgttagcttaatatatatagccagtgggcacaaacttcccagttatattccgcacgaagaaaaacttccctgttcattttgtgatccctcgaaaattgggtttagttcttcaattcaaaagagaagaggtggacgtagaacgaataggattgggatgcatcgagaaatgcagagttgcaaacatggacattgcggcatggaaatttcctgttctaattattgcatgttatttcttatgtgcgctagaagcaccatttcgcgaagnnnnnnnnnnnnnnnnnnnnnnnnnnnnnnnnnnnnnnnnnnnnnnnn

SEQ ID NO: 20330 - DNA, 453 bp, Oryza sativa
ctaaccaaacgtgctccaaacatccacgaactcacctcgattactaggcgcaatttgccaactcgatcgcgccattaaaatttgcacggtagaagaggagtagtagttgtcacgttggcacgcacgagtggatggatgcacgagcgtacgtcgcctcgaaatggatccacggtcacacacactggctggcaccgtcgcaggcacgtggactgaacaccgggccccacattctgacacacccgcatcttttgaatatctctatatgtattttttatatttatacagtagtatatataaaaagagaaaaaggaaaataaaaaaagtgggaaagccaagctggtagtgtgacgactgaggaactagctagatccaaacgccgcgcaaaaaaagaaaaaagaaaaaagaaaaaaaatgccggtcaaagtgtcaaacctgccacccccacgtgggccc

SEQ ID NO: 20331 - DNA, 768 bp, Oryza sativa
  unsure (1)..(768): unsure at all n locations
nnnnnnnnnnnnnnnnnnnnnnnnnnnnnnnnnnnnnnnnnnnnnnnnnnnnnnnnntgtaccccttcttggattgttgttgttgttttatcactctcttatcaatgaaataagagccttttgcctttgtttaaaacaaaatgccataaaggaaaaggaaagcatatcagaaaaacaaagccacctgatatagctgtgcaagcccaaatagttcagcatactgaactaccatcgtgttggcatttggaatatctattccactttcaatgatgtgtgtgcagaccagaattttgacttctccacaagcaaatttttccatagcaagttgtatgttctttgaaactttctgcgggaaaaagaattggcaagaaatttgattatgacaaaagcaccattcgactatgcaaatagaacataaatcttgattgttaacctaacattattccatatataataactagcaacttaagatatagacttgactgaaattgaaggttgtaagctttacagaaaataaatagtcattgacaatcaaaatcaaaacgaactatcgaagaacaaggtcatcgacaaggcccatatagagtttcctgttaaattagtttgaacactaatcagccatgcaaggaaatcctaacaatgataagagagtttcattggtagaaatccacatgttggactttggctttaacacaatcaagggtatacaaataaaaatagcctacaataaataatagtgaaatagcatactaaacacatctgaaagtt

SEQ ID NO: 20332 - DNA, 878 bp, Oryza sativa
  unsure (1)..(878): unsure at all n locations
nnnnnnnnnnnnnnnnnnnnnnnnnnnnnnnnnnnnnnnnnnnnnnnnttcttggatgaattgttcatgggttggatagccctttgaataagatttccatagagtctaagaacgtcaaattccgagacccgagtcaagagatatcgccgttttactaacagccggttgagctgaaaagtgacctgcggtctgacagaagtatgttgtccggtctgacctcccatcccatggcggtctgaccgctcatcctaattttgaaggaggtctcgtcttggcgatccaaagccgctagagctgcaaccagtcagaccgagcccctggtggtctggtcgagccgtggacggtctgaccggccactacactgcggtcagaccggccaggttgagtgggctcaatgattgcctagccgttacaaagtagtccgatctgaccagccacactatagtggtctgaccggcagagcaaagagttggggatttcaatcccaatggctagttttggtggttgggggtatatatacccactctctagcagcaagggtaaggttttggcactccattgcattatcttgaacccttgaaagtgttctcacacccttgggcacttagtttatctagtgaggtgttagagagtgagttaagccaatccaagtgcattgcttcattgttatagctagtgtggtacttgatcatcctcggcaagcatcctagacttgttactcttggaggttgccacctcctagatggcttgtggaggtgtttcccggtgatctctccgaggagattgtggaggaggcccgacgccgtttgtgagtgatttggagttcaccaccttcgaagtnnnnnnnnnnnnnnnnnnnnnnnnnnnnnnnnnnnnnn

SEQ ID NO: 20333 - DNA, 670 bp, Oryza sativa
  unsure (1)..(670): unsure at all n locations
nnnnnnnnnnnnnnnnnnnnnnnnnnnnnnnnnnnnnnnnnnnnnnnnnnnnnnnnnnnnnatagctgtgcaagcccaaatagttcagcatactgaactaccatcgtgttggcatttggaatatctattccactttcaatgatgtgtgtgcagaccagaattttgacttctccacaagcaaatttttccatagcaagttgtatgttctttgaaactttctgcgggaaaaagaattggcaagaaatttgattatgacaaaagcaccattcgactatgcaaatagaacataaatcttgattgttaacctaacattattccatatataataactagcaacttaagatatagacttgactgaaattgaaggttgtaagctttacagaaaataaatagtcattgacaatcaaaatcaaaacgaactatcgaagaacaaggtcatcgacaaggcccatatagagttttctggtaaattagtttgaacactaatcagccatgcaaggatatcctaacaatgataagagagtttcattggtagaaaatcacatgttggactttggctttaacacaatcaagggtatacaaattaaaattgtctacaataaataatagtcaaatagcatactaaacacatttgaaatgttaagtcaataaacctttccatgagcaacag

SEQ ID NO: 20334 - DNA, 1503 bp, Oryza sativa
aagaaaggaaataaagagaagaaagatgatgcttctagtgattcttctaataaacatatactccatcagttttacaatgtaagactttctagcatggctcacatttatttagatgttaatgaatctaaacatatatatgtgcctagattcattaacctctatatgaatgtgggcaatgctagaaagtcttataacctgaaacggaggtattagtagctatatttatagttggctagaacaatagatacttcataaacaaattaactttttatcaaaaccttattaagagctaaggtaaactaatagaccatatacaataaacaggatcaaaagtcgcgcaaaacgcgattatgtggttagtttttagtgaattttgtcaccccttgagtgggaattcaatggttctctttactccttcctattgattattaataaaagagtaaattttagataaccccaaatatacaaaactaatgggttttggcacgtgatacataacccctagctattataactataaagtttcacaaaccacattattaattattttatctaatttataagttatttattcatcatataaatattatatctaatcgtgtatataaagctttttaaaatttcaaaacaagagtatatcaatttagttaacggtgtgaattagtaaaacttcaaccacaatggttgtgattatgtttctcgtgccaaatctgttcgctcatatcataatagatatgaaatttactcattttattataaggttttcgtggttttgaactcctgatgtactaatgggttccaccgtatataagatccaatggcgttgatattcgtgatcaagatctgacggtgatggatgcattgtaagtttgtaactacacaaaatttatttccaggtggcgtctcctcattggccagcttatggcgcgcaacggggaagaaaccgacttcctttcccgcgcttttagccgttgccccccaatcccaccgctactttaacggagggggaattaatcaatagcgctcaaatttacatctcaccccctaaaaaaacatataataacaccgaaagcatcaaacgatctgcacagcgcaacggacaacggcagttttccctaaaaccccctccagacaaataaattcgcactcctgcccttcttccttctctctcttcctccacctcctcctcgatccccaaatcccccaaaccctagctcgccggagcagtggagggcctcgccgccgtgctgcctcttggcccctccgtgtgatgccactgagtgcgcgtgggtgggtgtgcgtgttgtagctctttcatggcgtcgcagcctcccgccgccgtggaggctcgtctcgcggatctctgcaaggtgaggtggtggttagatctttggttggccgctggtgggaatcgtcgagcgtttgaggtctcatggttcgatgggttttggtgcaagagctgggagtggaccagggcgtctcccgcgaggccccggcggtgct

SEQ ID NO: 20335 - DNA, 1389 bp, Oryza sativa
  unsure (1)..(1389): unsure at all n locations
tcttctcacttaagtaatatttctcaactttattccaaattatttctttaactgtcttactttatttggcatctgcacagattataattacagtccttttgtttaatttcagtcaaacaaactgagaaaggcgtggatcttcttccatcgttatgtcacaactatcatacctctgaagaccgcttgaaagaaatgatgggaaaatcttacaaagtgatagaggtcttttttagcaggaaagcaataaatgcttcagagttcaaaacagtgaatttggataaaatagatacaggcatgacctcaaacacccgtgttctctctcatgtgttcctgcatgcatgctctgtcttacattcaattatctaagtcttgtttcattgttatggtggtagatggcctgatgtatttcaaagatcttgtcgatgatgagatttttcagtcaaatttggaaaaactggagaagctaagtagtaccaccggctgccaaggggagcttgatttggaaatgtttttgaccagcaatgactatgtactcaatgctgaaaactcttctggtagttccgctaattttggctgctcaaaggtatctgtgatgattcataatctttttagttaactacacattgttttctttttttacattacagattcccttttctctttttgcagcgtgtgtttgaaacactagcctctcctacaaagacaataaagaatatgttggctgcccctagttccccttcatcacctgccaatgggggctcaatcaagattgtgcagatgacaccagttacttctgccatgacaactgctaagtggctacgtgatgtgatatcttcattgcccgataaaccttcctctaagcttgaagagttcctttcgtcctgcgatacggatttgacaagtgatgtagtaaaaagggtcagcataattttggaagctatttttccaaccaagtctatagatcggggtacttccataggcctcaattgtgcaaacgcatttgatattccatgggcagaagcaagaaaaatggaggcttccaagttgtattatagggtgctggaggcaatctgcagagcagagtcacagaacaataatgtaaataatttaaccccattgttgtcaaatgaacgttttcatcgatgcttgattgcatgttcagctgagctagtattggcaacacataagacagtcatcatgatgtttcctgctgtcctggagagtactggtttaactgcatttgatttgagcaaaataattgagaactttgtgagacatgaagaaacccttccaagagaattgaaaaggcatttaaattcattagaagaacagnnnnnnnnnnnnnnnnnnnnnnnnnnnnnnnnnnnnnnnnnnnnnnnnnnnnnnnnn

SEQ ID NO: 20336 - DNA, 731 bp, Oryza sativa
  unsure (1)..(731): unsure at all n locations
nnnnnnnnnnnnnnnnnnnnnnnnnnnnnnnnnnnnnnnnnnnnnnnnnnnnnnnnnnnnnncatcccctttaaatgccactagagagaatttgtcttgctcttgtgccctttttcagccttgcgcgtgccacatcactgttacaacgtggaatcagtggggagaagataagatttcccctagcccaagaacaagaggaagaagctccccgatgtacttgttgtcagggttatggataccacatacctaatagtagttgactaaatctcggcaggacctaccacataccatgttctatacggaaacaacctacggatataggaagagttccggataaggaaagacaaccagagttctacatggaaacgacaaggactactcggattgtatccatattgttttcctagttctacttagacaaggggacacctataggtataaatacaaggcccccctaggaggagaggggatacggacaatcaacaccaaccataatctacgggacaacagaagccacaacatacaagccaacatacgccaatacaagacgccggatattgacttcagggataggcacggctagtcccctacggtgtcttcggatactgttaggagagacgaaagcgctatctctgatcttgccggcacggattcgaggaggaaaaattacctgttgtcgactacgagtcagaccttcagaccgcatgttgacaatagtagataggctaccc

SEQ ID NO: 20337 - DNA, 2317 bp, Oryza sativa
  unsure (1)..(2317): unsure at all n locations
nnnnnnnnnnnnnnnnnnnnnnnnnnnnnnnnnnnnnnnnnnnnnnnnnttttttctggcccacagctgtttccgacgccgacaaaattgtgcgaacatgtgaaggttgtcaattctttgcccgacaaactcacttaccagctcaggagttacaaaccatcccgttgtcttggccgttcgtggtttgggggcttgatatggtcggtccattcaaaaaggcagtcgggggttatactcatctctttgtagctgtggaaaagttttccaagtggattaaaaccaaaccggtcgtcaccatcaccgcagacaaagctagagatttcttcatcaatattgtacatcggtttggagtaccgaatcgtatcattacggataacggcactcaatttacgggcggaatatttaaagatttttgtgaagacttttggcattaaaattgttacgcctctgtggcacaccccatgagtaacgggcaagtcgaacgcgccaatggcatggtacttcaagggatcaaagcacgagttttcgaccgactgcgtccctatgctggcaagtgggtagaacagctgccgtctgtactttggtctttacgcaccacccccagtcgggctactggccagtcgccgttcttcttggtttatggcgcaaaagcaatgctgccgagtgaggtagagtttgaatccctccgatttcgtaacttccgggaagagcgccatgaataggatcgagtggatgacatcaaccgactggaagaagcccgtgaagcagccctaatccagtcagctcggtatttacaagggttacgccgttatcataatcggaatgttcgatcgcgagcctttttagttggcgacctggttctgaggagaattcaaactacataggatcggcacaagttatctcccttatgggaaggaccattcataatcgctaaagtcactcggccaggttcttaccgactcaagcgtgaagatggtactcttgtcaacaattcttggaatattgaacaccttcgttgtttttatgcttaggcatcacttctgtattttcctcttcgactgctaacatcaagccttttcttgagttgtcagtcgggggctactatgataatggagtgtgatctttatcaattcaattcgcttacttgatttatcattgctctgtttgattttttggcttagtcaatgaggactgaaagttttttaacaacttttgcgagttttaggctcaacaaggtttgacaaaaacttttaagaaatcaggagctaagtttgaaatatcatgcacagcataaatttatcagtattgtacaaattgtacctccatcatcgtcatcatcatcatcagaatcacaattacaatataacatcaatcagtgtcagttttttcatcgtcggaattatcagacccagtcggccgaaggtcgccatcctggaatctctcaactatgtcagcagcaatcttgtcagcggctttttgcgcatcattgatgaggttgagggctgtttcttcgcttgtcccgtctgcaaacccatcaacggcgtcaatatcgattttggggtataaagatttggtcatagctaacgccatgcttgctcccatacatccaacctccctaatattcttgaagtaagtatccggagcgactctcagcttgtcgaagatctcggaagcgtcaagtgtactcgaaccggcgttattgaagaacatggcttggatgagtagggtagcggcattagcgactttatccctggccccttcaagcctattgatcttattgattaagacatcaaactgtgcctgggacttgattttgcgatttgcacgaataaatttgtatcaacaggtggctataagagcatggggaactagttatcattaccttcaacatcttttaaggccaagtccctctgctttgctagttcggccttgtccttctccagagcttcgacctgcctctctaggtcggaaatcctggcggcttgcactgaaatgctcttcggttaatcgatatgacaaggaaggtttcacgaatatgtcagacggatatggtatttacctttggatgaaccactcaattcatagttagatttttgaagctcagagattctattcctcagatcatgctcagttttcctcgcgagctctctgacctcatgtaactggcttttggtggcttcaagagttccaagatggggaactaatttctcaagtgtcgtggtctttgcctcattcctgagatggattctctgcaataagaatctaccggcgttttcagcaaaatatggaagggaacaattaaagctatgcgtaaatg

SEQ ID NO: 20338 - DNA, 1932 bp, Oryza sativa
  unsure (1)..(1932): unsure at all n locations
ctgtgaaaagttgaaatgtttgattacatatcggtggaggaggattgaaagcattgaatggcatgactagcagcaagtgcgaatagctgacgacgatagcattcgagaagatcttgtacatcctttccttcataatcttaaagttaagagagtctggatcttcacgatttggatcatgtttgccgtcaaactcaaaagctgtgcgggacctctctttgattggagctaatcggctttttatgaagtgccaagtgatctgttctccctgcaaaccttgctctttcagctttatcatgcgctccattagttctacagcctgggctgcctcatctcctgtaggcaatgaattccatgtatcttggtagactggagggagacaagagtactcgggaagggctggtttaggattttgaacatagaaccagttggcgtgccagcctttgtttgaggtcttgaagggcatggagaaatatttttggcttagtgttcccctgagttggaaaccagcacccccaacaacgcacagtttgctcttgtttggctagggtttgaggaagaagatgcggcgaaacaaggcgaaatgaggcctaatgcccagaaaagcttcgcaagcatgaacaaaattggcgatatgcactatggagtttggattcagatgatgcaagctaattccatagaagttcagaattccccggaagaatcttgaggttggaagagaaaatccgccatagaagaagtgagagaataccacaatctcgtgtgtgtcgggggtcgggaatgctttgccgaacgctggtcgccacccgatgatttccttcgtcggaagaacgccgtgcaccaccatttctttcagattctcttccgttacatcggagggagcccactgactctcgaaactttctctctcctccgccatggatgcgagttgcatggttagatttggtccaagatatagctggaggggaatgaggaattggtgcggtggacacgcggagaagtttcgtgggattttttgagaatggattgggacggattgatgaaccctagtttcgacggtgcggtttgctactgtagcaaggagtggggaaatggcgagagtctcggtggggaagacgaagcgatgcttggacttcggtgctttgttagggtatcgggagtactaatgggcctgggtctgtacagtacttcagcccaatattataatcagcgtggcccgttgtgatccctagggacttaggtgctttttgctttggcaatttgtgctcacaatgatgtggcccgatgctgctaaaatcctttttaacgcggttcgataattctttggaattattatgctgcaaataaaaaggtgcccgacagaaaggtgttataccatttttgtcagctttattaggctgcaaaagttgtttgggttgatttgagatgactggtttattaatagtcattctcttagcatgttatatgcacattttggttatgatgagggccatagcctaggctattagactcgttgattaccatgattttttatcatatttgatgggttgtctttagagtttttactcggattcctgtcaaatatgtctatttgaggaccttttgagtgtttatcactcgggccttttcatatttttttctcgatgtattgcagctaagaagcagacggctgggtgttttactgactaccacacatgctttgctatataatgtttggttgtaaaaccactcggttcttgactacatgtttagtttttcaactaaccacatagtcgggggctacacctaattaggtgcatctactcgatgcaccatgttttcttttcgcccttcacagtctttgattttagcactcggcaggctggagcaggttgaattgaagcactnnnnnnnnnnnnnnnnnnnnnnnnnnnnnnnnnnnnnnnnnnnnnnnnn

SEQ ID NO: 20339 - DNA, 511 bp, Oryza sativa
cctctccgctatcaaacatattctcgttcttgcaatctgcacatggacaacacatgtaatcactgggtcttcttatccgatcctcctccgcggcgttcataaaatttattacgccctttcggtactccgtagaatgacgtttcaaatttttggcatacatccaacttcgatcaattgctacaaaaaaaaacaaattagaggcacatattataagatcagtattgcaaaagtaagacgtgatgaaattgctcaattaatgatttatattactcacttgattgatccattttgatcacttttgggaatttaatttctgctttccttggaaaaaggacaaaaaatcgccccctacagcctaccaccaaaatagtgaacagtgggatacagttacactagggggggggggtatttatacttggcaacaaatatctggaacggccctaaaacaatcaaacgtgacgggcatacaagttatctctatcgggccttaaaaaaaagaacggcaaaaaag

SEQ ID NO: 20340 - DNA, 790 bp, Oryza sativa
  unsure (1)..(790): unsure at all n locations
nnnnnnnnnnnnnnnnnnnnnnnnnnnnnnnnnnnnnnnnnnnnnnnnnnnnnnnnnnnnnntgttcatgtttagcatatgccagctctgaccaaaatctttattctgtattgcaatttggtggaggaactttaggacatccttggggttatgcacctcgtgcagcagctaatcgggtggctttagaagcctgtgtacaagctcgtaacaaagggcgcgatcttgctcgtgaaggtaatgaaattatccgatcagcttgcaaatggagtcctgaactagccgcagcttgtgaagtatggaaagcgatcaaattcgagttcgagccggtagataaactagatagctagactaagtagataaaattagatagaaaaaaggtcaaaataaaaaagaaacgaaatagaaagatcaaaattagttacgaaaatacagtaattcttggtttttcttctaattaattgcaattaaactcggctcaatctgttttcaaattgagccgagtttaaatagattttgatatgatcatgagacttgacaaattgggattcctctattctatatatttataagatataaaggtttaatacaaattaaataaatacaaatatagtattatcatatgataatggaatcaaatacgcagtatttacagaaaaaggtttcatttattgggaaagaatcaatgacatacaatgcattacaaaatatatgatcattacactttaacccggttattttattccacttatagatagagaaaataccttaaggggaatggaggaaaaaaaaa

SEQ ID NO: 20341 - DNA, 667 bp, Oryza sativa
ctagccgagcttcccaatctgacccataacggcttcccaaaacctggtcgatccttgaagcaagccgttgtgattccttgaagaaatcatcatacctgcacaccaaacaaaggtaaaaaaaaaaaaaaaacaatccattgtcaacaaggccctaaaacttgctacactacagttcaaaaaccattataacatagcatgacccacttgagcttgcaacccttcaagatctcccagagcctaacgccggaggaacccgccttggtctccttcagcttggagacgcagtacagcacgaacgcgaagcacagtttctcagcatactcgggctgcaagaatccaaactttaggggggggggacaaaagatagcctcaaattcgccgcaaaagacagagcagccctcaccgatttgctcccgaacgacggcgacgcgaggagcgcgcccttcccctcctccagcaccgccgcggcctcgccggcgacgccctcgtccactcccagctcctgcaccaaaacccatcgaaccatgagacctcaaacgctcgacgattcccaccagcggccaaccaaagatctaaccaccacctcaccttgcagagatccgcgagacgagcctccacggcggcgggaggctgcgacgccatgaaagagctacaacacgcacaccca

SEQ ID NO: 20342 - DNA, 1030 bp, Oryza sativa
  unsure (1)..(1030): unsure at all n locations
nnnnnnnnnnnnnnnnnnnnnnnnnnnnnnnnnnnnnnnnnnnnnnnnnnnnnnnnnccaagttgatggatttactatcaatcagccattgctatctaacataattttcactagctcttcattccaccaactatcttcctgcaaaagccgggatgagatttcagatatgaaaagagtcattaaaaaggtaaaaacaagattatcatgaagtactgaagtactcaaatgttaccagttcgtgtataggttagtccatcaatgccaacaccttgctgttcgtataacaagaacagccataacaatcaagaactatccgttgctgactatcaagatagccgagactgccttctcacaaattgtatcatgttctcacgtataagctgcgggcaaaaccttcatttttcacaaacaagttctagtacttcacaagtgctggtattacagcatagcagtctgctaagcaatgaaaaagccaattcaggagtagagtgtccggcagattgacaagtagttcaccctacaaaaatgtaaatttttgaaaataaaattaatattcacagtatgtccgaagttgaacttttaatgacagaaagctgaaaccccaattcgctttccaatattcatgcttgtatatcctaaaaataacatgtccaatgtgatctttgtgatgcatttcaacaatgaaaaacagtactacatgtagtaataaggatgttagttattatcggtggataaaaaaggacgtgatggtagacaaatctatagttagcttcaagatcactaattaagcagcaaattgctttgccatctaatcaggcttttggaaaatatttgcaaaatatcttttaacaattttgttttcaccaggaaactatggggatactctgatatttaccttaatttcctttccagtgaatgataaggaatttcgatgagtctccaaagacattgcttctctcatgagccgaaataccttcttgttcatgtttgttttcatgatgatcattttgccagatgaatatatcctact

SEQ ID NO: 20343 - DNA, 1421 bp, Oryza sativa
agtagtatgtggaccaaatgggtaaggactacctgaaattgcctataaaatatcttcgcatgaaacaaagatgataacaatatgcatgccatgaatgagaagcattctcaaataaaacaaatgaggcagtaaaaaaactgggtctagaaggggattacataacaataatcactacttcaagtggcaaacaagaaaaaattgttcaaaacagagttcttttctttaccaagaactagccatcttaaaggcagcaacaaagtagtgaatagatgaatactccctccgtcccataatatagcaacctaggaccggatgtgacacttcatagtacaacgaatttagacaggaagcatgtccggattcgttgtactatgaagtgtcttgtccggtactaggttgctatattataggatggagggagtaaaagatatgtatgatacaaaataaaggatataagaataacaggtgcagaaccaaaaaaaggaagtgaatagttgaataaaagaaaaataatatcatgagcagatatgcgtgattgatgtgtatacctttgacaagctatcaaaaagcatatcaaagaatagatcaatgccaacatttgcaacatctccagattgttgctcaccaaacaagcttccgaaccccctgatacccatatccttctctgcaacatggaaaccttgaccaagatctgaatgctcctcaatagctccaagtctatcctgcagatggagatattgaactacagatgaagaatgacacaacacaatacagattctgaactcatttaacaaaagatatttcaagggataattgccttattgtcatacaaaagaccccttattttttctgtaagatgccctatagaaatgtatcagaaaatcaaacatcaggtgctgtggaagtagtaaaagctacaatttagttcacttcattttgccatggcataaggctagtcatacaagtggtggtcaggactgagggctcaggaagcatcaatacactgaaacctagtaagcataacatacattccaaagtgccaataatagaaatactgcttattaggtgccaccaagactggttaactgatcttatgtacaacaaactatcattaaaggaaatttaggttatatttctgactgggcttccatatttagtattattgcaaatatgctttcagtaacagtcatcagatgatttggatgctgtgacaagaaaatgaatataaataataaaattaggggcactatggtagagctaaccgttgcaatctttgagagcaaagacttatcagtgtagaagaggtatgcgaaaccttctgtgccggatcttcctactctacctcgcaactgtgaaggaaaaacaaaggggtgaacttgtaaaattaggaagatgcagggtaccgagctcgaattcggcct

SEQ ID NO: 20344 - DNA, 901 bp, Oryza sativa
  unsure (1)..(901): unsure at all n locations
nnnnnnnnnnnnnnnnnnnnnnnnnnnnnnnnnnnnnnnnnnnnnnnnnnnnnnnnacatggcatatacagcaaatttctcattgataggaatttgtcgaatacatcattagatataaagcaggggggaaaaataacaaaagcaattgcgatgcaaacacgaggcaggagacccaacctcgcctgggctggtcctatataaccttccttgttgggcccggcccatcgaatagtagcagacaggcgggccttttttccagctcacgcagcattcgatcgatccgttttctgccactttccctcgctcccatggccgctgcgccgtcgccgccgccgccgccggcctttcttccgccccacccccgtatcgtaaactacatctccactcgccagggggcattcgagctagcagctcaggcggcggcacatccggggacttccgtgatcgtcgtggtgaccggatccaatccactccaggacgcacgcaaactgtttgatggattggttgcccggcgagacgcactgggatggtgtgttctcgggctcgacaagttttcacagctgttggagagatacgacgtgctctgcgacgacaggaacaagttgagggagctggtgggcagcatctacgccgacatgctcatcggcggctcgtcggctccggaggtggcgctggagagccacgacgccgccgacgacgtacaaggcagggtgcgtcggctactgagcatcgcggatggggcggacgcggcaacacttcgcctgacgctgctcgacgacgccgacgaggctcgccgtctctgccgcgctgggttcctccaagggcgccgcgacctcgccgccctcaagcagctagtcgaggacttctggatcccatccatcaaccgccagcttgaaggtcc

SEQ ID NO: 20345 - DNA, 5154 bp, Oryza sativa
atcgtgataactgaaggatactctctccatttcatatcatgtcgtttgatttttcttagtcaagtttgaccaaatttatagaaaaatatattagtattttcaacacaataaaatatattatcaaaaatatattcaatattagattttatgaaactagtttgatattttagatggtgctaaatttttccataaaattagtcaaacttgattagaaaaaagtcaaacgacttgtaatatgaaacagaggaggtattctttgagagatctccaaggactgaactcattggagggtaggtagacggaagacgaaaatatataccaatagttttattatagtatctgcgtaaataagttattccgtagcagctgattttaaggagaatgacatgaacccctaatatttaaacattatagtcttgcgcctctatggctatatgcctcccaaaactttgaaatcatcatacggtatagtgatggagcgatcgacgagccgacgagcattgcaaggttaggaacaggaggcgtttgggaacgtaccaaagcatgaaagtgaggatcttgaactggttgtgacaacacaagaggttctatcctgctagtccgtaatcatcatatgctagtttttgcttttcgatgtcccatttttcttcttttccacagtccctgcacatatttgatcctttgcgtgagttgtgaatgtgagaggcatccagtaaaacaacatctgccgaaaacacaagttctttcctctttttttttttaggaaattggagcggttgaaacacatttaaccattgtaatagcatattatgaacagatatctactggcccgtagataaaacccaatccaacactgaaatcaaccaaaatcttcatgctaatcacagttcccctgaacaccggaagtggggatttatgcacaatgctctggagcacatgaacaaaatattcagaattaagacatgaatgggaaaaaaaaagagatcaagatcatgatcatggacaattgtgctacatacatcatacatcatgttttgtttatcttagatggcctacaaaaatatgtaatacgaattcctaggatattgccctgatttcacatactatgtgggatcagcttaagcaaacacatgctgtgatttctgtgcaactcttttagcatgctctctgaaaatatgaattctggtttttactgttggtggaagaattcagtaatcctatgaatgaatactatagtgagatacacatcatctaatcgcatcccgtaaattgattttttttttaaaaaaaagaaatttggaggctcaaaccggcccacaaaagtttgcacacaacaagagcccacactaggacagagagaaccacataaagtatggccgaagaaaaagttttaaacgtttcagaaaaaagaggtaagtttttaaggaaaagtatgaccaatagaattgatggaatttctcaatctgagtcctagatagattcatgtttaccaccaaaaagcacatggtggcaacatgttgcttttctctggggatgcagtttcatcattcaaatcaaaggccaatggtttatttttctcgacgtaagaaaaattaataaaagaagaaacataatctccaaacaatcgtgaaaggtactatatattcaaacaatataaatcatccaattgctctagacacagtgatcacaatagaagattaattattcttcccctactacaccactcttgacaatcttcctaccctattgcagaaacaagcatcctcgcattttgcacaaacaaattaaggggatggctacacacagatgaaaatgtactgcttttgagaaattaatatatttcgtggaataatcaacaattccacacaggatattaaaactggatcagatgcatgtatgttaatcttagaagatatcaatacagaagcatgtgcatctctatgaaaaacatttttttaataaaaggtaaataataaatatatgataaatcgacaaaataaatttctgggctagtcatgaattggcttagcccattactctctaatccacctataaaatggctttgcaatcgataaataacgtagccctcacgccgccgccatcgccggagtccgccgccgccgccgtacacttccgccggcggcaagggcaaccatgaagtttttgattccgccgccgctggttcggccgcctcctcctgacctctcctacatcaaccgatcgtaccgatctgtccgtcgacgagaagatcgagatgataatctaaggtgcgttaattcgttcattccttcgtttcaacgagatcgtacttacgtgccaatgcaagctgagatcgatcgatcgatctcagattcagttgccctcctaattaaaattaactagtagtaataactagtggggattttcttcttgctgttcttcagaaacatagtggtgcacctataccattcgaggagtcgcaaatccttgaatattacaagaaatttttggcccagtactctgactacgaggatgaggattcagaggaggattcagatgaggaggattcagaggagggggagaaaggcaagaagaatgtatgttaaaaggggggagatgtgattttatcacaactgtctgtctgagtgacagtttagaagaaatcagacgattggagtttagcgtctcccatttatctatcatttatcagttaatcggcgtatataagatgctatcaaattcatgagtaaatttcagaaaatctcaattattatggtcaaagtttcagaaaaccacgtgaactttgacatatggcacataacctcaggtattatggtcctaacatttcacaaagccacatcactaattgttttgacttgatttactaccttttaagttctacaatcacatcttaaatttatgagcattttattcctaactagaaaggtagcccgcgcacatgcgcgtgcaactaatttaatatgtgtgaaattttattacgaatatctatgtatgtgactttgtattaaaatattactttactatatataaattattatttaacttatttaatgtgctttcaacgtgggttatgattttcttctaattacccttgcagcacataaattctaaactaaaattacttaaaatcgtacagttttcactttatgagataatattatgtcgagacaatagatgtagttcctatgaaaaatttttgggtatttcaactacccatggggatatctttccccaaacatttgctcaaaaagtccaaatttttatcagattctattcgaaattttagatattttcgttctattagtcctgctaaaatatttgaatatttccatttagaatgggttttaaacccaacaattttttaaaacatttacataaattttgaattcttatcatgtccatttttaataaattggagaattccattctaccaagcatctttgaaatgatttgatctctgcaatttgggttataaatatatgtgggttaagcctacaacctgacatggggtaaaatcatctattctaattatctctctggaattgagtaagaatatgaaaatagaggtcatataataaatgcacatttctatattattctacagtaaatattatgaatttacgatgtagcatagcaagttttaccaaaaagaaataaatgaacatggtctttaattccatatggaattaactcactatattggtaatgccacctcagagttgtttcactgctaagatttcttggtgcatttcctcaaaaaaaaaaagatttcttggtgcaatccacatgtttggtactatcagttggatgttcaactgagcatgtttttttacttttaaaatgttgtctataaaaaattaacgctagatggagtacacattatgacataaaaattgttatcatttaaagatttttttctctaatttattagtgacttcatagattatatataattttatctcctaaaaatatcatttattgataaaagcaccaaaatcaaattgtataggcaaattaccccatatacatgttgagagaaattaattaagttgatagaaagttgttatgtgtctaatgggatacaagtaataggtctacaggctttattaaaaattaagatgtgatattttgatttataatgatgaattttcatttttgttttactaagtggatgcctcaagatggatgtgggtccggaatgtaatttttatgttaacatttaaatatactcaatatggatattaaagttgatttcactaagaaaatacaatagttcaaacaaatcataagttgaatatatgatttaaaagattatattattttatttatattgttcccataaatgttagtaagatgagaaagagaagaaaagggatcatgggagagctagctagacctgttatgtggaggtccatttgtggttttttcccatgaagataattttaatttcaattattataagaataaaaataagagaaaaggatgaacgatgcacaccatatagggataaggtgggcgagatgtttttcttaaataaattattgatatatttttttcaaaaaaataaaagattgatataatgactaaaataatgtgttggatgtttaatgtataaggctttaacattgttgggtgggggagagaggaaaggaggtttgtttctttttttaaataaaaatctcataacaacctaaattctatgcccatcgatttaagtcgaaaccaatgattagatgttttattcttaaatttttattatttactctatttacgaagtgttacagagtggtttacaaacatttataaggatggttaatgggttttaacgccacatatgaacgcgaggggagtttgggatgttttacgtaagaaaaagatatatataataacctaaaataatgtaaatcgatgaacgaatgttttatatctttttagattttctctaatttaggtgtcaaatagatgttcggtaatatttatatgatgtttaatagacttattaggatgggctagaggaagaatagatctagtagattgatggattttttaggcatgcatttttctaatttaattattatggaaataaaaaaacgaaaaaaaaatggaaacggagggatcgtacgtacgtacgttgctgatggattgatggaaagt

SEQ ID NO: 20346 - DNA, 5128 bp, Oryza sativa
ttttttaagacatcatgtgatgtttctacatacatcctaaaccgccacgtaacattgtctaatcccactattgattttcacttaaattggtggacctattatttgacattattagattagatctatacatattatcaattttcacttatattactatcggtggacccatagatcattagattatgtaataccttcctcatatataagagaatatataccgctgaagggagaaaaaaaaacatatatacatacagtatgtatgatttggaaaaaaaacaataaagattaagtacagttcggtggaaaaaaaaacatgtccacatacataagataaaaaaaaagataaagccacgtgtaaaaaataaaaaaaataaagccaacggaaaaaaaatcgaaaatagaattttcgaccatatacgataaagtaaaagaacatataccataaaaaatgatgatatttataatataatttatatataaagataaatatattatttcataaatataggaagttaaactagatcgataatataaatatcaaatatcgaaccaatggtctataaacgttcacatttgaaaatatttttaaattatatatccaatttgtgatatttgttgtatacctttaattaaatgaactattgatgtattataaaatttatattattgatatttgtagtatgtcttatttgctagttccaaactactatgctcagtactattattaatgttaaaatattaaaaaatatataacatacgaaataaattgtttttcaaagtaatagcttatttttttaaaaaaaagggttcatttcaattagattgttaatattaattttagaaataaataaataaaattcttagttgagattttaatatggatataacttcatatttaaaattcattgtttttttaaaaagaaaaactaaagagctaatttacaatggcacaatatatttaacacgattagtatattctgtaggataaaagaatgatttaggatattatatttaacacgattttatattctttaggtataagggtttctatgttgcgataaatattcatgatcatatttgtttcagtttgtattcactctatgactatattcgataatatttgattatgtttcgaaatccaaaatagaaataaaaataaatatggtagataccttccatccgttacaaagccgttttcatccctaaccggggctccactgaccataggcctggatggcggttggtaggattgtggtggggtaactgaggcaccaacaagttaagttgcgagggacagaggatggcgacaaggaaggggactgtgcagcaagggaatgatagaagttcaggtaaccattatatatgggtctcatcgtgtgaaggaagatgaatattgggtcatcaggtaggcggccatgggactctcaagtcatggctcgagagtagaagagaatgaggaagggaaaaaggacaaaccgtgtgtgatcacgcgtttcacgcagcggcgcatgaattaaaatcccctggctcatgttgacatagtaactactactaactcaggaccaattttttaattaataataaataatattatttaaattaaattattagtaattagaggataacatttaccaaaataagatggacactaatagaaacagcgtccagatgtggacgctattaccattaacgtacagatgtggacgccaattggatcgacgtccaggttggtgcggtcataacctggcgctaatcatcgcgattagaaaaaagaaaaaagaaaaatcccccaacgctagggcagggtgcctctgccgccgtccaaatcgacgccgggagtctgccgccgccgccggcgtccgcctcaacctctggagtctgttcctccttctaactgagcgtagggactacccacgaggcaaatggcgcggcagcgctaaggcagggggctgccgccgccgccgccgccgtcgtccacctcgatgccgggagtccgccgtcgccgtccaccaccaccggaagaccacgccaccgcctgaatcgacttttgaagttctgagaggtggctgccgtcagccgcttccatccgtagcttgctgtcttccctggaggctgcagctgttgtctgcctcgactcctgccaagtgctgtcatctgttctcatcttggaagcttgcagccaccattgacgtccaagcccagaactcctacagtcaaggtgattcaactaacttattttgttgtagcctatttaataaacattttgggacacaatttatggatggtaattacaggagatggagaatcaagaaccggcttcacaacttctaaaaaaaaaagaaccggcttcaaaaatataacataggttcatcctgataagtctaatgtataatagagatctttataaaatatatgtcaactgcatcagagttgtcattggagttccaacttcggaactggaattacatttattcacacagtagaattgaaatactaatttagcttattgattgttaacattttgtgcagctaaaaaatggctgatagtgatcggttcagtgatttactatggatgcctcatgggcagcacaaagtatctaaaatttcagaaaatgtgagttgtctacttagtttggtttcttgtcgatttgtaaatatattcatctaggttcccatgagtaattgtttttatctttgatgtagcctagtagttcaatgaatatacggcaccatcgcgttggaatcccttaccacccattgtgccgatcggctcaacaaaatattagtttctatcaaattgcaaagatgaggagtatcaaaattgacaaatatttgatatctgctttggtagaacgttggcggcctgagacaaatagctttcatctaccgataggggagatgacaattactttgcaagatatcagttgcctttggggtttgccaatcagtggaaaactaattgtgggccaatctgatggaaattggaggatatgattgagaggtatcttgggattccaccagaagatcaagaaataaagaagaaaaagaggaaaaaggaagatgatacatttgcactgagttactcacgatactccataactctgagcaaattgcgtgatcactttcgtgtcatgcccagtaacccaacacaacgggagatcgattggcatagtcgagcacttgtcttagaaattcttggctccattatttttactgattcatctggagatagtgtgcctgcaatgtacctccaatttatggataatttagcgacccgcactgaatacaattggggaggagctgtacttgctatgttgtacaggcagttgaacaatggtgctgagaaggcaagatcaaaaatttttggccctctagtattgttacaattgtggtcatggtcacggttgccattaggtcgtccaaaaaatataattcaaaagacggatgaagtggaggagcaagaagaagaagaatcagatggctatcctatatttggggccaaatggtgtagttatcatgaattccccaccccacataattgtggtaatgttttacatatcttttgaattatgtctcattgtatattcttataacaaacaacatatatgtcaacatgcttatctttttatactaatattatacaggcactcaatactaccgaaaccaaattgacttgattcgagaaggtactgtacaatggcaaccatatgaaggtctcatagagcagatgcctatccaaattcagaatgaccgtacttggtggtttgctagactacctctcatccatttttgggttgtagagttccattatccagaaagggtaatgagacagtttggaagaaaacaattaattccaccatcgcctccacatggtgaggttgagcttcggaagctacgcaaagtgaagcatgtaggaggaaaagtgtgcgattggaataaattccatgccaaatatgtgcaacaatatgatgggattgaagcaacaatcgttcaagaggattgtcctttcgacgtagctagcttaaaggagtatagatgttggttccaagcaaatggtatgttcactatgttttttgattctcaatgcttgggaggacttgaaaactctatcccataccctcgagataacatggagtggactgggtacatgcctagtggtccacccctagctcgcattgtaagttatagatttcttccaattactctttatattgcagtgacaacctagatctgattttaactcataattgcagggattgcgtgagattaaaaatgcagcatggggaatcaaatgttgtataactaatggatgcaagaagataggtaaatctatattgatcacatgtcaggggaatattagggatcttaacttggaatacaaattgcaaaacatgttatctgaggctggactaccaattaaggttgaagaaattccatctgatgacgatggcactactgcttgcacgccaagtcctccaaatgaaagttccgttgatatatttgatgagtggatgatctcaggaaaatgttttagtagatatattgatctaggtgtggaaactactaatagagttcccacaacacaagatgcaagccaagtgactcaatgtttggaaaatgaagatctggtaaaattctaacacttgtgtgtatgcaaattaactttgtaatgtatttaatatatgatatactattgggtgacatgacaggtggcttcaagagaagcatcagctccattgcatcctggtgaaagaacgtcaagtcattcagaaagttctatccaagtggttgattggactagtactgagaggactcctatgttcaaaaagaacactccaagttaggaagaccatatattctgttggatataattttgtagaacttttggagctatatgttctaaatatatgttaactagaaatcagccactccaagttaggaagaccatatattcctgttgacatatatgttcttttcgaccactgtcttatatgggtgctatactatgtaaaatatggtcatgctgtcagtggttgaatggcgtgttactttactttgtactgacttactatattaatggatttttatgttgccaacttacatcccatttgaatgagcgcatgctatt

SEQ ID NO: 20347 - DNA, 1198 bp, Oryza sativa
  unsure (1)..(1198): unsure at all n locations
nnnnnnnnnnnnnnnnnnnnnnnnnnnnnnnnnnnnnnnnnnnnnnnnnnnnnnnnntgcgtaaaactatatggtgccagagggtccatcaacatgtgttctgctcgacgttgcacctacaaaacaatcaaagagagtcatatatcaagtaaaagttaactaaccattataatgcatataattcccattgtttgctacctaaattgtcactatctcttgtggaacggtgtgcctggtgtccaagtcgtcttccttgcatttcatccatgtacattggtatcctgttatgctgacgacggcctagatttatctgtctaggatcaggaacaattattggaccagtaaatggtggccattcaatttgatttccataaggaagaaattgtatagcccaggtactagcaagtgcttgagaagagtagaatggattgatcaactgattttcattaagatttctatgtttgcaaactgccaagacatgagcacatggaacacctgtcaaatttggcttttgacagtcacaagatggtgtgttgttgggttgcaaaactaccttatacttgaagtccctccatgtgtaaacctcatggtttccttgttgcattgggactaactcattgtcgacctttacctcatatattccaacttcatctccatacgagattacattcatatgtccagccttatttcctcgcttcactaatagcttatcaaccctttgagaccattgcttgccattgttaagtaaattaacagcatttcgccttctctcaacaaaccattctaagcactttgaaaatgtttcctccacaatggctgccaccggtaacctccgagaaaacttaaacacattgttcaatgactcagatccattgcttgtcatgattccccaacgatatcctccatccttgcattgaaataccttctcgagcttttcttgctcatctttatcttcatgcaagtactttccaacatttttaatatatgttattgcctcaggacaaatatttgcaattgatcacattccttcatcaaattttctaggtttctttttcttcactgtccacttaaatgtcttgagcattatttcattgcgacaaaatttccatagattctcagctacatgctgtgagcaannnnnnnnnnnnnnnnnnnnnnnnnnnnnnnnnnnnnnnnnnnnnnnnnnnnnnnnnnnnnn

SEQ ID NO: 20348 - DNA, 749 bp, Oryza sativa
  unsure (1)..(749): unsure at all n locations
nnnnnnnnnnnnnnnnnnnnnnnnnnnnnnnnnnnnnnnnnnnnnnnnnnnnnnnnnntattggagttatgaagaatgaattaaatatagagtcagcagaatagcgctatgatcacattaaatgcacgaattatctcaagaaaacagtagtaactattgcaaatgtaataaaatggctcaagtgaatcccctaaaaaaactctagtgattactcgtaaccattgtccacaaattatctcaagaaaacagtggtaataaattagcaatatctcgtaataaattgtggacaatggttacgagtaataaattagcaatatctcgtccaatatctcgtccaacagaaaacagaagaaaaaaatagtattgttgccatcttacctggcatcacggaaacctgtcaacgcgagatacaaagtacgtggaatgggtgttgcagacagtgtgagaacatcaatagaagccttgtatgatgcaatcttctccttttgttggacaccaaacttctgttgaaacatagagtttgtgaatatatataaaataaaataaaatgcatggctgattttggttgcgagatatttagtcaaaatttatggaacactagagttaagttttcagataaccattcctgacctttagaaaaataacaaaaagtaaacataaaacaatctagtattttttttgtcgaatataatctacaacaaaaaggctttcccttgctatatatatttcttgtagaaaaccttaatatg

SEQ ID NO: 20349 - DNA, 1158 bp, Oryza sativa
tggtatgccacactccgctgcggcagcaatgacatgggtgcatggcctgtggagcagcttcggctttgcacaagagcaatgacatgtgccgtcggctttgagaacacactcctgcttcactctcttgcggtagatacccctgcctgccttatcttgacatagtatctcaaacttgtgctggtgggtaccttgcactagagctcgatgtttcatggcctttttacgcaactcctctagctttttctgcatgaaagttctgaataaaatgctgttgttcggcataaagggaagaactgcttggaaccgatccctaaaatacctgcatgtcccatgtaaaatgaactccacggacaccgcgcatcacctagttgtaaacttctgccaaatttgttgttattattctatatctagcaccacctgtgtcatacgccttggcccatttctcttttggttcatgtagaatccactgagaaaatttccgaatctccactccagttcttctaaccaatgttggactatccgttgggagaggtccaagagcttgaggagggtcagcaacggcggtcgatggagctgctgcacgctgatcactacatttggctgtcaactcatctaatctcttccaaagctcattgaattttttctcctggttttgattgcatagcctcttgaacatgttcatgagctccttgttcttgaattgcttgaagaaattagctcccatatgacgcatgcaccacctactttgtacatcttcccactcaccaggttatcctcattccatactccaaaactgcaactcttctatcgctcgcagaatgcaagcgtgcctgtcatgtatcaggcacacatttggcctcataccaacaacttttgttttaaccaatttcaggaaccagtaccagctgtcggtattcttactctcaacaaaagcaaatgccaagagcaatacctgattgttcccatctacccctattgctgttagtatctagccccgatactttccagtcaagaatgtcccatcaatgcagagaacaggacgacagttcacgagtgccatcttgcatgcatgtagagctaagaacgccctttgcagcacactcttgctaggatgttcaattgacgggaagggtaccgagctcgaattcgccctatagt

SEQ ID NO: 20350 - DNA, 674 bp, Oryza sativa
ctctcaagagaccgcatgcaaaaatagattttcgcatgcaggcatcttaagagcaccgcacgcaaaaataccctcccccctcaggcatttttccctctcaaccacttcaaaaatttctatcttatcctctccaactactcatccttatcctcatttcttctatctctctcatctctcatgggcggcagcggagcggcctcgcactcccccggtggcggccgggagcggtggcgggcggcggaagcgcaacctcgcgtgcaagctgcgaccgggaccggcagcagcgcggcctctcacacgctccctggtggcagcgcccctcgctcgcccggatctagaggcggcgcccctctcctgcccggatccggctgtgggcgccggcggcgacgcagccgggagcggcggtgggctcgggagccggccgcggcggccgatcgcggcggaagtgtggcgacgctgacaacgacgatgacggatgacggcgatgacgatgacggcggatgacgacggcgacgatgacgacaaccacgaggagggcgtcagcttgggttagggtttgaatattatttttttggggttttttttcgtgcgggtgacataagccaccctgattttcgcgtgcgggtgcatcgcccgcacgaaaaaaaatcagatttttgcagacactttggtgc

SEQ ID NO: 20351 - DNA, 977 bp, Oryza sativa
  unsure (1)..(977): unsure at all n locations
nnnnnnnnnnnnnnnnnnnnnnnnnnnnnnnnnnnnnnnnnnnnnnnnnnnnnnnnnnnnnttgtcctgtgccaaagatcaggaagtcttccaggtacaaatcatataacgatctctcttgcattgatgtgcacccagtgcagaaataatactgacaaccaaacttgcaggaaaccatctgatatagatccttctggaaaagactctgacccgactagcagggaaacaaacttaaaaggaatcgagccaactgacgaggatcagccgagtcacagccagccagcaaccgataatgtaggatctggtgatcaacccccgactgagaatgagtcggccgaagctggagccggagttaatcaggagcccccgactaaaaaccagtcggacactaggccaagccaagagattccagaagttggagctcgggcagacagccctcgtagacaagacgccagcaacgacccgatgccagggtctcccattaaggtgcaagagtcgactcgttcccgtccggaaatcatcacaggtaaacaccttgcctgaaatcgtgttgatccaaataactctgatcaattgtctaacctttgtcagtggatacattaggaccaatgattggtgatgaagaagaaattccccgtatacaagcagctgaagactcgcacccttctatcttagtcaagtggtgggacgatgacaggcaacctcaaggaatcataataaacaaacaaaaagaagatgaggaagtatgcttgctgaaaaaggcactcagccaggccactcgcattgtgaatgtaagtccatttacgcatagctttaattgttccccttcatattttgctgaaaacgccggtaaattcttattgcagagaatccatctcaggaatgaggcaaagaccacgacacttgagaaattagttccccatcttggaactcttgaagccaccaaaagccagttacatgaggtcagagagctcgcg

SEQ ID NO: 20352 - DNA, 1389 bp, Oryza sativa
  unsure (1)..(1389): unsure at all n locations
ccatttcatccatttcccctttcacttttccaccactttgaaccatcccccaacctctctctcctcccggttaacggccttgcactcgccgttccgaccatttccctcactccctcgacctactaccaccctcccttgttgcgccgcactcgggaacatactccgccgccggggttgtcgtctcccagccaccggagcaccggcgccattctctacctcctctcggttccctggaaagaggcagagaagtagatgacgggaggaagaagagaaagaaaaataaaaaggagtagagaaggattgagaaaaacaaaaagaaaaaaaatcgaagggtagaaccgtacttacacagttgtttctctctccaatttcttcggatataataaaataatctcgcgggtgtccaacagctaattaccagtttttgtggtgtcctatagcaaatacacgtttttgtggtgtctcacagctaattacacgttttttgagtgtcctgtagcaaattttgccttctgaaaaagggcgggttcatgagatatttgaccatatttattcaatggttgccgtcaattcacatatatgcagtctaaatctatgatcttaagaaaataatattggctttgaattagtctgcgaattagtttcgatatctttagacaaccttgaggacctggaccactttcagaaataaaatgtatgaatggtccaaatatatgttgtagctaaagggcagtggcagccaccagattatgtaatggcatgtttacatgtaacacataaaaatttaagatgttcaatcccatttcagtaattgatgtatgtgcagcacagcagtgtagttaattttagaaaaaaaatactttaccctgaaagccatgaacacatatattacccaagaacatctgctccatgtactacatgatttcttgcagtgtatgaagcgtaatgttctgtttctttcaggtagctttaaatgacagaaacaaaagtaattagtttctcaataatttggtcatcctcaacggatgttgtacagtatagttctttcttcagcgcaccagaatttgttgagtttccaccatcatatgtaacactggccagaaagcttatgcataattctacccaccttgaaacccaaattttcaaggtttgctagacgaaaaacctccattgcttgtcaaaacacatggtaagtaaactattgaagcctcgagatgcctcatgccacggagtaattttttagtttgatcccaaaaaacaactaaatgtattaataaagaggtgaacattttctgttgtgaaactgaatagcagctaaatgtttttggcagcagggcgactnnnnnnnnnnnnnnnnnnnnnnnnnnnnnnnnnnnnnnnnnnnnnnnn

SEQ ID NO: 20353 - DNA, 1162 bp, Oryza sativa
aattatccagaatctacgcaacagcgaaatgtgaagctctctagttaagatatcatttaccacacgatgctaagcagcaaaaaatgactgcacatcatgtcttattaacagaacccactaacccagctcctttcgacttttcgacttattcagcaacacgcgtagcacatcatgatgaagctcaatggagcacaatcaataaggtttcacaaccataattaactcatctgttatgcaaacacacattgcagtaaagatatagcaagcacttcagtgggaaaaaaatttctactcatcatggtttagaaatcagaacagtaaactcattgtcatctaagtcaaaacaaagccagttctaatcaaaatcctatgtaactctttctttaactttacgagagaattatgtcgtgcaaaaatattagtgccgttgatatcctggagcaaattggagcataaagaaactggccttttgtttcagctgatcagctcaaacctgctgatacgcatgtatcttgcaaagcacagctaattaaaatcaaccagcagaatctacgcaacagctaaatgaggaactctctagcttaagataggacttatgagatagccgtaccacaagctgctaagcaggaaaaaattgtttatccatcatgccttatgactgttcagcaacaaaatccccatatagagcttattttgagtttaagactgattcagcaacacccatatagcaatatcaaaaatatcagtacctgtagcaatgatgaaactaaactagaacatcagaaacaaaaatcatatgtatagcaatatcatcacaaaatgcaactccgatgtcaagtgcttctgtcccttcaagcctagctccaagagcatcaacatattatctatcaaaagttcaaaagccaggcaaggcacatattcaatcattttcaaaaagggatagcaagaacaaaaaacaaacttcagtgctgatcgatcatcatcggaaacatatcaggaccacatgacctatttggtgaacaaaaaattgctcaaatccacaagttcaccatttgggtcatgtgcacctgaaccaaaaaaggctacctgtttctaactagagtaacgatgtaagcagctcaatgtaagtaaggaacgcaacgtttatgtactcaattcgcag

SEQ ID NO: 20354 - DNA, 3672 bp, Oryza sativa
  unsure (1)..(3672): unsure at all n locations
nnnnnnnnnnnnnnnnnnnnnnnnnnnnnnnnnnnnnnnnnnnnnnnnctctctcaaaccgcgctttagtaaccctgtattgctctggtagttcaagttgcacaacatggctaggtagagttagaacccttctggtgtctatccattctctgtattgacatctccttggtggttcctaggaggaaataatagatgtgaagcgagcaaagttagtaaatgttgtgagaaaataaggattcatgtaatcaaaatattcttaccatgaaatcgtcgtcaagaatatttggacaaataaagaaccttcgacccaatgttctaagctttatggaacgaagaacctgacaacgatcaccacacctgcatcttggacaggcttcccatggagagagtgccgtagttagcacccgccagtcgcactgttgttcacgacattgtcgttcgtaagccgcttttctatgtaagtattgctcagtactttcgatgcgaaataccagcgaccttcttgtaaacaagtggttaggtcgagaacaggattttctgtatcgacccactcgatgtatgcgcaagccgtagtgcgggtctgccgagtagagtagtgttacgaagaataaaacgattgcccatatggaatgaataagcatatgcagatagtaaaatacctcacggtcatagttaggacacctaaaaaagctccttcctcgaatatcaggattcatcaaagccattagttggcatcgatcaccacataggcagagaggacgctggcaccaaggtggtagtaggtatacacaaggatcgctacgccagttcggatcctcaacgcccaggcgtctagccattgacgaaagccggtaggatttgtaatgaagcaagtggggaagagagtactgaatgtgactgattctgaaagattgtgaggcctcgctcgttaaggcgacttatataggcaccaaaaattgagtgatatccctgacatgtgaacgtggcggggcatggtgggtatgcctgattggcgccgaaagttacatgcctgattggcgccgaaagttacattggtcgtatgcggcaaatggcgggcaaatactcgtatcacacgcgaataaaggaggctgcatctgtgcggcaaaaagtagtcatgcatgcgccgaaaggtatcgtgcatgcgccgaaaggtatcgtgcacatataacaacaacgtattcattacacaagcatacagtactagcatgtgaagcaaataaacaaagagaagtctgctctactggccctgccccgcgccgcgaccacgcttggtcctccaggcctgtgctcgcacatagttctgggagtaggtgaaacgatccggtggcacagcacgggtagcacgtgtgtctggcggcggagtggcctgcgcctagtcctgcgtctgcaccggcggtgcgcctcccagctatgtgaatcgacagatgttgcaaattattgtggacaggtagattttaatgcaacaaatcaaagcgtagtgaaagatcttaccggtgaacagcagctggacggtcatcggaaacggtactggaaagagctgacggaagccaaactgccacatcacacggaaaggggcgtgaggctcaacgcagatgtcgaagaccatcggaaccgtagtcatccagtacgcctggtcccttgtgcagagtgtggacagacccaacggcgcacgagcctgggtagccgcggcactgtagggctcccacacgacgttagtcggcagaaggcggtcgaactccataacaaactcaggatacgaccgcctaacctggacgtgagcccatcagcgctgcaatacgagacgatcgatgtgatgtacaatgaacttagcaatgaacttaacaataagagaagatcgatgcaacgtacctgacgacggcaccacagagtacccatcgtagggtagtcgacctccggtcgctccacgtacagtgactccccgtatgcgtgttggtccacctcagggcagccgatcgcaatcctctcagctacccagatagaaagaaagagagggcacccaccaaaggtcgcgctgggatccgtcttcgtgcaagcctcacaaaggccacggtacagagccgccaacaacgcggaaccccagctccactgaggcacctcgcctaccgcggtgtcggcgatgctcctggcgtagtgcacgagtcccttgtcgaccgcgtgcccgtgaccgccacagaacatcacccagccaaaaagctagagcaagcacgcctccaaacagcggctgtaggagtactcgtcggcctccgcctatagctgctcgacctgcaagcgttcgataaaatgttaggcaccttaccttacgactaaatatgtagtacgcttgtcatttcggtacaaaaacactcacggtgaactgaagcagccacctcctcgtaggtccggtgttgcggtggtgtgccaacggctggagcgggagatgtggtgcgcgctgtactggtgcgaaacgtgccgtcagatcgtccttccagtccacacacgtggtcactggcccaatagcgtctcccgcgagcggtagcctcaacaagtacgatacgtcctgtagggtaggggctacctcaccgcatggcaagtgaaaagtgtgcgcctctggcctccatcggtcgaccaaagctgctaggagggaccggtccacattccagcgtctggccgggtctgcgtcgccggcggcagcctccaccagccgacacatcggtaggaggccggcctcacgcaatctgcaataacaaattaatatgtcattataaaaattattacagcgcaactaatttatagtaatacactgttcgtacctctcgacaaaggagtcgtgaactgtatgtagctcaccgcacgtccgtgcccggaacgtcccaagctgagccccctgcaccatagtaaggtgagaccggtgtcggtgatctatcgccgggtccaacaactcaggtgtatcctgacgtgccatctctgaaaaatatagtgtttcatgttagaacaattcaaaaattagtaatgtagaacaaaagataacttgtaaaattatgaaaaagtaataaaatcataagaattattatgtacaacaagagtacagactatttaaatatagcaaacgttactaagggtacataacgatgacgtgcaatttaacatatatgtagagttcgataatataacataacaaaacataacattacatgccgaagtccgacattacatcagcatacctaaagacacgggtgcctaagtctgacgttacataacgagacctaaagacatgacatgccgaagtctgacattacacgacgaaacataaacacatcgataagttcgaaacaaattacaagcaaaaccacatgccaacatagaacagaagaactacaccacatagctagacgtggcacgacgacgcctaggacgtggtcgagtggaggtagtgccttcacccgtagggcgagctccatctgctgctgatcctgatagtcctgcctcctccgcacttggtttctccttgtctttaggacaatgcttgtaggtgtgcccacgttcatcgcatttgctgcaacgcttcaccctgccagcctccgactcatccatatcgttgcggatgcgatgagtcttcctccttccagccttgcctcaaagcttcgattgggg

SEQ ID NO: 20355 - DNA, 1831 bp, Oryza sativa
cacacatttggcctcataccaacaacttttgttttaaccaatttcaggaaccagtaccagctgtcggtattcttactctcaacaaaagcaaatgccaagagcaatacctgattgttcccatctacccctattgctgttagtatctagccccgatactttccagtcaagaatgtcccatcaatgcagagaacaggacgacagttcacgagtgccatcttgcatgcatgtagagctaagaacgccctttgcagcacactcttgctaggatgttcaattgaggggaatttcttcactgtgtaagagctcccagggtttctttcttcgataacaccaagcaggcgtggcaaattgtcatacgaggcttcgtaagttgcaaatctcatctctattattttctgtttggccctatacgccttggcatagctaatagtatacttgtatgtctcttcgatttgttggattattgaccttggttcatatgtgagattatcgatgacatgcgcatacatctcagatgcaacaaatgcacatgtaatgttcctgtggtatttttaaacaccaggtagaaaacatgtatgcttggtaacgactgacactgtccaataatctttccattttcccttataagcgtgcactctccagggacaaccatcttttttcttagcacaccgaacttcatattgcgaccggttgaacttggcaacccaaaactctctatgaagtgacactgcaaaatgttttacccccctcttcatatcttctgctctagtataaatcgctcccttgaataacctcattttctttgtactcccatctcacactatccttttcagagacgaccagactagaaaaatcctccctagcccattctgctggattaatatccgtctcatcatctgacgaatcacctttctctacacgctcgttgtcagaatcctccctctccatttcatccacaatggcaccgacagtctccccctcgtcggccactccacctagttgaatgcccactggagctactacgcccccgtcctctcgtgcgttgacctcttccacagaagtctcatttacttcagcacttggtccctcgccatcatccatgttcatctgcacacctggatccttcgggtgaacaaacggaaccatagctagaggctacccgcgttgcaatgcattttccacataccatctccacactcgagagttttgaactggcattagttcccaataaaaaccctcagttgcccgacttactataacattgattgttatgtcacttgtctgtggatcaactctcaagcccctcattaaccatccttttatagaaggtacactcctctcagccagtttatcaattcccctttttgatacaataaattctaatagatctaccccagttggcccgtaacggacgttttctgggccatggtaaacttgaaatatttgtttgttcgacatatctgtcaatgaaataactagatcatattactctttcatgcaataaacatctacaacgtaatatcttcttgtgtatgccaatgcaacggtaaagtattgattccaaactagcagatctacgtagttaccgatatctacaatacgcacttctagattagtacaactaaaaccctaaaaatataatgcatttattcaaacaaagtttttaaaaaatacacagtatttaactcaataaacacatataggatctatgaatattacctgtaatcggcgtctaaatccggcagggcttcgccccttcttctcttctcctcccctttcttcttttttttttactggatttgtggggggtggaatgagggctgggggctgg

SEQ ID NO: 20356 - DNA, 2980 bp, Oryza sativa
  unsure (1)..(2980): unsure at all n locations
catgcattgcgcctaggacgaggttggtggtgctagcatcggtgctggacctaagctcaatatatgcagggatgccacagtgaggccggcggcactggtaccgatgtcggacttctcgctcttgatcggagtcgtaaagtaaaactacctcttcatcaaggttatagaaaacttcgtcatctagttctaccattttgaaaataaattctctttccttacgggcatttcgagtcacttgttgactcacgattgtgcttgttaaaagtttcaaaatgccatcttttttgaaagagtattataaaagggtctaacttccaaactctgttttttttttctttcattctcctttagttattttctctatctataagtggaatagaataacccggttgaagtgtaatgatcatatattttgtaatgcattgtatgtcattgattctttcccaataaatgaaaactttttctgtaaatactgcgtatttgattccattatcatatgataatactatatttgtatttatttaatttgtattatacctttatatcttataaatatatagaatagaggaatcccaatttgtcaagtctcatgatcatatcaaaatctatttaaactcggctcaatttgaaaacagattgagccgagtttaattgcaattaattagaagaaaaaacaagaattactgtattttcgtaactaaatttttgatctttctatttctcttttcccccgcgttcttttttattttgaccttttttctatctaattttatctacttagtctagctatctagtttatctaccggctcgaactccaatttgatcgctttccatacttcacaagctgcggctagttcaggactccatttgcaagctgatcggataatttcattaccttcacgagcaagatcgcgccctttgttacgagcttgtacacaggcttctaaagccacccgattagctgctgcacgaggtgcataaccccaaggatgtcctaaagttcctccaccaaattgcaatacagaataaagattttggtcagagctggcatatgctaaacatgaacaccccttgaagccaccggtataacacctggcatggatacccagtcagtgaaaaagatattgcgaacacgatctttttcaataaaatcatcgcgcaataaatcaacaaaacctaaagtcattccgcgttccccttctaacttacctattactgtaccagtgtggatatgatctcccccaaacacccgcaatgctttagctaatacacggaaatgcataccatgatttttctatctatcaatagctggatgcactgcttggtgaatgtgaagaagtaggccgttgttgcagcaataatgagccaaactagtatttgcggtaaatcccctggttaagtagtcatgcattacaataggaacccctaatttccctgcaaatacaactcttttaatcatttcttcgcatgcacctgcagtcgctttcaagtaatgccccttaatttcaccagttctagcctgtgatttataaatagcttcggcacaaaagacaaaacagtccctccaacgcataaatggttgtgagtttacgttttcatcatctttggtaaaatcaagtccaccgcgtagacactcataacatgctctaccataactttttgcagataatcgcaattttagtttaatagtacatctgtaacatcctcaaattttaaactaaaatttgactacatcatgctggcttttgacttgagttaatcttgatttagcaattcaaaatcttcattaaaaatcccccttttattcttaattttggttcaagaattactcctagaatccttctaatttatttcacttctaaaaccctagaataattatcctacctaaatcttagtgtttctagcaaaattctttcaaaatttgaaatttagaaaatttccctatttacccttctattagtgaaactatgccctagtataaacttagcnnnnnnnnnnnnnnnnnnnnnnnnnnnnnnnnnnnnnnntggaccataaggaataattactcctttcaatttggagatatttaaccatttgccatatttagatgtgacaattaactttttgccattggacccacatgtcatagacacatgtggatccacatgtcattgagataggggtggcaaatagttatttgctaaatctaaaagtggcaaatagttaaaagcccctctaatttgtcctctccagggattatatcagatcatgagagcctcttaacgtctgtttttttccctcaaacacacagtaaagttaagcttcatttcgttaagaaaataagagaaagtaaagaggaaaggtcaaactcaaagaaacctctaaaaaaacaaccataacacttctacaaacacgccagaccagtagaactagaccactatgatcagcacattaccaactagattaagcatctagggcgagcgactgaagaaagagctcatgcagtacatcatgtacagaagctccagcccaataccataagctacactcataagagctcctccactgcaatgataacacaatcacacccatcaacaatttcttaaaaggtaaggcacacacataagaaaaagcatgaactagaacatgaaattaccttccagactaagggaggaagagaaaaccaacctaggatacaatgttaatgtggcacctctgcatttcttgatgtgtcccagtcctagtcctgtatgtctatcagttctctttctcattgcaagttaatccaatttttaggtatcacaaaaaataagcttggaaggtgcacactagctattaagccaacatatatatgcacaaaatttccatctcttccttccctcaagtaagctgatttcttttttttttctgaaatcctaagcaagcatctcctttcttcttccttataaagagtgagcactgaattaatttggttgcatctattaggtcaagcagtaga

SEQ ID NO: 20357 - DNA, 700 bp, Oryza sativa
ccctcctctcacatgttctgcctacctccacaatgtgtgtgttgccccactaataccctactacccctctacagtcgcccactactggagaaagggagcgagaaggaggtagaaagggattatgacaatggcggctgacatggacctggagtcctgcctttatggccgatgcatgtgttgtcctgccacttccttgctgcctttcctcaacctcgcgccgctttgctttcgccgggatagggatagagagagggccagagggggtagggaagaaaggggtgagagaggatgacgtgtgacctggtcatatttttgttaagagtaaaatgcattggtgatacacggacttatcaagtggatgcaatttagtaaatgaacttataaaatacttattttcgtacatgtacttgtccggtgcgtgtgaaccaaaatgacactacatggctaatcttgatgatttaggtgttgattaggatgctacgtaaacatatacatgaaaaggttgctacttagatatacattggttcaataaaaataaagaatgagacgtagtgatggtaaaaaaaaaaacccagcaatgatacaagggttagaaatatatgaaattcatcattttaatgatgaaggataaattagtgacccaatttataatagatatagcatgttttaagcatactcactacggataagcatgtcacct

SEQ ID NO: 20358 - DNA, 864 bp, Oryza sativa
  unsure (1)..(864): unsure at all n locations
nnnnnnnnnnnnnnnnnnnnnnnnnnnnnnnnnnnnnnnnnnnnnnnnnnnnnnnnatatagcacctcctctaatttcacaaagtttcatatcaaaactcaccggcggtgggccctagatccaattgtcattgcataacaaaatatagcaataggccctctctagctcacacttactccattagtctcaacattgacaggctgtggactgggacccacctgccggcattctcatctctctcacacacacacaccaaattctaatcaaaataaaagcaaaggggatcatgatagtgtcacggctttgaccggctactgccattagataagccctaatcaaagtggattagtgcttaattagagtgtgtgattagcgcgccggatttggatctgaatcggagccgggagctaggatcagtgagctggaagtataatgcccccaatttctcaatctttttttaacctcggagaacgtgctctcctctttcttttaattttctttttctcttttcaattcaatcttgccttttaattttgaccccggtcaaactgctcccatctcgacatctctcatggaaacaaacgcacgcgtcacatgccacacatgcgtttcagtgtacagtaactgaccgaaataattactgacttaacaacaactgtcaaaagttactactaattaccttagctaacaaagatacttagcactaatcaggaacaagatgacgtaatgcgtagaggcatattcgaatctttcactgttttgatccgcttggaacaccggttaattacggcataacgcgtaatatacgccatagtgatttggacttttttttttctacgtactttttcttttttttttggccta

SEQ ID NO: 20359 - DNA, 820 bp, Oryza sativa
  unsure (1)..(820): unsure at all n locations
nnnnnnnnnnnnnnnnnnnnnnnnnnnnnnnnnnnnnnnnnnnnnnnnnnnnnnnnnnnnnaaatgagacattatgagtatgtcagctcctaagaacataattttgacacttctgttgacctaattagttggtagagatacataatcctgctatgccacttcaacttacatttaatctttttacatatcatgaaagaacatatagccaaaacaaggaacagcatgaacccagaaagttgcttcgctggattatgggctaaaatgaacaactaagagagttgctgcttgttgccttcacaatttggtatctgactgaatccaacgatcagcttgtccctttcataccacttgccccagaatggctattttactagcatgcagttcaacaagcaccccatatgcataaagtaacctgaggtgagggactgattaatgcatttagcgagaaagctcggcgctaattagccaactaacactatgttattgtagtgcacctacaatttcatactgatcatgatcaaccttgtaacagaaggaagcagagtgctactatctttagagcaccttgatgcaatgcgtgcagatccatcagcagcaaaacttgggaacctattagtcctcttgtattccggctattttacctgcggacttgtaagggagatggttaaaagcacccattcaatatggccaagacaatagtataacatatatatatgcatgtctaaaatattctcggcagtttttatgtggttctatgtattcataaaatgattggatagaaatacttaggtaggcatttcttgactgcactccaaagaaa

SEQ ID NO: 20360 - DNA, 741 bp, Oryza sativa
tcaatttcggtgcgttaattatgtggatttaatttcccactctaggtgctctgttcagaatatgtctggcagctcaaggtacaagctgatattgtgtatttgcagcaagagctgactcttgcactaaagctgactccatagacgccgtcgccgctgccgagccgaagacgtcgccgccgtagacgcagccgccgcagcccgtgccatcgccgtagacgttgtcgtcgccgcggccgccgtagacgacgtcgccgtcgtcgctggtagggttaggtctaaatcgaactagaaaggggataaaatgtgtgctgctcctgctgacccgactccagtggcggacgcaggattaaaataaagatgggacgaagatgctcgtctcaataagaacaactaaacataaaaaataccatatttatgttgtaatcatatgaacatatagtataattaataaattaaggcaaacaaaaaaaatgatattaaaataaagtaataatttttgcgccatacataattcattatacataaaaagatatatattaaaatcgtagacgggtgacaaagtcagtgacatataatggattctctaaaaagatactagtaaacatattaatttgcaaatatgagtcaatgtttgatagatatcttttaaaaaataaatatatgagaagatatcgcattaccaaaataagatgattattattttgtgtagaagggagagagagaaacattagacacctaact

SEQ ID NO: 20361 - DNA, 3086 bp, Oryza sativa
ccccctcctcctctccctccccctcctcctcatcgcccgcgccgcctccctcgtcgccgcctccttcccgccctccgacctccagtcccacgcgctccacgtcgccgcggccctcctcctcgccgcggcagtcgcctcgctgctcgccgcgatctcccccccgaaccgcgggctcctcgccgagaccgcgctcgcctgcgccggcgccgtgggtggcctctgggtggggcagagcggcctcgtcctctacgtcgacgcctgcgtccccgccgggtgccaccgcctcatggacgccgccgtggccacgcccgccacgcggtgcgacgtcgaggaggccaggctccgcgccgtggcgctcatggacctcgcgctgtccgtgcactgcgtggtcgtcgcgccggtggccgtgggagtgcacctcggggtggcttggtggtgcggggtgaacggcggcgccggggcggggatggggacagggaggaggcataatggcgtcggtgggtcgtacgatgcaatgcccacggtggcgtctgccgaggcggagatggaacatttgccgatgaagggcgtcgtcggcaagagcattgcgcaggaataagattgtgttgcttcaattgtgcttgattaagtaggtacattttgatcattctcaagtaatgtgatatgttcacatgctgatcccctgaaatatttagccgtatggcctatgggggttttgggatgaacactgtggtaacctttatcttattgaatcagtcaatggatccaaatgtaggataggccacttgttgtaactcattcaatgatctcatagttttgtagtttgttcacattatgctattgtggtagctttatatactctatcatggtgaatttactgctatgcagtatttcttttctattggcccccttggctgcaagcatgcaaaacccaaagaactattccggattgggatcacctgcagtttcgaattgtcctcacatttcgtttaaaatctgtgctttgcttcgaaccttccgacattcatcccatttccttaataaaacttcatacacatgcgcattcagctgttgcatgcaggcacaactctttatcattaagacagtagtctttgttacagatgtaaaacttcatcatgattgcatgctgttagttgtgctaaaccaaatatgagctgcgttatcgctctcctacttccatactgcttgatattcatttcatggaatcttcttgaggttctgatatatatatattttgtgtatacgtgttgtaatttgcaaaaaattgcataccagttctcgatctctggtgaatatggggcctccatttaattcctttagacattttttaaacctatatttgcatctgtttttgggtgattcggacttaccaaagattcatcatttgggatttgaaagattcttaatccaatgtgtacgatgcgccaatgatgtctcactgtcatgtgggtctatggtccaatacacacaatgtgtcacatcgtggatatggatgaaactcagttgcatggatttacccttggatggaatattttctacaaaagtgagaaataactttgccggtggccccatgatgatactaggtgtttgtacatattacatttcataactcaagtgctacaaaatataggctattgtactgactggaagaagagaaacttaaaatggttttgaacaagaggattattcattatccaggcaatttgcctaatgcctaattcctaacttgacagcaatacctttatgatactcatatagaattgaaaagagaagaaaatggtgatccaactaagtggaattaattcattagagcattgacaagaaccatattcagtttgattctctgcaaaccttacaccttaactaatgcaagcgaatgtttcttctagactagacttgtctacatgcatctttggtgcctttttatttgactctcttctttaaaccttcatactggctgcagatgataatattctttctcctagaatttatctgggtgacttttgcctaaagaaattattccttctttttggaatagagttccatttgtttgtagagttgactctttcttttctgcagtatttctatgacataactggatcatatactctctctgtttagaattgtaaaatccattcatgcattctttttcattctaactttttagttatgtgcaatcacttttacctggtggagaaatgaagtaaaacctgttagtggtggggccttttctaattctttcctaggttatagagctggaatttttccttttcttagctgcagttgatctgctataaacttttcagagatacggtgggcagcaaaagaaacccctggaacatactgatcgactgtctgacactgacgagtaaccacttatggtaccaattatcttccaaatctaacactttagggacctattacttagtgctactttgtattggtggacaagcctttggcttctctagtgtccaaagggtcacttgtacctgtaatgtgatgatcgattgatctcccagattccgttgtcaatgttatatgagaatatccagttcttctgcagctgaatgcggcttggtgagtgtttgtggtattgtggttagacttttgctgacaatatgatcaaaacttgttggtttagaacagtgtcacctgtgtatgatctgtacacaagtctcttagaattttctgtatggtgactggtgagaactatatacatatagctacttgtactgaacatttcagtctgaccattaacaagcttcttttatggcttttctaaattttggaggacatctatcctaagcaatttgatactccctccgtttcaggcagtggcggagctggacagaaaatcaaaggggggccagccggcttttgacagttcaaaaaattagcaatttctcttttttttcatgcattggcaatacataaaagcgaatagtttgcaaaagtcgacgacaaagatcagctacagatgtcagattttgaaatttaggattggtgggtacatcaagttcatagtgacgtaattgacatctcaaattggctctcttgttctaaaa

SEQ ID NO: 20362 - DNA, 7537 bp, Oryza sativa
atatttgttaattggcactgctgttatgtgttaagggtgggaatcaattgtaaccatgagttggaccaattgttcggcatagtcagataccattgtccaaaagatcatgaaggaaaggtgccattgtactaaatgtaagttttctagaactaatggaggcaaagctctcctatcctcatggccttgtatctctttctgctttctaggcagttgagtcgattcttcattaattacattatcactccacaatacaattatctcccctttatttagtgcaggattctgttgtcccttttagtttggtctcatttgttttatgtatgtatagtagctttgtggacactatatatactgccacaaacttatattccagtcattccactccatgtgctttgcagatacaaattcatgtgtctgcaaaagcattggttagtacttctacttactacattcaaagtgatgttaaacggcacggttttcttggatctctctctcccttgaaggctatctcatggaggtttgatgtacaccattgttgcctaagaaactgagaaagccttcgggggaggagagaagccaagcaagccacagtgtctaaatttacagcttgcatagttgcattagctcaagtaacaagaaatgctgcatggctactggagttaagcaacatactttgttcattgggtgttgggatttatttttcaaaaatatagattacctgattgttttctcgtaatatggtaagtttaatcttcatagacagatggattaatttctttggagtgcagtcaagaaatgcctacctaagtatttctatccaatcattttatgaatacatagaaccacataaaaactgccgagaatattttagacatgcatatatatatgttatactattgtcttggccatattgaatgggtgcttttaaccatctcccttacaagtccgcaggtaaaatagccggaatacaagaggactaataggttcccaagttttgctgctgatggatctgcacgcattgcatcaaggtgctctaaagatagtagcactctgcttccttctgttacaaggttgatcatgatcagtatgaaattgtaggtgcactacaataacatagtgttagttggctaattagcgccgagctttctcgctaaatgcattaatcagtccctcacctcaggttactttatgcatatggggtgcttgttgaactgcatgctagtaaaatagccattctggggcaagtggtatgaaagggacaagctgatcgttggattcagtcagataccaaattgtgaaggcaacaagcagcaactctcttagttgttcattttagcccataatccagcgaagcaactttctgggttcatgctgttccttgttttggctatatgttctttcatgatatgtaaaaagattaaatgtaagttgaagtggcatagcaggattatgtatctctaccaactaattaggtcaacagaagtgtcaaaattatgttcttaggagctgacatactcataatgtctcatttctctctcccactgaaacagttgaataattttttttgtcaggcaacaccttctttgttctcattttcttccatccatccacaacgcctcattacacataattttttatgtattttgtaggattttttttataggaatcagatgtagaaaggccaaattcttgtattctaaagaaacattacttcctccatttcagattataagtcgttttgacttttgtcaaagtcaaactacttcaaattcgatcaaatttatagaaaaagtaacattttcaatctaagataaatatattataaaaatatattcaactattgatttatttcaatttaacggaactaattaagtgttgtaaatatttctatatttatctacaaacttaagttaaatttaaaataatttgaatttgacaaaagtcaaaacgacttataatatgaaacatagtacatgccaaaagataatgtttggataactcatgaacaccgtttatatatatgcacagtcctaattacacaaaattaaacccatgtgtgtgtgcatttgtgtgtgtatacatcaccttcactaaatcaagttaagcaagtagtactagaatgctatggaaaccactactccattagcaagcatgaggaagctgatcaaccaaagctactacacaacacacgagcagcggaagcacaagatcaccaaaaaaaaacagagaaaaattcgctacattaattgatcgattaattagctgcgttgcatcgtcgagctcccaagaaaatggcgccaacgcacttggagacgacggcggcggcgacgtcacacgggctcgaactccctcccgcgaggccggccgccgccgccgccggcggcggcggcagcggcggcgccgtagtgcccgaactccgtcgggacgtcgtcggccttcctgacgctcgtcctccctcctccgccgtcgccgccgaagatggagtgccgcggcggctgctgctcgccgccgtagatgtcgccgaagtcggaggagttggagcagacgtcgacgctggtgcgcttggcggagtatcctccgacgccgccgccgacgccgacgccgccgaggtcgaagctcgccgtggccatgtcgaagctgaggctcccccgcgtgttgaagctggccgccttggactccgacgagagcggcccgatcgagtaggagtagaagtactgccccgacgccgccccggcgccggcggcgtagtagtgctcgacggcgacccttgaccggaagtcgttccggctcggcgggatcggcgagaggaagatctcggcgacgttcttggcgacgccgcggttgtgcgggttcgccttccgctcgtacctgtcaaggtttaaaatctctcgctaaactgctgcttatctcccgctataactgtttgagaaggattcgagctatttgctctcgtgtactccctccatattttaatatatgacgccgttgattttttaaccaacgtttagccactcaacttattcaaaaattttatgcaaataaaaaatacttatgttatgcttaaagaatatttgatgataaattaagtcacaataaaataaattataattacataattttttttaataaaacgaaagattaagcgtttatcaaaaagtcaatggcatcatacattaaaatacggagagagtacaaattagccgctatagctcaatttagcctgctatagctgtttaagaagtaaccgctaaatgttttagcccgctatttaaaacattggtacctgtagcggaagttctcgtacgtggtctggttggtgcagacgaggtaggagtggaacgcggtgaggccgccgacgaaccacgccgtcacgaacgtgtacacgatgaggatccccgacaccggcgactccaccaccgcgcgccccatgctgcagccgaactgcctcgcggtcatcgccaggttcacccagcagaagacgaacacgtacaggcacaggaacgtcgtcgacgagatgaacatgaagaagaacctgtagttcctctgcgaggcaatggatcgaacagttggtcagcacgtcggagatggtcgccgccggagacggagaagacggcctaccttgccgatgcactggccgacccaggggcagtggtggtcgaagcgatcgacgcagttgttgcaaacggagcagtgggagcagcgaggggggcggtagagaaggcaggtgtggcagtatttcaccttcaccaccacgccgttcacgtacacgtcgcgcgtcggcgggagcgacccgccgccgccgaacgccggcgacgacacgccgatgtcctcgggctccggcggccgcacgttccgcgggatgatccccgggtcccgccccgacgtcatcaccagcacgatcacgtccttcacgcacgcatgcacgcaaagtgatcggtcaattgcttcattttgctcgagcgacgcagaaatggtggtggccgggcttacgaatacgccgacggcgatggcgacggccgggacggcctggccgagcggcttcccgatgagggcggcgaggtggaaggagacgaaggcgacaaagagcgcgagcggcgtcatgatgagcgacacggtgagcacgatggagctggcgtccgggccgaagatgagccgcccgccgcacaggaatctctacacacaacaacaacaacaaaatatatgggctccttttaatgtggaaacgcacgaattttgtccgaattcgtttttgaaaacgtacgttcctgcccctccagacttggtagaggcggtgggtggggacggcggtggcggtggcggcggcggcggaggtgggggaggacgcgtcggaggcgttgctgcgggcgagatgggtcttcttgaacggcaaccacctcaccttcaacatcccggtcggtgcgccggtgatccccgtggccgcgtccttgtcacctcacccgcatgcatgcatgggcccctcctccgtacgcgcgggacggggccagggttggggttggggttggggtgaggtggaaggaaggaggaagagaaaggggcggcaatgggggagctcgtgagagacattgcgctatccataggaggcgccatagcgcgttgtggttgttgttggggtgtgtgcaaacaaaggaggcggcaatgagaacatctaaaaatagatcaggagaatcccaacaaaataagggtgaaagtaatgatgatagttcaattctaagtgtggaagaaccataagctcctaacttctcttgcttgcttcttagattgcgaatgcttacccgcatgatcaccaccatcctgagttccgaattttttatttataataaacaattacccttaaattaaataattagtaaatcgttggggggatttacaggagtaggatggacgctaatacagaaagcatccagaattggacgccgttgtaaacaacgtccatacttggacgctgttggaaccaacgtccacctccctggtgcagccaagccacgaatagagtgagaacaatcaaaagaaaaccttgacaatcaaaagaaaaccctaactctagcgatgagcgctcgatcgcgcatgccggcagccggccacacatcgtcgtaactcatatacgagttcaccctctctacgactttgatccatccgctttgtcgtccaagccactctcgtcgtcgacgccggggccttcgatttgtccgtgttttacggcgccaccaatcctgcaatccagccacggcgccgtgtgcattggcagctctctcgtcgtgagcaacaggtttgccctgcaatttatatcacgcatgcatgtcttttcacttatagcatgtctttgctcaccctcatctaattagcattaattgatatgtactacattgttcatatctatacttgatatatgacatgagtgttttattgaatatatgtatagattattatccaactagtagacatataccatgcctttgttaattgttgagttcgtttggaagacacagccaggaaataaaatgactattgttcattgacatttttaatatgcaaaacaacattttttaaaacttgaaaggatatatcagcagattattatctaacttaaagttaattatataacttgttttgctaacttgtttagtttgttttgcagatttgactgagaaaaaatgattattgttctagtgtatgttgatgggagaatacaatatggagctaagggtgcagaatataatattcctccaaaaataacttttccggcagtggaggctacaacctttgaggaagtcaaaaaagaaatttttcaggcccttggatacactgaggatcattgtgcaatgaatatccaagctcggtttgatatccgaaatcctggaccacaatattttcaattgattcctatttatgaagacaggggatggaggatgatatttgagaagacatgtgggtaggttgttgagctttatgttgaatgcgcctatacggaagcaagattaagtcaggttaatagtacaaccttggttgcatcaactaggcattcggaaagggatggctcaggtgttttgttggagccaggtacagttcattcacaagcaaaggttgtacccactttagtagatggtctgcattcaacaacagttcagttgtcttcacctatcaaccaggataacctatcaaccaggataatgtggtttccaaaacacaaccaactatagatgatgacaatactgcagaagacacatatgttggtgaggatagatttggactggacgatgacaacgagcaggattgtgatggtgcccttgataatagtttagatgatgagccaccagaaccacgagttgttcattctgtcaatgcatttccttttatgcgtgcatctggacaaaatcctataaaagcatttagtgatatatctatattgagggagacaacagcagacgagagtttctttggacgtaagaatcaattttctaacccactagcagaaggaaagtcttttgattcaaaaaagcacctacaaattgctataggtgagtttcatatatgtaaaaattcagaaatcaagtacaacacaagtagtcaatctaaacttgtagctgaatgcacggataatagctgcatgtggaggctctatgcaactcccacaaagataggttcaggttggatgataaggaaatgtccatatgctcacacctgttgagcaccggctgatagatttgatcatgctcagttatcatcttctatgattgctaatgtgatacgtgatgcattaagggatgatctggaattgagtataaaaaatgtgaggtcactagtccaacagagatatagaaatgtgaagccatcttatagtaaattatggcgaggcagagagaaggcaatagcacaactttttggtagttgggaaggttcatatggcctcctcatccctttcttacaggctataaaagctaaaaacctaggtacaaagtatgtccttttgtcaaagccaatgactcaggaaggacggcgagcatttaaaagtgttgcttgggcatttggaccttgtatcgatgtcattccctacctacggccagttataagtgttgatgcatgctttttgtcagggaggtacaaggatagattgttgattgcttgtggatatgatgctaacaatcaactactatctcttgcatttgctattgtggagaaggaagatagtgcaaactaggggtggtttatgagatggctacgaagtgaggtaataggctatggaaagtttatgtgtgttatatctgatcgacataaagccatgaaatggttgtttaagcagccccacattggatggaatgagagcgccggtgaatgtgtgcaccgcctttgctcacagcatgtagctgagaatctatggaaattttgtcgcaatgaaataatgctcaagacatttaagtggacagtgaagaaaaagaaacctagaaaatttgatgaaggaatgtgatcaattgcaaatatttgtcctgaggcgataacatatattaaaaatgttggaaag

SEQ ID NO: 20363 - DNA, 688 bp, Oryza sativa
cccttaactgatgactaactaagcaagatgattaaacaacgtgtacgtggtgacttcgttaatatcaagatatgtcggtctaatcttctggagatgtttataggggtaggatttacgtgtttgtgttcacaaggacgatgagtgtgaccgtgttattagcgtctacatttacactgtgtttttttttttaaaaaagtcaatgtgtctgttgctcacgccattgcaccgttttgggctgctccatggcctcggttggattctacattgaaggaggaggaggaggccttcaagtgttgagcccaaaggcagcaagggccagaaattttgggcctatattgggcctaatttaccagataaggtcgtcactcccttagttgataaagtccgcttgagatacctcgctgtgggtcaactttcattagcatcaatcgtaaaatatggtacaaagccacccactactctcaaaaccagtgttaatcatgtccctcgataatttggacagtgattttgttctttatcctacgtgacatactccatccgtctttaaaatatttgacgccgttaacttttttaaacatgttataccattcgtaatattcaaaaacttttgtgaaatatgtaaaactgtctgtacagaaaaaagtcaacgagtcttaactaggggtgtgtttggttcacggtcatgtat

SEQ ID NO: 20364 - DNA, 1116 bp, Oryza sativa
agttgtggaactaattcggatgttttgttgtatctatcatgagtaaattggttcccggtctggaataaatactagtctcttattgtatctatcataaatttcttactatacttgtcattcccggcccggattgaatctgggcgtaaccgaacaaagccgaaatatgtacccctaaactcatacaaactgtgtacttaaggtcctaaggcagtatatatgggtggtttcgctcacgtggcatcctagtcagaaaaaaaaaagtacgtgggggcccacatgtcagctgcacatcttttttcttcttctccttcttttctctcttctctcttctcttttctctcttctctcttctcttcttcagtgagggaggccagcggccgacgggcggagcagtgatgggcggccggcgggagagcgcggcggcgggcctgcgaggaagcggaacggcggcgggcaagcgcggtgggggagtggggagagacaaagcgagaccggaggagggagagagagagagaggaggccgactggcaccggcgttatcgcccggttgcgcgacgacgatcctggccaggtcgaggtgcgggtagcggtggagcacggcgcactgtgcacctcatgtcctccctgtcacgctcgtacgcatctcgcgccttctccgccagcgcgcccgccgccaccgccttcgtctcggcgagctcgagcttggccttcacgttccacagctcctctagcaacgcgtccgcctctgcgccggcgtcgcgctcccacgctctcatgtagtaggttgaggcgatgacgtcgcctgttttggcaatgacgagctcgctctcctgcgatggtgtcacgatgccctgcacagctgcgtcaccaccttccactcgccttccgccgtggcggcactatctggcagcaaaccaccagttcgccgcctgcggccgtgctcgccttttgccagccgccccgctatcgcgctcgcccgtcgctgctctgccgctgtcgcctacctgcttcgccttccgctcgcttccgacgaagggaagaagcacgacaaggacgggggttgctctgaccgccgcctcgtagtggtagacagtgtgggtggcggagacgcaggag

SEQ ID NO: 20365 - DNA, 855 bp, Oryza sativa
gatggctttttacttaattgatgttttttttcagtctatcagctcaagtttcaatatttgctctttatttttcttcattatgagaaaaatattgtactaaatagtccacatttaatgcgaggattaatggaaaaaaacgtatcatttcccctatccttaataaaccgatctcttcattcacgttgaagtgaaagcgaagaacttcattcacgccctggattccggaattgtagaacttcacaacaggatcattccgttcctgttaactaaaatacaaacacaagtccatcagctacttcaaaaatggtataaataagaaacacattgaattagaataggaaaaataaccttccagattgtcaaattaaggaagaggaaaccacattagactacaatattaatatttgcacctcggcatttctcgatgcgtcccaatcctaataccatctccatcggttctctttggcattgcaaaataaaccatttttttgagcgatcacaaaatgaacttggaggttaacttgtgcacactagatattaagattacacatgttcatatatgccattctgtcccatctctaccttccctcatgtaagctctggaatccatagcaagcacctcgtctcccttataagccatacctttacatgtgaactttgcaatgtgacagtgtctaacttaccactttgggtaattgatgaatagaacagtcgtgattcctggcacatatatgttggtttattttgcagtacaaatatagtagagataaatatggagaagtaggagtgggagtgggacacatcaagaaataggtgcaagcattgtgatagcctgaacaccacatctgtaacgcc

SEQ ID NO: 20366 - DNA, 894 bp, Oryza sativa
agaaataaacagccttggtcttttggctgaaccaatgccatctcttgatggcatagtagcagggcagagtattcaccttgatggcttgccacttactccctcaaaaagatggctttatgctggcacaggtgctttctcaatcattcttaaatttaatgtttttgtaatcaactactctcatttccaaaactactgttcttattgggaaggtacttggtatggatagatttgatcaccttctggtaagctggttgaacgttgctttgaacattatattatcaaatatcaactgattgcacatcttgtcttaggctaggtagcagatgttttatcagtttggttgcacagtgcattgctattacattttctcttatcaatcggattgcaaaatattttctgttacttaccttaacattggttaggtgtagacttttagtcctacttgtatattggtaatcataattgtcatcaccaccatttttgtcaccacaaggtttcatgagttcatagtaactattagtatcatgtccattagttttaggttagtgtaatagtatgtgcaattctgcattgtagcctatatataggtggcagaaaggactgtgatgaaaaggtattgccactaaaaattttaaaagtccctataatgtaacaaaaagtgccatttaccaaggaaacctctggctcctctagacttatgagctgaactgtacagtctagcttagtatggactttggtccttgaacatagtcatgcatctattactcttgaactggggataccacgagctcagttttgcagcagcatgtatccctattttgtttcatatcaactgttgtcggtttgcattgaaagtagaattgacgccttattgtcatgcacaaggaatgcttg

SEQ ID NO: 20367 - DNA, 767 bp, Oryza sativa
  unsure (1)..(767): unsure at all n locations
agtagcggcagcctgggggatctgttgctcttctcggatctcttacctaatcttggccctcatcgactcgagcttttcgtcgaattcagatgtcagctcagctcgtatcgactcccggatcttggcttcaaggcgtgcatctttcttcgccttgttggaagtccgcttcttgtactgccacgcgtagtctggaaatccatacttccagggaacagaagacccaacgccccgtgtccgtccacggtgttccttgttgcccaacgctttcgtgaggaggtcgtcctcgcgtctttgagagcaggcctcttgcgaggcttgttgctcggcaaccaactccttctgcattacaatttagtggggtcaaataaactgcacgatgggaaacaatgcgaacatctagtttgattagacacttactatagcttcgtatactcgttgatcttctacatttggcatgaagattgtgccatcatcatgtttctggtacctagccctggcccagttcctagcccgagggtgtgggatatcgccaaacacgagcggtgtaccacgattccttcgcttcttcatcctcacgctgccattcctcttccttaccggcatatccggcggtaccaagccggtgcggatgctggttcctagtctggagcaagcgatatgcctcgcttctagctctggactcgggggtcgacttcttcgcatggaattnnnnnnnnnnnnnnnnnnnnnnnnnnnnnnnnnnnnnnnnnnnnnnnnnnnnnnnnnnn

SEQ ID NO: 20368 - DNA, 917 bp, Oryza sativa
cagatgcaagccggtaagcaacatatgtgccttgtacctgattgcagttttataacagaaccgttcttttgcatggggatttgaagctcacgagtttattagaattttgccacaaattacaactgatacataggttcatattgttgagatttgtttgtttgctttatatggtagtgcaaaatttacccacaatttcacaatatcctaggttctattgcaaagcatttaatgagctattcttgagcccaagtactgatcaggagcctggatcaactacaaatattcctgattatatccgttttgggtggctgctcttcttaattcttcgctcaaaatcacccgaactgtttaaggacctggtatcctgcatccatggactagttgccatattggtgagtttgcttttctctttattccgtttcattatttttatcctttagctatgcaatcttgtacttgtggttaactggctacttcaaccaccactagcccttgtgctttctggagctaacttgtcaaaaaaatgattcattacaggccatacttttaattcacgtacctgctaaatttaggagcttcacaattgaaggttcttctcacttaagtaatatttctcaactttattccaaattatttctttaactgtcttactttatttggcatctgcacagattataattacagtccttttgtttaatttcagtcaaacaaactgagaaaggcgtggatcttctttcatcgttatgtcacaactatcatacctctgaagaccgcttgaaagaaatgatgggaaaatcttacaaagtgatagaggtcttttttagcaggaaagcaataaatgcttcagagttcaaaacagtgaatttggataaaatagatacaggcatgacctccaacaccccgtgttctctctcatg

SEQ ID NO: 20369 - DNA, 3433 bp, Oryza sativa
gcctcaattgtgcaaacgcattggatattccatgggcagaaccaagaaaaatggaggcttccaagttgtattatagggtgctggaggcaatctgcagagcagagtcacagaacaataatgtaaataatttaaccccattgttgtcaaatgaacgttttcatcgatgcttgattgcatgttcagctgagctagtattggcaacacataagacagtcatcatgatgtttcctgctgtcctggagagtactggtttaactgcatttgatttgagcaaaataattgagaactttgtgagacatgaagaaacccttccaagagaattgaaaaggcatttaaattcattagaagaacagctattggaaagcatgtcatgggagaaaggttcatcgttatataattcactggttgttgccaggccatcactttctacagaaataaacagccttggtcttttggctgaaccaatgccatctcttgatggcatagtagcacggcagagtattcaccctgatggcttgccacctactccctcaaaaagatggccttctgctggcccaggtgctttctcaatcattcttaaatttaatgtttttgtaatcaactactctcatttccaaaactactgttcttattgggaaggtacttggtatggatagatttgatcaccttctggtaagctggttgaacgttgctttgaacattatattatcaaatatcaactgattgcacatcttgtcttaggctaggtagcagatgttttatcagtttggttgcacagtgcattgctattacattttctcttatcaatcggattgcaaaatattttctgttacttaccttaacattggttaggtgtagacttttagtcctacttgtatattggtaatcataattgtcatcaccaccatttttgtcaccacaaggtttcatgagttcatagtaactattagtatcatgtccattagttttaggttagtgtaatagtatgtgcaattctgcattgtagcctatatataggtggcagaaaggactgtgatgaaaaggtattgccactaaaaattttaaaagtccctataatgtaacaaaaagtgccatttaccaaggaaacctctggctcctctagacttatgagctgaactgtacagtctagcttagtatggactttggtccttgaacatagtcatgcatctattactcttgaactggggataccacgagctcagttttgcagcagcatgtatcctattttgtttcatatcaactgttgtcggtttgcattgaaagtagaattgacgccttattgtcatgcacaaggaatgcttgaggcagtatggagcatttaagtgtttatttatggactaacaaatttgataaccatatgaaatatgatcacacattatttaaacaggaagttcataaattaaaacttctttaattgcttgttgcattgttcggttattcatttctcaaatggttttttgtagatggcaactgttatcctcaatcaccaaagagattatgcaccgaatctaggaactcattggtagagcgcaattcgcagacaccacccccaaagcaaagccaaacagggttaagtattttgaaagcaaaataccatcctctccaggcaacattcgcaaggtgtgatcacctacttcagtttgtgaagagtttgagcatatactatttttttgctaaccagagattgatgatttctgaagaaattgttttactatctcatatcttttgcagccccactgtcagtaatcctgttagtgggaatgaaaaatgtgctgtagtaggggtccagatcttcttttccaaagtatggtccatcttgtaattaaatttatggtttttcattgtttctatgtttatcgaatatttagttctggcctaaaactttgcagatcttgaagttggctgctattagaataagaaacctatgtgaaaggctacgacatgaagagctgactgtgagcgtctataatatctttaagcagattcttgaccaacagacagctttatttttcaacagacacgttgaccaaatcattctttgctgcctctatggtgttgccaaggtactacatcacatctccttgagttttgattggaactgaacttctgtgttgattgagggatatgcctactttttctggccctaggtcctgtagtttctcataattacgaaatggtatgaaatataaaataagagccagactttatttcaggcattttaatcattgttgtctcaagataaatatatttgtttatctcaataatatttttactgttcactaataaatcaattaattaaactcatgtttctataattaacctgccctctgaaacaatctgaggacacctactaaaaggttatttagttttgtgaaaagtctgttcgaatttatggaagtttgtttgtattacatatattgagcctcttatttttttttcttcctttttatttgtgttgaccatgctttttctgccaggtttctcaattatcattgacgttcaaggagatcgtcaacaattataagagggagccacaatgtaaaccagaagttttcagaagtatctttgttgggagtacaaatcgcaatggtgtatgtatcttttaattccagtatctgccatttttctttcttctgatagttcttcccctagcttcttatttttactttgtttttcttttcttttgaaaattctttgatattaacagggatttggatcacgtcatgttgatatcattgttttttataatcaagtatttgttcccacggtcaaacctttgctggtggctctaatgccttctagtactcgtcctgaagacaagaggaacactaatagtatatcctccattctgttttctcagtttaaacctgctaattctccacttaattcctcttataattgacttatgtctattacctgctttcttaggccaaattcctggatcacccaagtcatctcctttctcaaatttaccagatatgtccccgaagaaagtctcatcttctcataatgtgtatgtctctcctctacgacaaactaaggtgtgcacttctcttctcatttctatactttgatcgttttagtttgtcaattttctctttactcagttatagttaaattcttgagcggactatatttcatgccgatgtgtcttttttggttgggcctgtgcatgatctttttaacgcatgattctctgtatcaattacagatggatgcattgctttcaccaagttcacggagtttctacgcgtgcatcggtgaaagcactcaagcttttcagagcccatccaaggatctggctgctataaatagccgcctaaattagtatgtcaacttcctctgaaatacatagtctctctctctctctcacacacacacacacacacaagaagtgaagctcacaacactc

SEQ ID NO: 20370 - DNA, 8976 bp, Oryza sativa
tgggcctgtgcatgatctttttaacgcatgattctctgtatcaattacagatggatgcattgctttcaccaagttcacggagtttctacgcgtgcatcggtgaaagcactcaagcttttcagagcccatccaaggatctggctgctataaatagccgcctaaattagtatgtcaacttcctctgaaatacatagtctctctctctctctcacacacacacacacacacaagaagtgaagctcacaacactcagaattcactctgtttcttgccaaatatgcagccctaccaggagaatcaacacacgaataaacttcgacatggtgagtgactcggtggtggctggtagtctgggccaacccaatggtggttctgcctcttcggatcctgctgctgcatttagccccctctcaaagaagagcaaaacggactcttgatccaaataaatgggtccatccatctgtatagagctcataatcccacagattgtttctttggttcttctgaataagtgggtgaagcaaagtgcttctcgactgtaaatgttgtgctagtgttgtaataggctgtagcagtgtaaaaggcggctgattgtctagaattaactaatggggtgtatcatttcattccccagccgattcattaggagcgaaggctatgtaaaatgctacttctttttcagtgtgtaaataaattctgctaatatcccttcattcagctttggcaattaggcaagtgtttgcacagtgttgttctcagatggatggtaagcaacaaaagaagcccttaaggtcacttatacatgtaacgtgatgattgatatcaacctcattgtcaattgttgtacaagtaatgagaaatagtgccacctgcgtatgaccatgcattgtctgtatgaggactggtgagaatgttctgcgcactgaacattattaattttcggtctaaccactaaaaagcatcttctattgccacataaattttggaagggcatccatcgtaatcattctgcaagtatagaactatgtaatagcaattgaggtttcagttctgggagatctcctataacagctatggtttgatccttagaaatcagcaggaaatgtacatcgtctttctcacttcttgtgtggcctatacggaacgactcagtccaagtcttgtagaatgtatcagagaggtgagacgagcattattagcccgtgtcactccatgtcttgtagaatctgactcagtccatgtcttgtagaatgtatcagagatgtgagacgaacattattagcccgtgtcactccatgtctagtagaatctggtctccgatgactccagcggatgatagacgatcattagcccatgggagccactgctcctcaacatgctgcttcaaagcagccaggtcagctcggagattgatgagttcaccatgaattctctccctcccagcaatggcagggacaagaagaggtgattcaaagtccttgggaagctccataccttcaggaagcttcaataccctggccaaagctgctttgaagtccccagataacaacggtacatcatcagtgaccgctcctcccaataaaagatcatctccaatatctgatgcaagtgtagtgagcttatcgcgagctcctaccaactcgtccctagcttcagccagctctgcaagccccgcaagctgtgtgtcatcaactatccagccctcttgattcacgtactcctccaggtactgataaagttcccgcgcatcattcagtggttcacaccctgacactgtgacaacaacaggaggcggtaaaggcaagctgcctggtggcatcagaagttcagcatgaatacgacctgcacctggaccatctggggccactgtcgttgagttgagatcaaaaggcagcaccccatcctggggaagatgaaacgcactagccactgccgatactacccgtgagtcgatgggtggccgcacccaatcatccacttcgacgagaacagttgaacccgcaggtagatctgggactcgttgagcaatgacaaacaaaactggggagcatcagcacttgtaaggtttccctgggcgatagctcgaagtcggggaatgtcctctgccttaatcaagtcgtgagcaccgtgatccagacgatcctcaacaaattccagtagcctgtgaatattggctgactgctcacaaggtactctaataatcatggtaggaagtgtaggtgacatttccgcaactgcacgaacgtcagcaaggccattaatgtggtgaggcgccattggcgcacacaatctgcagatcaaattaaattcagttagctctcataatctaggagaattaaacacactgttactacagaatggcattgtatgcaatcaatgaacatgtaatgcatgtaaactgagcagagtgccacagagttatgccagggctacaatgtcacaatgataaatgattcgttcaaggcactatctaagtagttaaaggcagcaaatcaatagtactcttcaagtaggaatccaaggatggtgagaagtatcaagtacctagcaggccactttctgggaggatcaagtgatagatttcagcacattattcagaggatttggagaaaaatataaaccaaggagccaggaatcctaattcaagagctatcttgaatgtccatcaagcaccaaatgttggggctagtaagcaatgggaaaaaaacaaatagatatggaccagcaactagttactacataactaattagacacaatacaatacatcagagctagctcaacacattttattaacttgcttggtgcacggaaaaacagggatgacgtatatattcatggtgtgcagcctatgaacccattgcagttagtaaattgtgcaatcttgacactaatttctttccaataaaacaaagtggacctagagatatcatgcaggcatactctggtggatccttctagaacatgttccctggtgtgtttaacattattgttgatagtacaaactgtagtaacatcgaccaagagtacataagagttgtattatgcagtcagttcggcaattggctgccaactaaatgggaggaactatgaacaactaataaacatctgaaaatgtttgtacgagatgtgaaggatcaaagcaccaatgtcatcagggttggcaaaaaaaaaatccagaggggagggtcctcgcgcagttcatgaatctcatggccgtgcttgcgccaccatcccctgatcccctggcccctggccggtggcgtccccaccgacgcggcgtcgccagctagccatgacggatgagccatccacaaatctgaagctatctatcctcaccgcgtgctgcccgcccacccgccaatccgaacccaaacataatgggggaaaattcgaaccaaaccctactcacataccggagaaaaaaaagcctcgatcgagcccgcgcacccaccaaattgaaccgaaacagggtggaatctgacctcagggacgccccggagagggctccggcggcggcggcggcggtccggaggcggagggagcaccgatcgccctcgaatggcaagggcaaggagcagacgagagggggtgggcaactctggcgagcgatgaatggaggcgcgccgtctcccgcccctatttcgtttggatgtggatgcggtggagttttttttttttttaaagctttttgacatctgtttcggcgggcttcgccaaattgatgatgggcgtcttcgtgtgctttctcaaaataaccctcgcgtctctcctttagatatgcattcaaattagaatttggttgaggagttgatggattttgggttctttttgaaactttatgacatcctatttttaaatgccactagagagaatttgtcttgctcttgtgccctttttcagccttgcgcgtgccacatcactgttacaacgtggaatcagtggggagaagataagatttcccctagcccaagaacaagaggaagaagctcccccgatgtacttgttgtcagggttatggataccacatacctaatagtagttgactaaatctcggcaggacctaccacataccatgttctatacggaaacaacctacggatataggaagagttccggataaggaaagacaaccagagttctacatggaaacgacaaggactactcggattgtatccatattgttttcctagttctacttagacaaggggacacctataggtataaatacaaggcccccctaggaggagaggggatacggacaatcaacaccaaccataatctacggaacaacagaagccacaacatacaagccaacatacgccaatacaagacgccggatattgacttcagggataggcacggctagtcccctacggtgtctccggatactgttaggagagacgaaagcgctatctctgatcttgccgggcacggattcgaggaggaaaactaccctgttgtcgactacgagtcagaccttcagaccgccatgtcgacaatagttagataggctaccccaaatattgtattggtgtgattatggtgaataagagcaacaatggcttcagccaacaggatgtagggttattacctgacaattcaggggcccgaacctgtataaaaatcctcgtctctgtctcttttacctcagtctcgcgtatatcctagtaccaacgatccctatacgatgcaaataccagaatcgcgacatcaaacgtcgacactcgtgttgtgcaccgccacctccctagcgccgggcatcagatggtgaggccgggaaagcaactgcagtgacatcaaggggcatgacgttgccgtcaatgttgagggagcgtggagaagagcctaggggaggaggacatcaccgctaactagtcgatggcaagaggttggtgatgtccaactcgcctagagttgaagctacccacttagtgctcggagaacaacaacaggagccatgtagcgaggcgccaacgacgagctccgtccctaaatttggagttccctgttgtggtgctcgaaggattgcgctagccatggagcgaggcacccatgtccctagatcgagagctcctctctaggtgctcgaaggatggcggcaacggccaatgaccgaggcaccagcgacaggctctgtccttggaactgagtctccctgttgcggtgcttggaggacgaggatgatggccatggagcgaggcaccaacgacgggctccatccctggatttggagctcctcgttgtggtgcttgaaggactacagctgtgaccgtggagcgaggcatcgtcgatgggccctatctctagatctgaagctcctcgctaggtgcttgaaggatggcggcaacgactaaggaccgaggcaccagcgacgtgtgtgctccatcgatggaactagacctccccattgcggtacttgaaggaggacgacgatggccatggtgcgaggcaccaacaacgaactccatcctatggcatctaccctccatcttaggaccactcctagaatgagaaattcgaataggaaaagaaaaggttggggactgcattaacttgggatatgttcagttaatcaccatttttgtggtgtgaaattatttccccttaatctccttcaaaccgaacaaggcttatggggtaatcatatattttcttcctatatactccctccattccaaattgatctacatatttcaaaggtacatcaagacccagaaaagctaataactctctcatgctatatttactctagcaacaaactcaatacatgcaccatccccactatttcctagccaatagcaaatcaagatattgcatgtgggttataaatgcttgtgtgcatggatgcatgcatcaatgtccatttactccaatacacaaataacaaatagacctaatgaatgaacacaaatatgtaagatcatttagaaataacctcaaaaaaactatatgtagatcaatttggaatggagggagtaattggtacccactacctatcattattgctataaagcagctacaggaataagccacgtcatcgagggaatgcagccgttagatatcatccaagagataattccagccgtgtaatatggttccatcggccgtcaatcccaggcgtgcgctcacttattgcgtggttgggccaagccatggcccatttcttttctcccgttggcccatcattaggcacaaagatgcaaggcgaccactacattgatttctttgttttttcgcaagcggaggaggcgccgtgacaaatgtttcagattctgaaacggaggaaggcacatgaagagatgagaagtattgagaactggtatgccttttattcccccacacaccacgatgctttcttccagtaatggcaaccggaccaccgatccgagtccctggtcatcgactctacgtatgtgggcacatggagaaattcatgtatattattttgctctaatcaggttttggttctggtctgagttatgcagattcgaattggactgcccgccgatgggtgagataactctaaaatcgtacgcacataatatgcttgatagaatgcataactcataattggacgtacggaataagttggacaaaaacatcttcactttttataatagtagagatatatattcgaagttcataaaaacataaaccaattaagtacttgttgacgaaaaaatcgaacacaccggcctgggagatctgcttaactcctgtgcaggtccaaagattggttggatgcgggtatgccagtcagtttgatcctgcaactgacaagatatgcaaataatagacaaaacagccgatggagtagttccagccgatagctgatgccgataccagccgataatgatagggttttgagcaatcggctatacgtccaatgtagattctaacactttagtaaataatgatatataggcaatcgactactgataataaaatataacaataatatagtccagtataaaccaatcggctaacattgatatgatagaataagcactgatctggaggttaaagcatacatcggctaaaggtccgctgccatgaaatccacaagattagattaaacagtaaaacctttgttgtcatcggctaaatccaacttatatgtatatgcaattcttatgagccgatgcaacgtctagataactcaccggctgaaaccccgatgaaacccttattggcaatcaagaagcagactagagattatggttctaagcacgacttagtagatcaaacttaactgatgcagcactaagtatgaaaagaagcataatatctagacaatcaagccgttgattgagttttcagggtggtagatgtctaagctaatctaatctagcaacgcgatttagccgataccggcagaaaccctaaaacaagaagcagccgatagagctaaattgatatgctaagactagattaacatagacatatgataaataggtaggcaaatatatcatctaaaccagagcaatccaagaggtcgaatgtactgatgcagccttgaacgacgccgacataaacgatacaattgcctgggctgacagaacattggacttaccccttagccggagatcgaacaccgatgcagccccacgtcaggtgccaagtcctgccggacgataaaataaagtagaaaaggtaaaaggtggcgatgcgccgaattgtattgatcgtgaagatagtttacaatgatcccgggtgtacatatttatacccatggtagatactagtccttgtaggataagaaagaaactttcctaaagataaaaggaaaacataaagtctttataggacactgaacacacttttctaaaaataaaaaggaaactaacaaactattcataattaatagatacaactgccttcttcggacttgatccgtacatggcaatcatcatgaagcacgtcaactcaatcagacaatgattccaatatcaccttgccggaatcggctacatcggcttaccttgttcgattcggtaactgccgatgcacactatagccgatgcggttctgaagccgattcatactctgtttctgttatcgatttcctcccaaatccgcttcagctttaactccaaatccaatgcaaatttaccaaatttggtcgttaacagtactgtgatgtgaaaaaatattaaagatcgtagaaaaattaatccctccgagttaataatacttgtcgttttggacaagggcacggtcttcaaaatgtaactttgacaactattttttattacaaaatatatataaatttcaacaaatatatgattttattgaagtactttttaagactaatctacacatgtggttttcatatttttaagataaatattttagaaattatttgtagtcaaagattttaaagtttgactttatccttatccaaaacgactaatattatcagcccggggggactaatacactttatagttatattttctatgaagataatatgttttcttacacacagggttattttcctattgataaaaattgaatagccagctctttatatttaaaaacatagcattttattctttcttttatattattttaaaatttgtatttattattgaatatatagtcatatccccgtatgcatgcatgtttctgaaaatacaacgtatcgtgtatccgtgtaaaatatcagctgcgacatttcgaatatttaatcgcatatatagacgttgaatgcaacatggcatatacagcaaatttctcattgataggaatttgtcgaatacatcattagatataaagcaggggggaaaaataacaaaagcaattgcgatgcaaacacgaggcaggagacccaacctcgcctgggctggtcctatataaccttccttgttgggcccggcccatcgaatagtagcagacaggcgggcctttcttcagctcacgcagcattcgatcgatccgttttctgccactttcccttgctcccatggccgctg

SEQ ID NO: 20371 - DNA, 3847 bp, Oryza sativa
  unsure (1)..(3847): unsure at all n locations
nnnnnnnnnnnnnnnnnnnnnnnnnnnnnnnnnnnnnnnnnnnnnnnnatacagctgtcgttgcaattttaatttctactgtagcagtcctagcactgcaactcgcaccacgtgcaacttgtttgtgctacattaggaatatgataatctaacacggcgaggaatcgcattgctaacatatttggagatagtgtgttcatatcctttcgagcatttcgcatccaagtcaccaccaaaagtgattcggcaaacagatctgtcaagccgatgatcaagaatcaggagttctagtgctggtgagttctccacgaaatacagagcaagctcaaggcttgaacggcctgctgaaaatccagtcattttgaccaacttgaggtttttatgtggacaatgtttctccagacttctcaactctgcttccttttccatgtaacaaaatggctcctctatatcttccagctacataaagtttcaacaaagatgaattgcttaggaaaattatgagtctcaaaccagacaccaaagtttaaaagtatgtgctcataaaccaagttggacttgaaatttgaacattagcacattcagaatacacaaatggcctaaaaaagctacagcagtccacaatttcatactgctatgaactgaaaagttgtgtagcacggctgtggttttggtatcacattgcaacaattgtacattgttcgaattcttaatttcttactccttcccatttcaaaatgtaagaatttccaggattcagattatgtaccacaatataccacccattccaaaatacaagagtttccaggattcaaattctgtaccacaatataagcattgctgtgctgattcccatggttccaatgattccaaagtcaattggatgcttagaaagggaatctaagcaatttaaaattcaaaaattgaccactgaggtgactaaaaggaatcttttgacttaaccttactatttgctaataaacaacctaagaaatgcttatattttggaacggaaggagtattactcaattaatcagacatgacctatccactgtttcagcttctactataagtattacatgaagatcacacagggctcgaaataatgacaccacaaacgtttctgtacacacaaccacaagggttaaggagaataaatcccactattcccccaaacgattgttggtccacttattcccttaaacatttgggaaggaaaagatgttggagaggaagccatatgattcatgccccatattcgtgtccaatttcttgtgactctttcatagttaacacgaagggataaaaggccttgcaagctactgagcgtctcaggctctgagcctcaggctcccatggttcacttccaatttggttcttgcttcctgaagcagctctggaatcttttcttgttcctggaaaccatgctgccggtcgatcactcttgactagttctgtaacaaccggcggtgattatagggttggaggcagccagattcgttatacaacacatcacagcaggtctggggtttagggtttagcaatgggtgaaggagcatggtgataacggtgagaggctgtggccatggcagctaaggtggagagaatatgatgtgttaggatctgtcatctgggggcaaatttatgtcgatttcaactgaaggggttggcagaggtgacaagaaaggaaacatgataaaaaattttatggcagaaggacaaaggtgaacataagattttttttttttttttggggggggggggggttggggggcataagtggatcaacataccaacatcatatagcttaacattagatattatctagacaaatgtaagttatagagtgatgttctaaaaaatgcctataatatggcatatacaacgaagagtgtcaacactggaatttacacttaatgtgcattccactgatggcatcatttacttttcaaaaattttgtttaaaactgcaatataacagaacagttcaacagttatcaagttaagggcctcgaggctgcttatcccatttcttggagaaccagttatttaattttagtactgtctaaagttcatgctgctaaatgtgctagagagaagtaacttacatgaaaaacgagagcttctaggactggagcagcatcaacaaacttagcaagaaatagaagatcatatttcgtcgatatatcctgcaattttaactccaattgcttcaggcaatggaatctattgcttggaggtctcctggatataatcatctgcataggaaatgtagtcaagataaagaacgtaaagtatctcaaataagtgatattgttttcactaacctcagtacagccactcaggaacaatgactcgaggtctggcatgagtggtgcaagatcagtaaaagcatactcaataacatctgatgacagaactaactcaatgtgtgcccccttcaacactaatgcttcactcagtactatttttaggtgacagatattgtaagtattaatcgcaacaagattttgagcatggatctccaaaatcttcagccacaagcagggaacgatatcaatgtagacaagcttagctagtacatcagtgatcttcaagtattccagcattggacattgccttagcttcaactgttgtagagcaggggtataactcaacaagctctctaaatcttctgtggttatacatacaagggccaaatcaagagtcttcaagcttcttaggccactaaaagttggtaaaggcctcaaattcataaagcaaagcttaagatgctctatagaggttggttctggagcagcaacattagaggatggaaagctgtatttgacatcacgaggatgagcataccatcgtggacttaggtcaatagtcagttcatttgcaccagatcggactgcaaagtaaatccaacggtcaatatagtgtgcgtacttgtgattgttgaggttgcgcttcaaggtgaatgagttaatccctgttccagcgtggtgccttatgatggtgttaacacacctgacaaatttagccctcctcccttgtttgtgcacccgtttattcaaacccaacgccttcgaggtgaactctaaattaggatagagcctccaagattgtagccacttttgcgacaccatgctgacacgcgcagcattagtcagcgaaagcaaccggattatcaagaacaccacatcctatacatcaagaagaagtcagttgaatatatatatatatatatatatatacagaactccatactcacattcataaaaagaaaaacagcacagtcagtataagtggacctatataacgtacatagaatggaaattgacactagattctactagtatttacctcaggaatgtcatcaaactgtaatatggctcttttgttcttggggaccagtttcccatgacatggattcattcgcttagccattagaccaaaaaaacactgatctgcagtcaactggaagttaataaactgtaaattgtaataggccattattagcgttggatgggtgctactgatgtcagaacagaaagaaaacaagagagagaaaagatgggagctttaaacatctactcaccacagtattgcagcagcagcacgcaatgctgacgaaatttgtggatttgagtctcccaagtattcgatcgatcccctctagatacaaacagaagcagcgcaagcagtggcgaagccaggataaaaattcacctatggcgaacttactacggactaagtactagtctagtactctagtttgtataagaaaacatacatatataatnnnnnnnnnnnnnnnnnnnnnnnnnnnnnnnnnnnnnnnnnnnnnnnnnnnnnnnnn

SEQ ID NO: 20372 - DNA, 2772 bp, Oryza sativa
  unsure (1)..(2772): unsure at all n locations
ggcgaattcgagctcggtacccagtgtgcgtacttgtgattgttgaggttgcgcttcaaggtgaatgagttaatccctgttccatcgtggtgccttatgatggtgttaacacacctgacaaatttagccctcctcccttgtttgtgcacccgtttattcaaacccaacgccttcgaggtgaactctaaattaggatagagcctccaagattgtagccacttttgcgacaccatgctgacacgcgcagcattagtcagcgaaagcaaccggattatcaagaacaccacatcctatacatcaagaagaagtcagttgaatatatatatatatatatatatatacagaactccatactcacattcataaaaagaaaaacagcacagtcagtataagtggacctatataacgtacatagaatggaaattgacactagattctactagtatttacctcaggaatgtcatcaaactgtaatatggctcttttgttcttggggacccagtttccccatggaacatggggaattttcccccaaattttttttattcattcgcttagccattagaccaaaaaaacactgatctgcagtcaactggaagttaataaactgtaaattgtaataggccattattagcgttggatgggtgctactgatgtcagaacagaaagaaaacaagagagagaaaagatgggagctttaaacatctactcaccacagtattgcagcagcagcacgcaatgctgacgaaatttgtggatttgagtctcccaagtattcgatcgatcccctctagatacaaacagaagcagcgcaagcagtggcgaagccaggataaaaattcacctatggcgaacttactacggactaagtactagtctagtactctagtttgtataagaaaacatacatatataataaaataatggactgaatttcattatcatctcttgcttctatattttcatttccatctcctcctgatatattagcagtgctactgctaaaaaatctctttatactgacaactaacaaacataaaaatttaaaataagagatacgttaaagtgaataaataacagtaccaacaagggtagattaaattctcaccttttatttttttcccaatctgggtagcttctgaaattgggcgcagtcggcgtcggcgattattagatggttcttcctcttccatggcgcaatctgggtaactacagatattacgagctagtttaacattactactcgtaacaactgattgtctgattcaacaggatatagttgctaatgtgcgagagatggaaccaactggtgtctcggagtgattactgtggcggcgtccagcgtggcaacggcgtccggcggtgtcctggacctggagtcggagatcgggcggcacgcggcaggagacgagtcaactgtcgacgagaggaggcgaacagccgatgcgatgaggcgatcagccggtgggcaggtatggcggccgccatacctcgccatactggtggcttcgctactgagcgcaagatccccaaacaaccgggccgatcgatgccaaagctaggagtggccttggttttttttcccttcttgtataaataagcaatccaaatcaataccgaatcggaaccagagaggacggaggggtgaaaaaaaggcgataactttgagacggactcttaccacgaaactgatttcaccgcatgggcatgacgagaaggagttggcgccagatgttctacgtggggggtggagcggagtgatgatacagagggaggcgaaatgatatgcgacgccggccgcggccggaaggcgagtacacggcggcgccggaacggacgagagagaggaagggggggaggggtttgtagatttgggttaacgagagagagagggggtccgtcttttttttttgccgaatccttttttctgttttttttttgcttccggttttattttctttttatttcgttgttttattttggtccgtctttttttttggtgtttttatccggtttctttttatttcgttgttttattttggtccgtctttttttttgccggtttgttttttctttgctgtttttatccggtttctttttttccgttgttttttttgcccgattcgattttttttgctaggttcctttttcgcttttttcatccggtcttttatctcatccgatctgttgtacgttgccgtcgtcggaccaaaccctatagtggccgccacttcgatccgtctccatatgcgttttctcctccaattgatcgtttccccatgcgttttctccttcaattaattgcgaaaatcgattctccacctctctcatcatttttctcacatttcccctctcaattcggcttacagttcgccaattatgcccgaccggcctttttatcccattttgtgaattctttccgatttcgggaaaacagaaagaggagatcgagtggatcaaaattcaaaagaaaaggaaggaaataatgggttgtaggcccaaaaaaggaataattttcatttactttttcaattataatgaatagcgatcctaatgtttcttcattgctagcggttgtactactcaaaaaacgtttttgccccgatgcaatgcacgagtatttttttctagtatatctatatatctatatatctgtatacctatatgcctaataaaaaaatacgcaaggtttccggttttttttccgtctcttttttnnnnnnnnnnnnnnnnnnnnnnnnnnnnnnnnnnnnnnnnnnnnnnnnnnnnnnn

SEQ ID NO: 20373 - DNA, 1619 bp, Oryza sativa
  unsure (1)..(1619): unsure at all n locations
ccttgttatattcctctttccatttggttttaattcgttggatttaatcccgaccgattgattttgaaaaaaaccttgttatattcctcatgatttcctctttccatttggttttaattcattggatttaataccgaccggttgattttgaaaaaaacagaaaaaggagatcgagtagatcaaaagccctcaaccaatttcggggagatcgagaaagattcagctggatttgctcctcggcgtcatgcgtggcatcttctagaggttgaagatgcagtcggttatgcaagctagatttgtttatgggccggaccaaggagagacaaaccgagcgaagggatgtatcgaactgggatagggctgaaaaataaggaagtttttctcaggcttccttttttttatccggttttcttcattgccgttttttctgctctcaatccgatccgatcgccttttcttattgctctcagtccgatccgctccacacgggcaaagcctctccagccgccgccacgatgttgattcgtctgtacgtttcctctttcaattgattgcgaaaatctattttctaaccttgttatattcctcatgatttcctctttccattcatttttaattcgttgtattcaatcccgaccggttgattttgaaaaaaatagaaaaaggagatcgaatagatcaaaagccctcaaccaattttaggagatcgagaaagattcagctggatttgatgccgaggatcggctccggcatcattgtaggatcgaggattcagctggatttgatgccgaggatcggctccagcatcattgtaggatcaaggaggccgactagaggggggtgaataggcggttttaaaacttaatggcacttcaacaaaactaacctaagttgctaggcaaggtgaggtacaaggttaactaagcaactaagttaagttttgcaaacctaagtgatatgggctcaaatatgtctctatgaatgtaaatttgctcaaatgtaaatgcaacaaataaatgagacaagagacaaggaatttttcaccgaggttcagaaactcgccggtttcctaatccccgttgaggcgagtccaactccaccgctcaaccatgaagccaccgcacgcccccttcatcaaggggtgggcaaggtgggagccagcccacggagaggactacccaagcctcgatcactagggtagttattccttcacttcgaaggtggtgaactccaaatcactcacaaacggcgtcgggcctcctccacaatctcctcggagagatcaccgggaaacacctccacaagccatctaggaggtggcaacctccaagagtaacaagtctaggatgcttgccgaggatgatcaagtaccacactagctataacaatgaagcaatgcacttggattggcttaactcactctctaacacctcactagataaactaagtgcccaagggtgtgagaacactttcaagggttcaagataatgcaatggagtgccaaaaccttacccttgctgctagagagtgggtatatatacccccaaccaccaaaactagccattgggattgaaatccccaannnnnnnnnnnnnnnnnnnnnnnnnnnnnnnnnnnnn

SEQ ID NO: 20374 - DNA, 3695 bp, Oryza sativa
  unsure (1)..(3695): unsure at all n locations
agagagggggtatatatacccccaaccccaaaactagccattgggattgaaaaccccaactctttgctctgccggtcagaccactatagtgtggctggtcagatcggactactttgtaacggctaggcaatcattgagcccactcaacctggccggtctgaccgcagtgtagtggccggtcagaccgtccacggctcgaccagaccaccaggggctcggtctgactggttgcagctctagcggctttggatcgccaagacgagacctccttcaaaattaggatgagcggtcagaccgccatgggatgggaggtcagaccggacaacatacttctgtcagaccgcaggtcacttttcagctcaaccggctgttagtaaaacggcgatatctcttgactcgggtctcggaatttgacgttcttagactctatggaaatcttattcaaagggctatccaacccatgaacaattcatccaagaaacacaacttaattcagggagaaatggctcatctccaaaggatatccaccggacatacccacaagatgtcactcactcctattggacatacccacttctctctttgtttgggacatgagaaaactcatcatacttagctagacaagaccaccaaatgcacctacatgcatatgaactaatatggcacaagatcatcgacgtgctcgcttcatagacccctcttgataatacggcgcctatctagcaaatccggtctacaccaaacaccaagaccggggaaagactacgaaaacattcttatttcaattatacctttatcttgtgccatccaacttggggtcaatgcttgagccaagatcaacactcatgaccattcgcttgaaccatgtttatgccgaggtcttgaccatcctttgttaaggctttcttctcatcacaatcttgacttcattcttgtcgacatggcgatgtccttggcttggtgaccatcaacccatggtgtcatccattagcctcatcacaattagacctattcctttgcacatctcaaaggggaacattagtaccaacaaatcggttgtcatcctccacttggtgactaaccggttgcatatgaaagatatggatatgtttgttgagtattcattaacatcgcaaagtgtcatatactcgtatgcaagctcaaatgcaaagatccaatataaataataggtgaacaacgtggatctaaaacatgcacaataaatgtataggatttgctccccctaaatatatgcatacaaataaatatacaagagagacaagtgtatgcataagttatgaagaactaatagggtttatcctatacacatggagaaggcatgtagcaatgataaagataaacaaaaaacacataccttcatgatctccatgttctcaatgtaaaggagactaaataagataagactcaagtaaacattagtctcacacttatataacaataacatggaaatcatatatatgaacctatcaaaaaggatgagataagaagtgatacatatcgctttatctccacgaatttcatccttgtcatgattaaggtccatcaccaaagaatgcatatctaccacatcttattatcgggaaataaccttgttgaaaacttatgtaaaagagagattaatcccataaatatcggtttatcatctatcaccaaagcaacaattacacaaattatttaattcaagatctttcaatcttttctctcttttgtgatagataataatccgatataaacaatatggagagatgagatgaaagatgatttcaaatcaagatagaaatcttaaataaacaaaatatagagtaacctccccctcaagatgtgcatacatatggatataaaggaacacatatgcacataatcaatcaagatcaatgagggagctcacactatattttggatccacaggagagacaaagttagaatatgtgaagtttaatacatacctctcatcatttttactttcatatccaaatgagattagtcaaacaaaagctcataaaaatgttagtatcatattgtcggtgacatggggccgggggtatcgtgactagaggcttgggtagccgcggtcacccacgtggcctgaccccctcgggggggtcgggcccgagggtgacgtggccacccctccctctgtctccccgaggggtcgggccgctcccgtttcggccccgagggctggggcgccccgaccccctgtggttttggcgccacgtgtgtgggttaggtgagcacagcgggctcacctaaccgcatttatagcaggttggacgagcgcgccacgccgcatttaatgcggcacagcgcacgcttatccggtccgtgaccggtcgcggtgtgtgaccggtcacagaccggtcagatcgcgggttaggtggcaacaggcggcctgtcacacgcctcgcctcgtcccatcggaatgatgagagcttcctggctctcgtccctagccggagccggcgtgctaactcctggagttggtatgtcagtcccggtcagatccattccaagcttcaacgcaagtatggcaaggaagtcactggccattaaatgaaagttgaagtgggcgtccccgggaaaagcgggcgagcggggcaggaggcgtgtgctctgcttgtcagatgtcacttccggctgtagactagccctcattgtaaaaagcatgtatccctccttaggcagcaggaggccaatgtggtgaccccggaccagataaaaaggaggcccaggtctagagaaaggggggggggaaagaagagttgggacgctagcgattgggttctagagcctgaactctctctcgctctcgggcgctctgtattccttcactcacagatccatcagaacacaggagtagggtgttacgcttctcagcggcccgaacctgtctacgtcgcccgtgtcttgtgcatttcctctctcgctgacgttcctcagatcgagggcgaagaacctcacttagcgcccccggccgaaccggcaaaggggggcctgcgcggtctcccggtgaggagccccacgctccgtcacatataattagatttgtcattaatcaccaaaaccaaattaaggcacttgaacttacaatcatgcgtggcatcttccggaggttgaagatgcagtcggttatgcgagctagatatgtttatgtgctggaccaaggagagataagccgagcggccaaaaaaaccaacgaaggactttcattaacttcttcgattataatgtatagtgatcccaatgttttaatttattgctcggtttctaatagttgttgtatcactgaaaaaacacctttacccattgcaacgcacgggcatttttacgcaaggcatccgaatttattttcatccgtctaaatttttttccactatttcttttttattttcttttttcgccctttttctctttttttcgccttttttttctcgggtttattcttgtccgctttctttccatgggctggcacagctgctgggcctgagcggacacgggattagcggcccaagaggtaggagaggaagtgtggcggctgctgggcccgagcgaacagatggatgacggctcaagagagaggagaggaagcgggacggctcgggggtgaagaaggaagannnnnnnnnnnnnnnnnnnnnnnnnnnnnnnnnnnnnnnnnnnnnnnnnnnnnnnnn

SEQ ID NO: 20375 - DNA, 9308 bp, Oryza sativa
  unsure (1)..(9308): unsure at all n locations
nnnnnnnnnnnnnnnnnnnnnnnnnnnnnnnnnnnnnnnnnnnnnnnnnnnnnnnnntttatctattgtcgtcatttttccttttttacgttgaggtattttttttatcggtgtcagtcttctcattatgcgcgagaaatccccttccggacgcgcgagtcccccccccggccccctctcttggcactctcttcgattgtcctctttttatttaaaaaaaaataaataaacaatctaaattcataatcacaaaaagataaaagatctaatctgactatatatatatacataggtttccggtagtatttttagttcgcttccgcttgcgttaaaatattttccatgtgcgtcgaaaaaaaattatgtatatcgttgctcagaaatccatgcacatgttatcgcatgggtcatttggggatgactagggatcggtcgcccgatccaaatctttaaaaatcggcatgacgtcaacgccgatttacgtgtaaaacaaattcaaactgatttttctcttaaattatttatccaaatcatgatccgattgcaccattaaattcgttgcaattaaatcttctaaataagaccacacatggatatattctgatgaaatattttttagcttattattgattttttttaatgttgcacgatgttccaccaggtatatcggaattgtttcaataagtagatcgaaaatgtttcactcgtttaaatcgggtgttgtttcaccttatataaaaacaatgtttcagcaaatagcgaaagaatgttttagttcactgcaacatttgatccatacatagtgaaacattgtgagtatactaaacgaaacattttttaatggaacaaaaaaataaaacgaattcccttaataaagggtttccaaaatatgtgggttttttgttgcaatagagtatctcagatcactgtaactttagatctataaatagtgaaacatcatgagtacactaggtgaaacatttttggttgaacaaaaaataaaacgaattcccttaatagcgggtttccaaaatacgtgggtttttatgttgtaacagcgcgttccataatatcaaaatccaatgcaacatttgatccgtacatagtaaaacattatgagtagactagctgaaacattgtaaaactactggttgaaacatcaaaagagaccatatgcaacattaaaaaaaatcaataaaaaactaaaatattttttttatcaaaatataatcatgtgtggtcttgttgtaaagatttaattgtaacgaatttagtgatgcaatcagatcgtacattagctaaatagtttatgagaaaaaatcttttgaagaaatgagagatgaaagcacgtagggaaagattctttgcatgcaaatggcagaccatgcagcgtctgatttttcttccctcccatcggacgcccgacaactagcattctccgggtcattaccgcagaaagattgagaaattaacccaatcctaccctattgtactattgtactgcttccttgccagcttgaactgaatcgaaactataattccacgagcgtaatttctactccctccgtcccaaaaagactcaattcctaagtttccgtatccaacgtttaattatccgttttatatgaaatttttttataattagtatttttatcgttgttaaatgataaaacatgaataatactttatacgtgatttatctttttaattttttttataatttttttaaataagatgaacggttaaaggtcgtaactatcgatctgagacacgtccccatgatcgtccatccgtgcgctcgtgcgtacgagattggaagtgcttttgtttttttattatctataccttttttttataagaattacacagtacaacgcagacattgacaacatacgtgcactcacccctataaatgcacgcacgcaaaccgtacccctagcatcttcgaagactgggccggcaagtccttgagagacaacgcacgcacactcacccctatgaacgcacgcacgcaaacactacccctagcatcttcgaaaagactgggccggcaaatccttgagagtttgacgaagtcatcataggcacctcgctatcgaggggtacgtcgcccaccactgaaagcacaacgccgttaaatcctggaaaattcgctcccattgggagtcgaacccaggacctcaagtgctaataaggctcttgtaaccactaggctacatgccatttcgcttttattatctatatctaataaaaaatacctaagactttcggtttaatttcggtaaatctgtttttttttgttttttttccgattagtttttctcttacgtggaagttttttttttgggctttcggtttttttttctgactgaaaaaatacccgtgcgttgcaacgggtaaaaatatttttggatcgttatatattttactctttggttttggaccaaaagctcatttcattccttgtcaagtggagttgtatgtcctgctcgcatagctgactgtcctcttcaatcttcaaagacaatgttgtgtccgtacatgccaaaaccgatacccgtcaaatccggtccaatcttttacgatctttcaaaattggttgagggtttttgatacacttttttttataacaggcattcataatacccggcttttaaacaaagccaaagataacagaggtcttacacaacagaacgagaaaaaaaatccgacttaaaagaacaagttaacactggagcataggatcactgcagaggcccatcaatcagataaaaaacacacccacgaaacaccctaaaacaagacacctaacatgctaaaccaaaacccaaccccttagccaagatccagatcatccggcaacctccctagcgggcgtagttgtttttgatacacttgatctcctctatccgtttttattaaaatcgaagtgataaaactcgggataaaaacggtgattttttaaatagagattaaattcagtggattagagcagagttaaaagggaaaatcgtagaaaaaatgatgaggggtagcggggaattgatttttggcaatcaattggaggagggaacgcatgggaaggcagatcgacctagtgtttagccgggcgataaaaaaacatggtacataaaaaaacaaatccttaccgcgtgcgagaaaatacaactaaaaaacagcagcaaacatatgaaaaaacccggtaaaaagacctaaaaaaagtaaaaaacagcatagggtaaaaagcgaaaaaaaggtgaagagaaaaaaccagatggaaaaaaaagcgaaaaaaaaacaaacggaaaaaactgtgaaaaaaaagaaaaagagtgaaaaggacggaaagaaagaaaaaaaatatacggataaaaaaagaaaaaggaatcggacagaaagaaggaaaagaaacgggcggagaaaaaaaaaggaaaacggactggaaaaaaggaaaaaagggtgaaaaataaaaaaagacggacgaaattttttacggaaatagatccaatccccagcatcgtcacgacatagatatgcctcgccgtgtatttctactctaattgattgaaaaaagcaattccctgttcatccttcatttattgctcagcttctaatgctattcccaatccaataactaggatggtgtctatagcattaaataagctgccaactaaaatgaaaaatgatgtggtaagtgaataaatgaggaaagagaagaaaccatatcttgcatgagacatagtttctacacaatatcgaagacatcacatgagataagtagtattaaatttaagtattgagtagtggtgtatgcattggaagagtagcatctttagtactattttctcgatgacgtgaagtttatagaaactatgtctagtgtcttgggctgggaatggcctaatagctgttttatcaatgagaaaatatttttacccgttgcaacgtacgtgtattttttctagtttcataaaaagtacagaaactacataaaactaaggcaataattataaaactgcatatttagtggaaactaaaaaaactatatatttaattaaagcatattgtagagtttaaatctctatcaatattattattagggagaattggtcattcgactctattctgaagtctaattaacaatctgaccctacgtttttgtttccccaaaaaaaaaaaaattttttttgcccttaatttagaatccttgttttttcaaaattggagttgccattagacccttgtttctattataccattctggtttcatttaacaaaagaaaaaaaatgtgttctaatagaccaaaatacccctgattacacacattaaccctatccccaaatttatcacttcccattccttttcctctccctctcccctctctccctctctctccagaggagctctcctcgccgtgcagaagcaggcacgcgacggaggaacagtggcggcggggcccgggtggcggaccttggactgcggtggtgttgatgtaaaaaacacgaggccggagagatctgcttaactctagtgcaggtccaaaaatcttgccttttaggttcgtgagcgtgccaattgatttgatcctgcaatcaacaagaaataaagacaaagaaatcgtggttaaatccataaatgatagccgatcggctagttgacgatgacatattatttatctctgagccgatgtcatatgtgaatcgatcggcaaccatgaataaataagaaaagactaaatctactcgatcggctgtagatattaacaatatataatccttatgtcgatataaacttaaatcaagtaattgggatagatcggtcgtcataccgagacagtataaatcacttagatcgaagtatatactaacaatgagattatagatgttcatagcatagccgatccaatagatctagcatgtatcggctaataatccgatatcactctatactaagatattaaaacaagtaaaatatatcaaacaaaagcctaatatactttattgtaataagatcttaatataaagggaagatctagcatatctgaaagtgtaaattaggcctagaggggggagggtgaataggctaattcaaaaattcaattaaaagcggaagcactaattttcggatatttctgaaatttttggatatatccgaaaattttcggagtcagcacaaacagcaaagtaaatcctagatctagttgcctacaacaagaatatgctagcacaaacagcaactagacctgtagcggctcaaacaagcaaagctagtggagagggaggaagtaaagtcaccaaagatgaagctcacgaggttgttcccgaagttcgaatccttgaggggattctactctccgttgaggagctcactaagagtcgggtcttagctaaccctttcctcaagaggttgcactaagcactcctccttccactaagggtatctcttcccttttggaggtgagatccgaccttcacaaacttctcccggccaaccataagtagatcggtggctcgggagcgacacctagccgcctaggagtcctcaacctccaagagtaacaaatgaagcaaagaactcccggagatgatgaaagtgctcacaaatcttcacgaagtcaacaacaagcactcccacaaactcgaatccacaactctcacacacacaccaaatccaaatcgaacacgggtgagagggaaaacaagaaaacaaggctcaaaagtgctagagaaagagcaagccaagggcacaaatgattggaatggaaccagcagccctcacaagtgaggggagggggctatttatagccacagcccagattctgtccgttatgcacaataattcagattttcggatattccgaaagattttcggacatgtccgaaaattccagctcagcaccaacaacaaagttaacgaaggatttttcggacattccgaaaacttttcggacaagtccgaaaatttctagtaccaacaacatcgttctggatgttctcggaaaagtccaaaaataactttcggacaagtccaaaaatatacagaagcgaaattgactctactgatgattttcggaaaatccaaaaatcagattcggacaagtccgaaaatatacaaaaccacttttgctttcgcagtctttttcggaaagtccgaaaatcactttcggacatatccgaaaatttccagaagcgaaaatctggttctgtgtgttttcggaaagtccgaaaatgagtttcggaaaactccgaaaaaatccagaacacaccaaactgaggagaaacactttttaaaaatagattttgagcactttgatcactcctcgtatgtcaatgcatcatccctcttaatagtgcggctttcctattaactcaaggaaacgaaaacgtacaaaataccatttgctcatttgccgcattacatcacatcaacgtattcggcgggatatgtattacgctaactcattgaggacaaaacaaccttcacatttgcttaaataaaaatgttagtcctctctaatcgcattgtaattaatcaccaaaatcattaggggcctagatgcactttcaatatcaatcaaatacatgaaatataaagctaaatcaggtaagatcggttgaaaccccgatactaccctaatcggcaaccaaaagcaggctagagattgagattctaagacaacttataagatcaaactcaactgatgcagctataagtatgaaaagaaggacaatatctagacaatcaagccgttggatatttcatagagcggtagatatcctatataatctaagtcaacaatagtatttaacctgatcggctgccttttagcaacagatgttagccgatttgagggttagataacaatattgcctgagattatatagaatatctgataactcaacgaactacataaacaagattagagtatcataaagatggaagcactaatcccgaaaacgcaagccgccataacaagttttacctctagttgaagatcgaaaccgatgcagctcaatccgaaagcaagaactcgtcgaaacaaaaccaaagtaaaagggtggcgatgcgtcgagattgtattgaacgtgtgttgttgtattacatggggctcggggtctatttatacctgagattacaaaatatgtccgtgtcggacacgactcttatttctaacaaacttttaagataccataagtctttgcggcagacttttgcccaaacatatctttaaggaaattacatgaaatatcataattaatagatacaattgccttctcaggactctatccgtgcatggcaatccatatgaagcacattaactcaacccgacaacatgcattacgtcatattgtcggtatcggctcaatcggccaacctagtccgactcgaactctgctgatcctgatcatagccgattcggactttagccgattctcgctatgtttccgtaacgatctccatcttgaattccgcttcgattctatcttcatctccgatacttggattaccaaatttggttgttaacaggcgggcgaatcaaacgaggaggggcggcagaggcccgacaataacaaggacaaccaggggtggcaaggcccaggcagcgaacctctggctacggtggtggatccggcagggcttaggcattttgggcctacgggaattccgaacaattttttgggttttccaaggtgtgccggttgcggatccggtggcaacggaacaacaacagtggcacggcggtagcagctcaggctgtaattttgccccggcggccccgaggtgtatagccggggnatntgnnnnnnnnnnntnnnnnnnnnnnngcccanggcaccaaatttgcnttggcagtggatgtaaaggtgactggccatgcgggctgcaaatccggcggtcctgaggtgtaccggtggcggttcantgatgggggcacaccattgccggaaatcaccggtctgcgacaatgcatgacttggcgaggatgatggagtctaaaattttattgaagtttattcatatttttatcaaatctatgttaaatttgtcaaacatctatcaaattgaagtccattttgtcaaactgaagtcaaatttgaaaaatttaatataacaaatataggtcaaatttgaccaaagtctgagtcaaacttgtcacaaatcggtgaaacttacactaagtgcacaaatcattctcattattgccaccatacaaaactatgctaaactaactaaatgctttggtaaaatagggtcaaaagagcaagggcagaagagaaattttatgctccttttaagaccgttacatgcctttgatagaatagggtcctaccgtatcttcagttttgaaatgaagggtcaaatgagcaaacttgatataagatggttaaattggtagttagctttcaaaagagggtcagatatgtaattgccccttattattatgttggaactattaggcgttgtagttttgtacttaaattgatgcaaaacttgtagttattaaatttgctaatcaatctttatttttgggatattatattttaaatctctagttctatgaaaatttccatgctaaatttgtagttttgtaatacaagattataaatatgaagttttacgataatttggttgtagttttctgaaatttacttgaaaatatatcattactatttacctatttaaattagtgtacagtatggtatgaatccaattttcatattattgtagtggtaccatttcagttatacgaataatggtagtattctttaaaactgtcaaatttataatgatatgatctaactaaccctttaaggtatatcattttagttcatatattttttttaacagggtaactataatttatagctactccctccgggctgataatacatgtcgttttggacaaggctgaagtcaaactttagaatctttgattatgaatcatttttaaaatatttgtctttcaaatatggtgactacatgtatagattagtcttaaaagtactttaataagatcatatatttgctaacaattttatacatattataatgaaacataatggtcaaaattgttttttttggagaccgtgtccttatccaaaacgacaagtattatcaaccggaaggagtataagcgatgtcactttttatattataccagtaaatattttcttttagcccctgtcctttttcttcctcttccttctcttttttcctctatgaccaaattgcaatgtattctaccaatcannnnnnnnnnnnnnnnnnnnnnnnnnnnnnnnnnnnnnnnnnnnnnnnnnnnnnn
